United States Patent 7,625,699 (GENETIC POLYMORPHISMS ASSOCIATED WITH CORONARY STENOSIS, METHODS OF DETECTION AND USES THEREOF) - sequence listing, part 15

SEQ ID NO: 45247 - DNA, 201 bp, Homo sapiens
atactgtatatgtcttcataggaagtatgtggtttctctttaaagttatccctcagaaaagaaggagctgctttatatttgagtctttacaatgtctctcrtaaggccttctcttaattttttatttataattatctaaaaactatttttaaagagatagtacatgcacagggtaaaaaatgcaaaacgcataaaaaggca

SEQ ID NO: 45248 - DNA, 201 bp, Homo sapiens
atgctttttaacttgatgtgattccgtttgttgatttttgctttggttacctgtgcttgtggggtactgctcaataaatttttgtccagaccaatgtcctrgagagtttccctgatgttttcctataatggttttatagtttgaggtcttagatttaagcctttcatccattttgatttgatttttgtgtatggtaagaga

SEQ ID NO: 45249 - DNA, 201 bp, Homo sapiens
gcatttgacaagatgtattacatagtctagagatttaaattagggagacattaaaacataatggaatccaatcaattttagtaataagaacaactttacttgtgtcatttaacatatattccaggtggctgaccaatttagtgtctattgctctaatagacacacaaggtacctgtaaaatgtagtattacagagaaagag

SEQ ID NO: 45250 - DNA, 201 bp, Homo sapiens
tcccttggctaggggagggaaatcccctgaccccttgcacttccctggtagggtgatgacccaccttgcttcggctcaccctccatgggctgcacccactrtccaaccagtctcaatgagatgaactgggtacctcatttggaaatgcagaaaaatcaccccccttctgcatcgatctcgctgatagctgcagactggagc

SEQ ID NO: 45251 - DNA, 201 bp, Homo sapiens
tcctttcacataaaacaacttttaacctaattccactgatctgattttgtttttggaaattttactaacttccatgccagcaaaggtgccagagaacttawaagcaattcatcttaaagaatgcaagagccagactctgacatttaaagccgctgtgtagtatgtgatttctccacctgctgctccttagatcagatggag

SEQ ID NO: 45252 - DNA, 201 bp, Homo sapiens
aatgcaaaacgcataaaaaggcatatagttaaaaagtaagtctgcctaccgtctcacttcccaccttcagagaccgtcactatcacacacacttcaatttytgtgggtacacagtaggtgtatatatttatgagatacatgaaatactgtgatacaagcatacaaatgtgcaataatcacatcatgtaaaatggggtatcc

SEQ ID NO: 45253 - DNA, 201 bp, Homo sapiens
agcatttgacaagatgtattacatagtctagagatttaaattagggagacattaaaacataatggaatccaatcaattttagtaataagaacaactttacttgtgtcatttaacatatattccaggtggctgaccaatttagtgtctattgctctaatagacacacaaggtacctgtaaaatgtagtattacagagaaaga

SEQ ID NO: 45254 - DNA, 201 bp, Homo sapiens
acagtcattcaaatatagagataaaacgattgcaattgacttgagtttcagtgtgttacaaagttggccagattagatctacatctacatgtctagttcawagttcaatttcaaattatagatttttctcaaagtcttcttttatcatctgctttgtttaatctgccctaacttattctacatcctttcacataaaacaac

SEQ ID NO: 45255 - DNA, 201 bp, Homo sapiens
cctcagcctcccaagtagctgggattacaggcatgcgccaccatggtcagctaattttatatttttagtagagatggagtttctccacgttggtcaggatrgcctcgaactcctgacctcaggtgatctgcctgcctcagcctcccaaagtgctgggattacaggcgtgagccactgcacccggcctgttttttaatttaa

SEQ ID NO: 45256 - DNA, 201 bp, Homo sapiens
aatctcacctagcacctccctctacaggttccagtatatactgtatatgtcttcataggaagtatgtggtttctctttaaagttatccctcagaaaagaargagctgctttatatttgagtctttacaatgtctctcataaggccttctcttaattttttatttataattatctaaaaactatttttaaagagatagtaca

SEQ ID NO: 45257 - DNA, 201 bp, Homo sapiens
gagcatttgacaagatgtattacatagtctagagatttaaattagggagacattaaaacataatggaatccaatcaattttagtaataagaacaactttacttgtgtcatttaacatatattccaggtggctgaccaatttagtgtctattgctctaatagacacacaaggtacctgtaaaatgtagtattacagagaaag

SEQ ID NO: 45258 - DNA, 201 bp, Homo sapiens
aaactcattctccatccagtttttttcccttcctggcacggagttgtgatcctttgaaggagaagaggcattctggtttttggaattttcagcctttttgygctgttttctccccatcttcatgggtttatctacctttggtctttgatgctggtgaccttcagatgaggtctctgagtggatgtcctttttgttgatgtt

SEQ ID NO: 45259 - DNA, 201 bp, Homo sapiens
taacccaaaccagaactgcgagcctgaattgctctctgaacctgggaaaaccctatttttttcgttggttgtaaattaactccaaataagcaaacttctgyaccaaagtcatctaactcaatatatttctgcatacgtatcatagctgatgctggtgcacgtataatctcacctagcacctccctctacaggttccagtat

SEQ ID NO: 45260 - DNA, 201 bp, Homo sapiens
ggagcatttgacaagatgtattacatagtctagagatttaaattagggagacattaaaacataatggaatccaatcaattttagtaataagaacaactttacttgtgtcatttaacatatattccaggtggctgaccaatttagtgtctattgctctaatagacacacaaggtacctgtaaaatgtagtattacagagaaa

SEQ ID NO: 45261 - DNA, 201 bp, Homo sapiens
atgggtggctgcaccggcttcttctggtgttgtgcaagttgcactaataagtgaaatcagcagcagacaatttgtctgcacaacactaatagtactttgartactggagatagtctaaattagtgacaggcacacatgacagtcattcaaatatagagataaaacgattgcaattgacttgagtttcagtgtgttacaaag

SEQ ID NO: 45262 - DNA, 201 bp, Homo sapiens
caggcatctaagagaggatccagaaagacaaacctactaaggagacctggagggactaatcagaggggtgcagggagagctggagagagcagtgtcacacrccaaggcagcagagttacaagaagaaatagtaagtggtcaactgcgtcccaggaagtgaggaataaaacctgtctactggactgggaatcaggaaggcat

SEQ ID NO: 45263 - DNA, 201 bp, Homo sapiens
gccaggtaaacatgggtggctgcaccggcttcttctggtgttgtgcaagttgcactaataagtgaaatcagcagcagacaatttgtctgcacaacactaayagtactttgagtactggagatagtctaaattagtgacaggcacacatgacagtcattcaaatatagagataaaacgattgcaattgacttgagtttcagt

SEQ ID NO: 45264 - DNA, 201 bp, Homo sapiens
tagatgatgagttcagttttaggcatatggagtctgaagtgcctgtggacatccaaaaggaagagaccacagctggggagatttcatctgagagacaactrcttagagaagtagttcaaatgaagacaacctgcagcccacagggtgctgggccaagaacagaacctgcaaagcacaggcatctaagagaggatccagaaa

SEQ ID NO: 45265 - DNA, 201 bp, Homo sapiens
ttctgtatgaaacgcctgtcatgtgccaggaacctgcttgccactagaggtataaagatgaataatgcagggtctttgctcttaagaaacttgtagtttaktgctggagacagacatattaatagtttctaaataatatagtaagtgaatagagagctgtagactctaagtaatgtgggagcccagaggaagggcccttca

SEQ ID NO: 45266 - DNA, 201 bp, Homo sapiens
agaacacacccctgtcattaaactaggcataactgtaagtagatattcatcattccttttagtatctacatagtactccattgtggagacgcactacattwttcaactggccctccactgatgaacatttatattgtttccagtcttttgctattacaaataatatttcaatttgtagtcttgtgcagatgtatgtttgtt

SEQ ID NO: 45267 - DNA, 201 bp, Homo sapiens
cacttccctggtagggtgatgacccaccttgcttcggctcaccctccatgggctgcacccactgtccaaccagtctcaatgagatgaactgggtacctcakttggaaatgcagaaaaatcaccccccttctgcatcgatctcgctgatagctgcagactggagctgctcctgttcggccatcttgccagcaaatcccatgg

SEQ ID NO: 45268 - DNA, 201 bp, Homo sapiens
ccccatctctactaaaaataaaaaattagctgggtgtcatggcgggcacctgtaatctcagctgcttgggaggcttaggcatgagaatcacttgaacctgrgaggcagaggttgcagtgagccgagattgtgcagctgcactccagcctgggcaacagagtgagaccctatatcaaaaaaaaaaaaagaatcatactttcc

SEQ ID NO: 45269 - DNA, 201 bp, Homo sapiens
tgtgcatttgttcgatgaatgaatgtgtgatcgctttcttctctctccctccctttgtctccccagccgcctgtgttgggctcatccctttctgaagtccrtagatatgtttaagttccggggaccatctacagttggagatcgtcttgtcttcactgccattgtcaacaatacatttcagacctggtaaagtgagccctt

SEQ ID NO: 45270 - DNA, 201 bp, Homo sapiens
gttctcctggataatatcctgaagagtgttttccgacttggttccattctccccatcactttcaagtataccaaaccaacgtagatttagtcttttcacawagtactatatttcttggaggctttgtttgtttattttcattcttttctctcttatcttgtttctcactttatttcattaagttgatcttcaatctctgat

SEQ ID NO: 45271 - DNA, 201 bp, Homo sapiens
agtccaagcagaaaacccattccccaaagtcactgccatccctagagcagggttcaggggcagagaaggacaggagaccctccagtcaagaagttggcggccaaaagctgagaaaacccatcctggaatttttgcttaggggctctgagtttaaactttgaaccacatccttataaatttgtatttgaatttggaaacact

SEQ ID NO: 45272 - DNA, 201 bp, Homo sapiens
cagtccaagcagaaaacccattccccaaagtcactgccatccctagagcagggttcaggggcagagaaggacaggagaccctccagtcaagaagttggcggccaaaagctgagaaaacccatcctggaatttttgcttaggggctctgagtttaaactttgaaccacatccttataaatttgtatttgaatttggaaacac

SEQ ID NO: 45273 - DNA, 201 bp, Homo sapiens
acagtccaagcagaaaacccattccccaaagtcactgccatccctagagcagggttcaggggcagagaaggacaggagaccctccagtcaagaagttggcggccaaaagctgagaaaacccatcctggaatttttgcttaggggctctgagtttaaactttgaaccacatccttataaatttgtatttgaatttggaaaca

SEQ ID NO: 45274 - DNA, 201 bp, Homo sapiens
ctattacagtgttttgcatgccatcaggtttaaagagacatacatcatttggatcataattttatctattttcagaggttttttaggagaccctcggaagytcatgcccacaataactagactgtaagctccctgagggccgatctgctcaccactacacccagaccataggagcgcctggcacttcagagatgctcacta

SEQ ID NO: 45275 - DNA, 201 bp, Homo sapiens
ccaccacactcaaataattttttaaaaaatttttataaagatagggttttgcaagattttgcccaggttagtcctgaactcctggcctcaagtgatcctcycacctcagactcccaaggtgttaggattgcaggcatgagccactgtgcctaccctcaaagagctcttctaaaggcagacttgagcaataatgctggcttt

SEQ ID NO: 45276 - DNA, 201 bp, Homo sapiens
ggcccccactctcttctggcttgcagggtttctgcagagagatccgctgttagtctgatgggcttccctttgtgggtaacctgacctttctctctggctgyccttaacattttttccttcatttcaaccttggtgaatctgacaattatgtgtcttagggttgctcttctcaagaagtacctttgtggtattctctgtgtt

SEQ ID NO: 45277 - DNA, 201 bp, Homo sapiens
gtaaaggattttatttctgcttcgcttatgaagcttagtttgcctggatatgaaattccgggttgaaaattcttttctttaagaatgttgaatattggccsccactctcttctggcttgcagggtttctgcagagagatccgctgttagtctgatgggcttccctttgtgggtaacctgacctttctctctggctgtcctt

SEQ ID NO: 45278 - DNA, 201 bp, Homo sapiens
gtagatgatgagttcagttttaggcatatggagtctgaagtgcctgtggacatccaaaaggaagagaccacagctggggagatttcatctgagagacaacygcttagagaagtagttcaaatgaagacaacctgcagcccacagggtgctgggccaagaacagaacctgcaaagcacaggcatctaagagaggatccagaa

SEQ ID NO: 45279 - DNA, 201 bp, Homo sapiens
tgtctgcttggagcagctggttagcagttgtgccatgaactgagatcatggatctgaggggcagggaacggcaatttttgggaggtagatgatgagttcasttttaggcatatggagtctgaagtgcctgtggacatccaaaaggaagagaccacagctggggagatttcatctgagagacaactgcttagagaagtagtt

SEQ ID NO: 45280 - DNA, 201 bp, Homo sapiens
ggggtgccggtggagagcacaatgagggaggggaggaagtgaagtgagcccgcccaggccccacaagctcaccactgccaagagggcagaaggttcagcamcccttggctccaaaggaaggcaccggaagaagaggaaggaaaggagaggacaagaacatgtcagaacaaggatgtcaaaagagaaggagaaagagtgcat

SEQ ID NO: 45281 - DNA, 201 bp, Homo sapiens
agccaccaacacaagagtattgctagagagaaaatgcaaggtagagggaggcgggagaggaagaaggtaggattgtgtcatggaggctccctgggccatgycgagaggcttggcctttcttctgttcttgatgggagccattgaaggattttgagcagggttggggcatgactgggtttgcacttaatatggtcactctgg

SEQ ID NO: 45282 - DNA, 201 bp, Homo sapiens
ttgtaatctgacagttacatctaaaaattgacatgatgaaggtttgattttgttttttctttgagatggagtcttgttctgtcacccaggctggagtgcaktggtgcgatcttgactcactgcaacccaggttcaagcgattgtcctgcctcagcctcccgagtagctgggactacagggcagctgccaccatgccctgat

SEQ ID NO: 45283 - DNA, 201 bp, Homo sapiens
aaagagttctactcatatcaaaatgaggcagtggccatagaaaatatcaagagaggcctggctagcctatttcagacacagttaagctctggaaccaccartgaggtacttaccaatattaataaggattcagcatctcaataaaatttgtaaggatttctacttatacaatttcagtagaagagttactactaaggtaat

SEQ ID NO: 45284 - DNA, 201 bp, Homo sapiens
aataatgattgaacactttataatatatatttgaaaatctgttttaaaaattctatgtgtgcattacttatggcttgattctagtcaattgaaatggtctwaataaatttggaattgagaaacaattgtgatcagttgattattaggcattacatatttgtgtttatgaaaattacagatagtgtgttgacatacataaaa

SEQ ID NO: 45285 - DNA, 201 bp, Homo sapiens
atttttgcttcatttgtgttctgttcccctctccccaccaggtcaaagagttctactcatatcaaaatgaggcagtggccatagaaaatatcaagagaggyctggctagcctatttcagacacagttaagctctggaaccaccaatgaggtacttaccaatattaataaggattcagcatctcaataaaatttgtaaggat

SEQ ID NO: 45286 - DNA, 201 bp, Homo sapiens
gatagatatcaaagataaaattactaatctttgtttgctgggattctttttattatttttattgtttggccacttaatggaatttagtctcctcttattcytaaaataaatataaaggaaggtgtggagaaaggcatcttcttcctaaggaaaaaacaatatgaatgatgcctacctatttcaagaggaaactggcccctc

SEQ ID NO: 45287 - DNA, 201 bp, Homo sapiens
gtccaagaacttttttatttgctattattttaaaccttagttattttttgtttcaagtacagttacaggtagagaacatgctgacatgttcaaacagaatkttcatcatttctcttccctgggccatccttgttttcatgaggctcccagcctatatcagtgctctctcccaatgctgtgcccatcatgcaagagccttca

SEQ ID NO: 45288 - DNA, 201 bp, Homo sapiens
agatatcactgtgcaccactgtaccatggaggggcttgttacaaatatagattccctatattcatcccagagattctgattcagtagatcggggaggaccygaacgtctttttttttgagatggagtctcactctgtggcccaggctggagtgcaatggcgcaatctcggctcactgcaacctctgcctcccaggttcaag

SEQ ID NO: 45289 - DNA, 201 bp, Homo sapiens
gcaatctcggctcactgcaacctctgcctcccaggttcaagcgattctcctgcctcagcctcccaagtagctgggattacaggcgtgtgccaccatgcccrgcttgtatttttagtagagacagggtttcaccatgttggccaggctggtcttgaactcctgacctcagatgatccacccgccttggcctcccaaagtgct

SEQ ID NO: 45290 - DNA, 201 bp, Homo sapiens
tttctggttttggctttgtgttgattaaattaaccacgtggctgctgagtcagacctttattttgtattgtttccgggcattgatttgctctctaaatcascatggctcttgtacacacactgaactgccacaagaaatgtgacaccttgaaagtccttctgaaatttgttgtatatttctttacttgtttgttctccagt

SEQ ID NO: 45291 - DNA, 201 bp, Homo sapiens
tatttttggaaaataagattttctagctgtcttggttaataagtaacacgtggttgtattgacgatatcattttcagaaagctgggctaaattcaaaagarctgacattgcatatcttattcatcatccaggcaatttttcttccctgtatactgttgaaataatattttgaaaatgcaaacttaaattttcaaatctttt

SEQ ID NO: 45292 - DNA, 201 bp, Homo sapiens
gaagagagagtaaacctagtctgtgttcttcctgaggaaggaaccaagtactcccctgaataacagtgtttggtcagttaaaatggtttagatttatgtgytgagaagggaggccaaattagttggtctctggggacttttccaattgtaatatatggtgattcccttatttgcttctcaagaacctaaagataatagatt

SEQ ID NO: 45293 - DNA, 201 bp, Homo sapiens
cttattcatcatccaggcaatttttcttccctgtatactgttgaaataatattttgaaaatgcaaacttaaattttcaaatcttttaatataattgttgcyccagaaagacttcataatgagctttcagttacctctggagatatcacagtttgaaagacatggctatatacaacttgaataaattactatcttgtttgcc

SEQ ID NO: 45294 - DNA, 201 bp, Homo sapiens
aaaattaactgggcttagtggcgtgagtgtgtggtcccaactactcagaaggctgaggtgggaggatcacttgagcctggagatgaaggttgcagtgagcygagatcgcatgactgcactccagcctgggtgacagagtgagaccctgtctcaaaaaaaaaaaaaaaaaaaaagtaaagaaagaagaagaaactttctctg

SEQ ID NO: 45295 - DNA, 201 bp, Homo sapiens
tttctttgaaggttcgacagattatgtgacttcactacccaaaattctatggcagcgtcccatctcactcaaactccccaaatcttcctgccacccatagrtacctcctttaccttgtctccttcactgtgtcttttacttatttatttccagcctctttggtctccctgctcttcctccattacacctgcaggagccctc

SEQ ID NO: 45296 - DNA, 201 bp, Homo sapiens
taagtcacatctagaattcagggaggatagagggcttaatgaagttagggggaagcatatggtgtcaagaatgtggacaacggctgaaccttgaaagttcwgtcacataatagttatttgtccacaggtgacatactttactggcctcagtgttctgattattgctgcaaggactgaaaaaggataccaggatctttgcct

SEQ ID NO: 45297 - DNA, 201 bp, Homo sapiens
ccaatattaataaggattcagcatctcaataaaatttgtaaggatttctacttatacaatttcagtagaagagttactactaaggtaatgctcagaaaagrtgacttgtgtagtgaagtcgcatttgcctatgaaacaattgccatttatcccaatgttttgttaattaattacaaggtagagaggattagaaatatttat

SEQ ID NO: 45298 - DNA, 201 bp, Homo sapiens
ccagctggcaccaccctggctcttggaaaggcatgaggaaaatttggcttcctcttttttccactgaggattttttttttccaaatttgacttgggaaacwgtcattacaatgaatgtgcagctttttttttcctcatatgttgcagcaaaattgtccgtcgagttctgaaggaaatggtcgctcacaattatgaccgttt

SEQ ID NO: 45299 - DNA, 201 bp, Homo sapiens
agttatgagtggggtatgagcctgcagtgtatgttttgcagctctcggagctctggcggtccaccaggaaatacctgcagcctgacaacctttccaaggcygaggctgtcagaaacttcctggccttcattcagcacctcaggactgcgaagaaagaagagatccttcaaatactaaagatggaaaataaggaagtattgt

SEQ ID NO: 45300 - DNA, 201 bp, Homo sapiens
aaattatatagtttctgtgtcccctcagtctcttcatctataaaatgagactaataatagtgcctacctcattagatttttgtgaggattaaataagttamtacatgtaacatgcagatgatggatttttgaccaccatttcctctgggcaagtacgtgctgtcatatgtagaggagacagtgaacagattgttactgtgt

SEQ ID NO: 45301 - DNA, 201 bp, Homo sapiens
taagttccccaacctttgtgtggggttgtctgtcagaaacatttctggattgttggttttttgaagtaagaaagaccccttttaaaccaactgccccaccwccaaaacaattattttcttgtactacattttcatcgaaaagttatgccacagtgcagtaatttaatggtcacttgaccagaaatacaatagcagattttc

SEQ ID NO: 45302 - DNA, 201 bp, Homo sapiens
gttcaaaggttctattggtagcagtgacatcagagaaactgttatgatcatcactgggacacttgtcagaaagttgtgtcagaatgaaggctgcaaactcwaagtaagtgcaaatccaatctcatgtattacatcattctacaccattgtccatttgatactcaccatgctgcctactattggcactcctaattctcttta

SEQ ID NO: 45303 - DNA, 201 bp, Homo sapiens
aaaattaaaataaaatggggaggggtctttttgagaaagtcttaatcattttttcatttgttcaaattaaaaaaaaaatcacttcttgagaaaactcaaaycaatagaaactctgtgaatggtagagatttttaagtattccttcccctaaacattgatatccatgattatgcctttttttatagacctcagctggtggat

SEQ ID NO: 45304 - DNA, 201 bp, Homo sapiens
gtcaagaacatcctgctgtctattggggagcttccccaagaaatgaataaatacatgctcgccattgttcaagacatcctacgttttgaaatgcctgcaakgtataatacattgcacatgtctctctgtgtattcaagcttatttgtgtgttcatggggtaccgatgtagctaataataatgatgtggtcattatgcaggg

SEQ ID NO: 45305 - DNA, 201 bp, Homo sapiens
actaaaagccaatatagaggtccagggtggtctagctattgatatttcaggtgcaatggagtttagcttgtggtatcgtgagtctaaaacccgagtgaaawataggtaagtgtttatgcattatacatttatgaattacatataagactatatacagagaacttccgaaatatgttttgggaattaatcttctgacttttc

SEQ ID NO: 45306 - DNA, 201 bp, Homo sapiens
cagagaggagagaagagcatcttcaaaggaaaaagcccatctaaaataatgggaaaggaaaacttggaagctctgcaaagacctacgctccttcatctaayccatggaaaggtaaaggggcgtttagattccacaactttttctccaacttcatatttttcttcccttcagtagatattattttgaggtaatcacattgta

SEQ ID NO: 45307 - DNA, 201 bp, Homo sapiens
ttgaaaatgcaaacttaaattttcaaatcttttaatataattgttgctccagaaagacttcataatgagctttcagttacctctggagatatcacagtttkaaagacatggctatatacaacttgaataaattactatcttgtttgccaaaagaatggcaattagtatcttgttcactcaaaagaatgattataatatagc

SEQ ID NO: 45308 - DNA, 201 bp, Homo sapiens
agtatcttgttcactcaaaagaatgattataatatagcatttccctttggtattatgcaggcagaaattagagctgaagacaaccgaagcaggcccaagaytgatgtctggaaagcaggctgcagccataatcaaagcagttgattcaaagtacacggccattcccattgtggggcaggtcttccagagccagtgtaaagg

SEQ ID NO: 45309 - DNA, 201 bp, Homo sapiens
aactcaagggcagcctttaataagtcacatctagaattcagggaggatagagggcttaatgaagttagggggaagcatatggtgtcaagaatgtggacaamggctgaaccttgaaagttctgtcacataatagttatttgtccacaggtgacatactttactggcctcagtgttctgattattgctgcaaggactgaaaaa

SEQ ID NO: 45310 - DNA, 201 bp, Homo sapiens
agataagacaacatgtatttcctttatgccctatgtggaatttgataggtgtcataaaaagaaggcctcctgaccgaaatatttttcctgaccagaaagcyagtatttgaacccgctatagagtccccaattacaatgcagaagacatagagataagagggaatcccagtcttcatccccttcaaggtttttcctgactct

SEQ ID NO: 45311 - DNA, 201 bp, Homo sapiens
aaacacatgatcttgaaaatcccttttcttaaagcattttgtaagactagtgttaacatggaaaacactttgagaaacatcactataattaagaaaccatrgactccagagtcagaaaaacctaggtttcaatcccagcaatgccatttaccatttaccagctatatgaccttgaacaaatgactaggtatatctgcgtct

SEQ ID NO: 45312 - DNA, 201 bp, Homo sapiens
aattctaaatgcacttgaagggcaaatgaaagagattctgacttttttggctaatattactttctgttttggttttatctaacaacagttatcaaaaaatrttactatacatactctgaagagcactatcctacaaaaggaattaagtcaacaatataaatgggacatgccccaatgcccagtgttgccagatctctgcaa

SEQ ID NO: 45313 - DNA, 201 bp, Homo sapiens
agaatatataaggagattgaaataaaaatttacagatgattggattgacttgtaaagtttactttattgttttaatacattaatggataatagcctacgtktgaattttgcctccgttaccttcttgctatgtgctcttgggcagttacttaatagccttaagccacaatttcatactagtaaaatgaggcacctggaaca

SEQ ID NO: 45314 - DNA, 201 bp, Homo sapiens
tgaatgtaagagatgtaccactgagggcattgttgatacaaggggtgattgtgcgtgtgtagggttaaaaggtgtgtgggaactctctgtactttccactyaattttgctgtgaacctaaactgctctttaaaaagtctattaattaaaaaaaagagagatgggaagattctgaggtacttcattgtaaggaaacattact

SEQ ID NO: 45315 - DNA, 201 bp, Homo sapiens
tagggaatgcagaaaaacatttaaagaaatattgtgcaatctccccagtttggcacaattttcctttaagtgtatgcactattaaacaataaaaccatgamgaatcaaagaattttgccatgcctgaaatgtgtctactagtcaacttaagccacctcaaagctggacacccttgccttgctgtcattttgataccaaact

SEQ ID NO: 45316 - DNA, 201 bp, Homo sapiens
tttttcaatgggtgtctgaacaaaattgtttctgtcaatacaaatgtagaaaggacaaagagcagtgcgtcttgtatcccttaatcctcaagtcacacatkaaaaaaacagttctcaaattatatcagaattttacattgcacaattccagttttaatgaaagaatcgtctaaaggcagcataagtactgaaaaagtagtc

SEQ ID NO: 45317 - DNA, 201 bp, Homo sapiens
acaatgcctgaggatttgaatcggggtgtaaaaccatgaggagtaatctagatctgggtcagcaaacttgttctgtaaagggtagaaagtaaatattttaygctttgcaggccacatggtttctgttgcagccactcaattctgttactgtagagtgaagacagccatcagcaatacattaacaaatgagtatggctgtgt

SEQ ID NO: 45318 - DNA, 201 bp, Homo sapiens
agagtccacttctcagtgactcctagctgggcactggatgcagttgaggattgctggtcaatatgattcttcttgctgtgctttttctctgcttcatttcstcatattcagcttctgttaaaggtaagtttgtgttgccttttgctaaactttaatttccatctttggagttggaggcagatacgtgcgtgtgtgtgtgtt

SEQ ID NO: 45319 - DNA, 201 bp, Homo sapiens; identical to SEQ ID NO: 10294

SEQ ID NO: 45320 - DNA, 201 bp, Homo sapiens
atggagcaagtgagtgagaaaagaagccaaatctctctgcagccatgtatttctagttgaacgcatttagcttctccatttctttgtttgcttttatgagrccctgtgaaggagatcctgggtgtacttgctgccttcgtcttatggctctagcatttcagggacccggaaagaggagacagtggggtagagaacagacta

SEQ ID NO: 45321 - DNA, 201 bp, Homo sapiens
gactttctatatctagtagggtaatacatttccttccaacctttagtggggtgaagttcatttgtcttctaatctaagaaaatacgttaactcctgacaayctctgacactcaacagaaacacaactgtactttggaattaatcatccatctttatttcatagtctccttatttatcaatgcaaatggaagtatagcaaat

SEQ ID NO: 45322 - DNA, 201 bp, Homo sapiens
ctgaggtgggaggatcacttgagcctggagatgaaggttgcagtgagccgagatcgcatgactgcactccagcctgggtgacagagtgagaccctgtctcaaaaaaaaaaaaaaaaaaaaagtaaagaaagaagaagaaactttctctgcctttctctgcttgttaactggtgtagtcccagagccttaaaaagtacttac

SEQ ID NO: 45323 - DNA, 201 bp, Homo sapiens
gtgtagatcattgtaacatttttaatccaacaaagaaaattttccttttattgcatgaatcagttatgatatacattcagagaaatgacttaccacccagmatttccttatctgtaatctcttgtcagaagagcaaaccattggcttcatgctctgtgtgtaactatagggagatgctctttccttcagtattactggtgt

SEQ ID NO: 45324 - DNA, 201 bp, Homo sapiens
aacttcaagtacattcagtaacttggctggagaggtatagggtgacttaactgtgtgtgtaattctgttattgttgctgttgttgtacaggcaatttgagwaaaagtacgaaaggctgtccacaggcagaggttatgtctctcagaaaagaaaagaaagcgtattagcaggatgtgaattcccgctccatcaagagaactc

SEQ ID NO: 45325 - DNA, 201 bp, Homo sapiens
aattaaaacaaaacagtagaaacccagggaaagatgaattttctttaaatgagtagaagaataattgataaggccaaaaaaagtcagtttctgggataccaaaaaaaaatctaatgactagttcatttgattctggagatagttatcatattctaatccagaaacaatttatccaggaaagaaaggcctatgatttaccat

SEQ ID NO: 45326 - DNA, 201 bp, Homo sapiens
tgctgatttgctccaacctcatacagtttcacacataaggacaatcatctatgtttcatgaaagttctatctactttaacattattttgaagtgattggtkgtggtatgaattaacagtttaaatttaaatcctaaaattcagtgtgaattttttataatagcataaaaattcaaagatgtccatacaagaaaaattaaaa

SEQ ID NO: 45327 - DNA, 201 bp, Homo sapiens
attgttgctgttgttgtacaggcaatttgagaaaaagtacgaaaggctgtccacaggcagaggttatgtctctcagaaaagaaaagaaagcgtattagcakgatgtgaattcccgctccatcaagagaactcagagatgtgcaaagtggtgtttgcccctcagccggatagtacttccagcggatggttttgaaactgacc

SEQ ID NO: 45328 - DNA, 201 bp, Homo sapiens
cctaggagaacaccctttgtaaatgtggatgttcacagttatgagtggggtatgagcctgcagtgtatgttttgcagctctcggagctctggcggtccacmaggaaatacctgcagcctgacaacctttccaaggctgaggctgtcagaaacttcctggccttcattcagcacctcaggactgcgaagaaagaagagatcc

SEQ ID NO: 45329 - DNA, 201 bp, Homo sapiens
ctatagcctttcagaacttactaggataaaagctacagtcctgtgacagtctgaatggcagctagacaagtgcacaaccagtactatgccacatgtttctkttttatgtttgtcttttgcttatgttttgacctcccggcatcctaattccttattttcactgaatttgtacttgaaaaaatgtaaacctacagaaaagtt

SEQ ID NO: 45330 - DNA, 201 bp, Homo sapiens
atttttctggaaatctttatagtggaatgaagtatttatttattgatgaaaggcattattaaaaggtaaatttctcatcaaattataagggattacaaacrtaatgtaacaaagcaagtcatcaaagcatgattggatgaattcaggaaaggagacaaattatgagactgaaatgatccaactgagattagtaatattgat

SEQ ID NO: 45331 - DNA, 201 bp, Homo sapiens
tgatgaaaggcattattaaaaggtaaatttctcatcaaattataagggattacaaacataatgtaacaaagcaagtcatcaaagcatgattggatgaattyaggaaaggagacaaattatgagactgaaatgatccaactgagattagtaatattgatttgttatgagattatcgatatctggctaaagtacaaggttaaa

SEQ ID NO: 45332 - DNA, 201 bp, Homo sapiens
tactgtccctatgaaaaatactattgagttcatgttgaacttgactattaactcagtgtcatttcaaatgtcaaacagcagggtattaggcttagttaaabttgccttcgttttctagttggatgtaggcaattcctggaacttgtatacagttggcgtctctgtaaccgctggttcctcatcaaattcaaccaacctcag

SEQ ID NO: 45333 - DNA, 201 bp, Homo sapiens
cagtggagaatggatgatcctgagcaactctaacatgctccaaagaaacaagaaagcagcagcataggacaaacagtaactcctttgtagataaacaagayagaaaatgaagaggggtagagtgatagtccacatttggaaataagatattggagccagaaaaataactttaaacctcatttgcagtcctctagttctgac

SEQ ID NO: 45334 - DNA, 201 bp, Homo sapiens
agacaaattatgagactgaaatgatccaactgagattagtaatattgatttgttatgagattatcgatatctggctaaagtacaaggttaaagattttaaragggtatgacaagtctaaagtagagtttttttaaagcctttagaaattattttaaaactatgacatggaaaagccttttatatattaaaataatgattga

SEQ ID NO: 45335 - DNA, 201 bp, Homo sapiens
ctatttcagacacagttaagctctggaaccaccaatgaggtacttaccaatattaataaggattcagcatctcaataaaatttgtaaggatttctacttayacaatttcagtagaagagttactactaaggtaatgctcagaaaaggtgacttgtgtagtgaagtcgcatttgcctatgaaacaattgccatttatcccaa

SEQ ID NO: 45336 - DNA, 201 bp, Homo sapiens
ctttccttctattgggagccttttgttaatacttctccactcttccccatatcatccattctccccaaccccatgtatgtgtgtgtgtgtgtgtgtgtgtrtgtgtgtgtctgtgtgtttgtgtgtgcttgtagcctaatttcagaggttatgaatcctgtggatgaattagatcttaaaaccctttatttttaaaaaatt

SEQ ID NO: 45337 - DNA, 201 bp, Homo sapiens
gcaacaggatgagttgtcaaaatgtcagcatctgagctataagaaacacttatgggaccaagaggatcaaagaggtcacattagctacaaagttctaatawctttttcctctagttcataggaaagaatctaaataaatatgcactctgggccaaacaaggacataaacctatgctctctctctctttttttttccttttt

SEQ ID NO: 45338 - DNA, 201 bp, Homo sapiens
tttacctgttttttttttcatatgtcatttaatgttctaatgtaattttctaatgctgtatgagatggaaattatttaggaaggtggctaataaaactaawcttttcttatgctctgcactattaatttctctcccatagatattaaacattatgagccatctaagatttttgataattatttcttaattattatagaaaa

SEQ ID NO: 45339 - DNA, 201 bp, Homo sapiens
agttcataatctttatggaaaatgtacccattcagaatctgataaaagtgatgaggcccctttttactcatacataaaattttataaccctcacccctcctttttttttttttttttttgttcattgaccccatgaatccaatccataaatttccagggttaagaattccctgtaccacaggttaaaaatccctgaaaagg

SEQ ID NO: 45340 - DNA, 201 bp, Homo sapiens
aaattgtgccaatatttcttacataaacgtttaaaaataatattttatttttattcacagatatatttcttagcctcctctcacccccaagtatttaattmtagaatatattttccttttctggttgtttctatgaagagattgattccccataataaaacccttcataatagaatatgatgctctaaagagtcaatctgt

SEQ ID NO: 45341 - DNA, 201 bp, Homo sapiens
aagacaaaattgtgcccatcttggagctcatattccaagcacttggccctcttggtattggtcccctttctcctttactatagatatgttataatttcatwtattagatgattaataagtgcctttaattggaggcaaagagaaaatgttgatgttaacagaaacaagaaagtttaggacacaacagaatagagctaccac

SEQ ID NO: 45342 - DNA, 201 bp, Homo sapiens
ctttactatagatatgttataatttcatatattagatgattaataagtgcctttaattggaggcaaagagaaaatgttgatgttaacagaaacaagaaagkttaggacacaacagaatagagctaccactgtctcctcacttggctctctcaggcacgagggcttaggtgatatttatcctgaaggcaggagctgaactat

SEQ ID NO: 45343 - DNA, 201 bp, Homo sapiens
aatgagtatggctgtgttccaataaaattttatgtacaagaatagccagtgggccagacttgcctgctggccatagtttgccaatccctgatctagattawcttgtacagtttttctattcactaagctagggcagctaaggcaaggcatattctatgagaaagattgccccctagctattaaacatagcccagtgtctgt

SEQ ID NO: 45344 - DNA, 201 bp, Homo sapiens
gaatgtataagttaatggtggcttctgtcatattttgcccatgatttccttatctgtaagaggctgtatggtttatagtcactcagagaaagtttcgaatwtgaacttgaaacctaagtaatttgatccattgaacttgacaaatgtccatttgtcttttcaaaggtgcacatattcacaaaactgaaattgtgccaatat

SEQ ID NO: 45345 - DNA, 201 bp, Homo sapiens
tggatgaacaagattataattttcaaattaggaagagagaaaaagatgcaaagaaaggaatatttctgaggtgaggcacaccatagctttcatttggaaayaatcatgtttggagtacacatacagaactctcatattttggtcccatagttcacaggcataggtgaaaatgtgggcatgactattgtgttttcttcagga

SEQ ID NO: 45346 - DNA, 201 bp, Homo sapiens
gttctggcattctaaggagaagtaacctgaacatctttcagtacattgggaaggctggtcttcacggtagccaggtaactcacttctcatggattttgctyaataaagtatgcaagaaatcaggctgaggtaaaataaaacatatatgctgtgggtaatgctatagaatgtataagttaatggtggcttctgtcatatttt

SEQ ID NO: 45347 - DNA, 201 bp, Homo sapiens
aaatttttgattcatcttgagctatggatgaaggaactgagagcaatcaaacagtagcacatttaatgtgaagtgtgacccacagtgttaccaaaaggaamcacagaatgaaaaatgacactggtcatcaaaaggttcacaatataacttagggcttcccacataatcagtcatctttcacctctttccaaagtactttct

SEQ ID NO: 45348 - DNA, 201 bp, Homo sapiens
ctgatgaagacagatataggaagttttttttaacagctttctttctgttactccagatgaaggatgtaaatgttgaaaatgtgaatcagcagagaggagasaagagcatcttcaaaggaaaaagcccatctaaaataatgggaaaggaaaacttggaagctctgcaaagacctacgctccttcatctaatccatggaaagg

SEQ ID NO: 45349 - DNA, 201 bp, Homo sapiens
aatctagatgtgcactaagtttgaacatcttatgaacaggtgaagaagaccttaaacagaatataccaccaaaaccgtaaagttcatgaaaagactgtgcrcactgctgcagctgctatcattttaaataacaatccatcctacatggacgtcaagaacatcctgctgtctattggggagcttccccaagaaatgaataaa

SEQ ID NO: 45350 - DNA, 201 bp, Homo sapiens
ttaactggataattaccagatttccatttctggttttggctttgtgttgattaaattaaccacgtggctgctgagtcagacctttattttgtattgtttcygggcattgatttgctctctaaatcagcatggctcttgtacacacactgaactgccacaagaaatgtgacaccttgaaagtccttctgaaatttgttgtat

SEQ ID NO: 45351 - DNA, 201 bp, Homo sapiens
cagtttttttctttgaatgcccctcagtacttctgcatttataggatggtagactggtttggtttagctctcaaaagtgaaaacatttaaagtttcctcaytgggtgaaaaaaattaaaaagagtgagagactgaaaactgcagcccacctacgtttaatcattaatagtgagcccttcagtgaacttaggtcctgatttt

SEQ ID NO: 45352 - DNA, 201 bp, Homo sapiens
aagtgtttctgttgatataaaaagaaatgagaagaaaatcacccattcatggagtagcctttgacactcatatcctttctcagattgctttggaacagaarcttcaagtacattcagtaacttggctggagaggtatagggtgacttaactgtgtgtgtaattctgttattgttgctgttgttgtacaggcaatttgagaa

SEQ ID NO: 45353 - DNA, 201 bp, Homo sapiens
agtttgtgtccatcacattagttataatgcctcaaacaaccccttcatcccatgcagccatattttgtcctatatcaaatgtctctttaagtatccttagrgctatctcctaatgtgtcctgagcatggcactgagaatctcatgcttccatcaaagagtgtccttcagactgaaagtagcttcatgccgcaaccgtactt

SEQ ID NO: 45354 - DNA, 201 bp, Homo sapiens
ttcccaggcaatgctgatgctgttgttcacagaaacacactttgagaaccattgttcctttcaaagtgtagcaatgattgaaggaaaacatccttcttaaytggcacttcatcactctggtattttaattgactaattaatttagcaaatcaacagagtctacttccggtgcttaaaattaggacagcatgtttccaagcc

SEQ ID NO: 45355 - DNA, 201 bp, Homo sapiens
tgaatataggacatcagaaggtactctaagtgattcagggattaaaacgacctctgacctatttttacactgatcataacagcagcaggggttttaatttrcgcagcaaaaattaatattcctgtcaaaacataagggcataaaactctcatttaattgtgaaagcagtttctcacagtttgatttaaagtccacaattca

SEQ ID NO: 45356 - DNA, 201 bp, Homo sapiens
tactttctagacagaagtttttccaaatgaaatggaattgaattctttgcaaagagaaatcaacaacagcaacaacaacaaaaagtaatttggattttttwaaaaagtacacagtatccttaagaatctacccttatccatattgtaaccaatctgtcttccatttccacttgttcatttgaaaaaaatatcttttaaacc

SEQ ID NO: 45357 - DNA, 201 bp, Homo sapiens
aatataggacatcagaaggtactctaagtgattcagggattaaaacgacctctgacctatttttacactgatcataacagcagcaggggttttaatttgcrcagcaaaaattaatattcctgtcaaaacataagggcataaaactctcatttaattgtgaaagcagtttctcacagtttgatttaaagtccacaattcaat

SEQ ID NO: 45358 - DNA, 201 bp, Homo sapiens
ttgaaattatttatcctcttcatcattatccagggcacattccccagccaatgcaatctgtttatccagttatctagagcatcattaaaggacccaccatwtttttcctcctaggacctactgtacatgccccactgtaagaatgattttttgtaacacaatattttttcaaatatcttggcaatcaagggcttacgcctc

SEQ ID NO: 45359 - DNA, 201 bp, Homo sapiens
aaaaaaacaccaaacaataaaatatagcaaaacgacagtatatattcatacaatttttaaaatacagcataacagcaacatagcatttacactgtattagrtattataagtaatctagagatgatttaaagtgtatgggaggatgggtgtaggttacatgcaaatactatgcctttttatataagggacttgagcaccctt

SEQ ID NO: 45360 - DNA, 201 bp, Homo sapiens
agatttggagtgtcagatctctttctcccaggattaatacaggtaagaatctgaccttgcctgacacttatttaaatctgataaatgatgcatttttgctycatttgtgttctgttcccctctccccaccaggtcaaagagttctactcatatcaaaatgaggcagtggccatagaaaatatcaagagaggcctggctagc

SEQ ID NO: 45361 - DNA, 201 bp, Homo sapiens
tctaagcacatccaggtcacctctgaatcccttaagtgtttccttccagtcactggcatcatacgttcagaccctgtaaagttacagctgttagtccaatwccattaaatataatatgaacaagttttttctttttttctcaaatgtttagggtgactgtggtaataaccactgacatcacagtggactcctcttttgtga

SEQ ID NO: 45362 - DNA, 201 bp, Homo sapiens
tatcagctcaggatagctgtatataacaaaaacaaaaagcaatttagagtggcttaactaaatagtttcacttttatagtgtaacaaacatttggaagtasgtggtccagggttaatatggaaatcttaagatatcatcagaatccaagctgccttccttcagctcagccattcttacttgtgacttttgacctcatgctt

SEQ ID NO: 45363 - DNA, 201 bp, Homo sapiens
cattcaggtaagatgcagcgttcaggtcatgttccaggaccatccccagtgcaccaggaacttgcattcagtttagaacattcagtttcagaattaaaacraaacagtagaaacccagggaaagatgaattttctttaaatgagtagaagaataattgataaggccaaaaaaagtcagtttctgggataccaaaaaaaaat

SEQ ID NO: 45364 - DNA, 201 bp, Homo sapiens
tgcggcaggagaatggcgtgaacccgggaggcggagcttgcagtgagccgagatcccgccactgcactccagcctgggcgacagagcgagactccgtctcaaaaaaaaaaaaaaaaaaaaaaaaatttaaatatacacatacactagacaatggcataattgggaaatggcataaatgagaaaatgtggtttagaatatta

SEQ ID NO: 45365 - DNA, 201 bp, Homo sapiens
atttgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccat

SEQ ID NO: 45366 - DNA, 201 bp, Homo sapiens
tgagttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttg

SEQ ID NO: 45367 - DNA, 201 bp, Homo sapiens
gttaatcccagtggattttaattaatcccacaggattttaagaatttctaatcatgttcagctagttgaagttacacacacacacacacacacacacacaccacacacacacagaatctagatacagcattaacaatcaactcccttgccacagaattacccatttatccaaagtttcaattattaccaggccatttgtct

SEQ ID NO: 45368 - DNA, 201 bp, Homo sapiens
aaggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatc

SEQ ID NO: 45369 - DNA, 201 bp, Homo sapiens
tagcagtcatataaaagaaaaagagatgtgttcatttttctagttctggggaagcaataaaaactaatagaaaggattaaaaaaacttttttcattgtgtytcacagtttatatctatcattcagcctgccaggagggaaaaaaggctctaacaccattttctaagggatccagaggtcaagatcaaaacttgatccattg

SEQ ID NO: 45370 - DNA, 201 bp, Homo sapiens
aggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatca

SEQ ID NO: 45371 - DNA, 201 bp, Homo sapiens
tgtcatttcaaatgtcaaacagcagggtattaggcttagttaaatttgccttcgttttctagttggatgtaggcaattcctggaacttgtatacagttggygtctctgtaaccgctggttcctcatcaaattcaaccaacctcagatcaaaaatatttggaaaaaaaacaccaaacaataaaatatagcaaaacgacagta

SEQ ID NO: 45372 - DNA, 201 bp, Homo sapiens
ataatgcctcaaacaaccccttcatcccatgcagccatattttgtcctatatcaaatgtctctttaagtatccttagagctatctcctaatgtgtcctgarcatggcactgagaatctcatgcttccatcaaagagtgtccttcagactgaaagtagcttcatgccgcaaccgtacttttttaatacacctggttgtaaac

SEQ ID NO: 45373 - DNA, 201 bp, Homo sapiens
atcctgctgtctattggggagcttccccaagaaatgaataaatacatgctcgccattgttcaagacatcctacgttttgaaatgcctgcaaggtataatayattgcacatgtctctctgtgtattcaagcttatttgtgtgttcatggggtaccgatgtagctaataataatgatgtggtcattatgcagggttacgttgc

SEQ ID NO: 45374 - DNA, 201 bp, Homo sapiens
cattgattatataaaagtaaacgagtcagttgtattttcagagaataaaagattgtgctttatagttaaactattaagctgtcactaacttacattaagtkatatctagaatgaacctccacaaatgcattttaaaaaccccaaccttctaatggttgaaatgcagtgaccaccaacccacccacatgattaattggtttg

SEQ ID NO: 45375 - DNA, 201 bp, Homo sapiens
tttatttctcaggctatgcctaatgtgcataaggaagtatgtggtctgaagttcactacagtcatggaagaaagagatggagaaagccaccagctcttaayggcctcagcctagaagtgatcctcatagattctatccatggcgtattagccagaactagtcacgtggcccccaccaaatcacaaaggaatctgggaaatg

SEQ ID NO: 45376 - DNA, 201 bp, Homo sapiens
aaacattacttcatataactacctttccccagagccccatgccatgtagtatccttaaaattctatattagttaggtaacaccaggttatgctgcaataamaaatgtccctcaaaatctcagcaatgtgttaaaagtttatttctgagccaggcatggtggctcacgcctgtaatcccaacactttggaaggccgaggcgg

SEQ ID NO: 45377 - DNA, 201 bp, Homo sapiens; identical to SEQ ID NO: 10288

SEQ ID NO: 45378 - DNA, 201 bp, Homo sapiens
atacttctccactcttccccatatcatccattctccccaaccccatgtatgtgtgtgtgtgtgtgtgtgtgtatgtgtgtgtctgtgtgtttgtgtgtgcytgtagcctaatttcagaggttatgaatcctgtggatgaattagatcttaaaaccctttatttttaaaaaatttttcagcctagactctgtcatacaaaga

SEQ ID NO: 45379 - DNA, 201 bp, Homo sapiens; identical to SEQ ID NO: 10289

SEQ ID NO: 45380 - DNA, 201 bp, Homo sapiens
gcccaagattgatgtctggaaagcaggctgcagccataatcaaagcagttgattcaaagtacacggccattcccattgtggggcaggtcttccagagccastgtaaaggatgtccttctgtaagtgcagacaaatatgggaataatcatgacatcagactctgttttcattttgtctccagtgaaagcatcaactcattca

SEQ ID NO: 45381 - DNA, 201 bp, Homo sapiens
atttaccaaattgtgagttcccactgctatctctaattctaattctaattcaacactacagggttattttttccctcatttcatcattctattttccttcycccactgtgacaactgtggttttcgagaacaccaatatattgattcacctgctcaattctaaaacatacacaatatatttttggaattgccatactgata

SEQ ID NO: 45382 - DNA, 201 bp, Homo sapiens
gcttgggtattaacttattaagttctggcagaaattaaatttattatttttatattagggaagcatgacttcttatatttttcaatttccataattatttkagtagctgatttacttcagctatttgtgtattaaatatcttggcaaaagataaaacccacatatcaaaagatctattcagcagtatttaatgagcatcta

SEQ ID NO: 45383 - DNA, 201 bp, Homo sapiens
tgcaaacttaaattttcaaatcttttaatataattgttgctccagaaagacttcataatgagctttcagttacctctggagatatcacagtttgaaagacrtggctatatacaacttgaataaattactatcttgtttgccaaaagaatggcaattagtatcttgttcactcaaaagaatgattataatatagcatttccc

SEQ ID NO: 45384 - DNA, 201 bp, Homo sapiens
caaatgcattttaaaaaccccaaccttctaatggttgaaatgcagtgaccaccaacccacccacatgattaattggtttggttccacatttgccttgggcsagagctcttagaatgtttctctgtccgcattctctgcttaaatccagctgggcttgcctgttactcaaaaggagagtgctcccaaggtggggcttctgga

SEQ ID NO: 45385 - DNA, 201 bp, Homo sapiens
aaaagaaaaagagatgtgttcatttttctagttctggggaagcaataaaaactaatagaaaggattaaaaaaacttttttcattgtgtttcacagtttatrtctatcattcagcctgccaggagggaaaaaaggctctaacaccattttctaagggatccagaggtcaagatcaaaacttgatccattgcagtgggtcagt

SEQ ID NO: 45386 - DNA, 201 bp, Homo sapiens
ggggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcat

SEQ ID NO: 45387 - DNA, 201 bp, Homo sapiens
gggaaaatagtatcgaagtaagataatgctaaaatttttattttctttgctattctttgttatattattatacttgatttgtaaatagatctgtgtttgtgtgtgtgtgtgtgtgcgcgtgtagtcatgcattgcttaacaatgggaataagttctgagaaaagcattgttaggcaatttcatcactgtgcaaacatcata

SEQ ID NO: 45388 - DNA, 201 bp, Homo sapiens
taataacacatagtttaaaacacattgtataggtgtacaaaaaatattttttctttaaatctttataagcttttttctatttttaaattttttatttttatttttttcttttaaaaatttctggttaaaaattaagacataagcatatatattagcctcggcctacacaaggtcaggatcatcaatatcactgtcttcctc

SEQ ID NO: 45389 - DNA, 201 bp, Homo sapiens
cagtaattgcttattagtttctgaaattgagttagaggaaaaaggaaacattttaaaacacaaaatcatcattttcaaacattgtttcttcttttacctgttttttttttcatatgtcatttaatgttctaatgtaattttctaatgctgtatgagatggaaattatttaggaaggtggctaataaaactaaacttttctt

SEQ ID NO: 45390 - DNA, 201 bp, Homo sapiens
tgtttgagtgagagagaggggcgttcaaggagaaaattaaaataaaatggggaggggtctttttgagaaagtcttaatcattttttcatttgttcaaattaaaaaaaaaatcacttcttgagaaaactcaaaccaatagaaactctgtgaatggtagagatttttaagtattccttcccctaaacattgatatccatgatt

SEQ ID NO: 45391 - DNA, 201 bp, Homo sapiens
taagaaaccatggactccagagtcagaaaaacctaggtttcaatcccagcaatgccatttaccatttaccagctatatgaccttgaacaaatgactaggtrtatctgcgtctgtttcctagcatgtacaggggaatattaatattaaactgacagagatgttcagtggattaaatgaggtggtagtattagtaacagctaa

SEQ ID NO: 45392 - DNA, 201 bp, Homo sapiens
ttgttaatacttctccactcttccccatatcatccattctccccaaccccatgtatgtgtgtgtgtgtgtgtgtgtgtatgtgtgtgtctgtgtgtttgtktgtgcttgtagcctaatttcagaggttatgaatcctgtggatgaattagatcttaaaaccctttatttttaaaaaatttttcagcctagactctgtcata

SEQ ID NO: 45393 - DNA, 201 bp, Homo sapiens
ggggctagccctaatcctgatgctaccacgccagctggcaccaccctggctcttggaaaggcatgaggaaaatttggcttcctcttttttccactgaggattttttttttccaaatttgacttgggaaacagtcattacaatgaatgtgcagctttttttttcctcatatgttgcagcaaaattgtccgtcgagttctgaa

SEQ ID NO: 45394 - DNA, 201 bp, Homo sapiens
ctatggcctattagagacctcaattttcaagccacttctcactagaattcaaatggcccacaaggaatcccaagcattatgcccttgcctttctttttagrtagatatctctggaaattgtaaagtgacctaccaggctcatcaagacaaagtgatcaaaattaaggccttggattcatgcaaaatagcgaggtctggatt

SEQ ID NO: 45395 - DNA, 201 bp, Homo sapiens
ttttttgttcattgaccccatgaatccaatccataaatttccagggttaagaattccctgtaccacaggttaaaaatccctgaaaaggggattaactcttyaattcaaagctagatagcaaatgtgtaagtgtctcaaaagcaaaattctgagtttgcaatctagaaacataaaaatactttaccaagtatgtgtttattt

SEQ ID NO: 45396 - DNA, 201 bp, Homo sapiens
tatgcctttttttatagacctcagctggtggatgctgtcacctctgctcagacctcagactcattagaagccattttggactttttggatttcaaaagtgmcagcagcattatcctccaggagaggtttctctatgcctgtggatttgcttctcatcccaatgaagaactcctgagagccctcattgtaagtcaaatagaa

SEQ ID NO: 45397 - DNA, 201 bp, Homo sapiens
cgagagatgctgttaattagaactatttattaggttgttgcaaaagtaattgtggtttttgccattacttttgtgacaacctaatattatttttaaaaccrcaatagaataacttagtgtgtgtgagaattacctttatctaaatgctactctaaaaaacatagatataagaaatgaataattcagaccttagcaacagca

SEQ ID NO: 45398 - DNA, 201 bp, Homo sapiens
attcatattgatatgctctctgccttcagaaatgacccagtaaatctttagctaagtgcagctggaatttcacttggaatatcttcttaagattacatagytaaaaggcacttgaaaaagagaaaaaaaaggatccattgcttattaaaagtaatgaataatttaaaaactggcagcaagttattactatagagttagaga

SEQ ID NO: 45399 - DNA, 201 bp, Homo sapiens
gctgaatttctaaaaaacttttttcctccatcataaattaaccttagcttactgtaatatttttacgttaaaaactttttaatttttgttaacttttgaastactctgtaataacacatagtttaaaacacattgtataggtgtacaaaaaatattttttctttaaatctttataagcttttttctatttttaaatttttt

SEQ ID NO: 45400 - DNA, 201 bp, Homo sapiens
caattttcaagccacttctcactagaattcaaatggcccacaaggaatcccaagcattatgcccttgcctttctttttaggtagatatctctggaaattgyaaagtgacctaccaggctcatcaagacaaagtgatcaaaattaaggccttggattcatgcaaaatagcgaggtctggatttacgaccccaaatcaggtat

SEQ ID NO: 45401 - DNA, 201 bp, Homo sapiens
ttgtctttgtatcttatcatcctgggggagaaaaaaagtcccctatggcctattagagacctcaattttcaagccacttctcactagaattcaaatggccyacaaggaatcccaagcattatgcccttgcctttctttttaggtagatatctctggaaattgtaaagtgacctaccaggctcatcaagacaaagtgatcaa

SEQ ID NO: 45402 - DNA, 201 bp, Homo sapiens
cgctcacaattatgaccgtttctccaggagtggatcttcttctgcctacactggctacatagaacgtatgtacaccaaaaagaggttctccttccataccycacaacttagcattgctggaactgctattaaattacagttattgtgtgtcatcaggtagtccccgttcggcatctacttacagcctagacattctctact

SEQ ID NO: 45403 - DNA, 201 bp, Homo sapiens
tttttagctgttgcaaatatttaagtttttggccccttgagaagttctagctgcagctcagaagcttcaccattatttacagagcaggcagggagcttgcrtcatgaacattatattgattttatccaggtggttattgaagcccaaggactggaagccttaatcgcagccacccctgacgagggggaggagaaccttgac

SEQ ID NO: 45404 - DNA, 201 bp, Homo sapiens
aggccaagatccacatcacaggcctctgctggactgggtggatgaacaagattataattttcaaattaggaagagagaaaaagatgcaaagaaaggaatayttctgaggtgaggcacaccatagctttcatttggaaacaatcatgtttggagtacacatacagaactctcatattttggtcccatagttcacaggcatag

SEQ ID NO: 45405 - DNA, 201 bp, Homo sapiens
attgggagccttttgttaatacttctccactcttccccatatcatccattctccccaaccccatgtatgtgtgtgtgtgtgtgtgtgtgtatgtgtgtgtstgtgtgtttgtgtgtgcttgtagcctaatttcagaggttatgaatcctgtggatgaattagatcttaaaaccctttatttttaaaaaatttttcagccta

SEQ ID NO: 45406 - DNA, 201 bp, Homo sapiens
aaacaaaacagtagaaacccagggaaagatgaattttctttaaatgagtagaagaataattgataaggccaaaaaaagtcagtttctgggataccaaaaaraaatctaatgactagttcatttgattctggagatagttatcatattctaatccagaaacaatttatccaggaaagaaaggcctatgatttaccataggag

SEQ ID NO: 45407 - DNA, 201 bp, Homo sapiens
agagatactctgatgaagacagatataggaagttttttttaacagctttctttctgttactccagatgaaggatgtaaatgttgaaaatgtgaatcagcasagaggagagaagagcatcttcaaaggaaaaagcccatctaaaataatgggaaaggaaaacttggaagctctgcaaagacctacgctccttcatctaatcc

SEQ ID NO: 45408 - DNA, 201 bp, Homo sapiens
ccttttgttaatacttctccactcttccccatatcatccattctccccaaccccatgtatgtgtgtgtgtgtgtgtgtgtgtatgtgtgtgtctgtgtgtktgtgtgtgcttgtagcctaatttcagaggttatgaatcctgtggatgaattagatcttaaaaccctttatttttaaaaaatttttcagcctagactctgt

SEQ ID NO: 45409 - DNA, 201 bp, Homo sapiens
tgcctgacacttatttaaatctgataaatgatgcatttttgcttcatttgtgttctgttcccctctccccaccaggtcaaagagttctactcatatcaaartgaggcagtggccatagaaaatatcaagagaggcctggctagcctatttcagacacagttaagctctggaaccaccaatgaggtacttaccaatattaat

SEQ ID NO: 45410 - DNA, 201 bp, Homo sapiens
ttttgttaatacttctccactcttccccatatcatccattctccccaaccccatgtatgtgtgtgtgtgtgtgtgtgtgtatgtgtgtgtctgtgtgtttrtgtgtgcttgtagcctaatttcagaggttatgaatcctgtggatgaattagatcttaaaaccctttatttttaaaaaatttttcagcctagactctgtca

SEQ ID NO: 45411 - DNA, 201 bp, Homo sapiens
tggtacttatcatgagcttctcctgttttcccattttataaactagaacattgggtgacctcatgttttcaaatatacttataaaaaatttaaggccgggygtggtggctcacgcctgtaatcccagcactttgggaggccgaggcgggcggatcacgaggtcaggagatcgagaccatcccggctaaaacggtgaaaccc

SEQ ID NO: 45412 - DNA, 201 bp, Homo sapiens
catcccggctaaaacggtgaaaccccgtctctactaaaaatacaaaaaattagccgggcgtagtggcgggcgcctgtagtcccagctacttgggaggctgmggcaggagaatggcgtgaacccgggaggcggagcttgcagtgagccgagatcccgccactgcactccagcctgggcgacagagcgagactccgtctcaaa

SEQ ID NO: 45413 - DNA, 201 bp, Homo sapiens
agccatccatttgacaggtggaaagactgaggcccagagagagggtaaggggcaggacttgctcacacagcaaggccatgacagacctgagctgggacgcrgcccaggacaaacacgggcctccccacagcccagcccaaaggctcttctcaggtacagaccagcgcctgggtcagattcgttcttccctcttttctgaga

SEQ ID NO: 45414 - DNA, 201 bp, Homo sapiens
cgggagggagggcacagtccttcctgctggctgcatttcctcctgataatagaattctgcccagctgctgggctggctgctgtctgacctcccttcttaamgacagaatttgctgatgaattttgtttcaggagaaatatgtgtgtgaatgggggaagagacgagacagagagaaataggaagagtttgggagcctctaga

SEQ ID NO: 45415 - DNA, 201 bp, Homo sapiens
attcacctgtgaactttcagttttaaaacctagatggttctggcaaactgtatggagttaatcaccttaaattgaacacagggttaaaaatgaataccacraaaataaactaggttattaaactcgaactggcagctctgagcctggagcctgtccttacctgtgctgaaggcggagctccattagaatgctggagcttct

SEQ ID NO: 45416 - DNA, 201 bp, Homo sapiens
gtgcccgaccctgtgctaggcactgtagcagagacagaaaaattaagtcaggactctccttgccaaggaattcactgtcttgttggaaggctcaaaggctsggtctgttgcccaaggcagctcaggtaagaagtaaaatccacagcagtgcttcaattctgctcacaaactgggctcctccactctggtctcagaattctg

SEQ ID NO: 45417 - DNA, 201 bp, Homo sapiens
cacctcgtcaataaatgaatgagtaggtgggtctgagtcccattggctatggctgcaagcagttcctctcacttctgcaacctcgattcccctgcccctamgatggaactaacagtagtgactgtgccccactcatgggggagtgtggtgaggtttagaagagaatgagaggattttgaaagtgctttgtaaactcaggag

SEQ ID NO: 45418 - DNA, 201 bp, Homo sapiens
tgctcttcttccttttctccttaagtaactcaaactccccaagttataagcaaccccaattgtatggatgcgttgttctatttttcaaattgcaaaaatcrtaagagcagtggaattttttcacatccttatgctataagcgagggtggatggaaaggtgggagttttctgtttgatttgctgcagaacgggttgggagga

SEQ ID NO: 45419 - DNA, 201 bp, Homo sapiens
tcctgtaatcccagctacttgggaggctgaggcaggagaattgcttgaacctgggaggcagaggttgcaatgaaccaagattgtaccactgcactctagcytgggcaatagaacaagactgcatctaaaaataaaaaataaataagagtaacattaattggtagcaagagagaaaagaaggaagaacattccaggaggaaa

SEQ ID NO: 45420 - DNA, 201 bp, Homo sapiens
aggccctggaaggtctaccaccctaccttcgtaacacatgcctgttatcttgcccctttttttctcctagctgtactagatagctttctcagagcgtcagsacgtggtgctgggtcacaactcagggcctttgcacatgctgccatctgactaggatgatcttatggcccctaccctggctcccttggcctcccttactca

SEQ ID NO: 45421 - DNA, 201 bp, Homo sapiens
ccaagattgtaccactgcactctagcttgggcaatagaacaagactgcatctaaaaataaaaaataaataagagtaacattaattggtagcaagagagaaragaaggaagaacattccaggaggaaaacaaggttctgattgcagttataagagacagaaatccaattcaaattggcttaagcttgaaaaaaaatgggagg

SEQ ID NO: 45422 - DNA, 201 bp, Homo sapiens
aaggccctggaaggtctaccaccctaccttcgtaacacatgcctgttatcttgcccctttttttctcctagctgtactagatagctttctcagagcgtcascacgtggtgctgggtcacaactcagggcctttgcacatgctgccatctgactaggatgatcttatggcccctaccctggctcccttggcctcccttactc

SEQ ID NO: 45423 - DNA, 201 bp, Homo sapiens
ggttctggctctggcccagatacacaggcctcgaacaataccatcagtgcttgtcattgcaactcagtctctctccatcttttgtctctgccctcctctaygagggcttcactctcaagcaagctctttgggctccaggcttcctatctcccagctagacattttccctcaaaagagaactcctggccgggcacgatggct

SEQ ID NO: 45424 - DNA, 201 bp, Homo sapiens
gggagctaaaaaataatctttaaactgtatttatgatggtgcaagtaatgagtgctcagtggaacaagggcgggcaggaaggattggcttggtcatgttcscaaggaaattgtaacacacctcccgtccctgcctttatgctccatttctcggccttcctttatttttttcatagcccttttgccacgtgttatcttatag

SEQ ID NO: 45425 - DNA, 201 bp, Homo sapiens
tttgtgagttgctgctgttggtgccagcttttgcactgggagcaactcataccttaagacctcacccttaagaggataagggtgaacagagcctgcctgcycacaacagagcctgcctgccctctgacctctccccacctctgaggatggttggccttgtgagcttgggatgatgtggaggctcggagagggcaagcaacc

SEQ ID NO: 45426 - DNA, 201 bp, Homo sapiens
tggcattctctaggagtggttcagtaagggatgcaggggtagtgttgtttgaggaatgcagtcttttttcgttgttatcattctgtccctgtttgtgtacmtaacccatttagagataaggtcaaaattctaaaaatactggaatgtcagttttctgaatagctactatatttccctagtatgaaagtcaaagtgttcaaa

SEQ ID NO: 45427 - DNA, 201 bp, Homo sapiens
tggagaaagttctgcagggaaggaggggagtgctggggcttaaccaggctggtcaggaaaggagaaggtgccaagtagaaagggagggagacaggcatgtkggcatgtgggggaagagtgctctgggtggagagaaaagcagtgctaaggccctgggacaggaacgtgcctggggcactcaaggaacattcaggtattaat

SEQ ID NO: 45428 - DNA, 201 bp, Homo sapiens
gaaaggagaaggtgccaagtagaaagggagggagacaggcatgttggcatgtgggggaagagtgctctgggtggagagaaaagcagtgctaaggccctggracaggaacgtgcctggggcactcaaggaacattcaggtattaatgtggttggagcagagtgtaccggaggcaagagagtagaaggaggtgagatcagagg

SEQ ID NO: 45429 - DNA, 201 bp, Homo sapiens
ccattccgcttatcctgcactgttcagtgtgctctctctcgtattctattttcttcttaacttgtttcatctctccacataaaacaggatgttctcaaagyctaagactgtatcttactcacttctgtgctcaaaacagggtgggtgggctgcctgttttgtaaatacggttttaatggaacacaggcaggcctattcatt

SEQ ID NO: 45430 - DNA, 201 bp, Homo sapiens
gtcccagagtgggggaagagcattccaggcagagggagctatagtgcaaaggcctggggtagaaatgagctcaatctatgggagaacagcaagaaggccaytgtggctgcatgggaccatgtgagagaagggtagtaggagatgaggttgagaggactttgggggacaggtgagatttggtgagatgggagggaatgaatg

SEQ ID NO: 45431 - DNA, 201 bp, Homo sapiens
gtggctgcatgggaccatgtgagagaagggtagtaggagatgaggttgagaggactttgggggacaggtgagatttggtgagatgggagggaatgaatgartgaagcctccaatacgataagcgaaaaaacatgatattccaagagataggcgtggtcctcccccaaattttggttgctgggaagactggcagtccctccc

SEQ ID NO: 45432 - DNA, 201 bp, Homo sapiens; identical to SEQ ID NO: 10308

SEQ ID NO: 45433 - DNA, 201 bp, Homo sapiens
atattgcattattccaggaaagagaagaaagatgacagcccagaagagggtggtggcagggaagatcggtgaaaagtggctggactctggatgtaaggtgkggaggcagctcctgggaagccacaacgcccctgcctccaccagtggtcacagaccctcaggctgtgcaatgggtcttaagccctagcctttttttaagct

SEQ ID NO: 45434 - DNA, 201 bp, Homo sapiens
ataaaatagcactgttcattccccatggctgctttatttgtttcaacctgacatataattacttaattatatgattcctttctctctctcccactttgatrtaagcttcaaagggcagggattttgtgtgctttgtccactgttgtgtcttcagtgcctgccatagagcaggcatgaaatacatgcattgaataaatgaat

SEQ ID NO: 45435 - DNA, 201 bp, Homo sapiens
ctccaggcttcctatctcccagctagacattttccctcaaaagagaactcctggccgggcacgatggctcatacctgtaatcccagcactttgggaggccraggcaggcagatcacaaggtcaggagatcgagaccatcctggctaacatggtgaaaccccgtctctactaaaaatacaaaaaattagctgggcgtggtgg

SEQ ID NO: 45436 - DNA, 201 bp, Homo sapiens
gttggccaggctggtctcaaactcctgacctcaagtgatctacccaccttggcctcccaaagtgctgggattacaggcgtgagccaccgtgcccggcctgmtataatattttggatggcactgtggagaaagttctgcagggaaggaggggagtgctggggcttaaccaggctggtcaggaaaggagaaggtgccaagtag

SEQ ID NO: 45437 - DNA, 201 bp, Homo sapiens
aaatgtcatctcagcaaggccatccttgaccaccacatataaaatagcactgttcattccccatggctgctttatttgtttcaacctgacatataattacytaattatatgattcctttctctctctcccactttgatataagcttcaaagggcagggattttgtgtgctttgtccactgttgtgtcttcagtgcctgcca

SEQ ID NO: 45438 - DNA, 201 bp, Homo sapiens
gtgaaaccccgtctctactaaaaatacaaaaaattagctgggcgtggtggcatatgcctgtagtcccagctactcaggaggctgagtcaggagaattgctygaacccaggaggcggaggttgcagtgagctgagattgtgccactgcactccagcctgcacacagagtgagaccccgtctcaaaaaaacaaacaaacaaaa

SEQ ID NO: 45439 - DNA, 201 bp, Homo sapiens
tcaacgttggcaaatcattttaaaagttaaaaacatgcccaagtgcagtgtctcattcctgtaatcccagcacttacggaggccaaggtgggaggatcccytgagcccaggagtttgagaccagcctgggcaacttagtgagaccccatctctacaaaaagtagccaggtgtggtggcatgtgcctgtggtcccagctact

SEQ ID NO: 45440 - DNA, 201 bp, Homo sapiens
acctctcatcacttccatttcctaatctgtaagtgagggcgataataaaacctactccacagggttgtctgaaggatgaaggatgatagcacatgatcagwgttgaagctgtgcctgagaaatcccacatccccacaggataaagaaacccagagacccaggatgctccagtgacctgctgaggatcacacagcccatcat

SEQ ID NO: 45441 - DNA, 201 bp, Homo sapiens
tgcagtgagctgagattgtgccactgcactccagcctgcacacagagtgagaccccgtctcaaaaaaacaaacaaacaaaaaacaaaaaaacaaagagaamtcctcctcccccatggttgcaaagttccaagatccactctcatgaagccatcttgtgtcacatgcccatccctcagtcaatcacaaaggctgggagggtt

SEQ ID NO: 45442 - DNA, 201 bp, Homo sapiens
agagctgttaggagatgcccctaatgtaaagagcctagcccagcgcctgactcatgggaagcattcagtaagtggcagcaacgattgttagtgttttcacrgaattcctctgctccagctacacgtctctagtgtaatgaggttccagcttccttgacctgagccacaaggatctgtgtattatcatcaaaagaaatgcgg

SEQ ID NO: 45443 - DNA, 201 bp, Homo sapiens
ccccaacccctgcaagtggcttggtcctcatgcttgatgcttcatatcacaagatggctgcccagttccagccctcagacgtacattcagtgatgtttaayccgtgaagagaaacattttctcctatgctccactttctttcttttgtttttgaaatggagtcttgctctgtcgcccaggctggagtgcagtggcatgatc

SEQ ID NO: 45444 - DNA, 201 bp, Homo sapiens
ccagcactgattagtggtgcttcatatctgctatctcattgaaattcctccaacagggatacaaccaggtagtatgccagttagggatgctttgggctgcragcagcagaatagaaaactcaaagtagcttcaataaggaggaagatgcatcattgaatataatatgaagttccaaggcagttggttttaggttgagttaa

SEQ ID NO: 45445 - DNA, 201 bp, Homo sapiens
tccccacccatccccccagcttggatgccttgcttgtcaaaacaagcaaagcctgtggaaattgcttagaactcacagagtgacaggaccaaatggaggaycatttctaggtgattgtaagatacaaaagtggccatatctcatatgctgaagagcaaggatggatctggttctgtgccactccccacttccatagctttt

SEQ ID NO: 45446 - DNA, 201 bp, Homo sapiens
ggcaggggctgtaggggactgaggaaggcttggggtgggagccaaggcagggcaggagggcactggttgatcagcaacttctctacgtcaggctgggattyggggttgcctgggaaagatggggcctgtcttcatgtgcccgaagtgctgggtgctgggagcaaatgacaaaacagtgtgtgcaaggctataaaagaggtt

SEQ ID NO: 45447 - DNA, 201 bp, Homo sapiens; identical to SEQ ID NO: 10316

SEQ ID NO: 45448 - DNA, 201 bp, Homo sapiens; identical to SEQ ID NO: 10310

SEQ ID NO: 45449 - DNA, 201 bp, Homo sapiens
ggaaagaggctggtaggggcatctggggctgggccacccttggctgtggccctggaggcagcacaaacccctaccctggagatctctcctctccacacccmcacctgcccacagcccataccccacagttaccaagggaaacaggcgccagaggggaaaggctgcatttccctccttccttgtgggctttccagaaaccaa

SEQ ID NO: 45450 - DNA, 201 bp, Homo sapiens
gaacgctgaaagataagaaagacctgcagagatctaggagaggagcattcctggcaggaactgtaagtgcaaaggccctgaggctggacccagtctgggayattggaggagcagcagggccagtggctgcagcaggtttagctcagctggtggatgtgagtggagagaggtagccggggccagatcagacagggtcttgaa

SEQ ID NO: 45451 - DNA, 201 bp, Homo sapiens
acctctggagcatagagccttcacgtggctggaaatgttgggggtgcatttcttgcctctgaggcccccacctggaagggaggaaagagacagagcttggwtgacagaagcaataggtcccctgtattaattaaggttctccagagaaacagaatcactaagagatttgtttatttattcatttatttgagagaccgggtc

SEQ ID NO: 45452 - DNA, 201 bp, Homo sapiens
agagctctttggccttgttaagtttgagaagcccaagcgacatccaagtgtcaaaacaatcttcctcccacccagcaaggcccgagagcccagatagaggktggaggggagcctgcccggggtggagattaatgcacataacccagttctctctgcccgtggctatttgggtcacttggactgcaggtcctcacccctctg

SEQ ID NO: 45453 - DNA, 201 bp, Homo sapiens
aatcctctaatccatcattggagccaaggagtccatggccagagagttgctcttcataattaaaactctagcgggcaaggtcagaatgctgatgtcccagrttggaactaatgtacggggttggaattctgaggttcaaggtcagaacacttcggcagtcttcatgatcagaattctggcaggcacattcagaagactggt

SEQ ID NO: 45454 - DNA, 201 bp, Homo sapiens
ctgctgaaggggctctgggcttcttgaggggatagattgagtttatttagtttttgcatccccagaatctgccacaggctctccataaatgcttgccgaadggatggatggatggatggatggatggatggatggatggatggatagataacagatgaacaaatggacagattactgaacatatagatggtgcataagtag

SEQ ID NO: 45455 - DNA, 201 bp, Homo sapiens
tggccagagagttgctcttcataattaaaactctagcgggcaaggtcagaatgctgatgtcccaggttggaactaatgtacggggttggaattctgaggtkcaaggtcagaacacttcggcagtcttcatgatcagaattctggcaggcacattcagaagactggtgtttggagttggaagtcttattccctgcttgttat

SEQ ID NO: 45456 - DNA, 201 bp, Homo sapiens
aatttaaattttaggaccatcagggtttttggaacagagccataactcacaaactcatttctgtttatctgtggccgcgtctgtgctgccctgcagagttkaagggttgtgacagagatcatgcggcccccaaagcctaaaatatttactctctgacccttttacagacaaagtttgctgagccctggtttagagagcatt

SEQ ID NO: 45457 - DNA, 201 bp, Homo sapiens
tcatttctgtttatctgtggccgcgtctgtgctgccctgcagagtttaagggttgtgacagagatcatgcggcccccaaagcctaaaatatttactctctracccttttacagacaaagtttgctgagccctggtttagagagcattgccttattcaggcccttagggaagcaagtgtggagtgggccccaggctgcatct

SEQ ID NO: 45458 - DNA, 201 bp, Homo sapiens
gctcttcataattaaaactctagcgggcaaggtcagaatgctgatgtcccaggttggaactaatgtacggggttggaattctgaggttcaaggtcagaacwcttcggcagtcttcatgatcagaattctggcaggcacattcagaagactggtgtttggagttggaagtcttattccctgcttgttatattgggagtctca

SEQ ID NO: 45459 - DNA, 201 bp, Homo sapiens
ctccatgataggccctggtatttcttgcaagagtttatccatagatccccttggtcactgttttgggttccagtgttcatcactgtggggataaatcttcyctgaactggaggttctttatgagggaggtagccagagccctttccctatcactaagaaaaatgcagaaactcgcttcttctcccagaaatgaggcattct

SEQ ID NO: 45460 - DNA, 201 bp, Homo sapiens
ctaaaatatttactctctgacccttttacagacaaagtttgctgagccctggtttagagagcattgccttattcaggcccttagggaagcaagtgtggagygggccccaggctgcatctattaagcaccaactgtgggcaacctcttgggttaggcacattatatttgtcatccctttcacaatactctgaggtcagtgtg

SEQ ID NO: 45461 - DNA, 201 bp, Homo sapiens
ccttgagtctttgcacatgctgttccctctgcctcgaatgctcttcctctcttcttcatccagttatttgcctcctcaccctagagctcccagatagaatrccacctcctcctgcaagcctttcctaatctctcaataggtcagatcccccagttatggattttcaaagttctctgtgtctctcttgggtggcctccattc

SEQ ID NO: 45462 - DNA, 201 bp, Homo sapiens
tcttgggttaggcacattatatttgtcatccctttcacaatactctgaggtcagtgtgactgtccccaccttataaatgaagaaactgagactcagccagscacggtggctcacgcctataatcccagcactttggcaggccaaggcaggtggatcacctgaggtcaggagttccagaccagcctggcgaacatagtgaaa

SEQ ID NO: 45463 - DNA, 201 bp, Homo sapiens
gacggcttggcagaatgcaagtgagagagtgagatgcaagtgggagtgacgtgtctaggttgtggccacttcttgccaccccactgctgccttcctgaccytatcctctccctcctgtaccattgcaggagcctctagtcccatctgctgcctccagcctcccatcccccgtctggtctccacacacagcaactcacgccc

SEQ ID NO: 45464 - DNA, 201 bp, Homo sapiens
aatcctagcactttgggtggctgaggcgggctgatcacgaggtcaggagatcgaaaccatcctggctaacacagtgaaaccccgtgtctactaaaaatacaaaaaaaaaaaaaattagccgggtgtggtggcaggcgcctgtagtcccagctactcgggaggctgaggcaggagaatggcgtgaacccaggaggcggagct

SEQ ID NO: 45465 - DNA, 201 bp, Homo sapiens
cagtcctggtaggatacatcaggggcctggcccagggtgatgatcggggaggcaggagaagtgctcagactactttgaaggtggaacccatgggatttgcmgatgaacagaaaggagtcgaggagggctcttgggtcacagcctgaagatctgggaggatggaggcaccatttgccaaaaaaggcaaaacatagtacagag

SEQ ID NO: 45466 - DNA, 201 bp, Homo sapiens
gctgaaggcggagctccattagaatgctggagcttctctttccggtagtcccatgacaagtcccagggttcactctgattggcttgattggggtcacatgmccagactctgccaatcgttgttgccaggggaatgcaccgttctgattggccagacctggagccagaggtgaggccaggctacaagccacgtggcttgaga

SEQ ID NO: 45467 - DNA, 201 bp, Homo sapiens
aaaatgaagagtgaagcaggtaccttttgcttgttgagtgaaacagcatcagtgtcacatgtcaggaagctccattgttttcctgtctcaaaaaaaataaytgaaaacaatttgagtgggccaaacagaatatgtttggaaccatatgcagccctcgtggctctaatttttgacctctggagcatagagccttcacgtggc

SEQ ID NO: 45468 - DNA, 201 bp, Homo sapiens
tggatggattagtaggtggatggatgggcaattggatgtgtagatgagtggatggatggatggataaatggatgggtggatgagtggatggatggatgatggatggatggatggatggatggatggatggatgagtaaatggattgatgggtgaatgaatggatggatggatggagatataaaagggtgtgtgtttgcatc

SEQ ID NO: 45469 - DNA, 201 bp, Homo sapiens
acctagagcacctgctcctgaggaccaatatttttatctttcttgctcactacgtatcttcagcacctagcaaagtacctggcacacagtaggtgctcaaragacagttaataaatgttttattactatgataataataaaagcaaccatttgcattgagccaaacactgctcgttgctttctctctcatttttttaatcc

SEQ ID NO: 45470 - DNA, 201 bp, Homo sapiens
aaaggagacgtggagcaagaatgaatcacgtgcctaagaatccctgtctcaggctctgcttttagggatgccctgacatgaagggaggtgatcggtgttatttttttttttttttttttttttttgagacggagtcttgctgtctcccaggctggagtgcagtggtgcagtcttggctcactgcaagctccgcctcccagg

SEQ ID NO: 45471 - DNA, 201 bp, Homo sapiens
tggggattttcaagaagcctaacattaaaggattttaggaaccagcaactccaagccatccatttgacaggtggaaagactgaggcccagagagagggtarggggcaggacttgctcacacagcaaggccatgacagacctgagctgggacgcagcccaggacaaacacgggcctccccacagcccagcccaaaggctctt

SEQ ID NO: 45472 - DNA, 201 bp, Homo sapiens
aaggagacgtggagcaagaatgaatcacgtgcctaagaatccctgtctcaggctctgcttttagggatgccctgacatgaagggaggtgatcggtgttatttttttttttttttttttttttttgagacggagtcttgctgtctcccaggctggagtgcagtggtgcagtcttggctcactgcaagctccgcctcccaggt

SEQ ID NO: 45473 - DNA, 201 bp, Homo sapiens
agaagtgggaaatttggattaaggcacactgtcccaattatttttattgttggcaaagaatgcaaataataatttttttttaagaattaaacaaacatggrccaaacaaaacgtgtccatgaaccggccatttgggttgggcagtttggtagccattttgccatctgagcagagtacacactcacagaaggtggccccact

SEQ ID NO: 45474 - DNA, 201 bp, Homo sapiens
caggctctgcttttagggatgccctgacatgaagggaggtgatcggtgttatttttttttttttttttttttttttgagacggagtcttgctgtctcccargctggagtgcagtggtgcagtcttggctcactgcaagctccgcctcccaggttctcgccattctcctgcttcagcctcccaagcagctgggactacaggc

SEQ ID NO: 45475 - DNA, 201 bp, Homo sapiens
acttagcaaaatgttttcaaggctcgcccacagtgcagcttgtatccgtttttgttcctttttatggatgaatactactttattgtatggataggccacaytttatttatctttcatcagttgatgaacatttggggtgtctctactttttggttattatgaataaagctgctatgaatgtataattttttgcacagacat

SEQ ID NO: 45476 - DNA, 201 bp, Homo sapiens
ggttacttatttatttggtgagtttatttccagaatggtttggtgcagcttgtaaagatgtttcagctcttggaacaagatgtaaatttcaaaataggagmgaaaaatgaggcaatgtgaaaaataaaggaggaggaggaggaggaggcaggaatgagtttgaacacaaagagtgggccagagagtctttggtgctgctgg

SEQ ID NO: 45477 - DNA, 201 bp, Homo sapiens
tggccagcatggtgaaacccccgtctctactaaaaatacaaaaattagctgggtgtggtggcacatgcctgtaatcctagctacttgggaggctgaggcamgagaatcacttgaacctgggaggtggaggttgcagggagccgagatcacgccactgcactccagcccaggtgacagagtgagactgtgcctcaaaaaata

SEQ ID NO: 45478 - DNA, 201 bp, Homo sapiens; identical to SEQ ID NO: 10311

SEQ ID NO: 45479 - DNA, 201 bp, Homo sapiens
ggttcaggcactggcatcccagctgctggcaagcgactcagatggcgttgtcatggcgaccctcaggcacggatttccagagatgctccctgcatcctccygagcctgccactgctgattgctgggggagagcatgactcaccgttaaatatatcacggtcgtcccaaattggctgctcagccccagcagccggatgtagg

SEQ ID NO: 45480 - DNA, 201 bp, Homo sapiens
agcattttctacttcttaaaccaagagcattcctaactgataaatcataaatcatacttcagatctcatcttaaatgtcaactttctcagaaaagcctccyccatctcccaatggaaattaggcatctttatcattctggactttgttttggtagcattcatcccaatttatgcttacattttgtgtgtctattgaggcct

SEQ ID NO: 45481 - DNA, 201 bp, Homo sapiens
ataagacggaggagaatgttgggagcgtgaagtcctcagcgggcctgcagcagtcagacctaattactcaggcaggctcacccctaccagatagggtcagygcaggaaaggggactgcaaagcgtgcccggggctgcagctcaggtggccaatggccctagaagccccctccaccctctaagctcaaaagactgtctttcc

SEQ ID NO: 45482 - DNA, 201 bp, Homo sapiens
atatatgatttaatggatgcatgagtggatggatgaatgagtggatgaatggatggattagtaggtggatggatgggcaattggatgtgtagatgagtggdtggatggatggataaatggatgggtggatgagtggatggatggatgatggatggatggatggatggatggatggatggatgagtaaatggattgatgggt

SEQ ID NO: 45483 - DNA, 201 bp, Homo sapiens
gaatggatggattagtaggtggatggatgggcaattggatgtgtagatgagtggatggatggatggataaatggatgggtggatgagtggatggatggatgatggatggatggatggatggatggatggatggatgagtaaatggattgatgggtgaatgaatggatggatggatggagatataaaagggtgtgtgtttgc

SEQ ID NO: 45484 - DNA, 201 bp, Homo sapiens; identical to SEQ ID NO: 10317

SEQ ID NO: 45485 - DNA, 201 bp, Homo sapiens
ggagtggttcagtaagggatgcaggggtagtgttgtttgaggaatgcagtcttttttcgttgttatcattctgtccctgtttgtgtacataacccatttaragataaggtcaaaattctaaaaatactggaatgtcagttttctgaatagctactatatttccctagtatgaaagtcaaagtgttcaaaagggcacacagt

SEQ ID NO: 45486 - DNA, 201 bp, Homo sapiens; identical to SEQ ID NO: 10307

SEQ ID NO: 45487 - DNA, 201 bp, Homo sapiens
gaactcctcctcccccatggttgcaaagttccaagatccactctcatgaagccatcttgtgtcacatgcccatccctcagtcaatcacaaaggctgggagrgttggtctatgctgattggaccaggcagagccacatggccactcctggagctggaggtggcctcagagtagagacatcagaagagggtgagagagaggtg

SEQ ID NO: 45488 - DNA, 201 bp, Homo sapiens
cagcagacagtctcagaacaaggacaggaggcaaagaccgagaccgggccaccccgaggctggtgatctgagtgggtggggtgatgtgggctgagatttcmcctgtgatgacagctggcatctattagacactcaccgtgtgctgctggaagctgtcctagcactttgcctgtgctaacacatttcatcttcacagcagtt

SEQ ID NO: 45489 - DNA, 201 bp, Homo sapiens
ctccctagcaccagggacactggtcgcctttctcctcctcttcttgccaatctcttccctgccccaggacccttgcacttgccgtgactgctgcccggacsggcctttccccagatctttgcgagctggctcctttgcattcctcagatccgcactcacgcatcacctcctcagtgaggccctccaaagccgttgggctaa

SEQ ID NO: 45490 - DNA, 201 bp, Homo sapiens
cattgaattcccacatgacaacccagtgagggaggaactctggtgatccccattgcacagatgaagaaattgaggctcagggaggttaagaaacttgtccraggcctcacagctggaaaattgaaaacagattaaaatgcaagtcctggttcttaaccaacacattctagtgcctccctccccctggatctagctcattca

SEQ ID NO: 45491 - DNA, 201 bp, Homo sapiens
ctcagccaggcacggtggctcacgcctataatcccagcactttggcaggccaaggcaggtggatcacctgaggtcaggagttccagaccagcctggcgaayatagtgaaaccccatctctactaaaaacacaaaaattagccaggcatggtggcaggcacttgtaatcccagctattcaggaggctgaggcaggagaatgg

SEQ ID NO: 45492 - DNA, 201 bp, Homo sapiens
ttttcattactgtttattgaatgtctactgtataccaggccctgaacggggcactttacaggctctcagtcagtccttcagtctgagagactagggctcayttatttatttttaaaattcagttcctcaatagttattaagcacctactatgtaccagacacaggtctaggcatgagagatgctgaagttacaaagatggt

SEQ ID NO: 45493 - DNA, 201 bp, Homo sapiens
ccaatctcttccctgccccaggacccttgcacttgccgtgactgctgcccggaccggcctttccccagatctttgcgagctggctcctttgcattcctcaratccgcactcacgcatcacctcctcagtgaggccctccaaagccgttgggctaaagtagtcccctatctcctgcccgtcttttttaatcctctaattctg

SEQ ID NO: 45494 - DNA, 201 bp, Homo sapiens
ggtcagagaccaccattaggtccaggggaaatacctgaaataggatttgcttaatagtcttctttagattaagtcattaattttactaaatcgagttgttwtaacaggaaatttgatattatgaagaactggtgccatttgccataaatcatgtcataaaattccagccagatgctgaagcctgatacctactctctgggt

SEQ ID NO: 45495 - DNA, 201 bp, Homo sapiens
atggtggcaggcacttgtaatcccagctattcaggaggctgaggcaggagaatggtgtgaacccaggaggtggaggttgcagtgagccaagctcacaccaytgcactccagcttgggtgacagaacaagactctgtctccaaaaaaaaaaaaagaaagaaactgaggctctaagaggtggtggaagctcctcaccctggcc

SEQ ID NO: 45496 - DNA, 201 bp, Homo sapiens
tgatttcattgctgcctgacaaccacctgtgcagggggtattattctgagccccattttacagatgaggaagctgaggctcagagagttaatgtgatcatmcatgccagagttcaacctatatctagaactaatctgcttgcccaaaagctgaagtggttccaaactctgtactaagagtgtctacctgttttgtctgact

SEQ ID NO: 45497 - DNA, 201 bp, Homo sapiens
tcgggatctctggggatgggacccagggattggtgtttttcaaagctcgcaaggtgattccactgtgcagccaaggttgagaaatccagatttcaatgtawctaatactggtggtgtgtgccccacattgctacccacaagggttcagcaagtccattgggctgcaggaaggggcttattggagactggggtggcctggct

SEQ ID NO: 45498 - DNA, 201 bp, Homo sapiens
gttgcagtgagccaagctcacaccactgcactccagcttgggtgacagaacaagactctgtctccaaaaaaaaaaaaagaaagaaactgaggctctaagargtggtggaagctcctcaccctggccttcaaagctctgcctgattagcccacagtcgcccagctgggtaagtgttaaagctgagatgtgaacccagggcct

SEQ ID NO: 45499 - DNA, 201 bp, Homo sapiens
tggtactattggcacctagtgggtagatgccgggatgccgctaaacatccacagtgcacaggacagccccacaacaaagattcattcagcccaaatgatgrtagtgctgaagttgagaaactctactttaggaccaggtacggtggcttgtgcctgtaatcccagcactttgggaagctgaggcaggaggatcacttgagc

SEQ ID NO: 45500 - DNA, 201 bp, Homo sapiens
aaataaagattcccaaggcagcagcccctggctaaatccacggtgattgtcttggccactccagcctgactccggggacattagccagctcccacgtgtgrttacagccagaaacaggccatttgtgtggtctggaacccctgctgattgttccttggaaaacctgaaccagaatgagctcttctatatgccagagaattt

SEQ ID NO: 45501 - DNA, 201 bp, Homo sapiens
tttttccttttccctttcactcccatatggcttagcacaccagtgttgctgatcctgtctttattgaaaatatagatattttgttcatcatggggggtttyacattaagtttgattttttaaatgttacattaaagtagtatttatcttgcttactgagttatttggcaatgccttaaatttcacacccttaatttttttc

SEQ ID NO: 45502 - DNA, 201 bp, Homo sapiens
aatggatggattagtaggtggatggatgggcaattggatgtgtagatgagtggatggatggatggataaatggatgggtggatgagtggatggatggatgatggatggatggatggatggatggatggatggatgagtaaatggattgatgggtgaatgaatggatggatggatggagatataaaagggtgtgtgtttgca

SEQ ID NO: 45503 - DNA, 201 bp, Homo sapiens
cccccaactcacccacctccagatgctgagctattagattgtttgctcactgtagagtgctgtacccaggtgaaaggggttcagtttggcatgggtggtgktgaagtgtggccctgctctaagcgctactcagagccgaagcatccaggtcgttttgcagctggggtcagggctgcagccaggtcctcacctaccccaagg

SEQ ID NO: 45504 - DNA, 201 bp, Homo sapiens
tggggcctgtgagggaggctcttggaatgttctggagcccacccaaagggcagctcagcgaaggcaggaacgatgtcggtgttgttcactgctgcgtcccmgcatctagcagagtccatcctcataccgaaggcgttcagtgccacctcgtcaataaatgaatgagtaggtgggtctgagtcccattggctatggctgcaa

SEQ ID NO: 45505 - DNA, 201 bp, Homo sapiens
ctgattggcttgattggggtcacatgcccagactctgccaatcgttgttgccaggggaatgcaccgttctgattggccagacctggagccagaggtgaggycaggctacaagccacgtggcttgagagctgggaagggatagttcccccaaagggtgagatggtttgttgctaaaaagaagccccctcttcctccaggtat

SEQ ID NO: 45506 - DNA, 201 bp, Homo sapiens
atggatggattagtaggtggatggatgggcaattggatgtgtagatgagtggatggatggatggataaatggatgggtggatgagtggatggatggatgatggatggatggatggatggatggatggatggatgagtaaatggattgatgggtgaatgaatggatggatggatggagatataaaagggtgtgtgtttgcat

SEQ ID NO: 45507 - DNA, 201 bp, Homo sapiens
tccaagaagacagcatggagctgtccatgctggggacccttcctcatttgtatgttcccccttctaaaactcccttgccatggaaatgctcctcttggtattttttttaagggtttgattggggtataattcaaatgccataaaattcacccatttaaaatgtataattcaatagtttttagcatattcaaaaagttgtga

SEQ ID NO: 45508 - DNA, 201 bp, Homo sapiens
atggatgaggggctggcccaggcagggattccatccgcatattcctgatccagggcatctcgcggacccagctcttggcccagcattccctaaggaacccmtgactgcttctctggcactgtttaatcttttccctcatcgctggctacacgtctaatgatttattcctgggctcccaaaccagattcctgcagaagccaa

SEQ ID NO: 45509 - DNA, 201 bp, Homo sapiens
agttagattcaacttacaggccaccaattttcagcttgtctctctttgcttcgtacggatgggggaaactaagtcacagatatatgtcatattatacatatatatatatatatatatatatatatttggccttatcactgaggctgaattaggtgctttctcctagggtggtcttggtagtgtgtctctgagaaggtgaca

SEQ ID NO: 45510 - DNA, 201 bp, Homo sapiens
gttagattcaacttacaggccaccaattttcagcttgtctctctttgcttcgtacggatgggggaaactaagtcacagatatatgtcatattatacatatatatatatatatatatatatatatttggccttatcactgaggctgaattaggtgctttctcctagggtggtcttggtagtgtgtctctgagaaggtgacat

SEQ ID NO: 45511 - DNA, 201 bp, Homo sapiens
ttagattcaacttacaggccaccaattttcagcttgtctctctttgcttcgtacggatgggggaaactaagtcacagatatatgtcatattatacatatatatatatatatatatatatatatttggccttatcactgaggctgaattaggtgctttctcctagggtggtcttggtagtgtgtctctgagaaggtgacata

SEQ ID NO: 45512 - DNA, 201 bp, Homo sapiens
acaagccctgggccagccctccacatccgcgttcccattaaatattcacagttccacgattaaggaagtctcactgtctcccactgcagatggggaaagcraggcttggagcggtgaaggaatttgtcctgggtctagcatgaagctccaatgctggaacccagtgcggagcctgtttttcccaccattgtgttgtggctg

SEQ ID NO: 45513 - DNA, 201 bp, Homo sapiens
tagattcaacttacaggccaccaattttcagcttgtctctctttgcttcgtacggatgggggaaactaagtcacagatatatgtcatattatacatatatatatatatatatatatatatatttggccttatcactgaggctgaattaggtgctttctcctagggtggtcttggtagtgtgtctctgagaaggtgacatat

SEQ ID NO: 45514 - DNA, 201 bp, Homo sapiens
agattcaacttacaggccaccaattttcagcttgtctctctttgcttcgtacggatgggggaaactaagtcacagatatatgtcatattatacatatatatatatatatatatatatatatttggccttatcactgaggctgaattaggtgctttctcctagggtggtcttggtagtgtgtctctgagaaggtgacatatg

SEQ ID NO: 45515 - DNA, 201 bp, Homo sapiens
gattcaacttacaggccaccaattttcagcttgtctctctttgcttcgtacggatgggggaaactaagtcacagatatatgtcatattatacatatatatwtatatatatatatatatatttggccttatcactgaggctgaattaggtgctttctcctagggtggtcttggtagtgtgtctctgagaaggtgacatatga

SEQ ID NO: 45516 - DNA, 201 bp, Homo sapiens
tagccaccaggtaattccacattctgtgaaaaatatataagatcctgaattaagggaaaacatttgttctccacttttgccacctccaccctggccatagwggatcccgaggtgtgtttgattagcagaggattctatctcaaatagggaagactcctagactgttctcagctattctcattgacaaggctagggagtgcc

SEQ ID NO: 45517 - DNA, 201 bp, Homo sapiens
gcggcaggaaggctggagatcagtcaccaagtacaaagaccacggggtcctggggccttcccaggagccagagtggcccagaaggactggacttttaggcrgggcttctcagcctccgcactggtgacatttggggctggagagttctctgctgtggggccgtcctgtgattgttcagcagcatccctggcgtatactcat

SEQ ID NO: 45518 - DNA, 201 bp, Homo sapiens
ttgacctctctgtggcttggtttcttcatctgtaaaattggatgaaaatgatcgattgttttgagtattaaatgagttattgcattcaaagcacttagaaragggcctgacacattgtcggtactcagtaaatgttagttattatgttcattatctattcagtgtactcaatggtgccaacttatatgactcactaggatt

SEQ ID NO: 45519 - DNA, 201 bp, Homo sapiens
gtgcaatcagagctcactgtaacctcaaactcctgggctcaagtgatcctcctgcctcagcctcctgagtagctgggactacaggtgcacaccatcactcytggctacattagaaatttttttttgtggagacagggttttgctacattgtgctggctggtctcgaactcctgggttcaagtgatcctcccatctaagctt

SEQ ID NO: 45520 - DNA, 201 bp, Homo sapiens
ggaaaccctgtgttgcagccagggctcttagatgacacttttttggagagagtgggatcctcaggaattttgttcaaatgctgacatctgaccgcttgttyactttatgtgtcaactcctgggctttggttgctcctgccagaccccagtgcaggctgggagagtttggaggattccagatgcaatctagaatctgcccag

SEQ ID NO: 45521 - DNA, 201 bp, Homo sapiens
cagaacaagactctgtctccaaaaaaaaaaaaagaaagaaactgaggctctaagaggtggtggaagctcctcaccctggccttcaaagctctgcctgattwgcccacagtcgcccagctgggtaagtgttaaagctgagatgtgaacccagggccttctgattccactgagccccctgcttctccccctcacacatactgc

SEQ ID NO: 45522 - DNA, 201 bp, Homo sapiens
gggggagcttccaccagtgggtatacctcctcccgtccttctctccaccactccttgatctatggaagaagggaacaggcatttcttgaggacctggtagrtgccatgcactttctttgtgatatctcagtgtgattcagccccttccttcctgtggatcctaaacgcaagtcattttacctctatgaatcttagctctct

SEQ ID NO: 45523 - DNA, 201 bp, Homo sapiens
gattccactgagccccctgcttctccccctcacacatactgcgtgccctgttgcctgaagtagctctggaaacatgccagcagctatgtctctccaatgcyggacagaggaatcacgtggaagtgtttgtaaagatgtgaactcctgggtcctagcacagatcacctgaatcattatctctgtggaagaccctgggatctt

SEQ ID NO: 45524 - DNA, 201 bp, Homo sapiens
gtgattcagccccttccttcctgtggatcctaaacgcaagtcattttacctctatgaatcttagctctctcacctgtaaaattaagataacaattttgttmagtcagatcactttttatttgcaagggtcagaaatccagcccaactggcctaatccaaaaagagcattcatcagttcatattgttggaaaatccaaaggg

SEQ ID NO: 45525 - DNA, 201 bp, Homo sapiens
gacaaggatcagggttcagtctgagactgaggtcagtacatgacctgggtcatagatcacactaggagttagtctgtgatcagagtcagggatcagtatgyaactagggttaaggatcagtgtgtgaccagggtcaaggcttagcctaggaccagggttatgaaggaatgtgcggccagggtcaagattcagtgtgacccg

SEQ ID NO: 45526 - DNA, 201 bp, Homo sapiens
tagctctggaaacatgccagcagctatgtctctccaatgccggacagaggaatcacgtggaagtgtttgtaaagatgtgaactcctgggtcctagcacagrtcacctgaatcattatctctgtggaagaccctgggatcttcattgacagcaaactaccccagtggatttcaacaccaggagagtggttgggaggaggagg

SEQ ID NO: 45527 - DNA, 201 bp, Homo sapiens
atgctaaactatccaaaaacatatccaccacactaatacctacctcctgggtacttgtgaggattaattgagatagtatgctgtgcctggctcccagtacmtgctcagttactccatagccagccttgtcaactccttcctgaacctctgactatccatctctgacccagcctcagagtgagacaggcatgaattcaagtc

SEQ ID NO: 45528 - DNA, 201 bp, Homo sapiens
ggggctccaagcctcagatccatcctctgaaaaatgaaggtgaaaagaggagctacttcctggggtgatggtgaataaatgctttggtacctcacatgtcrcgggtgtgcagtaaatggtggtctcccctcttgccagttttctctctgtgtgcacacctgccctagccaaactggcttgactgttattccccacctccaa

SEQ ID NO: 45529 - DNA, 201 bp, Homo sapiens
ggctccaagcctcagatccatcctctgaaaaatgaaggtgaaaagaggagctacttcctggggtgatggtgaataaatgctttggtacctcacatgtcgcrggtgtgcagtaaatggtggtctcccctcttgccagttttctctctgtgtgcacacctgccctagccaaactggcttgactgttattccccacctccaacc

SEQ ID NO: 45530 - DNA, 201 bp, Homo sapiens
taggagtaacccagattcttatgcctgaaggacaggcagacgggggaccagcgtatacctggctggctcctgctccccctcgtcccctcttctacttgggytccaagggcaaaaccaggacactttaggagcccctgggacaggggaagattggagagtgtcctccaatccttgcatgttctgctgcagctggggccagag

SEQ ID NO: 45531 - DNA, 201 bp, Homo sapiens
agctctggaaacatgccagcagctatgtctctccaatgccggacagaggaatcacgtggaagtgtttgtaaagatgtgaactcctgggtcctagcacagaycacctgaatcattatctctgtggaagaccctgggatcttcattgacagcaaactaccccagtggatttcaacaccaggagagtggttgggaggaggaggg

SEQ ID NO: 45532 - DNA, 201 bp, Homo sapiens
aagatggatggatcacgaagtcaagagattgaaaccatcctggccaacatggtgaaacccatctctactaaaaatacaaaaattagccaggcatggtggcrtgcgcctgtagtctcagctacttgggaggctgaggcaggagaatcacttgaacccgggaggcagaggttgcagtgggctgagattgcgccacttcattcc

SEQ ID NO: 45533 - DNA, 201 bp, Homo sapiens
tgagacacgagaattgtttgaacccaggaggtggaggttgcagtgagctgagatcgcaccactgccctccagcccaggcagcagagcaagactctgtctcaaaaaaaaaaaaaaaaaaaacccaagagtccccagatgggcctagaatccacatctccagagctgtgttaagatagttctcagctggaggtgattttgacc

SEQ ID NO: 45534 - DNA, 201 bp, Homo sapiens
atacgataagcgaaaaaacatgatattccaagagataggcgtggtcctcccccaaattttggttgctgggaagactggcagtccctccccagctggatccmctaggccttttgccagcatcacctacagagaggaaagagccgtgggctctgtcacaaggctggggctcacagcatcacagcccccaccccctgcaccacc

SEQ ID NO: 45535 - DNA, 201 bp, Homo sapiens
ccagcttcattttttcatagccattatcatagcctgaaatgatcctgttgacttattattgttcactgtgtgccccttccctctacaaaaccatcagctcygtgcaaactgggatttttgcctgaattgtttactgcagtattaccagggcctaaaagattacctggcacatccccacatgaatgaatgaatgaatgaatg

SEQ ID NO: 45536 - DNA, 201 bp, Homo sapiens
ttgggtagatggaaggaggcctagttctgcctctgagcagcaatccattaataagcacttacagagtgcctactctgtgcccgaccctgtgctaggcactrtagcagagacagaaaaattaagtcaggactctccttgccaaggaattcactgtcttgttggaaggctcaaaggctgggtctgttgcccaaggcagctcag

SEQ ID NO: 45537 - DNA, 201 bp, Homo sapiens
cctgggtcatagatcacactaggagttagtctgtgatcagagtcagggatcagtatgcaactagggttaaggatcagtgtgtgaccagggtcaaggcttakcctaggaccagggttatgaaggaatgtgcggccagggtcaagattcagtgtgacccgggttaggactcagtttgtggctcattcaggggctggagttaga

SEQ ID NO: 45538 - DNA, 201 bp, Homo sapiens
gttatgagctgtatgttattattattcatttcatttcacaggagaaaacagattttcagttcttgtctgaggtcactcagtaagggaagctgaagaaaatrtggaaggagccccccacggtggctggacccagcatcaggggctctccccatctcctttagtcctctgaacccagagaggcttagctgaactgcaagctga

SEQ ID NO: 45539 - DNA, 201 bp, Homo sapiens
gaatgcttttcccttcactctgcatggttacttcctacttatccttcttagctcttagcctgccccctgcaggctcctgtctcctgatccctgggtatggrgatagggcagggtatagcaagtgtgacccccatgttcctggcttgtggagtctgatgcagatcttgtctggaaagttcttcataccctatggcaggtgtt

SEQ ID NO: 45540 - DNA, 201 bp, Homo sapiens
ttgaataactgaagggatcttccaggagaaccacaagaatggatgtccttgttttccaaagcaggtccttagtgggggacaaacaagggagtcagaggaaractgctgctaatgatactaataataatagcatgttctgcactcattgtgtgtggcctggaggcactctaagatctgccccccttaccacattccttactg

SEQ ID NO: 45541 - DNA, 201 bp, Homo sapiens
cacaagaatggatgtccttgttttccaaagcaggtccttagtgggggacaaacaagggagtcagaggaagactgctgctaatgatactaataataatagcrtgttctgcactcattgtgtgtggcctggaggcactctaagatctgccccccttaccacattccttactgtcccctccacttaacctacttcagccacgct

SEQ ID NO: 45542 - DNA, 201 bp, Homo sapiens
gctgtgtttttagatgtgataatgctattacgactatgttttaaaatctttatcttttagatacacatactgaagtgtttatggacgaaatgacaagatcraataattatgtagttttttttttttttttgagacagagtcttgctctgtcgcccaggctggagtgcagtggctcaatctcggctcactgcaacctctgcc

SEQ ID NO: 45543 - DNA, 201 bp, Homo sapiens
tccttgttttccaaagcaggtccttagtgggggacaaacaagggagtcagaggaagactgctgctaatgatactaataataatagcatgttctgcactcaytgtgtgtggcctggaggcactctaagatctgccccccttaccacattccttactgtcccctccacttaacctacttcagccacgcttgccaaacacgttc

SEQ ID NO: 45544 - DNA, 201 bp, Homo sapiens
atttttgcctgaattgtttactgcagtattaccagggcctaaaagattacctggcacatccccacatgaatgaatgaatgaatgaatgaggtaaatccttmtaagaatctgaccatgttggtattaatagtccctttttatagatgaggaaagtgaagctcatggagatgaagttccttgtgtaaattcaaacagccagta

SEQ ID NO: 45545 - DNA, 201 bp, Homo sapiens
ctgaggcgggaggttcccttgagcccagcagttcgaggctgcagtgagctatgattgtgctactgcactccagcctgggtgatggagtgagatcctgcctytaaaataacaataataaaataaaataaagatccttagggattgtgaggtctgcaaggaatggcactcccttttgcccacaccaaccccttcctgggagct

SEQ ID NO: 45546 - DNA, 201 bp, Homo sapiens
ctgtggctgcatgggaccatgtgagagaagggtagtaggagatgaggttgagaggactttgggggacaggtgagatttggtgagatgggagggaatgaatgaatgaagcctccaatacgataagcgaaaaaacatgatattccaagagataggcgtggtcctcccccaaattttggttgctgggaagactggcagtccctc

SEQ ID NO: 45547 - DNA, 201 bp, Homo sapiens
agactcagccaggcacggtggctcacgcctataatcccagcactttggcaggccaaggcaggtggatcacctgaggtcaggagttccagaccagcctggcraacatagtgaaaccccatctctactaaaaacacaaaaattagccaggcatggtggcaggcacttgtaatcccagctattcaggaggctgaggcaggagaa

SEQ ID NO: 45548 - DNA, 201 bp, Homo sapiens
atgtgatgtataacacaaaccatatatgcaagttttaaagtgcacacaaaacaccaaacacagttttcaagaactcatacaaacaaagcaatatacaggcygggcgcagtggctcacacctgtaatcccaacattttgggaggccgaggcagaaggttcacttgagcccaggagttttaggttgcaatgagccatgatcat

SEQ ID NO: 45549 - DNA, 201 bp, Homo sapiens
tggctcctgctcagaagatcttgttttttgtttgtttgtttgtttgtttgagacagagtctcgctctgtcactcaggctggagtgcagtggtgcgatctcrgctcactgcaacctccacctccctggttcaagcaattcccctgcctcagcctcccaagtagctgagattacaggcacccaccaccacacccagctaattt

SEQ ID NO: 45550 - DNA, 201 bp, Homo sapiens
ttgagcccaggaggtggaggttgcagtaagccaagatcacgctactgcactccaacctggatgacagagcaagactctgtctcaaaaaaaaaaaaaaaaaaaaagaaaagaaaaagaaaagaaaaaaaaaaagaaaataagtggttgagagaatctggatttttgtttgtttgttcagtctcccaagctctttgcaaattg

SEQ ID NO: 45551 - DNA, 201 bp, Homo sapiens
gaggaatcacgtggaagtgtttgtaaagatgtgaactcctgggtcctagcacagatcacctgaatcattatctctgtggaagaccctgggatcttcattgmcagcaaactaccccagtggatttcaacaccaggagagtggttgggaggaggagggccccataggctctagctgccagggaaggtttcctgaggaagagtg

SEQ ID NO: 45552 - DNA, 201 bp, Homo sapiens
tgagcccaggaggtggaggttgcagtaagccaagatcacgctactgcactccaacctggatgacagagcaagactctgtctcaaaaaaaaaaaaaaaaaaaaagaaaagaaaaagaaaagaaaaaaaaaaagaaaataagtggttgagagaatctggatttttgtttgtttgttcagtctcccaagctctttgcaaattgc

SEQ ID NO: 45553 - DNA, 201 bp, Homo sapiens
tctctgtgtgcacacctgccctagccaaactggcttgactgttattccccacctccaaccctttgaatatgcagctgcctctgcctagaacacccctactmccatctctgcctgctggaatccatctctagccctcaagccccagcccaaatgtttcctcctccaatggaacctcacctttttgaggcttggttttcacaa

SEQ ID NO: 45554 - DNA, 201 bp, Homo sapiens
ggcaaatcagggagaggagaggccaccccaggcaggggatcctgtctgagcaaaggtagggaggcaggaatgaggctgctgtgtgcagcgaggtgtcgctyggcccctcctgatgcggggacaggctgcatacaagccagccaggtttcgggggttgagtgacggtcaggttctcccatgagccctggtgcttccaagaag

SEQ ID NO: 45555 - DNA, 201 bp, Homo sapiens
ttacgagagtatctacctcctggggttgatataaggagtaaatgagatcggtcatgcaatgcagttggcgcagtgcctgctttggtgagaaatcaataaawctcagctgttattatatcattagtatcaggcatccagctgctaattcaagcttgcattttccaatagtgccttgcataggaggggtgctcagtaaacata

SEQ ID NO: 45556 - DNA, 201 bp, Homo sapiens
gagcccaggaggtggaggttgcagtaagccaagatcacgctactgcactccaacctggatgacagagcaagactctgtctcaaaaaaaaaaaaaaaaaaaaagaaaagaaaaagaaaagaaaaaaaaaaagaaaataagtggttgagagaatctggatttttgtttgtttgttcagtctcccaagctctttgcaaattgct

SEQ ID NO: 45557 - DNA, 201 bp, Homo sapiens
cctcctggggttgatataaggagtaaatgagatcggtcatgcaatgcagttggcgcagtgcctgctttggtgagaaatcaataaatctcagctgttattayatcattagtatcaggcatccagctgctaattcaagcttgcattttccaatagtgccttgcataggaggggtgctcagtaaacatattgcatttgggtggt

SEQ ID NO: 45558 - DNA, 201 bp, Homo sapiens
aagccaggagttcaagaccagcctgggcaatatcacaagactctgtctctaaaaaaaaacaaaaacaaacaaacaaacaaaaacttaaaaattagtctggygtggtggtgcgttcctgtagtcccagctactcaggaggctgaggcgggaggatggattgggctcaggagttcaaggctgccgtgagctatgatcgcacca

SEQ ID NO: 45559 - DNA, 201 bp, Homo sapiens
gtgcttggcctcagacctctgcttagcaggcatcctcagaggggctttcttaaccctctgcctccctcccattggcactctctccatcgcccactaactcyctccctgccatttcatctgtttgttggctcctctgctgtcttggggacagtgactcccagagcccagcacagtgcctggcacacagaaagcactcaggac

SEQ ID NO: 45560 - DNA, 201 bp, Homo sapiens
tcgaggcttactttatgtatcatataatgcacacccatttccagcatacaatttgataatttttattaaattttaccaaatcgtgcaggctttgccctaartcagtttttagaacacgacgtcctttatgatcattaactgttaatccctatcccccaccctggcaaccactaacctactttctgtctctatagatttgct

SEQ ID NO: 45561 - DNA, 201 bp, Homo sapiens
gtggttggactaaccttctatgccatctggtggccagtagccagctgggtgtgaaaatccaaggtgggcaccaagttatggcaccttagccgagcctgggytgttgactggcagctgtggccagatttgcaggccgggctctaggaactgtgatatcgctgcactccctcaccagctcacagtgcctttgcagggtgtggc

SEQ ID NO: 45562 - DNA, 201 bp, Homo sapiens
ctcacctgcccccagctaacgtagacgtgtttctcccaagcagtgggagggtccctgtctcccttgcctcagctttgcatctgtctctccccgctgccagrcggaggaagactaggtcttacttgctttcgcagaccctctctgtgctgacccagggctgatcatcttttagccttgccataaatttaaaatttattcatt

SEQ ID NO: 45563 - DNA, 201 bp, Homo sapiens
gtatatgaaatatacagcccttcactcattcaatcagtgactaaaacacaccaggcactgcgctaagcacggcagatatagcaataaatgcagcaagcacratccccgcactggagcgcccagcttggttggggagatgggcattacagctaattctacaaatagctgaagctagttcgcaggacccagaagagggtggaa

SEQ ID NO: 45564 - DNA, 201 bp, Homo sapiens
cacaaaccattcacctgttcattcattcaggcagtcatttagtgcaccagtatttgttgagtgccaatgccacatctggctctgtgctgggcagtggggayccagccttgtgaaatagacacagtccctgcccttgatgtgctaacctgggttggtggagaagcggaaaataaatgagtaaacaaacaaataaacaaaatg

SEQ ID NO: 45565 - DNA, 201 bp, Homo sapiens
tggagacccattagactctcagtggatcctgcatgagaaagatcagagatgtgacgacacttgccgaagcatgcccagccagaattaaaagtaggtctccygactacccacgtgtccatttcacctcaatatgaatctctggtgagactaaactgctataatttcataatagatgagaaagatctattgttaagccaccaa

SEQ ID NO: 45566 - DNA, 201 bp, Homo sapiens
cttctactttagaggacgtggagagaagagaggcatcagggaatgtgtacatttgcccagaaacaaagcactgtctcagactcccacaccttcctccatcrctaatcaaaaatgttctggtctttttatataagatggaatctaaatcaacccctcccaacgcctcatctctgggttggttgaacaaatgggggtgtttgg

SEQ ID NO: 45567 - DNA, 201 bp, Homo sapiens
ctcccagagcccaagtcccctttataaataacaaatattttgttaacttctcccaccacttcgtattctaaaatgaaattcacagataatatactatataygtaacttcaaaaaaatcaatatcattccctaactttagaacgaataattacaaggacgtttgtattaaacttgtgtgtgtttcagtatgcaaatgcctgg

SEQ ID NO: 45568 - DNA, 201 bp, Homo sapiens
ctagaagaggcagaaaagagggaagggctgcgtttttgctcatccacgtggccagctggttattacctggatttattaaccagtgtccatctttcaagackcagttgagctgttacatcatccaggaaagctttcttaagcaattcccctacgcctttctactgtgtgccccatgactcaggattttgttctaactggtct

SEQ ID NO: 45569 - DNA, 201 bp, Homo sapiens
ccagctggttattacctggatttattaaccagtgtccatctttcaagactcagttgagctgttacatcatccaggaaagctttcttaagcaattcccctaygcctttctactgtgtgccccatgactcaggattttgttctaactggtctaaagcaggcactattgacatctgaataattatctctcatggggtctgtact

SEQ ID NO: 45570 - DNA, 201 bp, Homo sapiens; identical to SEQ ID NO: 10312

SEQ ID NO: 45571 - DNA, 201 bp, Homo sapiens; identical to SEQ ID NO: 10313

SEQ ID NO: 45572 - DNA, 201 bp, Homo sapiens; identical to SEQ ID NO: 10314

SEQ ID NO: 45573 - DNA, 201 bp, Homo sapiens
agcccaggaggtggaggttgcagtaagccaagatcacgctactgcactccaacctggatgacagagcaagactctgtctcaaaaaaaaaaaaaaaaaaaaagaaaagaaaaagaaaagaaaaaaaaaaagaaaataagtggttgagagaatctggatttttgtttgtttgttcagtctcccaagctctttgcaaattgcta

SEQ ID NO: 45574 - DNA, 201 bp, Homo sapiens; identical to SEQ ID NO: 10309

SEQ ID NO: 45575 - DNA, 201 bp, Homo sapiens
cccaggaggtggaggttgcagtaagccaagatcacgctactgcactccaacctggatgacagagcaagactctgtctcaaaaaaaaaaaaaaaaaaaaagwaaagaaaaagaaaagaaaaaaaaaaagaaaataagtggttgagagaatctggatttttgtttgtttgttcagtctcccaagctctttgcaaattgctaag

SEQ ID NO: 45576 - DNA, 201 bp, Homo sapiens
ccaggattggaacccaactttgtccaaagtcaaagtttgtaggctaaccccttactctctatccagtttcaatatgaaggagctttgagaagttcaagtgrccacagaatccttggtggtactgaaacaattatctgtacaagatcctactaagcgtaagccctgagaagtgctaagacttctggcccttctatggaaacc

SEQ ID NO: 45577 - DNA, 201 bp, Homo sapiens
gtaagccaagatcacgctactgcactccaacctggatgacagagcaagactctgtctcaaaaaaaaaaaaaaaaaaaaagaaaagaaaaagaaaagaaaamaaaaaagaaaataagtggttgagagaatctggatttttgtttgtttgttcagtctcccaagctctttgcaaattgctaagagccaggaaaatgttaacat

SEQ ID NO: 45578 - DNA, 201 bp, Homo sapiens
atacccgggggcatctagtgggtggaggccagagatgctgctgaacatcccagaatgcacaaggcagccccctacctgagtgagccaacccaaaacgccartaggtcgaggttgagaaatgctcggtgaagggcacagattcttgcaccagacttcctggggccaaatcctggctgccgcttactggccgaatgacctcag

SEQ ID NO: 45579 - DNA, 201 bp, Homo sapiens
aacaattaatgtttttaattgtaaaacattaatgtgctgtaaagatagggaacaacccataggttgtgaggtagagcagccctgggttcaaatcccagctstgctacttgttagctgtgtggccttgggcaaagcacttgacctctctgtggcttggtttcttcatctgtaaaattggatgaaaatgatcgattgttttga

SEQ ID NO: 45580 - DNA, 201 bp, Homo sapiens
gacacctaccacagcctcctcactttgattcctgtttctattccagtccccctacaggctgttcctaggtgcagctcggggattattttattttattttatttattttattttattttattttattttattttactattttttgaaacaaagtttcacgttgcccaggttggagtgcaatggcacaatctcggctcacttt

SEQ ID NO: 45581 - DNA, 201 bp, Homo sapiens
agtatttgttgagtgccaatgccacatctggctctgtgctgggcagtggggatccagccttgtgaaatagacacagtccctgcccttgatgtgctaacctrggttggtggagaagcggaaaataaatgagtaaacaaacaaataaacaaaatgatttggccaggcatggtggctcacatctataatcccgtccctttggga

SEQ ID NO: 45582 - DNA, 201 bp, Homo sapiens
tggccaggcatggtggctcacatctataatcccgtccctttgggaggctgaggcggaaggattccttgagcccaagagtttgagaccagcctgggtaacayagtgagatcttatctctacaaaaagaaaaaaaaatagctgggcattgtggcacacatctgtggtcccagctactcaggaggctgaggtgggaggattgct

SEQ ID NO: 45583 - DNA, 201 bp, Homo sapiens
actgcagtattaccagggcctaaaagattacctggcacatccccacatgaatgaatgaatgaatgaatgaggtaaatccttataagaatctgaccatgttrgtattaatagtccctttttatagatgaggaaagtgaagctcatggagatgaagttccttgtgtaaattcaaacagccagtaaatgtcaggggcaagattt

SEQ ID NO: 45584 - DNA, 201 bp, Homo sapiens
aaattcacagataatatactatatatgtaacttcaaaaaaatcaatatcattccctaactttagaacgaataattacaaggacgtttgtattaaacttgtrtgtgtttcagtatgcaaatgcctggtcaggacaacaacaccagaaaacaccatgaggttgtcagatgcttccactatacatagaagcaccatgagtgtga

SEQ ID NO: 45585 - DNA, 201 bp, Homo sapiens
taaacttgtgtgtgtttcagtatgcaaatgcctggtcaggacaacaacaccagaaaacaccatgaggttgtcagatgcttccactatacatagaagcaccrtgagtgtgaccgtgacaaaaacagaggtacaggtgtgctggcagctctgatatcccaagcagcactgacatcagctgcatgacttttccaatacgatgaa

SEQ ID NO: 45586 - DNA, 201 bp, Homo sapiens
cagagaaacagcaagtgcaaacgtcctgaggcaggagtgggcttggcatgtggaagagcagacaggtggccagtgtggctggaagggagtgactatgtgcragagcacagagaaaaagagatcagagaggtcaacaggggccaagtcaggcagggccgtgcagcctccataagagtttggaccttgtttcaagtgcagcag

SEQ ID NO: 45587 - DNA, 201 bp, Homo sapiens
cctccttcatctgcaccttcccttcattctctggcttctcttgaaggttcagctttctttgtctttttctttcgtttgtttgtttgtttgtttgtttgttttttgagatggaatctcactctgtcgcccaggctggagcgcagtcgtgcaatctcggctcactgcaacctctgcctgccgggttcaagccattctcctgcc

SEQ ID NO: 45588 - DNA, 201 bp, Homo sapiens
tatgaaggagctttgagaagttcaagtgaccacagaatccttggtggtactgaaacaattatctgtacaagatcctactaagcgtaagccctgagaagtgytaagacttctggcccttctatggaaaccctgtgttgcagccagggctcttagatgacacttttttggagagagtgggatcctcaggaattttgttcaaat

SEQ ID NO: 45589 - DNA, 201 bp, Homo sapiens
agtgatgaaacttcacaaagactgctgtgacagggcaatgaaagggctgactcaacttaattcagtctaggaaaagctggtgacattgctactgagtcccraaagaaggaagaaagcaaactggtgaaggggcaggggaggtggcaggaaaaggtctctccaggccaggcccagggaacagcaaatgaaaaggtgccgagg

SEQ ID NO: 45590 - DNA, 201 bp, Homo sapiens
ctccttcatctgcaccttcccttcattctctggcttctcttgaaggttcagctttctttgtctttttctttcgtttgtttgtttgtttgtttgtttgtttkttgagatggaatctcactctgtcgcccaggctggagcgcagtcgtgcaatctcggctcactgcaacctctgcctgccgggttcaagccattctcctgcct

SEQ ID NO: 45591 - DNA, 201 bp, Homo sapiens
acccaactttgtccaaagtcaaagtttgtaggctaaccccttactctctatccagtttcaatatgaaggagctttgagaagttcaagtgaccacagaatcyttggtggtactgaaacaattatctgtacaagatcctactaagcgtaagccctgagaagtgctaagacttctggcccttctatggaaaccctgtgttgcag

SEQ ID NO: 45592 - DNA, 201 bp, Homo sapiens
tgccaacacacctgactaatttttgtatttttagtaaagacaaggtttcaccttgttggccaggctggtctcaaactcctgacctcaagtgatctgcccamctcggcctcccaaagtgctgggattacaggcctgcaccaccatgcctggccatctactattttcttaattgttcctctggacatttgttcttaagcctca

SEQ ID NO: 45593 - DNA, 201 bp, Homo sapiens
aattaatttaaacaagttgttgttcacctacctgagtatccactgggacactccaacattgagcaggacaagagaaggttatccatgagcagggctgtctygtgcattacaggtcgcctggtgtcctcagcctctgctcacttcatgcctgtggcatcctctcccatccttgtgacaccctcgcacattttcagggcatgt

SEQ ID NO: 45594 - DNA, 201 bp, Homo sapiens
ccccgttccttccctttccttctggacctcagcttccacatctgtacagtgggtgtggtagctcccatgatcttcaggggccacaccactcagatgtctcraaaatgctcccgttgagtgtgtttctagttatgagaggtcgcttcaacatccccactagggaaggtattgtgtattcattcatccagcaaacatttactg

SEQ ID NO: 45595 - DNA, 201 bp, Homo sapiens
cctgaatatggcctgaactcccatccagaatcttcgtgaggtcgagggagggtcatgtggctgccaatggcataatgagagctcccggcagccagggtctrgcaggatgcaggaaagaggctggtaggggcatctggggctgggccacccttggctgtggccctggaggcagcacaaacccctaccctggagatctctcct

SEQ ID NO: 45596 - DNA, 201 bp, Homo sapiens
agttgttgttcacctacctgagtatccactgggacactccaacattgagcaggacaagagaaggttatccatgagcagggctgtctcgtgcattacaggtygcctggtgtcctcagcctctgctcacttcatgcctgtggcatcctctcccatccttgtgacaccctcgcacattttcagggcatgtccttatgggtagtg

SEQ ID NO: 45597 - DNA, 201 bp, Homo sapiens
agaaggcttgaaagctacagttaaagtacttaggcaagtgcatgcagcaggtgctcaaactgtggttgctgatatttcttgtggtagcaagaagattttcytttttatttccctgcaatgtcattgggttttgctccatcttactcatggggagactgaggctcacagagagaagaagccattccaaagctacatgaccac

SEQ ID NO: 45598 - DNA, 201 bp, Homo sapiens
accacacctgcccacggatcttgtttgttatctgtcaatctttgcattcctaatggtttgtttacttgcactgtcacgatcagggtcctttgcacactacragtggcttgtctttgcctccaatttgtgcacctccctggtaattatccttggaagcagaggaggcaacacaagcacaaataaagattcccaaggcagcag

SEQ ID NO: 45599 - DNA, 201 bp, Homo sapiens
tgggtggagcgtttatttcagggtatgtgtactcgccgggtttttttttagaactatatttattactctggtccccagtccagaaggcttgaaagctacarttaaagtacttaggcaagtgcatgcagcaggtgctcaaactgtggttgctgatatttcttgtggtagcaagaagattttcttttttatttccctgcaatg

SEQ ID NO: 45600 - DNA, 201 bp, Homo sapiens
gtgtcaaggaacttgcttgggttccctcggaaagtggcctcaggccttactctgggtgtgtcccacgcactatgatgtagctgagagagccaaaagctgtrtgaccccagacaagtcattttatctctgtgagcttccatttcttcacctggataacaagggtgatggtactacctcacattcagcaaggttgttgcatgg

SEQ ID NO: 45601 - DNA, 201 bp, Homo sapiens
cagctcatcccctcatgaggtggaagtgatagagcttccacctctcagaccggagcgagattcaacaggtaaatacacacaagccattctgaacggtgccrggcagatggtcctcaaaaagcttagtcctttgcctttccacctggtgctgatccctgtcttaaatgatctgtcttgttttttagtagagacagcgtctca

SEQ ID NO: 45602 - DNA, 201 bp, Homo sapiens
gagatgttgttcattcatccaatgtatatcaagggcctattatttgccatgtactatgttttgtgatgggacacgatgttgaccaagacagataaggtacrtgccctctgagattttatgttctggtctttttggtcatagattgccaccaaatgttctataaacctgaacaaactatgcttcctcttcaggcctcagttt

SEQ ID NO: 45603 - DNA, 201 bp, Homo sapiens
atcagcctggccaacacggtgaaaccctgtctgtactaaaaagacaaaacaaaaaaaaattagctgggcatagtggcccatgcctgtgatcccagctattygggaggctgaggcaggagaatcacttcaacccgggaggcagaggttgcctgccatgagccgagctagtgccactgcactccagcctgggcgacaaagcaa

SEQ ID NO: 45604 - DNA, 201 bp, Homo sapiens
ggagatgagggatggctcttggagtggggtgcctcttccctcctcttccagaatgctttccctgattgttgaggggctgtatcaggctcttgagaggggtrttgggacccccggttattctgtgagcttaggacccccatttcttaacattcctcatagcatccagtgtttgtctctgcccagcctggatgtctgtcataa

SEQ ID NO: 45605 - DNA, 201 bp, Homo sapiens
ctgctcaagtggaacccaggagaagctgtgagcaacctactttccagctcatcccctcatgaggtggaagtgatagagcttccacctctcagaccggagcragattcaacaggtaaatacacacaagccattctgaacggtgccaggcagatggtcctcaaaaagcttagtcctttgcctttccacctggtgctgatccct

SEQ ID NO: 45606 - DNA, 201 bp, Homo sapiens
ggagggactggaagctgcgggtgctgagggaagacaccctctctcaccactgcatgcactctgggctggagttggatcccaggagaaccctgaaccagacytaatatccagaataatcctcactcccactgccccacaccattgccaactctggcaggtcctttcccatggctccctgttacccttaggataaagtcaaag

SEQ ID NO: 45607 - DNA, 201 bp, Homo sapiens
tttcactcccatatggcttagcacaccagtgttgctgatcctgtctttattgaaaatatagatattttgttcatcatggggggttttacattaagtttgattttttaaatgttacattaaagtagtatttatcttgcttactgagttatttggcaatgccttaaatttcacacccttaatttttttcaccctggactcagc

SEQ ID NO: 45608 - DNA, 201 bp, Homo sapiens
gggtactccaggcagagggaacagcaaagatctagaggtggaagcacccatggtggtgagtttgggaactttaagtggtttctgcaggattcagtgtgggwtacaatgggaaataggggaaatggtcaggagagagaagaaaagggatcttaatataaaacccagatctcttcatcaggtctcatcaggcccaccccgctc

SEQ ID NO: 45609 - DNA, 201 bp, Homo sapiens
acagtctcttgcctggacacctaccacagcctcctcactttgattcctgtttctattccagtccccctacaggctgttcctaggtgcagctcggggattattttattttattttatttattttattttattttattttattttattttactattttttgaaacaaagtttcacgttgcccaggttggagtgcaatggcaca

SEQ ID NO: 45610 - DNA, 201 bp, Homo sapiens
gaaaaaactctgggacctactggagaagcccaattcctctgtggctgccaaggtgagtctgggatctgggggctgctggtctggggggatctgcttgcatycccatattgaggaccactgctggaggactctggctttgttcccaacgatgaagattagtaatggggaggggctaggactgagtccccagaggtgaggacc

SEQ ID NO: 45611 - DNA, 201 bp, Homo sapiens
gtccaaaaccagctataaataaatgtaaagaaatgtggagaaataaatacaattaaagtttaaagtgattgtgccactagctaagggcattttgagttcawtgaattttcattgcagtcttgcaatgatccctgtcttacatatagggaaactgaggcacagagggcttaaatcacgttgggaagttccccaggcaggaag

SEQ ID NO: 45612 - DNA, 201 bp, Homo sapiens
aaagttaaaaacatgcccaagtgcagtgtctcattcctgtaatcccagcacttacggaggccaaggtgggaggatcccttgagcccaggagtttgagaccmgcctgggcaacttagtgagaccccatctctacaaaaagtagccaggtgtggtggcatgtgcctgtggtcccagctactcaggaaactgaggtggggggat

SEQ ID NO: 45613 - DNA, 201 bp, Homo sapiens
gctgacactgttaataattgatgggatgttctggcaactcggagacaaaccaaagcacaggccctaggctttgccatcaggggagcgaaaatcaaaacccrttaggcaaaaggcagtgtgattgattcttgtttagaagatggggacagccccattggtgtgacagggttgcggtgctggggctaccacggggctttggct

SEQ ID NO: 45614 - DNA, 201 bp, Homo sapiens
acgtgcacacacacacacgcatgcacacacacacacgcacgcacctgtgatgggatatgagtggtaagtatccccaaggtatggtaaaatggtgaggaaayccaaggatggagcagtcaaccctgcctggggaaagcagggagaactccaaagggaaggggtcacatgggctggatttgaaaagatggattggagttcacc

SEQ ID NO: 45615 - DNA, 201 bp, Homo sapiens
atctgctatctcattgaaattcctccaacagggatacaaccaggtagtatgccagttagggatgctttgggctgcaagcagcagaatagaaaactcaaagyagcttcaataaggaggaagatgcatcattgaatataatatgaagttccaaggcagttggttttaggttgagttaatggctcaatgatgccaccaggattc

SEQ ID NO: 45616 - DNA, 201 bp, Homo sapiens
tggtaagtatccccaaggtatggtaaaatggtgaggaaacccaaggatggagcagtcaaccctgcctggggaaagcagggagaactccaaagggaaggggycacatgggctggatttgaaaagatggattggagttcaccagacagcaagcaagaagctcggacatgcagaattgaccaatgatagtgtgcggctagagga

SEQ ID NO: 45617 - DNA, 201 bp, Homo sapiens
cccaccctggcaaccactaacctactttctgtctctatagatttgctttatctgaacatttcatataaatggaatcatataataagtggctttttgtgtcygacttctctcacttatcataatgttttcatggttcgtctgtgttgtagcatatatcagcacttcattcctttttatggatgaagaatattccattgtatg

SEQ ID NO: 45618 - DNA, 201 bp, Homo sapiens
ttaccgcatacgctgtgtgatgcacattcacacagaccgatggcaggtgtgctctgaccctcccaacccaaccctgagcagcaggcactcccccacacccyccaccttggagtccagtggagcccctccccctgctttgctcgtttcctaggcttccttgggctgagggaaggggagagggagggcacagtctcaagtaca

SEQ ID NO: 45619 - DNA, 201 bp, Homo sapiens
gaaagtactttataagtatgaagtattattgtattcaaaagtgggagtggcctttatttatttatttttaattttttaacttttttcagagacagggtctygctctgtcacccaggctggagtgcagtggtgcaatcagagctcactgtaacctcaaactcctgggctcaagtgatcctcctgcctcagcctcctgagtag

SEQ ID NO: 45620 - DNA, 201 bp, Homo sapiens
agagatggtcaaatgaatgggttggccaaagcttaactaactagaagagaacaagcatgcgttaggcaccaactccatacccagcactttgtgtacttccygtacttgataatgtcatcaggatgggaagcacttgaccttagcactggattgcccaagttcagagtttggcttctctactcactaaccatgtgatttggg

SEQ ID NO: 45621 - DNA, 201 bp, Homo sapiens
tccttcatctgcaccttcccttcattctctggcttctcttgaaggttcagctttctttgtctttttctttcgtttgtttgtttgtttgtttgtttgttttttgagatggaatctcactctgtcgcccaggctggagcgcagtcgtgcaatctcggctcactgcaacctctgcctgccgggttcaagccattctcctgcctc

SEQ ID NO: 45622 - DNA, 201 bp, Homo sapiens
atgaatgggttggccaaagcttaactaactagaagagaacaagcatgcgttaggcaccaactccatacccagcactttgtgtacttcccgtacttgataaygtcatcaggatgggaagcacttgaccttagcactggattgcccaagttcagagtttggcttctctactcactaaccatgtgatttggggtcaactattgc

SEQ ID NO: 45623 - DNA, 201 bp, Homo sapiens
ttcatttcacaggagaaaacagattttcagttcttgtctgaggtcactcagtaagggaagctgaagaaaatgtggaaggagccccccacggtggctggacycagcatcaggggctctccccatctcctttagtcctctgaacccagagaggcttagctgaactgcaagctgaggccaagggatttacagctcagaaatccc

SEQ ID NO: 45624 - DNA, 201 bp, Homo sapiens
ccttcatctgcaccttcccttcattctctggcttctcttgaaggttcagctttctttgtctttttctttcgtttgtttgtttgtttgtttgtttgttttttgagatggaatctcactctgtcgcccaggctggagcgcagtcgtgcaatctcggctcactgcaacctctgcctgccgggttcaagccattctcctgcctca

SEQ ID NO: 45625 - DNA, 201 bp, Homo sapiens
ttcttgccaccccactgctgccttcctgaccctatcctctccctcctgtaccattgcaggagcctctagtcccatctgctgcctccagcctcccatccccygtctggtctccacacacagcaactcacgcccccgctcaaaaccctcctatggctcctgcctcactccgagaaaaagcccaactcctcagtcccactcaca

SEQ ID NO: 45626 - DNA, 201 bp, Homo sapiens
tccaggaacagaggggaggccagcatggctggaggggagtgagcaaggggaggagtaaaggggatcaggccagagagatacggaggggccaggccctgcasagccttgtgggctgttctaaggactttggctgttgtcctcagtatgctgggagatagggaggtgttttgagcaaagaaaagtgccctggtctggcttagg

SEQ ID NO: 45627 - DNA, 201 bp, Homo sapiens
caagaagatagtgaagactatgaacgaccaaaggaaggttactggttaatgtacctgagatgagggggcagagaagagcatggaacaagagaaggctggaragttagtcaggcagggagagactaagcggctgtaacaatgagaccccaaaatacagtgagtggcttcaacaagatggatgtcatgagatagaccaggagc

SEQ ID NO: 45628 - DNA, 201 bp, Homo sapiens
tcaaggatggcttccttgaacaggtgatcttgagctaagaaggatgagtaggaagtaaccaggcagagtgaagggaaaagcactccgggtggagggaacartgtgggaaaggtcccgtggcaagaagatagtgaagactatgaacgaccaaaggaaggttactggttaatgtacctgagatgagggggcagagaagagcat

SEQ ID NO: 45629 - DNA, 201 bp, Homo sapiens
agatgagggggcagagaagagcatggaacaagagaaggctggagagttagtcaggcagggagagactaagcggctgtaacaatgagaccccaaaatacagkgagtggcttcaacaagatggatgtcatgagatagaccaggagctggcaaactttttccataaagggccagtctagcactgagattcgcttccatctcaga

SEQ ID NO: 45630 - DNA, 201 bp, Homo sapiens
gcaagacgtctcttatccctgggtcccactcactgaatgccagtatcaccatgataaccagaaacacctgtcctccctaacatttccaaaatgcctcctgyggcaaaatgccaccaccactgggctagatcactgtctttggagtcacacagccctgggctcaaattcagtttgtcacttagctgtgtgaccttaggcaag

SEQ ID NO: 45631 - DNA, 201 bp, Homo sapiens
aagaggggaagaatagatgttggtgacagctagtggtctttgcaatagtgggccagagagtggttttggggaggccagaaagaagtcctgatgcgggaggrtggggactgtgcaggtggagagaatggaacagatgcgcagatgttggtgaacttgaattgatcagacttagcaaccactatcttcttgccatggggcctt

SEQ ID NO: 45632 - DNA, 201 bp, Homo sapiens
gccatggggcctttcccacactgttcctttcgcctggaatgcttttcccttcactctgcatggttacttcctacttatccttcttagctcttagcctgccycctgcaggctcctgtctcctgatccctgggtatggggatagggcagggtatagcaagtgtgacccccatgttcctggcttgtggagtctgatgcagatct

SEQ ID NO: 45633 - DNA, 201 bp, Homo sapiens
cgatggttaacagcttgagttccaaagccaggctgctcaagtggaacccaggagaagctgtgagcaacctactttccagctcatcccctcatgaggtggargtgatagagcttccacctctcagaccggagcgagattcaacaggtaaatacacacaagccattctgaacggtgccaggcagatggtcctcaaaaagctta

SEQ ID NO: 45634 - DNA, 201 bp, Homo sapiens
gatcgaataaacaatgctgcagtgaataatcttatacctatatcatgaaaactcttgtttaagatccttagaagccaggcgcctgggtcctgcccatagtyacatctactcaggaggctgaggcgggaggttcccttgagcccagcagttcgaggctgcagtgagctatgattgtgctactgcactccagcctgggtgatg

SEQ ID NO: 45635 - DNA, 201 bp, Homo sapiens
ggctaaaacctttgaagacgaatttattatattctacagtagctgggaccacaggtgtgtgccaccacatccggctacgtttttaatttttagtagtgacrggatctcactatgttccccagactggtctcaaactcctgggctcaagcaatcctcctgccttggcctcccaaagtgctgggattacaggggtgagtcact

SEQ ID NO: 45636 - DNA, 201 bp, Homo sapiens
tgtccccatcccctgggagcacctaaattgggactgtgggctgctgttcctcctgagaactcgggtttactgtccctgttctcgggcctcccttgtctctytcactccctaaggagaattgggacagggtccctccagcggagagaagcctggaagacttctatttttttgagactcctggaatattaatttataaagaaa

SEQ ID NO: 45637 - DNA, 201 bp, Homo sapiens
gctcaagcaatcctcctgccttggcctcccaaagtgctgggattacaggggtgagtcactgctctggcctggttgagttttcaatcccaaactggcagtasaggggaggagagagagcacactatgcaggaaaccagaaaaaagagttttaaaagtaagcataggattgctactgggttgtcaggaaagataagaaatcta

SEQ ID NO: 45638 - DNA, 201 bp, Homo sapiens
aatatataatatcactgcatatatgcaaaatgtcaggagtaaggggactggtattcatggggtgtgggtgccatttgaaatagagtggtcagggagagccrttctggggatgtgagatttaagcagagacctgaaagacacaaagaaaggaaacaggcctatatatggggctggagtgttctaggcagagggcacagcaag

SEQ ID NO: 45639 - DNA, 201 bp, Homo sapiens
cacaagctaatgagttagcctgccacaatgccatacatgacggcagaagacacgagatcccaggtcagagacaaaggactttattagtcacagtatagcargcagcacaagcttcatatttgcgtcagttctaattgtctcccaagttccatgagagcaatgaaaacaacccaaatggattctgcacacacagcagcagat

SEQ ID NO: 45640 - DNA, 201 bp, Homo sapiens
tggctcatgcctgtagtcccagctacatggggggctgagacaggagaattgcttgagcccaggaggtggaggttgcagtaagccaagatcacgctactgcwctccaacctggatgacagagcaagactctgtctcaaaaaaaaaaaaaaaaaaaaagaaaagaaaaagaaaagaaaaaaaaaaagaaaataagtggttgag

SEQ ID NO: 45641 - DNA, 201 bp, Homo sapiens
cccccacacacagctaatttttgtattttttgtagagacgaggttttgtcctgttggccaggctggtctcaaactccttgggctcaagtgatccaccctcytcagcctctcagagtgctaggattacaggcatgagccaccacacccaaccttagtttttcgagataaattgaaaatttgcattctaaaacaaaatctctc

SEQ ID NO: 45642 - DNA, 201 bp, Homo sapiens
ctggcttccaaaagcaaccagtacagaggttagggatggggttgaccataaattacctgaataataatttatttatttgagacagagtttccctcttgtcrcccaggctggagtgcagtggctcaatcttggctcactgcaacctccgcctcccgggttcaagcgattctcctgcctcagcctcccaagtagctgggatta

SEQ ID NO: 45643 - DNA, 201 bp, Homo sapiens
acgccttcaggctcagctgaatcaagttgctcaaattatgttctaaggtttctgttttcctccatcacctggaccttttttcctttgtgttggcatcctckcaggcagctccccaagtcatagcaaaaatggctctcagcagccccaggcttgtatctaaccagcccagcagctccagtgggtaccagtagttcctaagag

SEQ ID NO: 45644 - DNA, 201 bp, Homo sapiens
ccgtgtgctgctggaagctgtcctagcactttgcctgtgctaacacatttcatcttcacagcagttctctgaggtagatactgttattatcagcccatttkctagatgaggaaactggggcttagagaggttaaataacatgctcaatgtaaggaaatggcagagctgaggcttgaacctcaaacaggctgacaccagagc

SEQ ID NO: 45645 - DNA, 201 bp, Homo sapiens
accccaaaaagaaaccctgtacccattaacagtcaccccccattccttcctcccctcatctcctggcaaccagtaatctatactttctgtctcgttaggtstacctattctggacatttctcataaatggaatcatacaatatggggccttttgtgactaacttctttcacttagcaaaatgttttcaaggctcgcccaca

SEQ ID NO: 45646 - DNA, 201 bp, Homo sapiens
gtagtcccagctacatggggggctgagacaggagaattgcttgagcccaggaggtggaggttgcagtaagccaagatcacgctactgcactccaacctggrtgacagagcaagactctgtctcaaaaaaaaaaaaaaaaaaaaagaaaagaaaaagaaaagaaaaaaaaaaagaaaataagtggttgagagaatctggatt

SEQ ID NO: 45647 - DNA, 201 bp, Homo sapiens
ttctaaaactcccttgccatggaaatgctcctcttggtattttttttaagggtttgattggggtataattcaaatgccataaaattcacccatttaaaatrtataattcaatagtttttagcatattcaaaaagttgtgaagccatcatcacatctaattttagaacattctaatcaccccaaaaagaaaccctgtaccca

SEQ ID NO: 45648 - DNA, 201 bp, Homo sapiens
gctgtcccctccccggccactgccacacccgtcctcccagctgcaagctaacaacaggctttgtcacgggtgtgcaaccagtgcagtagtaccagacgccmctctcagaagggccccacactttgttagaggctctgctgtcactgtcatgaaatccatagtttttgaacaagggtccccacattttcatctgcactgggt

SEQ ID NO: 45649 - DNA, 201 bp, Homo sapiens
taactgatcgtagcaaaaaaagaggaaggcagaagggactgattggcttatgtaactgaaaagcccaggggtacacgccttcaggctcagctgaatcaagktgctcaaattatgttctaaggtttctgttttcctccatcacctggaccttttttcctttgtgttggcatcctctcaggcagctccccaagtcatagcaaa

SEQ ID NO: 45650 - DNA, 201 bp, Homo sapiens
gaccctcaggcacggatttccagagatgctccctgcatcctcccgagcctgccactgctgattgctgggggagagcatgactcaccgttaaatatatcacrgtcgtcccaaattggctgctcagccccagcagccggatgtagggacaggcagcatctgggggtgtgtgggtttgggaagctgagaggcatgaccttctgt

SEQ ID NO: 45651 - DNA, 201 bp, Homo sapiens
tagagcagacattgactgctattgcccacatcaccccttggagcttgtcctgccatcctggccccttggggtgttctagctaacataaaataagacagatrgatactttggcaggcagagttttagagacttttaaaatcacatgacaaacccacttcgatgaaaagcaagcaaagaaccagtccaaaccctactccaaca

SEQ ID NO: 45652 - DNA, 201 bp, Homo sapiens
ggttggccaaagcttaactaactagaagagaacaagcatgcgttaggcaccaactccatacccagcactttgtgtacttcccgtacttgataatgtcatcwggatgggaagcacttgaccttagcactggattgcccaagttcagagtttggcttctctactcactaaccatgtgatttggggtcaactattgcagccctc

SEQ ID NO: 45653 - DNA, 201 bp, Homo sapiens
ataaataaaacaggaaaggaatagaaggagaggtttctgatgcttgcctatagagcggccttatttcctttgatagtccaagtaggacgatagccaccagrtaattccacattctgtgaaaaatatataagatcctgaattaagggaaaacatttgttctccacttttgccacctccaccctggccatagaggatcccgag

SEQ ID NO: 45654 - DNA, 201 bp, Homo sapiens
cccccattaaagtgtacaattcgatggtttttagtacatacacagagtggtgcaaccatcatcataatcaatttcggaacatttttatcatcccaagaagraactcctaccccttagtagtcactctccatctctccccacctccatcccagccctgggcagccactaacctaattgttatctctctacattgccctattc

SEQ ID NO: 45655 - DNA, 201 bp, Homo sapiens
tggtattatattcgaggaatctttggcaatagggggaaatcataaagcttttccccaaattttttctgagagtttgacagttgtagtcttattttaggtcyttgcatgtggtgtgtaagataaggaaccaacttcattccattgcatggggatatccccattttccccacaccatttgttgccctgggtgattctgcacac

SEQ ID NO: 45656 - DNA, 201 bp, Homo sapiens
tcgcagggctggaaagatgttgctgtctgacagttcccctccatgaggtggcttgagtttcctcacaggaggcatctggttccaagagtgatcataccaaygagcaggaagtgaaagataccagtttctcaaggtctgggtcctgaaactggcactgggtcatttctgccatattctactgaacaagcagttgcagagccc

SEQ ID NO: 45657 - DNA, 201 bp, Homo sapiens
ggataaggggcaatctctgacacacccagcatggctcatcccttcctcttccactcaggacggcttggcagaatgcaagtgagagagtgagatgcaagtgkgagtgacgtgtctaggttgtggccacttcttgccaccccactgctgccttcctgaccctatcctctccctcctgtaccattgcaggagcctctagtccca

SEQ ID NO: 45658 - DNA, 201 bp, Homo sapiens
cgcagggggatggtcatgaatgagttaagcgtgtgtacattattaatagtatcatttcatcctttctaccatctcatgggctgttgggaaactttaacgtygattcagatcaggccatggctacactaagtcaacatctctcactttgatttagtggctaaaaagcctgggctctggaattgttcagaactgggtagcact

SEQ ID NO: 45659 - DNA, 201 bp, Homo sapiens
ctcactttgatttagtggctaaaaagcctgggctctggaattgttcagaactgggtagcactcctagctcggcgctgtgagatgctgtttccagaggagasagcttaaaaaccacagacattcccctccagtccgcagcaagaccagcttcacagggtgggaattttctcttgcccatgttcagcagatctacatccccag

SEQ ID NO: 45660 - DNA, 201 bp, Homo sapiens
tgcaagtgagagagtgagatgcaagtgggagtgacgtgtctaggttgtggccacttcttgccaccccactgctgccttcctgaccctatcctctccctcckgtaccattgcaggagcctctagtcccatctgctgcctccagcctcccatcccccgtctggtctccacacacagcaactcacgcccccgctcaaaaccctc

SEQ ID NO: 45661 - DNA, 201 bp, Homo sapiens; identical to SEQ ID NO: 10315

SEQ ID NO: 45662 - DNA, 201 bp, Homo sapiens
gttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtg

SEQ ID NO: 45663 - DNA, 201 bp, Homo sapiens
aatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcat

SEQ ID NO: 45664 - DNA, 201 bp, Homo sapiens
agttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagt

SEQ ID NO: 45665 - DNA, 201 bp, Homo sapiens
gagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataag

SEQ ID NO: 45666 - DNA, 201 bp, Homo sapiens
agagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataa

SEQ ID NO: 45667 - DNA, 201 bp, Homo sapiens
gaggaaaagggtgagagagtaggactaatggaaggtgttatagtccatgtcaatagtatcctagactgagttcagggtgaatatatggctaggacagaaasaaggcaagtaatccaaagatggattgacacatcaaagtagagcaaaatgagtatagggacccaagagtcttggaaaggcatgcatgaagacatttcaagt

SEQ ID NO: 45668 - DNA, 201 bp, Homo sapiens
tgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatt

SEQ ID NO: 45669 - DNA, 201 bp, Homo sapiens
aagcttgtttcatggagaatttaatattattcttttcttttagttatattctcatattttaaatatatgagttgcatatgaatgtgatgtcacaaaattasttctataatatatagccatctgctggtaagccagctctccaaataaaacacgttttctgccagacattgttcgttgtatctaagtgttgccaaattctct

SEQ ID NO: 45670 - DNA, 201 bp, Homo sapiens
gcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcat

SEQ ID NO: 45671 - DNA, 201 bp, Homo sapiens
gtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgt

SEQ ID NO: 45672 - DNA, 201 bp, Homo sapiens
tgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctca

SEQ ID NO: 45673 - DNA, 201 bp, Homo sapiens
ttgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctc

SEQ ID NO: 45674 - DNA, 201 bp, Homo sapiens
tttattggccttttaccccatcatgtaaaacatttcaggcttttttccccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaat

SEQ ID NO: 45675 - DNA, 201 bp, Homo sapiens
gagtgcctattactagaatattaccaacttttagattggaaatattcaactctaagaactctgatgtgacaaaggcataatttgtagccataattgctttyattccggcccatggtctgattgcattgaaaacacatcagtcagatcaaaagcattcctgtcaattgggaaacctgtgtaaagcatccttcttcatgactt

SEQ ID NO: 45676 - DNA, 201 bp, Homo sapiens
catgaaaatctgatcgaggatttcaactcggggctgattgggcccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcat

SEQ ID NO: 45677 - DNA, 201 bp, Homo sapiens
ttcatggtataaccttgtcactccatacttcattttacaatcttttaaaaaaatttgcactctctataatttgctcttagtctttgtgatataacaagggyctcaaagataaaatgctaatttttaatggtgtcatttcaaagttagaattcgggatcagaaatatgtgttttacttaacccccttccattcacatgaaat

SEQ ID NO: 45678 - DNA, 201 bp, Homo sapiens
aaactctcagtgtgatctagaccaagaatggttctgccaatcagagtgccgacagcatctctgtgaagaaagtgcctggattatatagacacatcacaacyctccaaggaagggctctaatttggaattacctccatcagcccattttcaataagacctacctgagattcaaactaggcctgactcttccaaagtcctcag

SEQ ID NO: 45679 - DNA, 201 bp, Homo sapiens; identical to SEQ ID NO: 10354

SEQ ID NO: 45680 - DNA, 201 bp, Homo sapiens
agaggtcaagctttaattattcaggctaaacaaataattgaacagcttgcatggacttttttcagtgggtttaactgacctaattatgtttttctcagggrtagggactattggcattagtttacatcctgagcccacaggcctagtataggattcagaaattatcaaactatccacaaatttgaagatttaaataaaatc

SEQ ID NO: 45681 - DNA, 201 bp, Homo sapiens
agcaataaatctaaggcttggctgatccaggccccacttggctgctgaagggctggaggtgggaagagggatcaataaataggtgcactagaaacctgccrtggcacacctgtcaggagttgcagtacttccctttgggtggagagaagccaccatgattcacaatggagaaagtagctgaaacctggaatcagtttcctg

SEQ ID NO: 45682 - DNA, 201 bp, Homo sapiens
ctctgcgtggtgaggaaaagggtgagagagtaggactaatggaaggtgttatagtccatgtcaatagtatcctagactgagttcagggtgaatatatggcyaggacagaaagaaggcaagtaatccaaagatggattgacacatcaaagtagagcaaaatgagtatagggacccaagagtcttggaaaggcatgcatgaag

SEQ ID NO: 45683 - DNA, 201 bp, Homo sapiens
ttttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttat

SEQ ID NO: 45684 - DNA, 201 bp, Homo sapiens
ctctttagacttgttcatggtataaccttgtcactccatacttcattttacaatcttttaaaaaaatttgcactctctataatttgctcttagtctttgtsatataacaagggcctcaaagataaaatgctaatttttaatggtgtcatttcaaagttagaattcgggatcagaaatatgtgttttacttaacccccttcc

SEQ ID NO: 45685 - DNA, 201 bp, Homo sapiens
gtagaatttttagttcttttcagtgacttaggctcctaggaaaacctttgtgaaacagaggttctactcaggtaaactctcagtgtgatctagaccaagartggttctgccaatcagagtgccgacagcatctctgtgaagaaagtgcctggattatatagacacatcacaactctccaaggaagggctctaatttggaat

SEQ ID NO: 45686 - DNA, 201 bp, Homo sapiens
tgtatttatttacagcttactcagtaatacaaaggatctgagacagtttctcaagttataaaggcataaaacaaggagtctatgtaattgggatagaataygcggacaaagaaaataaagccacagataagtagataccatgtgaccctgtaaggctgtcttcaaattttgtcctaagctttatggcagtcagtgtaaaaa

SEQ ID NO: 45687 - DNA, 201 bp, Homo sapiens
tgaaaagaagagctggtactatgaaaagaagtcccgaagttcttggagactcacatcctcagaaatgaaaaaatcccatgagtttcacggtattttcctcrgactttgatctaatctcctaattaaatcacactgggtcacagtgatttctgcccttagatattcacaagattagacatgagatgcttctgagacacccag

SEQ ID NO: 45688 - DNA, 201 bp, Homo sapiens
cgttgtttataagccactcaatccagggtactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtga

SEQ ID NO: 45689 - DNA, 201 bp, Homo sapiens
acagaagatggcatttatttgaaattttcttgaacaagtattagctatgttctgctctttctttatgaaaagaactgcaaagtcaagactcctttatctgwcattctgcaatgtatatatacttcaaaacaatatgtcatacacagtatatgcatacaattttatctgtcaattaaaaagagaaacaactcctccatttca

SEQ ID NO: 45690 - DNA, 201 bp, Homo sapiens
gaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaa

SEQ ID NO: 45691 - DNA, 201 bp, Homo sapiens
ttgaatgattggccatgaattagaatgcctacatttacagaagatggcatttatttgaaattttcttgaacaagtattagctatgttctgctctttctttrtgaaaagaactgcaaagtcaagactcctttatctgacattctgcaatgtatatatacttcaaaacaatatgtcatacacagtatatgcatacaattttat

SEQ ID NO: 45692 - DNA, 201 bp, Homo sapiens
caggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacc

SEQ ID NO: 45693 - DNA, 201 bp, Homo sapiens
ccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgt

SEQ ID NO: 45694 - DNA, 201 bp, Homo sapiens
atcccattatgctgatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtagg

SEQ ID NO: 45695 - DNA, 201 bp, Homo sapiens
gatggcaataatcataaagataatagtcatgcaagttattgtatcagccgctgaatagtaagtacctgatgttaatatggttctaattatcccattatgcygatgttcagatcattgtaagcatagtagagttccatcaggcactggtataaaaaattgtatccatattataatagttgttggtatgagaacattttaaaa

SEQ ID NO: 45696 - DNA, 201 bp, Homo sapiens
tgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgtgatcatggctcactgcaacctccacttcctgggctcaggcgattctcgcacctca

SEQ ID NO: 45697 - DNA, 201 bp, Homo sapiens
aaacagtacaggaaagccttattatgattatcatcaccactgcaaacaaatgctggctgaactccatgagtgccgtgacttccttctcctgcttctaggaygcctaatggcgagaagccaatcccatgacacttgtggatggctcagaaatgacagtagttgatttctgtcacttgtctggaatggggcttttggtcatag

SEQ ID NO: 45698 - DNA, 201 bp, Homo sapiens; identical to SEQ ID NO: 10355

SEQ ID NO: 45699 - DNA, 201 bp, Homo sapiens; identical to SEQ ID NO: 10356

SEQ ID NO: 45700 - DNA, 201 bp, Homo sapiens; identical to SEQ ID NO: 10360

SEQ ID NO: 45701 - DNA, 201 bp, Homo sapiens; identical to SEQ ID NO: 10363

SEQ ID NO: 45702 - DNA, 201 bp, Homo sapiens; identical to SEQ ID NO: 10365

SEQ ID NO: 45703 - DNA, 201 bp, Homo sapiens; identical to SEQ ID NO: 10322

SEQ ID NO: 45704 - DNA, 201 bp, Homo sapiens
atatttaagtcagggccacacaaggtaggtaaaaatatctaattattgagtcagaaacataatccctaaccatggagttttactttattgtatatattttrtaagcaaaaattattcattttttttctgtttttcatagactgtaggatgccaatgggactaagcactggtatcatatctgattcacagatcaaggcttca

SEQ ID NO: 45705 - DNA, 201 bp, Homo sapiens
accactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacgtggttcactttcacggccagaccttgctggaaaatggca

SEQ ID NO: 45706 - DNA, 201 bp, Homo sapiens
acttacagtgcttgaatgtattaagggaaacagtacaggaaagccttattatgattatcatcaccactgcaaacaaatgctggctgaactccatgagtgcygtgacttccttctcctgcttctaggacgcctaatggcgagaagccaatcccatgacacttgtggatggctcagaaatgacagtagttgatttctgtcact

SEQ ID NO: 45707 - DNA, 201 bp, Homo sapiens; identical to SEQ ID NO: 10338

SEQ ID NO: 45708 - DNA, 201 bp, Homo sapiens; identical to SEQ ID NO: 10339

SEQ ID NO: 45709 - DNA, 201 bp, Homo sapiens
aaaagatgaatttcttatattatgcttttcctccaagtggaattattagaatatctttaaaggcagagaatggagcacaaaatatttactatacatttgaygaatgactaaatcaatgtaaatggaaggctttatctttttcctgagatttctcctttggctaatttaggagaataatctctcatttgaaaattctgagtt

SEQ ID NO: 45710 - DNA, 201 bp, Homo sapiens
cagaaaattactctcagctttctttgcataacttccttttggcagtgaatctatcatagttctagaccagtgctgtccaatagaaactacgtatgagctayatgcgtaatttaaaattttctgatagcaacattaaaaagtaaagagaaataggtgacattaattttagtaatatgttttacttaactcagtatatcctga

SEQ ID NO: 45711 - DNA, 201 bp, Homo sapiens
gtgaggacagtggacccacccatgatgaccctccatgcctcacacacatctattactcccatgaaaatctgatcgaggatttcaactcggggctgattggscccctgcttatctgtaaaaaaggtaagaacacccccaccaaaagattcaacaactaaatgttggaatggtcaggagttctgtcatgggacaaagcttggg

SEQ ID NO: 45712 - DNA, 201 bp, Homo sapiens
aatagtggcaagagagcatttgggtggtcacactgggaaaagtgtgcctatttggaaattcacaaggaaaatttgccctgtaagctagtaactgaaacagraactgagaagagaaaggtacgagcttgtgttatgaatatgtagataggtgttctcacgcctgatataatttgaaggatgcccaaatgatctcaacccgtc

SEQ ID NO: 45713 - DNA, 201 bp, Homo sapiens
tccagggcattgtcatctgaacccacttagactttgtatatagcacctgttgtctccagatttgtagtgtggatgcccatgtgcatgtctgtttcagcagkagcttaaaagcttcttatgaacaagaatcaagcttctttcatcttcacatctccactacctatcactctcatttcattagtagataatgtcagtacttta

SEQ ID NO: 45714 - DNA, 201 bp, Homo sapiens
tataatcagatatatttaagtcagggccacacaaggtaggtaaaaatatctaattattgagtcagaaacataatccctaaccatggagttttactttattrtatatattttctaagcaaaaattattcattttttttctgtttttcatagactgtaggatgccaatgggactaagcactggtatcatatctgattcacaga

SEQ ID NO: 45715 - DNA, 201 bp, Homo sapiens
attaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcc

SEQ ID NO: 45716 - DNA, 201 bp, Homo sapiens
acacgccccaacgcctggctaatttttgtatttttttgtagagatgaggtttcaccatgttgcccaggctggtcttgaactcctgagctcaagtgatccamctgcttcagcctcccaaagtgctggggttacaggtttgagccactgaacctagctgagaagatgacttcaaagacagtgtcctaaaaaatctaccgggca

SEQ ID NO: 45717 - DNA, 201 bp, Homo sapiens
gatacttgtacagagtcttgagagtcaccaaatgttttcttcccaagctggatgaaataaagcctgttccccaaagcaagaaggtatcaaagaagacagtrtggcaccagattttaaataaccctagaaccattattacttgataaatatgctattttaaaaaataagaatttcttcaagttgaaatcattatggttgatt

SEQ ID NO: 45718 - DNA, 201 bp, Homo sapiens
gccccctttcatatacaaataagatgacagcattaaacttggggcatgatgcttttaccaactgagctaacgtatctatatactcttctattgagactggrggaaatggatacttgtacagagtcttgagagtcaccaaatgttttcttcccaagctggatgaaataaagcctgttccccaaagcaagaaggtatcaaaga

SEQ ID NO: 45719 - DNA, 201 bp, Homo sapiens
atagttaaagtcctgaatcttgggaaacccctcagaccagaacagtcggttaccttcttggttcccttcttggcctaatcctttagcaatccctgtgtttytgagttcacatccaccatctctaagctctgttgttacctgtataatgccatttatcacaatgagttgtcactgcttgtttgctggtcactcagatgtctg

SEQ ID NO: 45720 - DNA, 201 bp, Homo sapiens
tagtgagaatggattaatgctgatacttccacccaattatctaatgccccctttcatatacaaataagatgacagcattaaacttggggcatgatgctttyaccaactgagctaacgtatctatatactcttctattgagactgggggaaatggatacttgtacagagtcttgagagtcaccaaatgttttcttcccaagc

SEQ ID NO: 45721 - DNA, 201 bp, Homo sapiens
acaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaa

SEQ ID NO: 45722 - DNA, 201 bp, Homo sapiens
ctacagccagcaattatttatgagcaattgcttaaaatgctcccacagctttcactggagacatgattattggcatataatattgcctctggtcctatgamtctaagaaaggtaaatacatattggtagggaaagtaaaattttaccttggaaatgagatgcaaacctagtaagcagatagtatcttttatggtaaaagac

SEQ ID NO: 45723 - DNA, 201 bp, Homo sapiens
gaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaag

SEQ ID NO: 45724 - DNA, 201 bp, Homo sapiens
attgcaattctgatgcctaggataatataggcacttgatattcattgaataaataaaggaatgaataaaggaatgaatacaaggtggaggtgtagtataawgaagtggcttaaaagtcacgatctagagacagacatattaaactttaaatcatgatgctgtgtgatattaggcaagatatttaaactctctgaggctcag

SEQ ID NO: 45725 - DNA, 201 bp, Homo sapiens
tcatctcaagattcttaatcatagatacacagtcccttttgccatataaagtagcatatttccaggtcccagagattaggacgtggacatctcagcagggrcacattattctgcctactacacccaccaaacaaagccctcccacggtgtcctccatctcagagaatggcaccctcctccacccagctccccaaatcagaa

SEQ ID NO: 45726 - DNA, 201 bp, Homo sapiens
ctccagcctaggagacagagcgagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagac

SEQ ID NO: 45727 - DNA, 201 bp, Homo sapiens
gacctctgtcccagaaatcagagtttaccattgcttctgtaaccagttactgcaaacttagtggctaaaacaacacaaatttattcttttatgattatatwtctgcagatgagaagtccaaaatgggttttattgggctaaaatcaaggtgttggcagagctgcattccttctggaggctctgggggagaattgtttcctt

SEQ ID NO: 45728 - DNA, 201 bp, Homo sapiens
tcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacgtggacatctcagcaggggcacattattctgcctacta

SEQ ID NO: 45729 - DNA, 201 bp, Homo sapiens
acaggacagggattttcacagtgcttttctatacaatgtctgtaatctatagataacataaccgattaggtcacgggtcgatctttaactaccaggtccakggtgtggcgccgggctgtctgcttgtggatttcatttctgccttttagtttttacttcttctttctttggaggcagaaattgggcataagacaatatgag

SEQ ID NO: 45730 - DNA, 201 bp, Homo sapiens
caaccataatttcttctcttgagttatttcattgtctttctgtcctaactcagctgggatgcaggcttacattgacattaaaaactgcccaaagaaaaccrggaatcttaagaaaataactcgtgagcagaggcggcacatgaagaggtgggaatacttcattgctgcagaggaagtcatttgggactatgcacctgtaat

SEQ ID NO: 45731 - DNA, 201 bp, Homo sapiens; identical to SEQ ID NO: 10353

SEQ ID NO: 45732 - DNA, 201 bp, Homo sapiens
tgatggcaataatcataaagataatagtcatgcaagttattgtatcagccgctgaatagtaagtacctgatgttaatatggttctaattatcccattatgmtgatgttcagatcattgtaagcatagtagagttccatcaggcactggtataaaaaattgtatccatattataatagttgttggtatgagaacattttaaa

SEQ ID NO: 45733 - DNA, 201 bp, Homo sapiens
gacaataactgtactgtgtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaa

SEQ ID NO: 45734 - DNA, 201 bp, Homo sapiens
atatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaag

SEQ ID NO: 45735 - DNA, 201 bp, Homo sapiens
agtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttact

SEQ ID NO: 45736 - DNA, 201 bp, Homo sapiens
taggtcattgaaagttatatagtatttatctggaactgatgttaaaaaaaatagagagccaaaaattatagtagtcatcttgtctctgtaaaatgtaattmaataaatatgtcatgtacactgtatatacataagcaaacatgcaaataaaaaagcagcctactcaaaggttacaataatgttgcaacaattctggtagta

SEQ ID NO: 45737 - DNA, 201 bp, Homo sapiens; identical to SEQ ID NO: 10324

SEQ ID NO: 45738 - DNA, 201 bp, Homo sapiens
aattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacaccttgaccctcttccccat

SEQ ID NO: 45739 - DNA, 201 bp, Homo sapiens
cttctcttgagttatttcattgtctttctgtcctaactcagctgggatgcaggcttacattgacattaaaaactgcccaaagaaaaccaggaatcttaagwaaataactcgtgagcagaggcggcacatgaagaggtgggaatacttcattgctgcagaggaagtcatttgggactatgcacctgtaataccagcgaatat

SEQ ID NO: 45740 - DNA, 201 bp, Homo sapiens
acccctgggtatggaaaatggaaagatagaaaacaagcaaatcacagcttcttcgtttaagaaatcttggtggggagattactgggaacccttccgtgccygtctgaatgcccagggacgtgtgaatgcctggcaagccaaggtcaagtatactctatgcatggtgttctcttagggctccagaagaaagcaaaggccctc

SEQ ID NO: 45741 - DNA, 201 bp, Homo sapiens
tagggttctagctttatatgattttgtgattatgaacaaatcatctttaaacaatccttataaatgaaaaactcgtcgtacacattgtttgaattcatatsatctgtaactttttaatcagatagattattttccaatagaaattgttcagatcaaaatagacatacctcagtatgaatacacagcatacatagtaaaaac

SEQ ID NO: 45742 - DNA, 201 bp, Homo sapiens
gagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgcct

SEQ ID NO: 45743 - DNA, 201 bp, Homo sapiens
cccctgggtatggaaaatggaaagatagaaaacaagcaaatcacagcttcttcgtttaagaaatcttggtggggagattactgggaacccttccgtgcccrtctgaatgcccagggacgtgtgaatgcctggcaagccaaggtcaagtatactctatgcatggtgttctcttagggctccagaagaaagcaaaggccctca

SEQ ID NO: 45744 - DNA, 201 bp, Homo sapiens
ctggaagaggggggtcagtcagtggagtccgacatgtcaggagtcaaaagaggtgtagacatctggactattctataaagatgggggcctgagcctgcccygtggaaggaatagggagagctttggctcaggagtccagagatctgagttctgatcccagcaatgctaccagatcactgactgaccttgggcaagtcacct

SEQ ID NO: 45745 - DNA, 201 bp, Homo sapiens
cagagggtagcagctggaagaggggggtcagtcagtggagtccgacatgtcaggagtcaaaagaggtgtagacatctggactattctataaagatgggggyctgagcctgccccgtggaaggaatagggagagctttggctcaggagtccagagatctgagttctgatcccagcaatgctaccagatcactgactgacctt

SEQ ID NO: 45746 - DNA, 201 bp, Homo sapiens
accccacaaaactttaaaaaatcattttatcatcaaacaaaatacccagatttctcagactggccaatggtatacggcagagtagaacatctggtcttgcrcctcaaggagctcatgctaaaaattggctaccaagacttttgattttactattgtagtttgttttgttctttatttcagtgtacctgaagtaaatagtag

SEQ ID NO: 45747 - DNA, 201 bp, Homo sapiens
agagtcttttccaggaaaaaccgatagctgggggtcattgatttctctacataaaaagcccagcctctctgcagggatttggcaaggatcagataccttastcttatgaccacgcgcccatttccaaaactctcctcagtcatcttttctgggtttgaccacacatgtagtatttcagccagattcacagggtcttatcag

SEQ ID NO: 45748 - DNA, 201 bp, Homo sapiens
tgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactatggtaggagctaaaggcctgttagtgtgctcttaacactgcca

SEQ ID NO: 45749 - DNA, 201 bp, Homo sapiens
agcctgagaaccctagttatctaatctgagaagtgggcagaggagttgtcataccaataagagaataaacatgacttgctatggttgctggatacaccaaygataaactcctaattttataaactcctagacttcctaatttgcctgaaactttctctgaatttagaaggccttaaggtgacatgctgcatatctccttgc

SEQ ID NO: 45750 - DNA, 201 bp, Homo sapiens
ttcacaaggaaaatttgccctgtaagctagtaactgaaacagaaactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaactta

SEQ ID NO: 45751 - DNA, 201 bp, Homo sapiens
ctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttatta

SEQ ID NO: 45752 - DNA, 201 bp, Homo sapiens
gggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctc

SEQ ID NO: 45753 - DNA, 201 bp, Homo sapiens
tccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattct

SEQ ID NO: 45754 - DNA, 201 bp, Homo sapiens
acgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacagggtacactact

SEQ ID NO: 45755 - DNA, 201 bp, Homo sapiens; identical to SEQ ID NO: 10349

SEQ ID NO: 45756 - DNA, 201 bp, Homo sapiens
tgggtatggaaaatggaaagatagaaaacaagcaaatcacagcttcttcgtttaagaaatcttggtggggagattactgggaacccttccgtgcccgtctraatgcccagggacgtgtgaatgcctggcaagccaaggtcaagtatactctatgcatggtgttctcttagggctccagaagaaagcaaaggccctcactac

SEQ ID NO: 45757 - DNA, 201 bp, Homo sapiens
tcctatctatgaatcagtttttctctttatgcttttctctacgacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctggg

SEQ ID NO: 45758 - DNA, 201 bp, Homo sapiens
aggattacaggcatgagccactgcacctggccatggatggtacctaatgttgtaaaatagcataatttaagataaaagcagaagaaaatcagtttaaaaartgattacatttcaggatttcagttgctttcttctaggatgccactatatctattaaagcaccagtcttgttagtgcatttaccattttataatcagatat

SEQ ID NO: 45759 - DNA, 201 bp, Homo sapiens
ctcagaccacagagaaatcaaattagaactgaggactaagaaactcactcgaaaccacacaactacatggaaactgaacaacctgctcctgaatgactackgggtaaataatgaaattaaggcagaaataaataagttccttaaaaccaatgagaacaaagagacaacataccagaatctctaggagacagggctttgctt

SEQ ID NO: 45760 - DNA, 201 bp, Homo sapiens
ctcggcctcccagagtgctaggattacaggcatgagccactgcacctggccatggatggtacctaatgttgtaaaatagcataatttaagataaaagcagragaaaatcagtttaaaaaatgattacatttcaggatttcagttgctttcttctaggatgccactatatctattaaagcaccagtcttgttagtgcattta

SEQ ID NO: 45761 - DNA, 201 bp, Homo sapiens
gacaattctccttaaatgtcatgtcacttcaccaagatagataagaattggacagcagagaattaaaggttgcaatctttgacaaaatcctagagtgtagwtaatctacagacaaaggatgatccaaaggctttgacaatcaaccaaatagaagataggattaaggttctcttttgcagattaaagagcctaactaggact

SEQ ID NO: 45762 - DNA, 201 bp, Homo sapiens
gtgaatcttgctagagatttgtcgattttaaaaaaatcttcttggccgggcgcagtggctcacgtctgtaatcccagcactttgggaggccgaggtgggcrgatcacgaggtcaagagatcaagaccatcctgaccaacatggtgaaaccccctctctactaaaaatattaaaaaaaattaggcagggtggcgtgcacttg

SEQ ID NO: 45763 - DNA, 201 bp, Homo sapiens; identical to SEQ ID NO: 10351

SEQ ID NO: 45764 - DNA, 201 bp, Homo sapiens
atgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgacc

SEQ ID NO: 45765 - DNA, 201 bp, Homo sapiens
gaactttttttcatatttttatattttgtatttttattttttttgtagagaagaggttgcccaagatcaaactcctggcctcaagtaatcctcccccctcrgcctcccagagtgctaggattacaggcatgagccactgcacctggccatggatggtacctaatgttgtaaaatagcataatttaagataaaagcagaaga

SEQ ID NO: 45766 - DNA, 201 bp, Homo sapiens
tttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcatt

SEQ ID NO: 45767 - DNA, 201 bp, Homo sapiens
agaactttttttcatatttttatattttgtatttttattttttttgtagagaagaggttgcccaagatcaaactcctggcctcaagtaatcctcccccctyggcctcccagagtgctaggattacaggcatgagccactgcacctggccatggatggtacctaatgttgtaaaatagcataatttaagataaaagcagaag

SEQ ID NO: 45768 - DNA, 201 bp, Homo sapiens
atgaaaagaagagctggtactatgaaaagaagtcccgaagttcttggagactcacatcctcagaaatgaaaaaatcccatgagtttcacggtattttcctyggactttgatctaatctcctaattaaatcacactgggtcacagtgatttctgcccttagatattcacaagattagacatgagatgcttctgagacaccca

SEQ ID NO: 45769 - DNA, 201 bp, Homo sapiens
agtcacagcaatgtcaaattgctttagaaaaacaaaagtttactaaatatttcattctcatttttctctccttgtgttattttgacccagtaatcaatagktcacagacaagcagtggtccacagcccatacttgaatattcctgacgaaagtttattagaaattacctgccacaatggattattgtgttttcatgtcttt

SEQ ID NO: 45770 - DNA, 201 bp, Homo sapiens
atagtttgcaccaacctaacacatgctgcctgaggagttagtgaaggcagcccctcgacagcactttgggtgacgttgtgtgaatctgcctcagatgcagrcacagaagtccaaatggactggtttgattaagagcagggaaaaaaagagggttcttattggtttttcacatgccagtaactcactaatacatctagagag

SEQ ID NO: 45771 - DNA, 201 bp, Homo sapiens
tgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctatggacatgagagaatttgtcttactatttatgacctttgatgaaaagaagagctg

SEQ ID NO: 45772 - DNA, 201 bp, Homo sapiens
agatgaacgcactggtcatgtgcttagagtcacagcaatgtcaaattgctttagaaaaacaaaagtttactaaatatttcattctcatttttctctccttrtgttattttgacccagtaatcaataggtcacagacaagcagtggtccacagcccatacttgaatattcctgacgaaagtttattagaaattacctgccac

SEQ ID NO: 45773 - DNA, 201 bp, Homo sapiens
gtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagct

SEQ ID NO: 45774 - DNA, 201 bp, Homo sapiens
gatcattccttttcctaggttcgttttaaaaatttagcatccagaccgtattctctacatgcccatggactttcctatgaaaaatcatcagagggaaagasttatgaagatgactctcctgaatggtttaaggaagataatgctgttcagccaaatagcagttatacctacgtatggcatgccactgagcgatcagggcca

SEQ ID NO: 45775 - DNA, 201 bp, Homo sapiens
caatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaata

SEQ ID NO: 45776 - DNA, 201 bp, Homo sapiens
tgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttgctattgtgaagagtgcgaaaatgaacatacgcatg

SEQ ID NO: 45777 - DNA, 201 bp, Homo sapiens
ttagatttttgttaagcttaagtacatttgtggatcattccttttcctaggttcgttttaaaaatttagcatccagaccgtattctctacatgcccatggrctttcctatgaaaaatcatcagagggaaagacttatgaagatgactctcctgaatggtttaaggaagataatgctgttcagccaaatagcagttatacct

SEQ ID NO: 45778 - DNA, 201 bp, Homo sapiens; identical to SEQ ID NO: 10366

SEQ ID NO: 45779 - DNA, 201 bp, Homo sapiens; identical to SEQ ID NO: 10318

SEQ ID NO: 45780 - DNA, 201 bp, Homo sapiens
aaccataatttcttctcttgagttatttcattgtctttctgtcctaactcagctgggatgcaggcttacattgacattaaaaactgcccaaagaaaaccasgaatcttaagaaaataactcgtgagcagaggcggcacatgaagaggtgggaatacttcattgctgcagaggaagtcatttgggactatgcacctgtaata

SEQ ID NO: 45781 - DNA, 201 bp, Homo sapiens
ctgccaagtgggggtcaaagtccaggttccccactccattgccacctaagaagggattgttccttggtggctgggtgggaagggaagttccccatttggcmtccactgatactgcaggggcaggagcttcattaggggctggagatgaaagccctaaatccctacatggccttttctgacacaaccccagtgagggtgtag

SEQ ID NO: 45782 - DNA, 201 bp, Homo sapiens
cagagttactttgaccattaaaatagtaatatgcgccaagtgcctagcactcagtagacaccaacaatggtaactattggagactcaccaagaaatctttratgttccagcaatgcatgccatttcagagattcaaaattgtcctcgtgaattattacttagaaacatctaaatgtctcttatttgtggggatagagctca

SEQ ID NO: 45783 - DNA, 201 bp, Homo sapiens
tacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttgatgttccagcaatgcatgccatttcagagattc

SEQ ID NO: 45784 - DNA, 201 bp, Homo sapiens
agtcacttaagtgatttaagtaggtatttaaatatttgttaatgccagtcattatactggtactaaggctaagagtggtaatcgaggtagacatgagcccygcccttgtagaaatcatacctttggttttttactatgcttagtacataagtaaataaaaatattgcctacagcagtgtcccttttaacaataatgaaatg

SEQ ID NO: 45785 - DNA, 201 bp, Homo sapiens
catcatgtaaattattaaagtcacttaagtgatttaagtaggtatttaaatatttgttaatgccagtcattatactggtactaaggctaagagtggtaatsgaggtagacatgagccctgcccttgtagaaatcatacctttggttttttactatgcttagtacataagtaaataaaaatattgcctacagcagtgtccct

SEQ ID NO: 45786 - DNA, 201 bp, Homo sapiens
ccaaagatggattgacacatcaaagtagagcaaaatgagtatagggacccaagagtcttggaaaggcatgcatgaagacatttcaagtgatcagtaagatkttcagaacaaaaggaattccctgaatgagggttccggcatttgctgcagttctaaagttcagtggccaaaagcactgccatggcagtctgagagaaatgt

SEQ ID NO: 45787 - DNA, 201 bp, Homo sapiens
tcatagcaacatttttaagcaagaggtcaaaggctcacatccttagaaatgcgtttgatcttctattccaagcgtgtgtgtgtgtgtgtgtgtgtgtgtgkacacagacatactctgcgtggtgaggaaaagggtgagagagtaggactaatggaaggtgttatagtccatgtcaatagtatcctagactgagttcagggt

SEQ ID NO: 45788 - DNA, 201 bp, Homo sapiens
tcttggcctaatcctttagcaatccctgtgtttttgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacaca

SEQ ID NO: 45789 - DNA, 201 bp, Homo sapiens
catgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactg

SEQ ID NO: 45790 - DNA, 201 bp, Homo sapiens; identical to SEQ ID NO: 10332

SEQ ID NO: 45791 - DNA, 201 bp, Homo sapiens
ataaccgattaggtcacgggtcgatctttaactaccaggtccagggtgtggcgccgggctgtctgcttgtggatttcatttctgccttttagtttttactwcttctttctttggaggcagaaattgggcataagacaatatgaggggtggtctcctcccttaaaatagtagttctgtttcaaattctttgagaaaccccca

SEQ ID NO: 45792 - DNA, 201 bp, Homo sapiens
aacaggacagggattttcacagtgcttttctatacaatgtctgtaatctatagataacataaccgattaggtcacgggtcgatctttaactaccaggtccrgggtgtggcgccgggctgtctgcttgtggatttcatttctgccttttagtttttacttcttctttctttggaggcagaaattgggcataagacaatatga

SEQ ID NO: 45793 - DNA, 201 bp, Homo sapiens
ccagtaattagaacagaacagaacaggacagggattttcacagtgcttttctatacaatgtctgtaatctatagataacataaccgattaggtcacgggtmgatctttaactaccaggtccagggtgtggcgccgggctgtctgcttgtggatttcatttctgccttttagtttttacttcttctttctttggaggcagaa

SEQ ID NO: 45794 - DNA, 201 bp, Homo sapiens
taatagaattgctaggtcaaattgtagcaggacaagccacagacaaaaacccctcagacaccaagttaaagaaggaagggctttattcagccgggagcttyggcaagactcatgtctccaacaaccgagctccccgagtgagcaattcctgtcccttttaagggctcacaactctaagagggtccacgtgagtgggtcgtg

SEQ ID NO: 45795 - DNA, 201 bp, Homo sapiens
agtagagacagggttttaccatgttggccaggctggtctcaaactcctgacctcgggcaatctgcctgcctcagcttcccaaagtgctgggattacaggcrtgagccattgcgcccggctgaacaatttattttcttttttggctatatacccagtaatagaattgctaggtcaaattgtagcaggacaagccacagacaa

SEQ ID NO: 45796 - DNA, 201 bp, Homo sapiens
gcctcagcctcccgagtagctgggattacaggcacccaccaccatgcccagctaatttttgtatttttagtagagacagggttttaccatgttggccaggstggtctcaaactcctgacctcgggcaatctgcctgcctcagcttcccaaagtgctgggattacaggcatgagccattgcgcccggctgaacaatttattt

SEQ ID NO: 45797 - DNA, 201 bp, Homo sapiens
cctgcctcagcctcccgagtagctgggattacaggcacccaccaccatgcccagctaatttttgtatttttagtagagacagggttttaccatgttggccrggctggtctcaaactcctgacctcgggcaatctgcctgcctcagcttcccaaagtgctgggattacaggcatgagccattgcgcccggctgaacaattta

SEQ ID NO: 45798 - DNA, 201 bp, Homo sapiens; identical to SEQ ID NO: 10337

SEQ ID NO: 45799 - DNA, 201 bp, Homo sapiens
ttcaagcaattctcctgcctcagcctcccgagtagctgggattacaggcacccaccaccatgcccagctaatttttgtatttttagtagagacagggtttyaccatgttggccaggctggtctcaaactcctgacctcgggcaatctgcctgcctcagcttcccaaagtgctgggattacaggcatgagccattgcgcccg

SEQ ID NO: 45800 - DNA, 201 bp, Homo sapiens
cccaggttcaagcaattctcctgcctcagcctcccgagtagctgggattacaggcacccaccaccatgcccagctaatttttgtatttttagtagagacarggttttaccatgttggccaggctggtctcaaactcctgacctcgggcaatctgcctgcctcagcttcccaaagtgctgggattacaggcatgagccattg

SEQ ID NO: 45801 - DNA, 201 bp, Homo sapiens; identical to SEQ ID NO: 10340

SEQ ID NO: 45802 - DNA, 201 bp, Homo sapiens
tcccaggttcaagcaattctcctgcctcagcctcccgagtagctgggattacaggcacccaccaccatgcccagctaatttttgtatttttagtagagacrgggttttaccatgttggccaggctggtctcaaactcctgacctcgggcaatctgcctgcctcagcttcccaaagtgctgggattacaggcatgagccatt

SEQ ID NO: 45803 - DNA, 201 bp, Homo sapiens
tttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcag

SEQ ID NO: 45804 - DNA, 201 bp, Homo sapiens; identical to SEQ ID NO: 10341

SEQ ID NO: 45805 - DNA, 201 bp, Homo sapiens
agtggcacttctgtagtgtggggacccagaatgaaattttgaccatccacttcactgggcactcattcatctatggaaagaggcatgaggacaccttgacmctcttccccatgcgtggagaatctgtgacggtcacaatggataatgttggtgagtaagagtctggacactcacagaggaagcttgctttgaatttctggt

SEQ ID NO: 45806 - DNA, 201 bp, Homo sapiens
ttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaata

SEQ ID NO: 45807 - DNA, 201 bp, Homo sapiens
atccttagaaatgcgtttgatcttctattccaagcgtgtgtgtgtgtgtgtgtgtgtgtgtgtacacagacatactctgcgtggtgaggaaaagggtgagrgagtaggactaatggaaggtgttatagtccatgtcaatagtatcctagactgagttcagggtgaatatatggctaggacagaaagaaggcaagtaatcca

SEQ ID NO: 45808 - DNA, 201 bp, Homo sapiens
cagcagacatcgaacagcaggctgtgtttgctgtgtttgatgagaacaaaagctggtaccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaata

SEQ ID NO: 45809 - DNA, 201 bp, Homo sapiens
tatttatttacagcttactcagtaatacaaaggatctgagacagtttctcaagttataaaggcataaaacaaggagtctatgtaattgggatagaatatgsggacaaagaaaataaagccacagataagtagataccatgtgaccctgtaaggctgtcttcaaattttgtcctaagctttatggcagtcagtgtaaaaaag

SEQ ID NO: 45810 - DNA, 201 bp, Homo sapiens
cacagatcagatagttgtaggtgcgcagccttatttctgagttctctattctgttccattggtctatgcgtctgttcttgtaccagtactatactgttttktcctccagagggcagcagacatcgaacagcaggctgtgtttgctgtgtttgatgagaacaaaagctggtaccttgaggacaacatcaacaagttttgtga

SEQ ID NO: 45811 - DNA, 201 bp, Homo sapiens
gatcagcaggaagattgcagtaaagatgaacagattaggagtaatcctcaacacacaaaaaaaaccagcatttcaaaaggtgacagaagagtaatattcartggcatctagaatattttctctttccatttgcatttgggcacttatgagaaggcaaaatcatagcaatcgttaagagaaaaaataactaattcccactta

SEQ ID NO: 45812 - DNA, 201 bp, Homo sapiens
agaatccagcccatctttcattaaaacaaacaaccacagtgagccacagcatgggaaataacgtgatggactcaccatctgcctatacatacacgctcagrccatacctacatacatgcccaatgtatttactcattatacaaagactttttttccatttcctggtatatataagatactgtgatggtactgaaaaaaacc

SEQ ID NO: 45813 - DNA, 201 bp, Homo sapiens
tttatcccatgagaatccagcccatctttcattaaaacaaacaaccacagtgagccacagcatgggaaataacgtgatggactcaccatctgcctatacayacacgctcaggccatacctacatacatgcccaatgtatttactcattatacaaagactttttttccatttcctggtatatataagatactgtgatggtac

SEQ ID NO: 45814 - DNA, 201 bp, Homo sapiens
ctatcagtagggaaagtccaatatacatggaggtgttaatgatgtgtctttgggtgcacaaagtacaaagtaagacatctaagtttcaggggatggacacrtttcatattcatacagacaaccagcctgcataggggagttagacgctgtggctcgggggaaaaaattgagataatcagatggctaagatgaaataaagag

SEQ ID NO: 45815 - DNA, 201 bp, Homo sapiens
gcatctcttctttcttgacttttcaatcatcgccattctgactggcatgagagggcatctcattgcgtttttctttctttttttgagacggagtctcgctstgtcgcccaggctggagtgcagtggcgcaatctctgctcactgcaagctccgcctcccaggctcacgccattctcctgcctcagcctcccgagtagctga

SEQ ID NO: 45816 - DNA, 201 bp, Homo sapiens
ttgcgtttttctttctttttttgagacggagtctcgctctgtcgcccaggctggagtgcagtggcgcaatctctgctcactgcaagctccgcctcccaggytcacgccattctcctgcctcagcctcccgagtagctgagactacaggggcccgccaacacaaatacaaaatacaaaaaatataattttttgtatttttag

SEQ ID NO: 45817 - DNA, 201 bp, Homo sapiens
cctctgcctcccaggttcaagcaattctcctgcctcagcctcccgagtagctgggattacaggcacccaccaccatgcccagctaatttttgtatttttartagagacagggttttaccatgttggccaggctggtctcaaactcctgacctcgggcaatctgcctgcctcagcttcccaaagtgctgggattacaggcat

SEQ ID NO: 45818 - DNA, 201 bp, Homo sapiens
caacctctgcctcccaggttcaagcaattctcctgcctcagcctcccgagtagctgggattacaggcacccaccaccatgcccagctaatttttgtatttytagtagagacagggttttaccatgttggccaggctggtctcaaactcctgacctcgggcaatctgcctgcctcagcttcccaaagtgctgggattacagg

SEQ ID NO: 45819 - DNA, 201 bp, Homo sapiens
atctcaactcactgcaacctctgcctcccaggttcaagcaattctcctgcctcagcctcccgagtagctgggattacaggcacccaccaccatgcccagcyaatttttgtatttttagtagagacagggttttaccatgttggccaggctggtctcaaactcctgacctcgggcaatctgcctgcctcagcttcccaaagt

SEQ ID NO: 45820 - DNA, 201 bp, Homo sapiens
atgatctcaactcactgcaacctctgcctcccaggttcaagcaattctcctgcctcagcctcccgagtagctgggattacaggcacccaccaccatgcccrgctaatttttgtatttttagtagagacagggttttaccatgttggccaggctggtctcaaactcctgacctcgggcaatctgcctgcctcagcttcccaa

SEQ ID NO: 45821 - DNA, 201 bp, Homo sapiens
gaggtatgatctcaactcactgcaacctctgcctcccaggttcaagcaattctcctgcctcagcctcccgagtagctgggattacaggcacccaccaccahgcccagctaatttttgtatttttagtagagacagggttttaccatgttggccaggctggtctcaaactcctgacctcgggcaatctgcctgcctcagctt

SEQ ID NO: 45822 - DNA, 201 bp, Homo sapiens
tacagaggtatgatctcaactcactgcaacctctgcctcccaggttcaagcaattctcctgcctcagcctcccgagtagctgggattacaggcacccaccrccatgcccagctaatttttgtatttttagtagagacagggttttaccatgttggccaggctggtctcaaactcctgacctcgggcaatctgcctgcctca

SEQ ID NO: 45823 - DNA, 201 bp, Homo sapiens
ttaacaagaccatactacagtgacgtggacatcatgagagacatcgcctctgggctaataggactacttctaatctgtaagagcagatccctggacaggcraggaatacaggtattttgtccttgaagtaacctttcagaaattctgagaatttcttctggctagaacatgttaggtctcctggctaaataatggggcatt

SEQ ID NO: 45824 - DNA, 201 bp, Homo sapiens
gagtacagaggtatgatctcaactcactgcaacctctgcctcccaggttcaagcaattctcctgcctcagcctcccgagtagctgggattacaggcacccrccaccatgcccagctaatttttgtatttttagtagagacagggttttaccatgttggccaggctggtctcaaactcctgacctcgggcaatctgcctgcc

SEQ ID NO: 45825 - DNA, 201 bp, Homo sapiens
ctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggcaggggaaaagtggttcatgtttc

SEQ ID NO: 45826 - DNA, 201 bp, Homo sapiens
aggctggagtacagaggtatgatctcaactcactgcaacctctgcctcccaggttcaagcaattctcctgcctcagcctcccgagtagctgggattacagscacccaccaccatgcccagctaatttttgtatttttagtagagacagggttttaccatgttggccaggctggtctcaaactcctgacctcgggcaatctg

SEQ ID NO: 45827 - DNA, 201 bp, Homo sapiens
acctatacttataagtggaacatcttagagtttgatgaacccacagaaaatgatgcccagtgcttaacaagaccatactacagtgacgtggacatcatgaragacatcgcctctgggctaataggactacttctaatctgtaagagcagatccctggacaggcgaggaatacaggtattttgtccttgaagtaacctttca

SEQ ID NO: 45828 - DNA, 201 bp, Homo sapiens
actctgtcgcccaggctggagtacagaggtatgatctcaactcactgcaacctctgcctcccaggttcaagcaattctcctgcctcagcctcccgagtagstgggattacaggcacccaccaccatgcccagctaatttttgtatttttagtagagacagggttttaccatgttggccaggctggtctcaaactcctgacc

SEQ ID NO: 45829 - DNA, 201 bp, Homo sapiens
cactctgtcgcccaggctggagtacagaggtatgatctcaactcactgcaacctctgcctcccaggttcaagcaattctcctgcctcagcctcccgagtarctgggattacaggcacccaccaccatgcccagctaatttttgtatttttagtagagacagggttttaccatgttggccaggctggtctcaaactcctgac

SEQ ID NO: 45830 - DNA, 201 bp, Homo sapiens
tcaaaaaaagaggatgcaaacactctgtatgtactaatacaaaaagttctccaagatatgttattaaattaaaaagctgggatgtagtatagcgtgtatayatagctgccttttgttaaaggagtgaaagggataagaatatttatattttcttatttgtaagacataaaggtattctggaattacacgcatgaaattaat

SEQ ID NO: 45831 - DNA, 201 bp, Homo sapiens
tatctaatggctacatgttatccaggttccaagtagaatatttaaagaattcaattgaacaatgagaacatttagacacaggatggggaacatcacacacyggggcctgtcggggggggggggtggggggcggggggagggatagcattaggagatatacctaatgttaatgacaagttaatgggtgcagcacaccaacat

SEQ ID NO: 45832 - DNA, 201 bp, Homo sapiens
ttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtgg

SEQ ID NO: 45833 - DNA, 201 bp, Homo sapiens
tttaataaattaggatacattcatacaatggaatactaagcatcaaaaaaagaggatgcaaacactctgtatgtactaatacaaaaagttctccaagataygttattaaattaaaaagctgggatgtagtatagcgtgtatacatagctgccttttgttaaaggagtgaaagggataagaatatttatattttcttatttg

SEQ ID NO: 45834 - DNA, 201 bp, Homo sapiens
ggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagaggagttttattggccttttaccccatcatgtaaaacatttcaggcttttttc

SEQ ID NO: 45835 - DNA, 201 bp, Homo sapiens
tggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgt

SEQ ID NO: 45836 - DNA, 201 bp, Homo sapiens
atccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgtttt

SEQ ID NO: 45837 - DNA, 201 bp, Homo sapiens
cagtcttgcttctcaatgcagaatcctttcttcccatgcactaactccctctttctcccttgccctttcaagccacctgcaccgcagacaaactttcctcrgttcctaacaaccaaacttagatattttgctcttagatttataacttgctctttggggatggagaaagcgaaggaattggcaaaggtttttttttttttt

SEQ ID NO: 45838 - DNA, 201 bp, Homo sapiens
gacttgtcattaaaacaatcaaaaagtaagtaaaaataacaattgaaaatcctcacatcatcttcacatcttcttcccttaggcagagcttcgaccactasagctagagagctgagaggattaagtgcttgaactcagccctattggcggttctggtgatttgactccctccagctgagatcagactggggtgaccaaaca

SEQ ID NO: 45839 - DNA, 201 bp, Homo sapiens
atataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagct

SEQ ID NO: 45840 - DNA, 201 bp, Homo sapiens
acactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactagagctagagagctgagaggattaagtgcttgaactcagccctattggcggttctgg

SEQ ID NO: 45841 - DNA, 201 bp, Homo sapiens
tcctttagatagaagaaatattatgtcagagagacatttagattcataagaaggaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatga

SEQ ID NO: 45842 - DNA, 201 bp, Homo sapiens
cttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttccca

SEQ ID NO: 45843 - DNA, 201 bp, Homo sapiens
gcagaaagaatttctcactaacagagcagaaaaaaatgttaaaggaactcctttagatagaagaaatattatgtcagagagacatttagattcataagaargaatgaaaagttccagaagttgataaatatagagaaattttttcctcgttttaatctattaaaaaggcaattgattatctaaatgttaaagcaaaatagt

SEQ ID NO: 45844 - DNA, 201 bp, Homo sapiens
aagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataaagcagaataaattgaa

SEQ ID NO: 45845 - DNA, 201 bp, Homo sapiens
aggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaag

SEQ ID NO: 45846 - DNA, 201 bp, Homo sapiens
aatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattca

SEQ ID NO: 45847 - DNA, 201 bp, Homo sapiens
tgaacaaaattggtccagtaagaactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctatttta

SEQ ID NO: 45848 - DNA, 201 bp, Homo sapiens
ctcaatacacttggtgagtgaatgtttgatcacagagtacttgactgaatgcttattttggcctgtgtctctccctctttctcagatataacagtttgtgyccatgaccacatcagctggcatctgctgggaatgagctcggggccagaattattctccattcatttcaacggccaggtcctggagcagaaccatcataag

SEQ ID NO: 45849 - DNA, 201 bp, Homo sapiens
cttaacaagaccatactacagtgacgtggacatcatgagagacatcgcctctgggctaataggactacttctaatctgtaagagcagatccctggacaggygaggaatacaggtattttgtccttgaagtaacctttcagaaattctgagaatttcttctggctagaacatgttaggtctcctggctaaataatggggcat

SEQ ID NO: 45850 - DNA, 201 bp, Homo sapiens
gataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcggggttatt

SEQ ID NO: 45851 - DNA, 201 bp, Homo sapiens
catattttaaatatatgagttgcatatgaatgtgatgtcacaaaattagttctataatatatagccatctgctggtaagccagctctccaaataaaacacrttttctgccagacattgttcgttgtatctaagtgttgccaaattctctatacaaaaatttgctcttctagatttttccaaaacattccaatgcttgactt

SEQ ID NO: 45852 - DNA, 201 bp, Homo sapiens
ctttaaaaagcttgtttcatggagaatttaatattattcttttcttttagttatattctcatattttaaatatatgagttgcatatgaatgtgatgtcacmaaattagttctataatatatagccatctgctggtaagccagctctccaaataaaacacgttttctgccagacattgttcgttgtatctaagtgttgccaa

SEQ ID NO: 45853 - DNA, 201 bp, Homo sapiens
tgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaat

SEQ ID NO: 45854 - DNA, 201 bp, Homo sapiens
gagtctcactctgtcgcccaggctggagtacagaggtatgatctcaactcactgcaacctctgcctcccaggttcaagcaattctcctgcctcagcctccygagtagctgggattacaggcacccaccaccatgcccagctaatttttgtatttttagtagagacagggttttaccatgttggccaggctggtctcaaact

SEQ ID NO: 45855 - DNA, 201 bp, Homo sapiens
ttgctactgtgaataatgctgtgatgaacatcctagtacatgtgtcttttcagtagaacaatgtattttctgtctttctttcttttttttttttttgagayggagtctcactctgtcgcccaggctggagtacagaggtatgatctcaactcactgcaacctctgcctcccaggttcaagcaattctcctgcctcagcctc

SEQ ID NO: 45856 - DNA, 201 bp, Homo sapiens
atagtacccaatagtttttcatcccttgctcatctccttccttcccccttctagaagtccccagtgtttattgccatctttatgttcatgagtacccaatrtttagctcccacttataagtgagaacatgtggtatttggctttctgtttctgcattaattcacttagcataatagcctccagctggcatccatgttgttg

SEQ ID NO: 45857 - DNA, 201 bp, Homo sapiens
actaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgctt

SEQ ID NO: 45858 - DNA, 201 bp, Homo sapiens
ggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccagga

SEQ ID NO: 45859 - DNA, 201 bp, Homo sapiens
gagactcaaaagggaacgggggatggatgaaaagctacctattgggtacagggtacactactcaggtgacaggtacactaaaatcctagacttcaccactmtacaattcatccatgtaaccaaaaaccacttgcattcctaaagcaactgaagttttttaaaaaatttaaaaatcaaaattaatgcacgaaagccacaata

SEQ ID NO: 45860 - DNA, 201 bp, Homo sapiens
aggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccagg

SEQ ID NO: 45861 - DNA, 201 bp, Homo sapiens
caggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagcccag

SEQ ID NO: 45862 - DNA, 201 bp, Homo sapiens
aataaatctaaggcttggctgatccaggccccacttggctgctgaagggctggaggtgggaagagggatcaataaataggtgcactagaaacctgccatgrcacacctgtcaggagttgcagtacttccctttgggtggagagaagccaccatgattcacaatggagaaagtagctgaaacctggaatcagtttcctgttg

SEQ ID NO: 45863 - DNA, 201 bp, Homo sapiens
agtaatattcagtggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaa

SEQ ID NO: 45864 - DNA, 201 bp, Homo sapiens
gccaggagttttagaccagcctgggcaatgtagtgagactctgtttctatttaaaaaaatacatacatatatatatatatatatatatatatatatatatatatttaaattagccagacatggtggtacatacctgtcatttcagctactggggaggctaaggcaagagggtcatttaggacaagagcatcacttgagccc

SEQ ID NO: 45865 - DNA, 201 bp, Homo sapiens
aactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaa

SEQ ID NO: 45866 - DNA, 201 bp, Homo sapiens
caaggtgggaggattgcttgaggccaggagttttagaccagcctgggcaatgtagtgagactctgtttctatttaaaaaaatacatacatatatatatatrtatatatatatatatatatatatatttaaattagccagacatggtggtacatacctgtcatttcagctactggggaggctaaggcaagagggtcatttag

SEQ ID NO: 45867 - DNA, 201 bp, Homo sapiens
cttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccatggc

SEQ ID NO: 45868 - DNA, 201 bp, Homo sapiens
ttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaa

SEQ ID NO: 45869 - DNA, 201 bp, Homo sapiens
ctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttgca

SEQ ID NO: 45870 - DNA, 201 bp, Homo sapiens
gacagaaagaaggcaagtaatccaaagatggattgacacatcaaagtagagcaaaatgagtatagggacccaagagtcttggaaaggcatgcatgaagacrtttcaagtgatcagtaagattttcagaacaaaaggaattccctgaatgagggttccggcatttgctgcagttctaaagttcagtggccaaaagcactgcc

SEQ ID NO: 45871 - DNA, 201 bp, Homo sapiens
aatggagtatcagtgaggacagtggacccacccatgatgaccctccatgcctcacacacatctattactcccatgaaaatctgatcgaggatttcaactckgggctgattgggcccctgcttatctgtaaaaaaggtaagaacacccccaccaaaagattcaacaactaaatgttggaatggtcaggagttctgtcatggg

SEQ ID NO: 45872 - DNA, 201 bp, Homo sapiens
gatttgagagtggtgaaaacgcaatcctcagaaactgcccacatgtcttgatggctgttactcctccaggtgcttcttaccttgaccacacattccctgcrgagaagatggacgacgctgtggctccaggccgagaatacacctatgaatggagtatcagtgaggacagtggacccacccatgatgaccctccatgcctca

SEQ ID NO: 45873 - DNA, 201 bp, Homo sapiens
tctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcagttcctaacaaccaaacttagatattttgctcttagatttataacttgctctttgggg

SEQ ID NO: 45874 - DNA, 201 bp, Homo sapiens
tcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccctctacacttcttttaatattgagtatctc

SEQ ID NO: 45875 - DNA, 201 bp, Homo sapiens
cagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaaaggcgattcaattctctgattatatttaaataataattgttcaggta

SEQ ID NO: 45876 - DNA, 201 bp, Homo sapiens
agacacaacaaagtccactttatgctagcgcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgttaaccagatctccaggtttttg

SEQ ID NO: 45877 - DNA, 201 bp, Homo sapiens
caaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagaactgatcatcagaaagcagaaaagggca

SEQ ID NO: 45878 - DNA, 201 bp, Homo sapiens; identical to SEQ ID NO: 10348

SEQ ID NO: 45879 - DNA, 201 bp, Homo sapiens
tttgattacaaagtcaaaatcacattcaccaaaactgcatctcacaaatgcttcctcttaatagctgtttgtattttatactttatattaatgtatgttgyaaaatcaaagatacaacaaacctgttttattctagactaaaggtaaaataatttgaagtgaaaagaataaaagcattgataaaattacaccccaattgtc

SEQ ID NO: 45880 - DNA, 201 bp, Homo sapiens
aacaaaatccttttgagctctgtgcttttttgcataacttggtctaaaaaaaaagcaaaggttttaacatcttccttatctatgtgtttttgtcattttcrtaggcaaacaacaataagcagtggctagaaattgatctactcaagatcaagaagataacggcaattataacacagggctgcaagtctctgtcctctgaaa

SEQ ID NO: 45881 - DNA, 201 bp, Homo sapiens
ccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaat

SEQ ID NO: 45882 - DNA, 201 bp, Homo sapiens
tctcttcttttcagtttagagcttaattttttttattttgattacaaagtcaaaatcacattcaccaaaactgcatctcacaaatgcttcctcttaatagytgtttgtattttatactttatattaatgtatgttgtaaaatcaaagatacaacaaacctgttttattctagactaaaggtaaaataatttgaagtgaaaa

SEQ ID NO: 45883 - DNA, 201 bp, Homo sapiens
ttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggt

SEQ ID NO: 45884 - DNA, 201 bp, Homo sapiens
gcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaaga

SEQ ID NO: 45885 - DNA, 201 bp, Homo sapiens
aacggctatagtttgtatatttaataaatcacaaaaatgtggatcccttttccaaagagacttgcaagtcctgtgcaatgaaatcagctctttataaaacrtcagcattgattcgcccattgcctacattatagcttctaaaagaatattctgaatctttgaatgtagtgaagcattcactaagtttattaacttaggaga

SEQ ID NO: 45886 - DNA, 201 bp, Homo sapiens
ggcaagaggattacttgagaggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtg

SEQ ID NO: 45887 - DNA, 201 bp, Homo sapiens
gacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactca

SEQ ID NO: 45888 - DNA, 201 bp, Homo sapiens
gggtcatttttaggaattctgtcttgggctttaaaatggctagtcttggctgggcatagtggctcatgactgtaatcccagcactttgggaggccaaggtrggaggattgcttgaggccaggagttttagaccagcctgggcaatgtagtgagactctgtttctatttaaaaaaatacatacatatatatatatatatata

SEQ ID NO: 45889 - DNA, 201 bp, Homo sapiens
ataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattca

SEQ ID NO: 45890 - DNA, 201 bp, Homo sapiens
agctggggtcatttttaggaattctgtcttgggctttaaaatggctagtcttggctgggcatagtggctcatgactgtaatcccagcactttgggaggccraggtgggaggattgcttgaggccaggagttttagaccagcctgggcaatgtagtgagactctgtttctatttaaaaaaatacatacatatatatatatat

SEQ ID NO: 45891 - DNA, 201 bp, Homo sapiens
ccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaag

SEQ ID NO: 45892 - DNA, 201 bp, Homo sapiens
gtacagctggggtcatttttaggaattctgtcttgggctttaaaatggctagtcttggctgggcatagtggctcatgactgtaatcccagcactttgggakgccaaggtgggaggattgcttgaggccaggagttttagaccagcctgggcaatgtagtgagactctgtttctatttaaaaaaatacatacatatatatat

SEQ ID NO: 45893 - DNA, 201 bp, Homo sapiens
ttaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattcca

SEQ ID NO: 45894 - DNA, 201 bp, Homo sapiens
gatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaatt

SEQ ID NO: 45895 - DNA, 201 bp, Homo sapiens
cattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattc

SEQ ID NO: 45896 - DNA, 201 bp, Homo sapiens
tcagtgacttttatgaagttatttaacctctgtgtgcctcatctttctcatctgtaaaatggtaataataatcatgtctctgtcatacaggtttgttgtcrtgaaatcttagaataatgactggcatataacagataataaatattagccatgatagtaaagataattcttcaattaaaatgtgttcaaataatttagtat

SEQ ID NO: 45897 - DNA, 201 bp, Homo sapiens
ctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaagggattccccaactca

SEQ ID NO: 45898 - DNA, 201 bp, Homo sapiens; identical to SEQ ID NO: 10358

SEQ ID NO: 45899 - DNA, 201 bp, Homo sapiens
agttccagaccagcctggcccacatggtgaaaccccgcctctactgaaaatacaaaaattagttgtgcatgatggtacatgcctgtagtcccagctactcrggaggctgagacatgagaatcacttgaacccaggaggtggaggctgcagtgagctgacatcgcatcacttcactccaacctgggtgacagagcgaaactc

SEQ ID NO: 45900 - DNA, 201 bp, Homo sapiens; identical to SEQ ID NO: 10361

SEQ ID NO: 45901 - DNA, 201 bp, Homo sapiens
tctgttcttgtaccagtactatactgttttgtcctccagagggcagcagacatcgaacagcaggctgtgtttgctgtgtttgatgagaacaaaagctggtmccttgaggacaacatcaacaagttttgtgaaaatcctgatgaggtgaaacgtgatgaccccaagttttatgaatcaaacatcatgagcagtaagtcagag

SEQ ID NO: 45902 - DNA, 201 bp, Homo sapiens
gatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaat

SEQ ID NO: 45903 - DNA, 201 bp, Homo sapiens
cttggcctcccaaagtgctggtattacaggcgtgagccaccgcgccaggcctacatttaagtctttaatccatcttgagttaatttttgtatatgatgtawgaaaggggtccagtttcaattttctgcctacggctagccagttttcccagaaccatttatggaatagagaatcctttccctattgcttgcttttgtcaca

SEQ ID NO: 45904 - DNA, 201 bp, Homo sapiens
gttttacgtttaagtgtgttgttgttgttttttgtttgtttgtttctgttatttttgagatggagtctcgttctgttgcccaggctggagtgcagtggtaygatctcagctcactgcaacctctgcctcccatgttcaggtgattctcctgcctcggcccctcggcctcccgagtagctgggattacaggcataagccacg

SEQ ID NO: 45905 - DNA, 201 bp, Homo sapiens
gggttttacgtttaagtgtgttgttgttgttttttgtttgtttgtttctgttatttttgagatggagtctcgttctgttgcccaggctggagtgcagtggyacgatctcagctcactgcaacctctgcctcccatgttcaggtgattctcctgcctcggcccctcggcctcccgagtagctgggattacaggcataagcca

SEQ ID NO: 45906 - DNA, 201 bp, Homo sapiens
tcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgct

SEQ ID NO: 45907 - DNA, 201 bp, Homo sapiens
ttatgtgcaggatgtgcaggtttgttacataggtaaacatgtgtcatggaggtctgttgtacttactacttcatcacccaggtattaagcctagtatccaytagttattttttctgatcctctccctctttccaccctccatcctctgataggccccagtatgtattgttcccttctatgtgtccatgtgttctcataatt

SEQ ID NO: 45908 - DNA, 201 bp, Homo sapiens
tacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtc

SEQ ID NO: 45909 - DNA, 201 bp, Homo sapiens
gtagccctagaagaaatctagaggtcaaacctatcacaattagggcaccaacatgtaccctagagttaactaggcagagcccctcaggggcccaggccctktcttctttacatttgtactctggcatttagcacagagcctggaacctagtggatgatgatggtcatgatcatgatgatattaatcattactgaactaaac

SEQ ID NO: 45910 - DNA, 201 bp, Homo sapiens
attattggcatataatattgcctctggtcctatgaatctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtct

SEQ ID NO: 45911 - DNA, 201 bp, Homo sapiens
agggcctttgcgcacgctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaat

SEQ ID NO: 45912 - DNA, 201 bp, Homo sapiens
ccagaaatcagagtttaccattgcttctgtaaccagttactgcaaacttagtggctaaaacaacacaaatttattcttttatgattatatatctgcagatsagaagtccaaaatgggttttattgggctaaaatcaaggtgttggcagagctgcattccttctggaggctctgggggagaattgtttccttgtcttttcca

SEQ ID NO: 45913 - DNA, 201 bp, Homo sapiens
cccagaaatcagagtttaccattgcttctgtaaccagttactgcaaacttagtggctaaaacaacacaaatttattcttttatgattatatatctgcagaygagaagtccaaaatgggttttattgggctaaaatcaaggtgttggcagagctgcattccttctggaggctctgggggagaattgtttccttgtcttttcc

SEQ ID NO: 45914 - DNA, 201 bp, Homo sapiens
ccaaggcagatggatcacttgaggtcaggagttccagaccagcctggcccacatggtgaaaccccgcctctactgaaaatacaaaaattagttgtgcatgrtggtacatgcctgtagtcccagctactcaggaggctgagacatgagaatcacttgaacccaggaggtggaggctgcagtgagctgacatcgcatcacttc

SEQ ID NO: 45915 - DNA, 201 bp, Homo sapiens
tgaggccaggcgtggtggctcatgcactttgggaggccaaggcagatggatcacttgaggtcaggagttccagaccagcctggcccacatggtgaaacccmgcctctactgaaaatacaaaaattagttgtgcatgatggtacatgcctgtagtcccagctactcaggaggctgagacatgagaatcacttgaacccagga

SEQ ID NO: 45916 - DNA, 201 bp, Homo sapiens
ccaggctggtctcaaactcctgacctcgggcaatctgcctgcctcagcttcccaaagtgctgggattacaggcatgagccattgcgcccggctgaacaatktattttcttttttggctatatacccagtaatagaattgctaggtcaaattgtagcaggacaagccacagacaaaaacccctcagacaccaagttaaagaa

SEQ ID NO: 45917 - DNA, 201 bp, Homo sapiens
gggtttcaccatgttggctaggctggtctcgaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaat

SEQ ID NO: 45918 - DNA, 201 bp, Homo sapiens
ttgggcctactactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcag

SEQ ID NO: 45919 - DNA, 201 bp, Homo sapiens
ctggttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaatatgcggacaaagaaaataaa

SEQ ID NO: 45920 - DNA, 201 bp, Homo sapiens
ctcttgagtagctgggattacaggcgcccgccaccacccccatgtaatttttgtattttttagtagagacagggtttcaccatgttggctaggctggtctygaactcctgacctaaggtgttccacctgcctcagcctcccaaagtgctggtattacaggtgtgagccactgtgcccggctcttttgggatattttaatct

SEQ ID NO: 45921 - DNA, 201 bp, Homo sapiens
attacattgctgctgaagaaatatcctgggattattcagaatttgtacaaaggtttggccagttttctccttttttattctcatttttccattactgctgmaaaaagtagctactacaattcagggggataattgtgggcaaattatactaagaacagtgtggttcccctattgcaagttggcctgttctttttcctttgt

SEQ ID NO: 45922 - DNA, 201 bp, Homo sapiens
ctcctgcctcagtctcttgagtagctgggattacaggcgcccgccaccacccccatgtaatttttgtattttttagtagagacagggtttcaccatgttgkctaggctggtctcgaactcctgacctaaggtgttccacctgcctcagcctcccaaagtgctggtattacaggtgtgagccactgtgcccggctcttttgg

SEQ ID NO: 45923 - DNA, 201 bp, Homo sapiens
gattctcctgcctcagtctcttgagtagctgggattacaggcgcccgccaccacccccatgtaatttttgtattttttagtagagacagggtttcaccatkttggctaggctggtctcgaactcctgacctaaggtgttccacctgcctcagcctcccaaagtgctggtattacaggtgtgagccactgtgcccggctctt

SEQ ID NO: 45924 - DNA, 201 bp, Homo sapiens
gagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttttgagttcacatccaccatctctaagctctgttgttacctgta

SEQ ID NO: 45925 - DNA, 201 bp, Homo sapiens
gagagcagtggcaccattttagatcactgcaacctctgcctcctgggttcaagtgattctcctgcctcagtctcttgagtagctgggattacaggcgcccrccaccacccccatgtaatttttgtattttttagtagagacagggtttcaccatgttggctaggctggtctcgaactcctgacctaaggtgttccacctgc

SEQ ID NO: 45926 - DNA, 201 bp, Homo sapiens
caggggcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatc

SEQ ID NO: 45927 - DNA, 201 bp, Homo sapiens
cagagatagacagactttcagctgccatagcgaaatgagatttttcttttgggatttgttttttttttttttttcttttgagacagagtctcactctgtcwcccaggctggagagcagtggcaccattttagatcactgcaacctctgcctcctgggttcaagtgattctcctgcctcagtctcttgagtagctgggatta

SEQ ID NO: 45928 - DNA, 201 bp, Homo sapiens
ggacagcccagaagaatctcatctcaagattcttaatcatagatacacagtcccttttgccatataaagtagcatatttccaggtcccagagattaggacrtggacatctcagcaggggcacattattctgcctactacacccaccaaacaaagccctcccacggtgtcctccatctcagagaatggcaccctcctccacc

SEQ ID NO: 45929 - DNA, 201 bp, Homo sapiens
agatatacctaatgttaatgacaagttaatgggtgcagcacaccaacatgacacatgtatacatatgtaacaaacctgcacgttgtgcacatgtaccctaraacttaaagtataatttaaaaaaaataaaaataaaagaattccttttgcaatattaattggttccagcgaaagcttatttatttatttattatcatgaaa

SEQ ID NO: 45930 - DNA, 201 bp, Homo sapiens
gggggagggatagcattaggagatatacctaatgttaatgacaagttaatgggtgcagcacaccaacatgacacatgtatacatatgtaacaaacctgcaygttgtgcacatgtaccctagaacttaaagtataatttaaaaaaaataaaaataaaagaattccttttgcaatattaattggttccagcgaaagcttattt

SEQ ID NO: 45931 - DNA, 201 bp, Homo sapiens; identical to SEQ ID NO: 10347

SEQ ID NO: 45932 - DNA, 201 bp, Homo sapiens
gggcctgtcggggggggggggtggggggcggggggagggatagcattaggagatatacctaatgttaatgacaagttaatgggtgcagcacaccaacatgrcacatgtatacatatgtaacaaacctgcacgttgtgcacatgtaccctagaacttaaagtataatttaaaaaaaataaaaataaaagaattccttttgca

SEQ ID NO: 45933 - DNA, 201 bp, Homo sapiens
cacgagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttag

SEQ ID NO: 45934 - DNA, 201 bp, Homo sapiens
agaaactaccagagttacctgttgcccataccagtggggtaagccctatgaatgtatatgagagtttcaaacatccacaaaacattggctttctaatattygtattcccactattcctttcttttcatgattcatgtcattgtcccatcaacatttctaagatttccattccgttaagagcaaaagagaatgttggaaggt

SEQ ID NO: 45935 - DNA, 201 bp, Homo sapiens
ataaatatgctattttaaaaaataagaatttcttcaagttgaaatcattatggttgattgcttgccctaaactctttgctatccaggaaagctaatgagcrtcttctatctgcagtgctactgaaaacatgtctttcctttcatagggaccctaactgagggtgggacacagaagacgtttgacaagcaaatcgtgctact

SEQ ID NO: 45936 - DNA, 201 bp, Homo sapiens
ccccccaccaagggtcttactctgtcacccaggctggagtgcagtggtgtgatcatggctcactgcaacctccacttcctgggctcaggcgattctcgcayctcagcctctcaagtagctgggactacaggcacacgccccaacgcctggctaatttttgtatttttttgtagagatgaggtttcaccatgttgcccaggc

SEQ ID NO: 45937 - DNA, 201 bp, Homo sapiens
aaattctgactcagccatcaactttttccctaactccccagacagaatttgtgcttcatcctctcttcttctgtaatattttgcccatatctcagcagtcrctcctatcatacatctatctccaaactagcttgtgagttccttcagtacagggactgtatttgatccaggtagccagaaactttctaacacagtgcctgg

SEQ ID NO: 45938 - DNA, 201 bp, Homo sapiens
ttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatct

SEQ ID NO: 45939 - DNA, 201 bp, Homo sapiens
gcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaata

SEQ ID NO: 45940 - DNA, 201 bp, Homo sapiens
ccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacct

SEQ ID NO: 45941 - DNA, 201 bp, Homo sapiens
aacgcctggctaatttttgtatttttttgtagagatgaggtttcaccatgttgcccaggctggtcttgaactcctgagctcaagtgatccacctgcttcakcctcccaaagtgctggggttacaggtttgagccactgaacctagctgagaagatgacttcaaagacagtgtcctaaaaaatctaccgggcaggggaaggg

SEQ ID NO: 45942 - DNA, 201 bp, Homo sapiens
cacgccccaacgcctggctaatttttgtatttttttgtagagatgaggtttcaccatgttgcccaggctggtcttgaactcctgagctcaagtgatccacstgcttcagcctcccaaagtgctggggttacaggtttgagccactgaacctagctgagaagatgacttcaaagacagtgtcctaaaaaatctaccgggcag

SEQ ID NO: 45943 - DNA, 201 bp, Homo sapiens
caatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgag

SEQ ID NO: 45944 - DNA, 201 bp, Homo sapiens
  misc_feature (1)...(201): n = A,T,C or G, or insertion/deletion polymorphism (see Tables 1-2)
atggagtttttacaaacgctgcatttgacccgagtccttaaggtaagatccctataaagatatttttgaaggaaatagaacactagggaaaaatggaagantataaagcttaacttttctttacataatcatatattaaattttaagtatgtattaaattttcaggcatgaaggaaattgtgttggcagtaggacacaggt

SEQ ID NO: 45945 - DNA, 201 bp, Homo sapiens
aaactaggaaaggaaaaagaaaagaaagggaagagaaaggaaggggagggaaaggattaatcatttcagttttcaaaaagtgtagttgcttcagtaagagkagttttattggccttttaccccatcatgtaaaacatttcaggcttttttccccagatccttgttgtctgcctacatccacactgatgttctcaccttctt

SEQ ID NO: 45946 - DNA, 201 bp, Homo sapiens
ctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtga

SEQ ID NO: 45947 - DNA, 201 bp, Homo sapiens
gtggtgtgatcatggctcactgcaacctccacttcctgggctcaggcgattctcgcacctcagcctctcaagtagctgggactacaggcacacgccccaaygcctggctaatttttgtatttttttgtagagatgaggtttcaccatgttgcccaggctggtcttgaactcctgagctcaagtgatccacctgcttcagcc

SEQ ID NO: 45948 - DNA, 201 bp, Homo sapiens
ctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatat

SEQ ID NO: 45949 - DNA, 201 bp, Homo sapiens
tttagcctcaggagcatagaagtctaggctccccattcagcctttgctgttgtgggttggggaggggcctcaggtttttctgtggtgtttggctaaaggasagaagtcagtgtccaccagttttctatcatatctcgctatgctgccctttactggtactttggttagagaaagcagattttatttgggctttttcagtct

SEQ ID NO: 45950 - DNA, 201 bp, Homo sapiens
aaagttcaggatctggctatttgtctgtgcctctcaagcaagtagcttttcccccccaccaagggtcttactctgtcacccaggctggagtgcagtggtgygatcatggctcactgcaacctccacttcctgggctcaggcgattctcgcacctcagcctctcaagtagctgggactacaggcacacgccccaacgcctgg

SEQ ID NO: 45951 - DNA, 201 bp, Homo sapiens
gagcatagaaatgggcatatgtgaatctttccaaataataaaagttcactattgaaggacatatgcatctccagagaactcatcttagctatccccagatktgagagtggtgaaaacgcaatcctcagaaactgcccacatgtcttgatggctgttactcctccaggtgcttcttaccttgaccacacattccctgcggag

SEQ ID NO: 45952 - DNA, 201 bp, Homo sapiens
agtacatgagcatagaaatgggcatatgtgaatctttccaaataataaaagttcactattgaaggacatatgcatctccagagaactcatcttagctatcmccagatttgagagtggtgaaaacgcaatcctcagaaactgcccacatgtcttgatggctgttactcctccaggtgcttcttaccttgaccacacattccc

SEQ ID NO: 45953 - DNA, 201 bp, Homo sapiens
tcattgcgtttttctttctttttttgagacggagtctcgctctgtcgcccaggctggagtgcagtggcgcaatctctgctcactgcaagctccgcctcccrggctcacgccattctcctgcctcagcctcccgagtagctgagactacaggggcccgccaacacaaatacaaaatacaaaaaatataattttttgtatttt

SEQ ID NO: 45954 - DNA, 201 bp, Homo sapiens
tatcaaagcctttgtaagtacatgagcatagaaatgggcatatgtgaatctttccaaataataaaagttcactattgaaggacatatgcatctccagagarctcatcttagctatccccagatttgagagtggtgaaaacgcaatcctcagaaactgcccacatgtcttgatggctgttactcctccaggtgcttcttacc

SEQ ID NO: 45955 - DNA, 201 bp, Homo sapiens
tcaatcatcgccattctgactggcatgagagggcatctcattgcgtttttctttctttttttgagacggagtctcgctctgtcgcccaggctggagtgcartggcgcaatctctgctcactgcaagctccgcctcccaggctcacgccattctcctgcctcagcctcccgagtagctgagactacaggggcccgccaacac

SEQ ID NO: 45956 - DNA, 201 bp, Homo sapiens
acaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatt

SEQ ID NO: 45957 - DNA, 201 bp, Homo sapiens
tttcttgacttttcaatcatcgccattctgactggcatgagagggcatctcattgcgtttttctttctttttttgagacggagtctcgctctgtcgcccargctggagtgcagtggcgcaatctctgctcactgcaagctccgcctcccaggctcacgccattctcctgcctcagcctcccgagtagctgagactacaggg

SEQ ID NO: 45958 - DNA, 201 bp, Homo sapiens
ccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaa

SEQ ID NO: 45959 - DNA, 201 bp, Homo sapiens
atttactctgtttttccaggaaaaagatattcactcaggcttgataggtcccctcctaatctgccaaaaaggaatactacataaggacagcaacatgcctrtggacatgagagaatttgtcttactatttatgacctttgatgaaaagaagagctggtactatgaaaagaagtcccgaagttcttggagactcacatcctc

SEQ ID NO: 45960 - DNA, 201 bp, Homo sapiens
cattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaaaacaaaaacaaaaaacctt

SEQ ID NO: 45961 - DNA, 201 bp, Homo sapiens
aaaggattaatcatttcagttttcaaaaagtgtagttgcttcagtaagaggagttttattggccttttaccccatcatgtaaaacatttcaggcttttttycccagatccttgttgtctgcctacatccacactgatgttctcaccttcttctcgtaaagaatttatcaagttattgtaccaaacaaaaataactgcatcc

SEQ ID NO: 45962 - DNA, 201 bp, Homo sapiens
ataatttctcaaaccaaattggaaaacattataagaaagttatgtacacacagtacgaagatgagtccttcaccaaacatacagtgaatcccaatatgaargaagatgggattttgggtcctattatcagagcccaggtcagagacacactcaaagtaagtaacacaaatacagaatcatgggagaaattacatagtaaaa

SEQ ID NO: 45963 - DNA, 201 bp, Homo sapiens
tttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcc

SEQ ID NO: 45964 - DNA, 201 bp, Homo sapiens
ttggataatttctcaaaccaaattggaaaacattataagaaagttatgtacacacagtacgaagatgagtccttcaccaaacatacagtgaatcccaataygaaagaagatgggattttgggtcctattatcagagcccaggtcagagacacactcaaagtaagtaacacaaatacagaatcatgggagaaattacatagt

SEQ ID NO: 45965 - DNA, 201 bp, Homo sapiens
aaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaa

SEQ ID NO: 45966 - DNA, 201 bp, Homo sapiens
cccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaa

SEQ ID NO: 45967 - DNA, 201 bp, Homo sapiens
aaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagtt

SEQ ID NO: 45968 - DNA, 201 bp, Homo sapiens
tgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctgtttactggctttcctatattgcaggtggacatgcaaaag

SEQ ID NO: 45969 - DNA, 201 bp, Homo sapiens
gacaaaacatataaaacagaagttttcagacatcgaatgacagacaactcaagacagtaaaagaagagtaacaaaccagatgtgccctatgagcacctaarcttactgcttgaagagtgtttccagggaacagcacaagcagggagaacccagacagagtctctatgggttgaggaaatagagtttggacttcggagaagc

SEQ ID NO: 45970 - DNA, 201 bp, Homo sapiens
agatttaccctttttctcaacaactagacaggcagacaaaacatataaaacagaagttttcagacatcgaatgacagacaactcaagacagtaaaagaagwgtaacaaaccagatgtgccctatgagcacctaagcttactgcttgaagagtgtttccagggaacagcacaagcagggagaacccagacagagtctctatg

SEQ ID NO: 45971 - DNA, 201 bp, Homo sapiens
tccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagg

SEQ ID NO: 45972 - DNA, 201 bp, Homo sapiens
cacagaagccaaggccagatgacttggagcacagaccaagaaggaaaaggcaggccaagagacacaaagcaaagtgtgggtcaggactagaggagctggtraactgaggcacccacgccggtagtgcaggtagagtgacaacacgtgggagggagcacagtgaagtgaggctgggaggagagaggcaaaggatgcaaagga

SEQ ID NO: 45973 - DNA, 201 bp, Homo sapiens
aaggaaggagagggcatgggtagggggcagtgtaagatgctgtgctggaaagcacatcactgtgtctagtgcatggggggaggttgacggtactgcctccytctttgcagcctgacctcactgtctgggtggcccactgcagcgggagcgggtgccttgtgccaaacgttgtgcacaccgacttccctacctgcttcctct

SEQ ID NO: 45974 - DNA, 201 bp, Homo sapiens
ttgtttagaaagaggctggacttacaccagtagaactccaagtccacatagacccgccatttggttcaccagacaccattcccagggctgtattttagccrtctgactgtccagggatccccgggaatccttatgtgtgatgatggggctttagagactttgaactaaaatgccaaggcctcagctccgtgaattggtctt

SEQ ID NO: 45975 - DNA, 201 bp, Homo sapiens
aattgagggctgtgggctcagccacagaacatcatggcctctgttaccctaagtttcttcctgttcttgaaattgtgacggtttggaaagagatggggagratattgttacccacgtgacaggctgcagcaaccttgaccactaaggtcaaataagcagcattgatgaattttagcatgtgggcacccctggagggggcga

SEQ ID NO: 45976 - DNA, 201 bp, Homo sapiens
ttgagtataactatctcccctcaggggccctgccacccatatgctagtacctgcctcccatcataaggaaacagtgccttttaggcattgctgaaaagtakagggtctggacctcctgatactgggacttgttaccctttagacatcatttcaatcttcatatatcttcctcctgtggttagacttaaattgagggctgtg

SEQ ID NO: 45977 - DNA, 201 bp, Homo sapiens
ccttagtctatgcacatttcaaccagagtgatccagccaactacaatccagctatgctacacctttgtccacctagcaaagcccaggcttctcaccacagmagccttctgtgacctggctccttcctccctctctagccacatggtctgttccacattgcctgggactgttcacacaaactctgttctttgccatccttgt

SEQ ID NO: 45978 - DNA, 201 bp, Homo sapiens
ggaaaagtatagagattcatagaactaggaaggtcatccactcatgtaagcccccacctctgcactgcaacttactattaactgcagtatttatagtaaasagtattactttgataagtagtcaaaaacctccagaacatattctgcccattgatagtctaataaataggtccagtcttaaaccccccaaatgtcatgcag

SEQ ID NO: 45979 - DNA, 201 bp, Homo sapiens
aaagtgcaaaagtttgaggcttccatctgacagctaaagccaagccacagagggggcctcttgaccgacaaaggacactgtgaatcacagtagcgtaaacragaggccttcctttctaatgacaatgacaggtattggtgaaggagctaatgtttaatatttgaccttgaatcattcaagtccccaaatttcattcttaga

SEQ ID NO: 45980 - DNA, 201 bp, Homo sapiens
acattgaacagagctttgactttgcaatgataaaagcagatcccagaaaaggggctaagtaccctgagatcaatgtgtcaggagatgctatggtatcacayagaaagaggcttggggccaggcacagtggctcgtgcctataatcccagcactttgggaggccaagggaggcagatcatctgaggtcaggagttcaagact

SEQ ID NO: 45981 - DNA, 201 bp, Homo sapiens
cacgtcttaaagatcccacctcttaatatagtcaaaatggcgactaaatttcaacatgaattttggaggggaaattcaaatcatagcacccctcaccactrctcctagtgtagacactcatcatcttttgtcaacaccagtagttcccaaactttagcaagcatcacattcatctggaaggccagtcattacacactgggc

SEQ ID NO: 45982 - DNA, 201 bp, Homo sapiens
taggtgtccttttcccaaaaagcaatgtactaatgttcataagccagggtgacctaaaaatgaaagttacaaatgaagcctttgagctggccttctggctyaatacaccaccaggaaatgcggatcctaatactcagctcaatgaatgatgatggccttagtttaatgtgcagaatactcagatttccacacacctcaaaa

SEQ ID NO: 45983 - DNA, 201 bp, Homo sapiens
tggttccttcaggagctgactgatggggctgatcactaaccagagtctcttgagaagggggataaactgagcctttggaagtaacttttcatcttcagttkgctggatccagaacttgcacaaaaaccgagaaatcttccattcattcactaggttattcctgggtgtctacatggcgcgttatgggaacacaggcattag

SEQ ID NO: 45984 - DNA, 201 bp, Homo sapiens
gaagtaatagtgtgagtgggatttatacagtttcctgctttaattgaaattagaaaaattcacccaacatcctttaggctatgagaactttggtttttttwaaaaaaaatcttcaatagatcatcgtccctgcgacgctgcaccaccaaaactccaagtcttgtttctctgcctgtcactactgggctctcaggagatgca

SEQ ID NO: 45985 - DNA, 201 bp, Homo sapiens
aattgctacgacgtcagttacaagacggaggagaaagaagacaagacatgaatttaaagaaacttgcttatccaaatcattcttcttttaagaaagctttrtattcattatagctgattataagagttaggacaaatttatgatgtggcagacttgtgttttagcttattagtgtgtctctgtgctgcactgaagcccttg

SEQ ID NO: 45986 - DNA, 201 bp, Homo sapiens
gtatttgtctctctccctctacattacaaactccattgtgcagactgtgccagtgtaaatcatcatggcagctctggcactatgcagtgataattggtacytggtaggcactcaataaataataaattcctagcacaacatctcttatataacagtagcccatctgataactcctaaagctgcaggctcagaaaacacttg

SEQ ID NO: 45987 - DNA, 201 bp, Homo sapiens
gccataaccacccaagcaactcagagttttagtagctgaacaaggtcactcttgggtgctagaggcagagaggcagccagtcctggcttcccaactcccawcacaaacctagttttcagtgtaccagctatatgcactcacttcttaataaaatgtcacagagaaatcgtgaggcagaatttagcaaaatgtttctgccct

SEQ ID NO: 45988 - DNA, 201 bp, Homo sapiens
tcagctttttgtggccaagtggggtggggtgcattctttgcatccccagcagctggcacagaagcttgtgtgcagaagacttgatggatttttgatagctrgataaacgagtctctgcctcttcaaaggacacgctgccaaagcttactgcagtgtttttctgtcgttggaggaaaactctagaaagaatgcaaaatgtat

SEQ ID NO: 45989 - DNA, 201 bp, Homo sapiens
ctttcctctggcccaaggaatcaagtttcagtaaaggtgttttagatgaacatcccttaatttgaggtgttcggcagctgtttttgaagaagacaaagaarattaaagttttccttgaataaatgcattattatgactgtgacagtgactaatccccctatgaccccaaagccctgattaaatcaaaagactcctttttta

SEQ ID NO: 45990 - DNA, 201 bp, Homo sapiens
tacttcgaaggtcaagatttaatacaattaataactcttactgcttcaaagaggtaattctcaagtgaaactggttctgtttttttgttttttgttttttktttttaatgtgagacaagatctcactctgtaacccaaactggagtgcagtggcagtcctggctcaatgcagactcaaaactccaggccccaagcgaacct

SEQ ID NO: 45991 - DNA, 201 bp, Homo sapiens
ttcttctctttttccttcttccagctcttatgtgtacttctctgcctctcctcaaccctctgatactggtgttctccagagttctgtctttggtcttctgytgtgagtgatggcaaggttttaactgcctttcctgtatgctggtgtcactctccctgagcttcatacttacatatcccagagcctgactttgcattttga

SEQ ID NO: 45992 - DNA, 201 bp, Homo sapiens
agttggtgacagaccccatcctctccccatgttacccaattccagggaactagtgcaagtggagaagccaggataacaagcattcctttattagtatctgrgcatacatgaatatttatcctgaataagaaactatttgaaagacagatctagaatgaaaccctttcctcagtgtgatccagatctactcctactggttaa

SEQ ID NO: 45993 - DNA, 201 bp, Homo sapiens
ctggattggagatccaagaacttaatcttagtaaatacattaggcaaacagctattttgcaaccaagttgacagctttttttaaaaaaaattttgttaccraattgactagtcactttggtgttgtaaagacatggacctttctgccagccctcccctcctccaaatacttaaaataattatatcaccatagagactcctt

SEQ ID NO: 45994 - DNA, 201 bp, Homo sapiens
tcatgacctagttacctgcctggattggagatccaagaacttaatcttagtaaatacattaggcaaacagctattttgcaaccaagttgacagcttttttwaaaaaaaattttgttaccgaattgactagtcactttggtgttgtaaagacatggacctttctgccagccctcccctcctccaaatacttaaaataattat

SEQ ID NO: 45995 - DNA, 201 bp, Homo sapiens
acagcccagtcacagtagcggaagccttggacagagttctagagattttacggaccacagaactgtactcccctcagctgggtaccaaagatgaagatccycacaccagtgatcttgttggaggcctgatgactgtgagtgatgaggcaaaacctgaaaagcaagagaggtatccggggcctctagagtgcagctgatgtg

SEQ ID NO: 45996 - DNA, 201 bp, Homo sapiens
aaaataaaaataaaaataaaaaaaatttaaaaagtggctgacatagcaagaaccaaagatgctagagacaagatgataattcacagggcatgtgagggacrgtaaccaataatataaagagaatatgaatcgagagatttttgagatggattgagcggatagatagaatattttagtctgagaggataagggatgagggaa

SEQ ID NO: 45997 - DNA, 201 bp, Homo sapiens
actatgtggcagacactgttctaaatgctatgcatatattaactcacttatttctcaaaacagcctataaatgagatgctatcattacccccacttcataracaaggataatgagacccagagaagttaagtaacatttccaagattacacagctgctgagtggcacagtagaaatttgaatcttgacgatttggctctgg

SEQ ID NO: 45998 - DNA, 201 bp, Homo sapiens
ggccacagtgtgatggttggcgctcagttcaccgtcactctaaacccgctggcatttggggtcatccccacactcacggggtggtccacaatcatctgaartgtgagccacaccattccacatagaagtggctgcccaccacaagatttcctccattttttggtctctcagctcctggcctggcttaccacacgtcagagt

SEQ ID NO: 45999 - DNA, 201 bp, Homo sapiens
ataacaaagcatttttatacctctggctaactacagtgtttttcctcttcatcgaaggaggctgcagcgaatggcaatgggatctgtgctggggagggcayctgtctgcaggcggttccggtggtgtggttttctggggtttagccctgatgtcaaaatcggcccatgggtttgcattttaacaaggtgtgacgtggtaag

SEQ ID NO: 46000 - DNA, 201 bp, Homo sapiens
tttacttttgtgtctgctgctggctggctcccgctaagacacagtcatcttaccgcactggctgcctgctgcccttccgggccacagtgtgatggttggcrctcagttcaccgtcactctaaacccgctggcatttggggtcatccccacactcacggggtggtccacaatcatctgaaatgtgagccacaccattccaca

SEQ ID NO: 46001 - DNA, 201 bp, Homo sapiens
ctcccgagtagctgggattgcaggcacatgccaccaagcccaggctaatttttgtatgtttagtagagatggggtttcaccatgttggtcaggctcatctygaactcctgacctcagataatccacccacctcgacctcccaaactgctgggattacaggtgtgagccactgcttccagccaggctaaaattcttaatgtc

SEQ ID NO: 46002 - DNA, 201 bp, Homo sapiens
atctcccaggatggtgactaagtagcttagctagtgatcagctcatcctttaccataaaagtcatcattgctgtttagcttgactgttttcctcaagaacrtcgatctgaaggattcataaggagcttatctgaacagatttatctaagaaaaaaaaaaaaagacataaaataagcgaaacaactaggaccaaattacaga

SEQ ID NO: 46003 - DNA, 201 bp, Homo sapiens
cagctcaattcaagtgcataagtgctttccacaagacaaccagcagattttggtatgcagttcaagtgtacgtgtactcccatttcatcacattcatcatmcagaatattacagagacatgtacttcgaaggtcaagatttaatacaattaataactcttactgcttcaaagaggtaattctcaagtgaaactggttctgt

SEQ ID NO: 46004 - DNA, 201 bp, Homo sapiens
tgtcagtatattatatatggaatttaaaaaaggaaaagctgccttcgccgagtcccagtcctacctgtgtgctcggtgatcaccatcgaatgcctggcgarttaacccttgtgggcttcaccgtcatcttgaaccaagcctgatctgaccatctgttttccagattgaaggcagcgactgtgaatgcaaccctgctgggaa

SEQ ID NO: 46005 - DNA, 201 bp, Homo sapiens
tagtagaaatcaagaaataattgaagggttacatgtatgtgccactgccctacctgaaatgcattaaagtagctaaaagctctgcttttacacattttttwaaaaaaactgggagaaatttcctctaagattacatatcaaattgctcaaaataaaaacaaaactgctgtagcagttacctctagggaagaaaatggatgt

SEQ ID NO: 46006 - DNA, 201 bp, Homo sapiens
cctaattgtttttacacaatcaatttgatggtgtctttaaaagtggagaataacaatctttcaggttctatgtaaatggcctgtgatgtgtgtaccaactygtgtcctggccacatggctcaggacactgacatcaccactaggtgtggaccagtctttctaaacatggctgaacacacctgctcctgactacttcctact

SEQ ID NO: 46007 - DNA, 201 bp, Homo sapiens
agaactaggaaggtcatccactcatgtaagcccccacctctgcactgcaacttactattaactgcagtatttatagtaaacagtattactttgataagtartcaaaaacctccagaacatattctgcccattgatagtctaataaataggtccagtcttaaaccccccaaatgtcatgcagccttttggcttggcagagct

SEQ ID NO: 46008 - DNA, 201 bp, Homo sapiens
agatgaggtcacaaggctggggacctgatccaacaggattagtatccctataagaagagacaccagaaagctactccccactccctgccatgtgaggacasagcaagaagacagccatctgtaagccagcaagagagccctcaccaggaaccaaccctgccagaccttgaccttggacttgctagcctttggaactttgag

SEQ ID NO: 46009 - DNA, 201 bp, Homo sapiens
actgttttgatgttctcaagggaagggagaggggaatcaccttgtcagataaacgtccaccatgtgacaggtaccttctctcttttttaaaatactcataratcacataagggtcagctatcactggggaaaatggaatagcatctgcaagtcttgcttactgggaggacgagctcttcttgtgatctgcacacatttctt

SEQ ID NO: 46010 - DNA, 201 bp, Homo sapiens
atccacaacacggatcattggccttggtgacaaaaacttccttgccccagtataccttatcactacagggaaaaagtccgtgtgtacctaccgtgaagaarcaaggttgttacctgacacactaacaacacatcagatgcacttgcagaatccggcttgtctctggggaaagaaacaatctacttatgccagaaaacctct

SEQ ID NO: 46011 - DNA, 201 bp, Homo sapiens
attttaacaatggtagttttatgactaaaatttccacttgatttttaaaatgttttctagttctttgtcaaaatgttgtttcttgtcttttaattctttgracatattttcaagtctgtgtgtgtaaccctagtatctggatcttccacgtgtctgtttaatgttttttccctctcttggcttttggtcaacctttttttc

SEQ ID NO: 46012 - DNA, 201 bp, Homo sapiens
ggaatttaagtggaatttgccagttttttaagtggaaaattggcaggtctgacctattggataattgcctgggagttaagagaaaaaaaattttttaacgwaatgaagagattgtcctaatccacaagggcatctttctttgttgtcttctctgtgttttgagacgttttctttagagaaagatttgatgttgtatcattt

SEQ ID NO: 46013 - DNA, 201 bp, Homo sapiens
attcactgttggaacccaagggccaagaatgctggctggctcatgggaagtacccaactaatatgggtggaagtcatagcaaatattgttgccaaggtgcrgatgaatcaggagcttcctatttggatgggaagcaaaggagagagtataactgcactgagagggataccttctatcctcaagaattaagaaacccccaat

SEQ ID NO: 46014 - DNA, 201 bp, Homo sapiens
ctctgactctgaaacagaaaagtgttctaggcagaaatgacaactgagggctaatgagcattaactggactgcaagctcgatgagggcaggggctattgcmtgtttattcactgttggaacccaagggccaagaatgctggctggctcatgggaagtacccaactaatatgggtggaagtcatagcaaatattgttgccaa

SEQ ID NO: 46015 - DNA, 201 bp, Homo sapiens
ttctttatcaaaacacatctttctttcttcactttcatgtagaattgtttctcttatatttagtagttttaattacatatattaactactactttaactcktagtaaccctaatttccatggaaaaacctaggattacttaatttaacataacagattttaagatttcaaattactgaaaagaactttgaaactagtttta

SEQ ID NO: 46016 - DNA, 201 bp, Homo sapiens
ggcagaggatacgcaagaaaggctttttgttgtgttttgtttgttttttgttttgtttttaaataacatagggagccatgggacacagcttctaaaggagrgaggcgttttgattcagaaagaaaagctaagcacttaaaaatcacttgtttttgtgttaaagctatttgaaagaacaatttgcaaggcaaaagttttatt

SEQ ID NO: 46017 - DNA, 201 bp, Homo sapiens
aaaacagtttgatttttttccagtgatttttgatattagggtctgtcccactaggggtgagcaggcaaattactgtgtttataattgtttaaatcagttcytttttatgtggctattctactaacaatggaccagttagtgattagcacaatacagttaggattatttatttcattttccttttgatttggtcttctttaa

SEQ ID NO: 46018 - DNA, 201 bp, Homo sapiens
acacacacacacacacatctcagaataccagtgatcaacacgacttcatgatcaatatgaacactgaaaacagtttgatttttttccagtgatttttgatwttagggtctgtcccactaggggtgagcaggcaaattactgtgtttataattgtttaaatcagttcctttttatgtggctattctactaacaatggaccag

SEQ ID NO: 46019 - DNA, 201 bp, Homo sapiens
aaaatatcaagaatgattcccccagtatttacaaactattatttgattcaacaaagaagttcctcacatcactgacaaatgagtgaaatttctatgtacayctttgttatttgtctttcatcttacttttttttttttttttgacatggagtctcgctctattgcccaggctagagtgcagtggcgcgatctcggctcact

SEQ ID NO: 46020 - DNA, 201 bp, Homo sapiens
ttggatggttaatttggggcagggttgttgcttcattcattacaatttctatctgctgcagtctagagcattacttattaacaggaaagtcttccaatgcyatcattgaaagaggctgtggccatcctgtgcaatgggaatccctgtgtttgcacagagtgcagtgggccagcttatgtggctgccgtgccagcctgccat

SEQ ID NO: 46021 - DNA, 201 bp, Homo sapiens
ctggctcttgaagttagaaaacgacgacagaattggatggttaatttggggcagggttgttgcttcattcattacaatttctatctgctgcagtctagagmattacttattaacaggaaagtcttccaatgccatcattgaaagaggctgtggccatcctgtgcaatgggaatccctgtgtttgcacagagtgcagtgggc

SEQ ID NO: 46022 - DNA, 201 bp, Homo sapiens
tgctggggctcctgtgctcaagtttgtgaagtttaagtggttttcccaaatacttagcttcctcttaggggaaagggaaaatattagctgtcccactgtaycagatgataaaataaccttgcccttaacttaatttgacttttcagactgcctttatgttttgaaatctcatttggtcttcagtgagttcataaaaatgtt

SEQ ID NO: 46023 - DNA, 201 bp, Homo sapiens
tgggaatggaaatgactcccttctggtggagacagagctttcagggaagcctgctaaaccagcacaagcaagtgcagccccttggccatcagggtgccgtygcaggacagggctgagctacaggttcaccttcctcacctgagtagcagctcttcctcctgcaggcctaggagagcaaattctgggaataccaaaaatgat

SEQ ID NO: 46024 - DNA, 201 bp, Homo sapiens
tgctatttatgttttctaccccagttacttgaatctatttcattgaagaattaaaaaataaacaggcctgagactccaagcaggattgaacataccacagyggcactagctggaggcccagagtttgggccccgtgggttctcactgctcaggtacagtcagtgaaggtggagcccaggttggggctgtcctgggtcctga

SEQ ID NO: 46025 - DNA, 201 bp, Homo sapiens
tttcaccatgttggccaggatggtctcaatctcctgacctcgtgatccacccgcctcaacctcccaaagtgctgagattacaggtgtgagccactgcgccyggcctatgctcctttcttttataccacatgatgtttcacagctgaagccacatgctaccagttgagaacagcacccaattcattaatgccaagaccaagg

SEQ ID NO: 46026 - DNA, 201 bp, Homo sapiens
ttagaaccaggtattgagggattaaggtcctaggtacttaagagctatagtgagacaggtagaagcagaaatggcaggaaaacagtaagggggtatgtggrtaaggttttcttctcagttttgccaacagcatcctgatatttattcactttcatcagcaaggaaacaatgtggcccaagaatgatgcttttgaataattt

SEQ ID NO: 46027 - DNA, 201 bp, Homo sapiens
tagatcattttcttagaaccaggtattgagggattaaggtcctaggtacttaagagctatagtgagacaggtagaagcagaaatggcaggaaaacagtaasggggtatgtgggtaaggttttcttctcagttttgccaacagcatcctgatatttattcactttcatcagcaaggaaacaatgtggcccaagaatgatgct

SEQ ID NO: 46028 - DNA, 201 bp, Homo sapiens
atgtgtgagtagttggttccattttattgctaagtggtgttctactatatggataggacacattttgtttgttcattcatcagttggtggacattttggtkatttttaaatttttgctattataagtaatgctgctgtggacatttgcatacaagtttttgtgtggatgtgtgtttttgttatttctcatgaggagataca

SEQ ID NO: 46029 - DNA, 201 bp, Homo sapiens
agagccaacccacagctcactgtgagtcctgacacagtcacatccactctatcccagttctccacgttctggggctaatagttacagaagggagagtatcrtctgtcttataactgttgtgatttaattttgagctttgcttcaacttagacttccagattggttgggttattcaggattcaaatctctttcactaataat

SEQ ID NO: 46030 - DNA, 201 bp, Homo sapiens
tggattggagatccaagaacttaatcttagtaaatacattaggcaaacagctattttgcaaccaagttgacagctttttttaaaaaaaattttgttaccgrattgactagtcactttggtgttgtaaagacatggacctttctgccagccctcccctcctccaaatacttaaaataattatatcaccatagagactccttt

SEQ ID NO: 46031 - DNA, 201 bp, Homo sapiens
tgctctctccacctaagagaaggctgggtgacacaatgcaagccctaccattgatgaaggccagtcatatggaaatggtgccacaggcttgctttctgggmtaagcagtcctacatcccccttccccaggagcaggtcctggagcacagaatctgccttgacttccttttcgtggttaaagggccctcaaggagagaaaac

SEQ ID NO: 46032 - DNA, 201 bp, Homo sapiens
ctgactgctgatacactttttttatcacttcctctgtcccctgcctgctgtccttctccctatcctgaactcaaagcccaagggtggaatgggggagaaasacctgagcctcataagagactcaggaccctgtcttatcagtttattccattttttttctcagtttttactttcccactttctataaccttctctccacag

SEQ ID NO: 46033 - DNA, 201 bp, Homo sapiens
aatctagaaaagaaaaagtgagccaattattctacattcagccaaactggaccctcaaatataagaaccacagacaaaactgtgcgaacatgccagacctyggggaatgaatttcccattaacccttcttgaggaaccttctgacaattactgtgactggagaaactttagcataaggactggtggttgacacgtgagact

SEQ ID NO: 46034 - DNA, 201 bp, Homo sapiens
tactggttctctgactgtggctgggtggagttggcatctgtctcctaggttcctcctgcccccaacagtttgtggttatggtgataaaattattgtgtgayaaatatcatggcagacatataaacagaggaaaggggacagcaattgaaagagtatcaaacacactttaaggttctaactgtttcagttaccaaggctcag

SEQ ID NO: 46035 - DNA, 201 bp, Homo sapiens
gaacttggaggaaacagtaccattattgcctttgaagatgcagacctcagcttagttgttccatcagctctcttcactgctgtgggaatagctggccagargtgtaccactgcgaggcgactgtttgtacatgaaagcatccatcatgaggttgtaaacagacttaaaaaggcctacgcacagatccgagttgggaaccca

SEQ ID NO: 46036 - DNA, 201 bp, Homo sapiens
ggaatgaggcctttttggacctcatcaaccttctctgaaattccccttgtggacttggggctcagcaagccctcctgcctccaaagttccaggccagatcrcctttccagactcaggcaagtagcagttgggctaccagccttggcagaagagatgggtgaattcatggctttttaggtgggagggtggccctgtgagaag

SEQ ID NO: 46037 - DNA, 201 bp, Homo sapiens
acaattcaatgttaatggacatttgagatgtttccatttggagctgtcatgaataatgctgctgtaaacattcttggacatatcttttggtgctcactggrcacattcctattgggtatttacctaagatagatagtgagtgtcactatatttccagtttgtgccccactgtcccagcttatgcctagacgtccagagtaa

SEQ ID NO: 46038 - DNA, 201 bp, Homo sapiens
atatctctacagttttgccttttccagaatgttatatggttggaatcatacagtatatggccttttcggattgacttgactcctttcacttagtaatatgygtttaaggttcctccatgtcttttcatgggttgacaaactatttctttttagtgctgagtaatattccatcattagaatgtaccacagtttatttatcca

SEQ ID NO: 46039 - DNA, 201 bp, Homo sapiens
ttggtgctagttcattgagtcatgctaaggtgttagcagttttacccactattgcttcttctcagtgtaaatgtcagtagttttggtatgagaattcgtgyttgtatgacattgaacagagctttgactttgcaatgataaaagcagatcccagaaaaggggctaagtaccctgagatcaatgtgtcaggagatgctatgg

SEQ ID NO: 46040 - DNA, 201 bp, Homo sapiens
attttctgactttttaatagccattctgactagtttgagatggtatctcattgtggttttgatttgcatgtctgattagtgatgctggacttttgttttgkttagtttttttttttttttttttttttttttgagacagtcttgctctgttgcccaggctggagtgcagtggcatgacctcagctcactgcaaccctcacc

SEQ ID NO: 46041 - DNA, 201 bp, Homo sapiens
caaaggttttaggggttttaattattttaattatttttaaaaatcttatgctgtagtctttgtcgtctctttggagggactccatgcttgttccttgatgkcttgaagcatgttgagccataaccacccaagcaactcagagttttagtagctgaacaaggtcactcttgggtgctagaggcagagaggcagccagtcctg

SEQ ID NO: 46042 - DNA, 201 bp, Homo sapiens
gaatttgagccctggtggagcaatgtccggcacgctcaggaaagtgtgaaatctagaactctctgtagtggcctgaggcaatagtcagacatggctggtaragctgtgctgcctcagaagtcatcctggataagctgctctggatccccatcgtggaagcataaaatgtcaagcagaaggatgttatgagaattggaacct

SEQ ID NO: 46043 - DNA, 201 bp, Homo sapiens
gcctaccctgactgaggtgggcacttcatatgtgaatgcaggtccacctgccgaggggctggaggtgtgcttgctgctgtaaacttgctctgtggaatgcrtgcgcaagccccaggccacagtgcccgtggaagcgccacttccctgctgcccttcatgacaccactgcccttgtgacttggcctctacctcagctccagt

SEQ ID NO: 46044 - DNA, 201 bp, Homo sapiens
catagtattttattagaagattcaacagcaagaaaataacattgcaaaaatgacctggcaatgccaaattgctggaagtttctaagcacttattgtcagtmtttttcctaatctctttactgttgggtagcagttcacagactggccaggcgcggtggctcacgcctgtaatcccagcactttgggagtccaaggcgggtg

SEQ ID NO: 46045 - DNA, 201 bp, Homo sapiens
gatgcaggtattagtatccacattttacaaatatgcagactcaggcccagagaggttgaataactccaaggttatccagctggttagtgacaaaggtgggrtctgaatacaggtcttacttccaaagtctgcacttgaattacctcctgtaccacctgtgctacctctgtgcctctctgaaccaactttgggttttctgga

SEQ ID NO: 46046 - DNA, 201 bp, Homo sapiens
ggaaaatttggttcctctgacaaatctttttatttcccagcaaacctatatcactttatttgtagtgcacatcggttatgatttagcttgtggctgaggawctctctagactaatatatgaaggcataaaatttttcctccaaataaaaaatgttctatttttatcttaatttcttaatcagttggaaagtatatatccat

SEQ ID NO: 46047 - DNA, 201 bp, Homo sapiens
ttacttctggatttgttcctcttgacatgaaaaacatatattctctgcttcacatcaaaaatgtaggcttacttttaagtagctatatttttaaaatctgwgtcctgtttttgatctagtttttattatatcttgcattttacctgccatttctcttctttctcttttgttcattttacaggaaatgggagatcagagatg

SEQ ID NO: 46048 - DNA, 201 bp, Homo sapiens
tgtagctgccaattaagcagatttatgggaaaatttggttcctctgacaaatctttttatttcccagcaaacctatatcactttatttgtagtgcacatcrgttatgatttagcttgtggctgaggaactctctagactaatatatgaaggcataaaatttttcctccaaataaaaaatgttctatttttatcttaatttc

SEQ ID NO: 46049 - DNA, 201 bp, Homo sapiens
tcaccatgaaccttgacattccagttttcccacagcatgtgaaggccttaagttgttcagatataaccttgattctccaaggggtgctgtggtagaacgcrgaaggagatttttggaaaattgcatctatagagttaaatactatgaatgtttcttatcttgtcataaaatcacctgcatacattctttttataaagccat

SEQ ID NO: 46050 - DNA, 201 bp, Homo sapiens
cacggtggttgttctcaccatgaaccttgacattccagttttcccacagcatgtgaaggccttaagttgttcagatataaccttgattctccaaggggtgstgtggtagaacgcagaaggagatttttggaaaattgcatctatagagttaaatactatgaatgtttcttatcttgtcataaaatcacctgcatacattct

SEQ ID NO: 46051 - DNA, 201 bp, Homo sapiens
cgaaagtccctagctataggtgtccaaagtcgtggagacaaaatatcatttctggaagcgagagagtgagagaggggcccagaacagatctctgagcaacyccaatctgtagaggagggccaggggaggtgaatctgcaagggagcctgaggaagcctactcactgagacaggagaacattcaccaggagcccgcagggag

SEQ ID NO: 46052 - DNA, 201 bp, Homo sapiens
taaaggataaaattgtaaaatactggatgagagtattccttaaatacattacagcacatctcagatagaagctctagtattgatatggtgtggtcctcackgtgaagtgtccttacagtgaatttttaaaatttacattttggtttttctgtgagcccagagggatgccacttcctttaccgtaactctgactagttgctc

SEQ ID NO: 46053 - DNA, 201 bp, Homo sapiens
gatatggctttgggcaagtcttgatctggtaatttggaagtgttacaaaggatcttgtttctttccatttctccactctgctttccatggtgttgctttcrttctcacatggtgtcaagatgttacgagaaacaacctcactacacatttctttttgataaacagtgagaatatttattaaaagtagaatagctttttccc

SEQ ID NO: 46054 - DNA, 201 bp, Homo sapiens
tctctaatatcaacaaggggaagtcatttgtttccattgagattctttctgtttaaacacaggagagctcattcaaccttatttaataaggagaaaaaagscaattaattggctcacctaactgaaaaatccagagttagatatggctttgggcaagtcttgatctggtaatttggaagtgttacaaaggatcttgtttct

SEQ ID NO: 46055 - DNA, 201 bp, Homo sapiens
ttttacagcccatttgtgtatttgttttgagcattgcttgtccttttcttgaccctttttaattgggatgttcgcctgttttattattgtcttagtagagrttcaaaaaactctaataaggatgccaatccctttactatcatatattactaatattttttctcagttttgtatttaaatatttattatgctttttaatat

SEQ ID NO: 46056 - DNA, 201 bp, Homo sapiens
tgggcaatgaactgtccttagttttactttgtccagaaatgtcttaacttgaaagctgttgttcctgttttctgtttccgtagtttctcatgaaaatttascagtcatctgaatcattgtcccactgtgtgtattgtgtagtttttctcgggccgcttttgtctttggctttcagcagattaattacaatgtgcctaaaca

SEQ ID NO: 46057 - DNA, 201 bp, Homo sapiens
ctgaaataattattgtcatatttcttataacgaagatctgtgggcaatgaactgtccttagttttactttgtccagaaatgtcttaacttgaaagctgttkttcctgttttctgtttccgtagtttctcatgaaaatttagcagtcatctgaatcattgtcccactgtgtgtattgtgtagtttttctcgggccgcttttg

SEQ ID NO: 46058 - DNA, 201 bp, Homo sapiens
atgcctcattaagcaggaaagtagtcatgaggaaaggcatgcacttgagagccgtacctgggctctttatcttctgacagataggatcattcccaaggtcrtgagagtgcaggggattgggtgccaaccaggacactgaagagctcccggagcctgtgcatggtgtctagcccttctgtcttcaggcagtcacgtgcaagc

SEQ ID NO: 46059 - DNA, 201 bp, Homo sapiens
tacaatggggaaactttgagactcatgttacttcctgttgttagagtgcttgatttagtgctttaattactatacactactgaaacaaagtgaatatacaycaccttaggaaatcacttgttattttcttgaactgttttgtttcatctacaattacatctttatatcacatttcacaaaatactggtgattatgtggtgt

SEQ ID NO: 46060 - DNA, 201 bp, Homo sapiens
atactgtctgaaaaatcaagtggccttttcttcatccatacctggaacacgtttacttccccagtgtgcagaatgtatgtgtttctgcttagagagtcccrtccccattcccgtcatgctgggctttccaactggacatggaaatggatccccacagctgtgacctaagctttttcttagcaaggtcacacatctcctttc

SEQ ID NO: 46061 - DNA, 201 bp, Homo sapiens
aattactcaagtgattgtctcaaacctctatgtcatttgtttgtagagttctttagaagaacttagtacaattatctgaaagtgtctctaaggtatgacayttctgtgtgcattattgtactcagcatttaaaacatggcattgcactgatgtccttcctgtttcttaaaataagccaagtcttttctggcctcagggcct

SEQ ID NO: 46062 - DNA, 201 bp, Homo sapiens
aggaagagctaaccagagataccacttccttctgggaagaagcagcagggctgggagaatcctagcccagactttctctggaagctgctccagctcctgascaggcttatcttaccagccgggtgggagttaggaggactccggagtcacacagaaagccaaaaatctcctgaaaacaataccctttccagtgtagatcct

SEQ ID NO: 46063 - DNA, 201 bp, Homo sapiens
attctccagttatcaattggtggttagaaaacctgtatccttgggagaggtaatattgtgatggtgtcacattatgatattaatcatctcccagcctttgygatgaacaggaagaagcaggagcatgaggccagtataacagatgcctgtaaaggagaggtggaaggagagtcactgcctttaaagggaaacttggattct

SEQ ID NO: 46064 - DNA, 201 bp, Homo sapiens
tagtgagcaggtgagagtactttctctgaaactgaagagagaagtgtcctgatcctaaaacctttcagagagctgcctgactgcgctgctcaggaaaaaasgggtgctcaccctagcatgatagggatggccaagtgccttggggcacccagctgttcagcggcattgtggtgaaagggaagtacagtcgatcctcatttt

SEQ ID NO: 46065 - DNA, 201 bp, Homo sapiens
aacaaaaagcaagatgatagatttaaacccaaccacatcaatagttgtattaaatgtaagtagtctaagtatctgaattaaaaggcagagattatcagatrggataaaagaaaagtcaagagccaactatatgctgtcaacaagacatccacttttaatataaagacacagaaagcttaaaagtatagaaaaggatgcacc

SEQ ID NO: 46066 - DNA, 201 bp, Homo sapiens
catgcgtcacctctgttctctgcttatctcaccactgttctctgcttgtctttctccatgtctaattgtagctgccaattaagcagatttatgggaaaatktggttcctctgacaaatctttttatttcccagcaaacctatatcactttatttgtagtgcacatcggttatgatttagcttgtggctgaggaactctcta

SEQ ID NO: 46067 - DNA, 201 bp, Homo sapiens
atggggggaactaagaacagagaagagaagtacaaaacaaaaagcaagatgatagatttaaacccaaccacatcaatagttgtattaaatgtaagtagtcyaagtatctgaattaaaaggcagagattatcagataggataaaagaaaagtcaagagccaactatatgctgtcaacaagacatccacttttaatataaaga

SEQ ID NO: 46068 - DNA, 201 bp, Homo sapiens
tgccagacggaaatccggggacagcatccaacagcacgtgaagatcaccccagtgattggccaaggagggtgagagcaaactgttcaactcttttagctgragataaagactcaaggccctcatgggcattgggcttgaaatgccagtatgagccttacatccacaaatgcagtagggttgtgctgaatgtagtatagatc

SEQ ID NO: 46069 - DNA, 201 bp, Homo sapiens
tagcatccccaagtctcagatctctttcattgactacttcataacagacatgtttgatgcttgggatggtaagacagttactgttttgtcacccaaagaarattgttatactttacgaatattatctttagtgacacagggtgagcctaaaggtaaacaaaatatatttttaaaaatgtggctgtcagctttttgtggcca

SEQ ID NO: 46070 - DNA, 201 bp, Homo sapiens
tttctaatgaacgacttagaattcaaccagctagcctgggccacagccttgaagctaacctctcttttagttttgtttagaaactacattttgaggaattcttggttcttgaatcttgaatttaatcttaaatttttaagttagatttaacttattacttggtacacaaataaatgctaggactgtatatgattatgaggt

SEQ ID NO: 46071 - DNA, 201 bp, Homo sapiens
gcccgccaccccacccagctaatattatatttttagtagagagggggtttcaccatgttggctaggctggtcttgaactcctgacctgaagtgatcacccrctttggcctcccaaagtgctgggattacaggagtgagccacggcgcccgaccggctgttttacttttgtgtctgctgctggctggctcccgctaagacac

SEQ ID NO: 46072 - DNA, 201 bp, Homo sapiens
cataatatcaccactttacaccacatagtatcacacacacacactagttgagtacagtggtgcccacctgtagtcccagctacttgggaggctgaagcagraggatcacctgagttcaggatttgtgaccagcctggacaaaatagtgagaccccatctttttttaaaaaagaaaaaatatatatactgtatatgtaaagt

SEQ ID NO: 46073 - DNA, 201 bp, Homo sapiens
cactggcccactaaaagaaatattttcaagatactgagaaatgcaaaaaaaatgtaaaaaccaagcataatatcaccactttacaccacatagtatcacamacacacactagttgagtacagtggtgcccacctgtagtcccagctacttgggaggctgaagcaggaggatcacctgagttcaggatttgtgaccagcctg

SEQ ID NO: 46074 - DNA, 201 bp, Homo sapiens
tcaggcccagtgggattccaaatgagggaggttcacaggctgttggaatcatctctagtcttaggaataccatgacttcagttttctcagaagaagtaagmcaatgagagatacttaacattaataatttgaatagtagaaatataatgacacttgaaagagaattcgtatgccagaacaacaacaacaaaaaaagcctat

SEQ ID NO: 46075 - DNA, 201 bp, Homo sapiens
ctgccttcctgcggacccattcataagactgacatattcattcattccactgacatattcattcattccacaagtagttattgagcatctgacatgtcccrggtgctatgctagctcctggacatgcagtgatggccaacctggcctagctacatgtgggggacaaatggaggcacaaatagtaccttggtattctgagac

SEQ ID NO: 46076 - DNA, 201 bp, Homo sapiens
tagtagagacaaagtttctccatgttggtcaggctggtctcgaactcccgacctcaggtgatctgcctgcctcggcctcccaacgtgatgggattacaggygtgaaccatcttgcccagctagttctatctttagactaaaatttaagtatctataaaaaggaggaactgctgtttaatgaatgcaaatgtttaggtacat

SEQ ID NO: 46077 - DNA, 201 bp, Homo sapiens
catgatctttgctcactgcaacctccgcctcttgagttcaagcaattctcctgcctcagcctcccgagtagctaggattacagacatgcgccactatgccyggctaattttgtatttttagtagagacaaagtttctccatgttggtcaggctggtctcgaactcccgacctcaggtgatctgcctgcctcggcctcccaa

SEQ ID NO: 46078 - DNA, 201 bp, Homo sapiens
tggctggacatgaaattctgggttgaaaattcttttctttaagaatgttgaatattggtccccactctcttctagcttatagggtttctgcagagatatcygctgttactctaatgggcttccctttgtgggtaacccgacctttctcactggctgcccttaacattttttccttcatttcaaccttggtgaattcaccaa

SEQ ID NO: 46079 - DNA, 201 bp, Homo sapiens
acaggaagaaatagggcaaaagccatttgaggtggacaaaatagtatataaaaaataaagtttgatttttattaacacaatggtgaaaagagagaacttcmaggtagttccatctgttttttttttatttattttttattttttatttttttttgagatggagtttcattcttgttgcccaggctggagtgcaatggcatg

SEQ ID NO: 46080 - DNA, 201 bp, Homo sapiens
attctcttgggagggtcaaaccacagctggctgatctgttatcaaaggatttgtggtgcctcgaacatgtcctgttatttcacaatcagtgccctttgtamatatggttccttttatttcttctttgtctgacttgtcctttaaaacctccatttgagagctgcctcttccagaaagccttccttgaccacctccagctgc

SEQ ID NO: 46081 - DNA, 201 bp, Homo sapiens
tgatgtcggaggacctggtatttggtgctatgtggagtaactatacagctaatttcctaatggaggttattgttattaattcaatttatttttatagcaastttattgagaaataatttaccaccatacagttcacccctttaaagcatacaacttttagtatactcttagaagttgtgcaaccatcaccataatcaattt

SEQ ID NO: 46082 - DNA, 201 bp, Homo sapiens
agtagcaggaaacataagcctttattcactttacaaagcataaatagtaacagtatacttcatatgtacagtgtgaccagttaaaatggaaagatcctgcrtatgggaacaggggtggcactagtgagtgtgcctggtaaaaaaaaaacagggcaaaaaggcagaaaatggagagaagcaggggacagactgaatgattag

SEQ ID NO: 46083 - DNA, 201 bp, Homo sapiens
tctgggccagtgaatacaatgagccagggtgggttttcctatttttcaggccattggtttatctgggcttaaaggtcttctctcggtttggagtatgtgartttttaaactgttctgaaaccactcttcgggcctggttccaagtgatcgaagccaactaccactcttccaatgcctaccacaactccacccatgctgccg

SEQ ID NO: 46084 - DNA, 201 bp, Homo sapiens
atcatagacaaactcagaacttcgatgcagaagcagtgtgcaggtaccttctctaatttaatatgcttagtaaatgttcactttacatcttaaaacgaatwtcatttatagatatctttagtttatttcaaatatttttaaaatatgcgttgatgtttttaagcagtgtatacagatgtctgtggtgaaagctatagctcc

SEQ ID NO: 46085 - DNA, 201 bp, Homo sapiens
cattgtatcgttttttatagttattgacactttgcttctatcctatcaattctatctgtaatttatttcaaatcaatttcttgaacaggcaggtaatagcytattatattatttttcctatgggaaaatatgatcgtttattaatttggttttttaaaatttactaaacatctattacccagaaagcactatagaaaatgc

SEQ ID NO: 46086 - DNA, 201 bp, Homo sapiens
agccttgtagtatagtttgaagtcaggtagcatgatgcctccagctttgttatttttgtttaggattgtcttggctatgcgggctcttttttggttccatwtgaaatttaaagtagtgttttttccaattctatgaagaaagtcaatggtagcttgatgggaatagcattgaatctctaaattactatgggcagtatggcc

SEQ ID NO: 46087 - DNA, 201 bp, Homo sapiens
aatgggctgggaggatctctgaggagtattttgcacaggtgcgccatctttccagggaagctccacttcccctctgggaatgggaactaggtcatggaackcctgggggattctccagctgagtaactttttaccaattagttaaccactcctccctggaagaaagcagcttacccccacctggggtaggcttctggttcc

SEQ ID NO: 46088 - DNA, 201 bp, Homo sapiens
taaagtgcaaaagtttgaggcttccatctgacagctaaagccaagccacagagggggcctcttgaccgacaaaggacactgtgaatcacagtagcgtaaayaagaggccttcctttctaatgacaatgacaggtattggtgaaggagctaatgtttaatatttgaccttgaatcattcaagtccccaaatttcattcttag

SEQ ID NO: 46089 - DNA, 201 bp, Homo sapiens
ctctacttcagtgcatctgaatccagctcattctttttaagaaaacataatattctatatccatagatttgccattattcagtcacgcatcttgtaatgawgaacatttaggttgtttccagttttttagtgctatgatcatgccactgtgctacagcctaggtgacagagggagaccttggctctaaaaaaatgaggaag

SEQ ID NO: 46090 - DNA, 201 bp, Homo sapiens
tctacatatacacaagccatgtgggggatttgagggtgtggtaaaaatgcttatatcttgataacctgaaagtccctctacttcagtgcatctgaatccarctcattctttttaagaaaacataatattctatatccatagatttgccattattcagtcacgcatcttgtaatgatgaacatttaggttgtttccagtttt

SEQ ID NO: 46091 - DNA, 201 bp, Homo sapiens
taatcatgtgagccaatttatataataaactcagctcgcttgctcgctctctccctctctctctacacacacacacacacacacacacacacacacacaaycccctgttggttctttgtctagagaatgctaatatagcaggtgttggtcgccatttaccaatgacgaaactgagacttagtaaagctctgtaagttcccc

SEQ ID NO: 46092 - DNA, 201 bp, Homo sapiens
cccaaccaggctctgctgcctgactctcttttctggaaaggtttctgctgctttcagacgttcatttttctccctatgcattaattgaagtttagagtatrtttcgtgtcctggctatgctacaggcagggctggcttcataggcatgccaccaacgcggctgcacagggccctattctcagaagggcctctcacctgggg

SEQ ID NO: 46093 - DNA, 201 bp, Homo sapiens
ggagataattttctatttcgacccttccattgaggtcactttttttacgaagtctaatctctgcaattatgacatcacattttattgtagagcaaagcatygtactttcagagggcaaatatcatttaagtgatagaactgatttttcccccaaaataaacacagctcaagaaaaagcagcaagaaaattaattggtatac

SEQ ID NO: 46094 - DNA, 201 bp, Homo sapiens
gcaggtcgatccgggccacaaatccctccgagcacacggtgatcctcgcagtggtttcgcgagtgtaagtgcacctcccattcccagatggaaggagtacygttcattctgaaatatttgtcagatgtaatctggtttttgagctatctaagcaatgggtgtgtcttgggtcctagaacaccagccttagatcttgatctt

SEQ ID NO: 46095 - DNA, 201 bp, Homo sapiens
aagttccccattctgactttgatacaagaagattggttgccctattatgtctgttgctgtttgtttgaggaagatacttttgtgacacctttttctgcccrtttccctttttgatactcctttttcctatataagaactatatttatttgatttggaaaggggtaaatataatcatcttatcattcctcctggcagaggta

SEQ ID NO: 46096 - DNA, 201 bp, Homo sapiens
ggtgagatggaaagaagaataaagaatggccccacctgagtagcagggcattgactgttccatgaattccaaggtggaaggagtatcacagagccctgagygaaggtttctgctggacaagagaagcagggaggatgagggtgtgctggaccgaggtgacataagagccaacgtctggctagatatgcagagagaggaatc

SEQ ID NO: 46097 - DNA, 201 bp, Homo sapiens
tgacttcttcccatgatgcttcttccccattttctcccccttctccctcttgaactccaagtaaataaatgttagactctcccactgtatccaccgcatcrctctctctcttcctttttttgtgtctgtgtcgtattccagatagttttctgatattttgtggtttaattctctgttcagttgtatcttagcagctgttaa

SEQ ID NO: 46098 - DNA, 201 bp, Homo sapiens
aaattagctgggcgtggtggtgcaggcctgtaatccaagctattccagagactgaggcaggagaatagcttgaacctgggagacggaggttgcagtgagcygagatcatgccactgcactccagcctatgcgacagagcgagtccactgtctcaaaaaaaaaaaaaaaaaaaaaagaagagatagacataagagatgtttt

SEQ ID NO: 46099 - DNA, 201 bp, Homo sapiens
tctttgtctttggttccctgcagtttcactgtgatgtgtgtaggtgtgactttcttcttatataagtgccacactcctaagtaaaaatgcccatctttgcygcttaaagagcaagtcctcttgaagttctggggcatgccccccttctttattaatttatttctgcttgagttaaagcagagaaggtctctttcccatgtg

SEQ ID NO: 46100 - DNA, 201 bp, Homo sapiens
gataaatttctgttgtttaaggcacccagtctatggtattttgttatggccactcaagtgtactaatacatgtagtttcccaggattaatccatttatatraccaatatctggctggagagacctttaaatcttcaacaacagaagcagaattcttcaaatgatgccactagtagttaatgaattctatccaaataagtag

SEQ ID NO: 46101 - DNA, 201 bp, Homo sapiens
cctaagcaccatgtgtagtaggtattcagtaaatgtttgctgtccaggggatccatgcaggaaggtctgaggttacaagcaggtaaacagaaaagcccacmgcacttcacccgcatggtggtgtttggatctattataacagcacgtctaagccaggcctgttcatcccccatgggacagctgagaaaacaaaggtaggtg

SEQ ID NO: 46102 - DNA, 201 bp, Homo sapiens
tcttttgattcttttctgtctttgcagcctttgcacatctgccagccctgatgcaacatttggctgacaactacaaacactggaagacactagatgacctraagtgcaaaagtttgaggcttccatctgacagctaaagccaagccacagagggggcctcttgaccgacaaaggacactgtgaatcacagtagcgtaaaca

SEQ ID NO: 46103 - DNA, 201 bp, Homo sapiens
attaaatccctactaggttccaggcatttttccaggtgctagggtaatagcagtgaattgaatggtagtgaacgtacatagaatatgatgtcaatcacaaraaagtagatatatctaataaactaacatagaagataagatatattagacatttcagaaatacttagtacatccaaaagaaaacagaaaaaggggaatggg

SEQ ID NO: 46104 - DNA, 201 bp, Homo sapiens
ctgttattcaatttatttaagaataatttattaaatccctactaggttccaggcatttttccaggtgctagggtaatagcagtgaattgaatggtagtgawcgtacatagaatatgatgtcaatcacaagaaagtagatatatctaataaactaacatagaagataagatatattagacatttcagaaatacttagtacat

SEQ ID NO: 46105 - DNA, 201 bp, Homo sapiens
atgcaaagaaatgtatctaaattatttttgttagatgataagagaacttgcttggtcaggacagcagccagctttgtattgtaatgctatattatgtaaawgtgatgaaaatgtttttgtgaagtacttgtaactaaattcctacagccatttttcactcccaacagctgtttttattttacctctttggcctaaagtttt

SEQ ID NO: 46106 - DNA, 201 bp, Homo sapiens
gtcctcatgcttcgcccagggtgtgcctcctctaattctgatcccaaacttgtcccagacacccccaggcttataaatgctcctggggtctaagttcaccrgtttcttttgattcttttctgtctttgcagcctttgcacatctgccagccctgatgcaacatttggctgacaactacaaacactggaagacactagatga

SEQ ID NO: 46107 - DNA, 201 bp, Homo sapiens
cctccaaatacttaaaataattatatcaccatagagactcctttatatgcatggcagatcatgaacccattttccaaatgttagctaggagctgtgttackgggttgcaggacagaacttaattattacagcaaatggttactagatctataggttaaattttagtatcaggatttggccattggtagattacagtccaga

SEQ ID NO: 46108 - DNA, 201 bp, Homo sapiens
tcttctaactctctctctttaggtactgaataacttctctcatggaatactttggtggttatttttctgttccctgcctccaacacacacacacacacagacacacacacacacacacacccccgccccccccccccccacacacacgaatgtttctgccccttgacaggggactgtgctctccagctgacctgtttgcat

SEQ ID NO: 46109 - DNA, 201 bp, Homo sapiens
tttgaacatgtgaataagtttgtgaacagcatcaacaagccaatggcagctgaggtgagtactgctttccatgccataaggcacatccaagtacatttccrtaagagcctgctctggccctgaagcattttctctcccactcaaatgtaaggtggttatttacttggagttgataaagggctgaaaggactggccacttgt

SEQ ID NO: 46110 - DNA, 201 bp, Homo sapiens
cttctaactctctctctttaggtactgaataacttctctcatggaatactttggtggttatttttctgttccctgcctccaacacacacacacacacagacacacacacacacacacacccccgccccccccccccccacacacacgaatgtttctgccccttgacaggggactgtgctctccagctgacctgtttgcata

SEQ ID NO: 46111 - DNA, 201 bp, Homo sapiens
gaaaaaagtttgactatagaaataaagctatcagccgggcgtgttggctcacctctgtaatcccagcagtttgggaggccgaggtgggtggatcatctgargtcaggagatcgagaccagcctggccaacatggtgaaaccccatctctactaaaaatacaaaaagattaggtggccatggtggcccatgcctataatccc

SEQ ID NO: 46112 - DNA, 201 bp, Homo sapiens
taatttttgtatttttattaatagtagagatggagtttcaccatgttggccaggctggtcttgaactcctagcctcaagtgatccacctgtctcagccacycaaagtgctaggattaccacacctggccactgtggctcacttcttaattgttgggccattttccccaagtaccctgtttctttatcagaaaagtgatgaa

SEQ ID NO: 46113 - DNA, 201 bp, Homo sapiens
cataaatagtaacagtatacttcatatgtacagtgtgaccagttaaaatggaaagatcctgcgtatgggaacaggggtggcactagtgagtgtgcctggtaaaaaaaaaacagggcaaaaaggcagaaaatggagagaagcaggggacagactgaatgattagctcacagagaaaaaggaagagagaagagcctctttatg

SEQ ID NO: 46114 - DNA, 201 bp, Homo sapiens
gaagaaactgtaaagaaagcaacagaagcatggaaaatctgggcagatattcctgctccaaaacgaggagaaatagtaagacagattgacgatgccttgtrggagaagatccaagtactaggaagcttggtgtctttggagatggggaaaatcttagtggaaggtgtgggtgaagttcaggagtatgtggatatctgtgac

SEQ ID NO: 46115 - DNA, 201 bp, Homo sapiens
ggagtttaccctttctgaatttgttactcatagtgacaaatctgtttaggtttgcccatacaatctttcttttctttccttcccaaaaagaggaccacttaaaaaattcttatttttctgccattatccctttggtctcattaattaatttatttttgtcttttaagagaacagttttaaattgcttcttgtgagggtgca

SEQ ID NO: 46116 - DNA, 201 bp, Homo sapiens
gtattaacagacatttgtagagcactttattctcatatgggctctgcgtgatagccattgtgtttcaggggtggaaactgagctgtgaaggcttaaaatarccagtccctattgctttattgcccagtaatgagtgccaacaagtaacaaggtcacgatcctctcacctcttccactccctgctcccaactcatcccagac

SEQ ID NO: 46117 - DNA, 201 bp, Homo sapiens
tcttctttctcttttgttcattttacaggaaatgggagatcagagatgctcagattttttcagcgtagtttcccctaacatcacagctctctcctgtctcttttattcacagtgagacactaaagacttcccagtgagcaaatttttcacataggtgaaacttactccattaaccgctaaaactttgaagaatgattattt

SEQ ID NO: 46118 - DNA, 201 bp, Homo sapiens
taaaactatgataaacaaaatgagagtttgattccaaatattccagaaatatagggaaggtcaccaagaaaagtccccactggagagctgcagaggtgcartgaaccagcaaggggagttctgctgggtttgcctttcaccatgccagggggaatggttggaagccgagtaacatcacaacagcaaaaaaggagaaaaaat

SEQ ID NO: 46119 - DNA, 201 bp, Homo sapiens
atcataaagccaagtgtctttgaagaattgtacttgagattcagaacaagactccatgttattttttaaagagagatacttcttttcttttttttgagacrgagtctcactctgtcgccctggctggagtgcagtggcgcgatcttgtctcattgcaagctctgcctcccgggttcatgccattctcctgtctcagcctcc

SEQ ID NO: 46120 - DNA, 201 bp, Homo sapiens
tctccatgaccacaactgtgaatgaaacagaagaacgtcattgcctcgtgttagtgttgaagtttcattcagcacacacatagtccattccatgatccacraagatttcactgaattacaattctttttgtatcatacacacagatatatatgctattgtttatgcatttagtttgaaagattagtttttttccctcaaag

SEQ ID NO: 46121 - DNA, 201 bp, Homo sapiens
ggagtgcagtggcgcgatcttgtctcattgcaagctctgcctcccgggttcatgccattctcctgtctcagcctcccgagtagctgggactacaggcaccygccaccacgcccggctaattttttgtgtttttagtagagacggggtttcactgtgttagccaggatggtctcgatctcctgacctcgtgattcccaaagt

SEQ ID NO: 46122 - DNA, 201 bp, Homo sapiens
aatgaaacagaagaacgtcattgcctcgtgttagtgttgaagtttcattcagcacacacatagtccattccatgatccacgaagatttcactgaattacarttctttttgtatcatacacacagatatatatgctattgtttatgcatttagtttgaaagattagtttttttccctcaaagcatattattaaccctcttag

SEQ ID NO: 46123 - DNA, 201 bp, Homo sapiens
ctaaacatagttttctttgtatttttcctgtctgtcatttgttgactccttaaatctgtaaatatatgccattcagcaaatttggaaaatttcccatctatttttttcccaaatgcttttatctcctctcacttttctccacctgggacttcaattactaatgttaggcattttgatactgcccacagatccctaggtctc

SEQ ID NO: 46124 - DNA, 201 bp, Homo sapiens
atgcatcatttaatgatggggatatgttctgagaaatgtgtcgttggatgattttgtcattgtgcaaacatcatagagtgtacttacacaagcctacgtgktatagcttactacacacttaggctacgtggtacagcctgttgctcctaggctacaaacctgtagagcatgttactgtactgaatactgtaaatactttta

SEQ ID NO: 46125 - DNA, 201 bp, Homo sapiens
tgcctcatcccctcacccttaggccacattggtttctcctaagcaccatgtgtagtaggtattcagtaaatgtttgctgtccaggggatccatgcaggaargtctgaggttacaagcaggtaaacagaaaagcccacagcacttcacccgcatggtggtgtttggatctattataacagcacgtctaagccaggcctgttc

SEQ ID NO: 46126 - DNA, 201 bp, Homo sapiens
agtgtacttacacaagcctacgtggtatagcttactacacacttaggctacgtggtacagcctgttgctcctaggctacaaacctgtagagcatgttactrtactgaatactgtaaatacttttaacacaatggcatttgtgaatttaaacatagaaaggcacagtaaaaatgcagtataaaaagagttaaaatggtgcac

SEQ ID NO: 46127 - DNA, 201 bp, Homo sapiens
gtggagagataagaaaaatatgcaattcctcttccttcctccagttaaattttgtgagatttacaaagccaaacaggaccccctaaccatacatcatggtragccgtggggagccagcctgaaggtcaacaccaggttcatagcttgggtgtataaggaacacaacgttgtgtgacatgtcagaaaaagatgaggccacag

SEQ ID NO: 46128 - DNA, 201 bp, Homo sapiens
ccctgcggtgaccctgtgtgacctgctgagggcctggctgctctgcatgttcatcaatatcacttttatgcagcaggtaccacatgccaggcctcgggctrgggctctgcacacatcacccttcatcctcatgagatccctgcagagcagcacaatacccatcttacagtggggaggtcaccacagcagtcagcaaagtct

SEQ ID NO: 46129 - DNA, 201 bp, Homo sapiens
atgccagccctttcagaggctcctgccctctgttccgcagcaggaggtgtgatgcggtcctggcactgcagtcacgcagggtgcctcggggtcccaaatgwgggccatgtcattctcacacgagcctccctctgtgtcatatcacaatgagtgcatccctgatggccctgtggggccacaaccatgaacattagtccagag

SEQ ID NO: 46130 - DNA, 201 bp, Homo sapiens
gactttgaaataataataataataaccaacctgtatatagttctcactttatactaagtacttttttaagtgctctctctctctctatatataaatttttwaaattctcactgcaaccccacaggatagatactgttatctcatttgattaagcaagacactaagcatcaagagatggagtgacctgcccaaggtcacgca

SEQ ID NO: 46131 - DNA, 201 bp, Homo sapiens
acgtgagggtgttatgtctgctacgacaccactaggcaataggaattaggttataatctcgcaggaccaccattgtatattgagtccattgttgaaatatygttatgagttgcattactgtatcttaaattgagtaatttataagcaacagaaatgtattgctgacagttctggaggctgagaagtccaagatcaaggtgc

SEQ ID NO: 46132 - DNA, 201 bp, Homo sapiens
caacaagaagggcactggggagtcagattggatgacacaagccaagccatgataggactgcaggaaacccaggcttgaagatcgtagcagacatacaaacyaatcagatgggttttagaaagacttagcttgggggtggggtaaaccggtggcagcagacctctgaaatggcacagtaggactccagctgtaggctcagct

SEQ ID NO: 46133 - DNA, 201 bp, Homo sapiens
cactccaccaccaccaccaccactgcaacaagaagggcactggggagtcagattggatgacacaagccaagccatgataggactgcaggaaacccaggctygaagatcgtagcagacatacaaactaatcagatgggttttagaaagacttagcttgggggtggggtaaaccggtggcagcagacctctgaaatggcacag

SEQ ID NO: 46134 - DNA, 201 bp, Homo sapiens
tccattatcccctgggaacacaatgttttatagggggtccttgagcagaaaaacacagcagcaaccctaacccttcgacgtcagtctctccaagtgcatckaagtttaagtgttttgcttccttcatcagtactttttctgtgatccttccttttcaacaagctctccagtaacagcacaagacaaaagttaaaatgaagc

SEQ ID NO: 46135 - DNA, 201 bp, Homo sapiens
aatatataggtttatgacttttgccacagttggaaatattccaaccattatttcttcaaatatttctttgtcttctctttctgaaattccatgacatgatkttaagaccttttgttattgttcaggttcctaagactctgtttttttagttcagtcttttctcttttgttcagattggataatttgtattgaatcatgtgc

SEQ ID NO: 46136 - DNA, 201 bp, Homo sapiens
tctttcaactgtcaaacatactttaaagaattcaagagaagaataatctactatagttacccaaatatttacaatctattgcttttccttcattcgtgatsttccaagttttctcctagtatcaatttcctttaatctgaaagcttttctttagaattcttttagagcaggtctgttgacaactgatttttaagtcttttc

SEQ ID NO: 46137 - DNA, 201 bp, Homo sapiens
gtgtggtgatggaggcaaaatcttgcctagagtggttcaaagagagaatgggggagagtaaatttagataactattttgaggagtttttccacaaaggaarggaaaaaaatgaaatgatattggctgggaaagtgttctataatgtcaatttagttcagttggatgatggtattgtttggtttttctatattcatgcttat

SEQ ID NO: 46138 - DNA, 201 bp, Homo sapiens
cagctgaggtgagtactgctttccatgccataaggcacatccaagtacatttccataagagcctgctctggccctgaagcattttctctcccactcaaatrtaaggtggttatttacttggagttgataaagggctgaaaggactggccacttgttttccttggggatgaaaataaactgtgtccacagcaactctgagct

SEQ ID NO: 46139 - DNA, 201 bp, Homo sapiens
gttcctagcctttatgtctctctgttcaaattccaaattcccagaaacagaatatcattagcctagctatagcctgggagatgggaacaaagagtccaatwtgggctacttggatctacttctttcctggagaaggtattatttttaagagctaggcagatatttttaaaaggtgattactatagtgttttactctgaagt

SEQ ID NO: 46140 - DNA, 201 bp, Homo sapiens
aattgcactgaaaatgataggttagtgctttcttttaagattcccatctctaatgggtttattagccacctcttttctctagtcattgtgtcgttaccaarctcccaaaaccaagtatgtaatgacgcacttagtttccttctgcctttctcacaaaggggctgatctttcaggctttgtttgttttgtctttttttttca

SEQ ID NO: 46141 - DNA, 201 bp, Homo sapiens
tgacgttaccctccaaagattgcttagattaatgggacgaaagttttgggtaaaagcttgggatacctgaaatttgcagctgtatacccctggctcttgaygtgagacttgacattgaaccttacaaagagggcaaccttaggtgatatcattggtcacaaatgcattacagaaaatgttttctcttagttaaattgatat

SEQ ID NO: 46142 - DNA, 201 bp, Homo sapiens
tctatggtattttgttatggccactcaagtgtactaatacatgtagtttcccaggattaatccatttatataaccaatatctggctggagagacctttaartcttcaacaacagaagcagaattcttcaaatgatgccactagtagttaatgaattctatccaaataagtagcaggtataatgatccatatttttacaata

SEQ ID NO: 46143 - DNA, 201 bp, Homo sapiens
tacaagtggtggtactaagacagtatacagttcaaattaggtagactggagcaatttaaataagaaaatatactactgcgcctgtaagccatttcagttgrgttaggttaatattctcctctgctcttctaacccgtatcatgattacttgttacacttaccttctcacactgatatcttcatttctgcaactataggaat

SEQ ID NO: 46144 - DNA, 201 bp, Homo sapiens
taagtggaaaattggcaggtctgacctattggataattgcctgggagttaagagaaaaaaaattttttaacgaaatgaagagattgtcctaatccacaagsgcatctttctttgttgtcttctctgtgttttgagacgttttctttagagaaagatttgatgttgtatcattttcagtgtgaagaagttccacattcattt

SEQ ID NO: 46145 - DNA, 201 bp, Homo sapiens
atgcctaccacaactccacccatgctgccgacgtcctgcacgccaccgctttctttcttggaaaggaaagagtaaaggtaggattttgatatcatgacctrgttacctgcctggattggagatccaagaacttaatcttagtaaatacattaggcaaacagctattttgcaaccaagttgacagctttttttaaaaaaaat

SEQ ID NO: 46146 - DNA, 201 bp, Homo sapiens
cagtgatcttgttggaggcctgatgactgtgagtgatgaggcaaaacctgaaaagcaagagaggtatccggggcctctagagtgcagctgatgtggaaacygttacctgtggttgcagaagtacctgttatatagactaacgttagcataaccagaagcaactgcgtcagaatttatgtataacatgtgcagtggtatttg

SEQ ID NO: 46147 - DNA, 201 bp, Homo sapiens
ctgggcagaatctttcgctggcttggacctaaaggatcagactgtggcactgtaaatgtcaacattccaacaagtggggctgagattggaggtgcctttgkaggagaaaagcacactggtggtggcagggaatctggcagtgatgcctggaaacagtacatgagaaggtctacttgtactatcaactacagtaaagacttt

SEQ ID NO: 46148 - DNA, 201 bp, Homo sapiens
aaggcacccagtctatggtattttgttatggccactcaagtgtactaatacatgtagtttcccaggattaatccatttatataaccaatatctggctggaragacctttaaatcttcaacaacagaagcagaattcttcaaatgatgccactagtagttaatgaattctatccaaataagtagcaggtataatgatccata

SEQ ID NO: 46149 - DNA, 201 bp, Homo sapiens
aatctctctaaggcttccttgtgctggcctcctttgggtacttgtcattttgtggattatattctagaccatttttttctttccattttaatgcataatcracatcaggctgagtttttttctcatgactgtagatgacatgactatgttgtataaataatttctctttaatctgatatttgtcagggggaaatggcttct

SEQ ID NO: 46150 - DNA, 201 bp, Homo sapiens
gattttgattgtaacgtagggatattgtttgggggggataattcaccaaatataaaagactttatcttcctcatgccaacattataatcttgtgtttttcrtggagctatctggaaaaaaccagtggaggtatctggaaatgaacacagatagctgtcaatgtctgggtccaggcatgatagctgagtcttgggtgggtgt

SEQ ID NO: 46151 - DNA, 201 bp, Homo sapiens
gtgacaggtgaattaaccaacctgaactaccttgatttctctcgtgagtttgcctcttccatctgcctaccctgcaccagctgggttgtatcgtggagttycctttctattgaagtgaagccaagctgagtttttttcttgatcattgcagtgtattttcccacttgctttcattgctgtagttcctactcatagtggtgt

SEQ ID NO: 46152 - DNA, 201 bp, Homo sapiens
gagtgaaactctgtcagaaagaaagaaagaaagaaaaagaaagaaaggaaggaagggagggagggaggggagggaggggtggggaggggaaggagaggaaagagagagaaagaaagagagaaagaaaagtatacaggcaaggtattggttaggggtgaattattattttttggacagcctgtgcccttcttgcaggaatcc

SEQ ID NO: 46153 - DNA, 201 bp, Homo sapiens
gcacttttttttctgagttttagaatttcatccttaagattagcttttttaataatgtcataattaagtgaaagatctattatgtttgcaaaatgagttcrtttttaagttaactttggaactcaagtgaatctggtgcttatcattatggtacagaatctggtgattttgtgtgaaaacatttcatcctgtgcatgaata

SEQ ID NO: 46154 - DNA, 201 bp, Homo sapiens
tgatctgcccaaaagcgataagaaccgggcagaccttctcgacaccatcaatacatgcatcaagaagggaaaggtgggttacaccagcaaaaccaatccaygaaccctctccccaatgcacttttttttctgagttttagaatttcatccttaagattagcttttttaataatgtcataattaagtgaaagatctattatg

SEQ ID NO: 46155 - DNA, 201 bp, Homo sapiens
agtgaaactctgtcagaaagaaagaaagaaagaaaaagaaagaaaggaaggaagggagggagggaggggagggaggggtggggaggggaaggagaggaaagagagagaaagaaagagagaaagaaaagtatacaggcaaggtattggttaggggtgaattattattttttggacagcctgtgcccttcttgcaggaatcct

SEQ ID NO: 46156 - DNA, 201 bp, Homo sapiens
cacgtgattcaggtatggaaagaaaccacctctatcattaacattcaaaatgaacctttcaggtttaagccacactttttatcaagtactttcccatcatsctcatgtatcagcacattttcttaggagaaataaatatcaagctgtgcaaagaatactgatagacttaagaattagatattcaataaagaacaaaaaatt

SEQ ID NO: 46157 - DNA, 201 bp, Homo sapiens
taaaaatccagacacttctagtaaaaatgactcaaagtccaaccacttagcatttggggatgtatccttaaagacatttccaatgcatataaatggatactttttttttaatacaaaaacaggactgtgctatacatatacatcatgcttggtaacccatctccagttcagtaagctggattcttcaatttagtgcacacg

SEQ ID NO: 46158 - DNA, 201 bp, Homo sapiens
attattacttcagatcagaacctgcaatttctttgacagaaatggggtttaaaaaaattttatttttttgagacagattgtcactctgtcgcccaggctgkagtacagaggtaatcttggctcagtataatttctgcctctcaggttcaagtgattcttgtgcctctaagtagcgaggattacaggcatgtgccaccacac

SEQ ID NO: 46159 - DNA, 201 bp, Homo sapiens
gcggaggtgcgcatcgggcccatgagactgacgcaggaccctattcaggtacgcctcctttactcagccctgtgactcagattattttcttttttttttcttttttttttttttttgagatggagcctccttctgttgcccaggctggagtgtagaggctcagtctcggctcactgcaacctctgcctcctgggttcaagc

SEQ ID NO: 46160 - DNA, 201 bp, Homo sapiens
acacagcgaagcccacagcagaagcctcacatttgtctgccctgaaatctcccagtgcacacatacacaccttgttctcataccagaccaatgacatcaayagcccaccctgcctaggccctgtcatcagcactttcattaggttgtctcatttctattcaataagggtaggcaagagacatcattgccctatagtgcaga

SEQ ID NO: 46161 - DNA, 201 bp, Homo sapiens
cagtcatgtttgaagcaagtcttgaagcataagatgttactcaggagaagaaggaagagaagactccgggtagcaggaacagccagggaaaaagcattgcratgggcgaagagggactggaacatttaaggagctgaaagaaagtcggagtggccggagcttggtaagcaggtgagagaggaggaggatgtaggttgtaca

SEQ ID NO: 46162 - DNA, 201 bp, Homo sapiens
aatagggataatgcccaactccaaagagtttctctaacgggttattgagtgagacagtatgtttctagtgcattcagtatagtggctgccccttaaaaaaytcccattaaactatagctgtaatcagcatcactttcctagggacatttaaggaaagttctcagaccattttttttcagctcaaatgaccactcccctgat

SEQ ID NO: 46163 - DNA, 201 bp, Homo sapiens
gcatgatactgaaagcacagaggataaaatgtcagcagctgatccaaagttaggagtatgacaatttgccaaggcataggaaagatgctcacttcgtatcrtaacttatacaactagaagaaggtggcaagcactgtccaaactactcttgataaatttttttaaataaataaaacatcttaattttcaatgtttctaata

SEQ ID NO: 46164 - DNA, 201 bp, Homo sapiens
atcagaactaaaatatgtagtcatgtctccaaagccttcctacctggtttcctgtttagctgtattgttagaatatgttttatggctgccccgtgaaatgyatctgaaggcttcctcatgttgctggctcttagtggcccacctgcccacaggtctgcctcttggacctcagagagagccagacgtgtttctgttacagac

SEQ ID NO: 46165 - DNA, 201 bp, Homo sapiens
atcacaaaggtgagtggcggctgctgcctgcactctgcagtcaggggccctcacacagggccgtgctctgaaaatacatcacactgacatcatggagctcrgtctagtggaagaagcaaataacaggcaaataaacacatagcaaataaacacctcatcctaagtcacaatcagggcagtgaaggaaaacaagcgggttct

SEQ ID NO: 46166 - DNA, 201 bp, Homo sapiens
aaaaaatggccatgtcaaagaaatcagaaatactgatacacagaatattaaagctgaagagggaatgcattacttaagttttgttttgtttttattttttrgttgcaagtaataactgccttataccaaaaaagtacataagtaaataagaaatgtattagaaggatagtgcaattttttttttcagactccaagaaagag

SEQ ID NO: 46167 - DNA, 201 bp, Homo sapiens
tcatgtctccaaagccttcctacctggtttcctgtttagctgtattgttagaatatgttttatggctgccccgtgaaatgtatctgaaggcttcctcatgwtgctggctcttagtggcccacctgcccacaggtctgcctcttggacctcagagagagccagacgtgtttctgttacagaccaagcacaaaaatcccacat

SEQ ID NO: 46168 - DNA, 201 bp, Homo sapiens
caccttcattcgtctatttgtttggcagatattgattgaagtgggggcctaatatgtgtcagtcaatgtttgagacactgagttacagcagaaaaaaaaamaaaactaaaaattcttgttttctgagtacttacattttaactgggggagatcaccaagaaaaaaaatttaacaaccttatttggttggtactataattat

SEQ ID NO: 46169 - DNA, 201 bp, Homo sapiens
cacctccctgttttgcagtgtgcagctggatttgatttcagaaatgaggagaaggggctccctgcccactagccgcccctccacctgtaatctaacaaacracttctagaatagggaacagagtctttcattctccagttatcaattggtggttagaaaacctgtatccttgggagaggtaatattgtgatggtgtcacat

SEQ ID NO: 46170 - DNA, 201 bp, Homo sapiens
tgtgtgcgtgcacgtgcttgaggaaaccccaagttgggaaacatgaaaatgggagcatagactaactaattgaccatatttattcacctttagtatattawtcaattgatgaaatactcagaatggcctttgctgtaaaacgtccagcattttgcctccatttgctgtgtatatttcagcactgggcctaccagtgtatga

SEQ ID NO: 46171 - DNA, 201 bp, Homo sapiens
gcttcacacctgcctgagcccagcactgaaagggctgcctcctgccccagccatttaactgaatttattgttctgattctactggtagtgtccccaaactrtagcaaacattgatcaatagatagtggcaattggaaaggagacatgagaaatccagttgtggagatgtgcataatacaagccgccactgttgaatggagt

SEQ ID NO: 46172 - DNA, 201 bp, Homo sapiens
ttccagtggtctctcacccccaacccattagggctattcttagccctcctggtctaagtacaattatcatggccgtcatctcacagagcagccccacagargcctacaatctgttgtttgtccttgcaccacagctgccctgggcccctcttgtatcacagaataatcccatagccctaccctaccttccttctggtattt

SEQ ID NO: 46173 - DNA, 201 bp, Homo sapiens
atcaatagatagtggcaattggaaaggagacatgagaaatccagttgtggagatgtgcataatacaagccgccactgttgaatggagttcttatttgttcrtttgtttgtttataagagacagggtcttgctgtgttgcctgggctggagtgcaacggtgcaatcatagctcactgcagcctgaaactcccaggctccagt

SEQ ID NO: 46174 - DNA, 201 bp, Homo sapiens
tcacattgtatattttgttaattttagaatgtattattttggagaactttgagaaattttgcaagcatagaaaaacatccatttttcatatttaaaaaacrttcctcagtatttcacatttacttatgcaaaagcttcttgtcttttaggttgtaaactttgttatgaagtctcttaaactttgtacattctccttatttt

SEQ ID NO: 46175 - DNA, 201 bp, Homo sapiens
ggtgaagttggacttgaaccattgtcagagggcaagggcgttggagcaggcccttgaaggatgcgttagctgctgaggcaggaaagggctttccaggtcarctgctttccttcctgaatccttagcttccctcttgtctgaggaaggctctaaaactcgatgccaagttacttaacaaaattcctgaagctgaaactatta

SEQ ID NO: 46176 - DNA, 201 bp, Homo sapiens
agggtcttgctgtgttgcctgggctggagtgcaacggtgcaatcatagctcactgcagcctgaaactcccaggctccagtgatccttctgcctcagcctcmtgaatagcagggactacaggtgtgtgccacaacaactggctaatttttttatttttgtggaggtggagtctagctgtgttttccaggctggtcttgaact

SEQ ID NO: 46177 - DNA, 201 bp, Homo sapiens
gctccattaatgttaacaccaaaataggaaatagactttcccaataaaattaaacctaatttccatttatttggaaatatctacatatacaagaagatagwaagtttaattcagtaaacacccatgtactcactatttactgcttaaaaaaataggtcatacgctgagtgtggtgcctcatgcctgtaatcccagcacttc

SEQ ID NO: 46178 - DNA, 201 bp, Homo sapiens
tttcagtttatccagtgtttgggagactagacatatttaataccagtatttataggtaggccaggtttttttcccagttttccttttctgttctctgatcrctgttcaacatacatttgtagcttcctcctcccagctgcacctgttcctccagtggcttccccttcatctgggtagatgaaggtaatgatggaagtccga

SEQ ID NO: 46179 - DNA, 201 bp, Homo sapiens
cctttgggtacttgtcattttgtggattatattctagaccatttttttctttccattttaatgcataatcgacatcaggctgagtttttttctcatgactrtagatgacatgactatgttgtataaataatttctctttaatctgatatttgtcagggggaaatggcttctccattatactgtgccagccaagttttctgt

SEQ ID NO: 46180 - DNA, 201 bp, Homo sapiens
cacggaaaactaatcaccttccctttctaatctgaaatccttagagcctcattcattcagatataagaacaggaggaaagagtccattgacgtgaaatcgrtatcatctcgaggcagtgatggtaagatgtttttcagattcctctgacctttttaaaatgtagaaaatgatggaagaatatgttaaaaaattcatcagcg

SEQ ID NO: 46181 - DNA, 201 bp, Homo sapiens
gcctcctgaataatcagagctagactgttctttgcttgttctctattacacaatgtaattttacatgcttgaagtcatccggcagtgtctattatcagtgrtatctctaataaaaggaaggaagtcagttgagggatgtcacgttttgaccattgcctttaaattcctgtgttctcccagtcagaccctgcatgatctttg

SEQ ID NO: 46182 - DNA, 201 bp, Homo sapiens
caatactattagcaaatccctaaattaaaataatttgttaatattatcaaatacaagacagtgttgaagtttccctatctcataaacattttcatttaaakatttttttaatcatctttcaaataagatctagctattgcaatcaattgatatgtttcttaaggatcttgtcatctgtgagttccctttcctctctttctt

SEQ ID NO: 46183 - DNA, 201 bp, Homo sapiens
aagagatggttacccactgatttcttttggattctgggcatatatatgacttttgggaagtagaaccctattatcctcagatgtattctttcttcactccrttaggttataaatataatcaatgcagcccaagaaaacagcccagtcacagtagcggaagccttggacagagttctagagattttacggaccacagaactg

SEQ ID NO: 46184 - DNA, 201 bp, Homo sapiens
atgcttagtaaatgttcactttacatcttaaaacgaatttcatttatagatatctttagtttatttcaaatatttttaaaatatgcgttgatgtttttaarcagtgtatacagatgtctgtggtgaaagctatagctccttcctgtagatttctctctcctcttctacttttccacatttgagttgtactaaatttagagg

SEQ ID NO: 46185 - DNA, 201 bp, Homo sapiens
taagttttgttttgtttttattttttagttgcaagtaataactgccttataccaaaaaagtacataagtaaataagaaatgtattagaaggatagtgcaattttttttttcagactccaagaaagagttgaaaagggtgggtggcttgcgaagggtgtccatgggccatctctgagccgtttgacatcagcagtttaacat

SEQ ID NO: 46186 - DNA, 201 bp, Homo sapiens
gaaagagttgaaaagggtgggtggcttgcgaagggtgtccatgggccatctctgagccgtttgacatcagcagtttaacattcttccatcagtatctctattttttttttttttttttttttttgagatggagtttctctcttgttgcccaggctggagtgcaatggcacgatctcagctcactgcaacatctctgcctct

SEQ ID NO: 46187 - DNA, 201 bp, Homo sapiens
gaggcaggaaaatagcttgaacccaggaggtggaggttgcggtgagccaagattgcaacattgcactccagcctggacaagaagagtaaaactccgtctcaaaaaaaaaaaaaaaaagagtaatctgaatcccaagtaggtggagtgatgtatttcttaaaaaatagggtactgcgtgtgccttgtgaattatgaaaatcc

SEQ ID NO: 46188 - DNA, 201 bp, Homo sapiens
aggcaggaaaatagcttgaacccaggaggtggaggttgcggtgagccaagattgcaacattgcactccagcctggacaagaagagtaaaactccgtctcaaaaaaaaaaaaaaaaagagtaatctgaatcccaagtaggtggagtgatgtatttcttaaaaaatagggtactgcgtgtgccttgtgaattatgaaaatcct

SEQ ID NO: 46189 - DNA, 201 bp, Homo sapiens
ggcaggaaaatagcttgaacccaggaggtggaggttgcggtgagccaagattgcaacattgcactccagcctggacaagaagagtaaaactccgtctcaaaaaaaaaaaaaaaaagagtaatctgaatcccaagtaggtggagtgatgtatttcttaaaaaatagggtactgcgtgtgccttgtgaattatgaaaatcctc

SEQ ID NO: 46190 - DNA, 201 bp, Homo sapiens
cagggaaagccagggagaagccaaccactccagatatgtggagccaaccactccagtgtatatgtggggtgtgtgtgtgtgtgtgtgtgtgtgtgtgtgtragagagaggaaggagtgaggagagggattgatttttttctctggccaacttgggtgaaggaaatctaagaaatacatctttcagcagggcctagtattct

SEQ ID NO: 46191 - DNA, 201 bp, Homo sapiens
ttgcccttttgcaggtgacgggatgctaatgagctacagacttcctctcgtttctagcaatgagtcagctccagactcactgagcctccaggaaaagatastgtaaccagtttcccaggcccctaggaggcttttaccctcactagaggacattctgatgggtgcttaagcaaacctatagagaatgtctttgcggggaga

SEQ ID NO: 46192 - DNA, 201 bp, Homo sapiens
ttcaaatgttggacatttgggctgtttctgccttttggctatggtgaatgatgctgctatgaacacacatgtatgagtatttatttgagtacttgttttcagttcttttgagtatatacctaggagtggaattgctggatcatatgagaattctgtgtttaacttttcccctgcattaggcactcagaaaattaggaagga

SEQ ID NO: 46193 - DNA, 201 bp, Homo sapiens
cccaaccatgggttaaaggagatggtcagcctcccctaattaaaatgacctcctgcccttttgtgggaacagagcaaagctaccagttgacagctagtaarattttttttcctggcacagcctggcttcaccagcatgtcacagaggagactgccccacagttctcaccaggatctaggagcttctctccaaacccagcag

SEQ ID NO: 46194 - DNA, 201 bp, Homo sapiens
ccagcccctccctgtggggtgcttgttaacaggaaggacagatcacttttgtactatgcagactcaggacccagcactcggtggcctccaagtttcatgaygttgacctaaggaagtcagatgttggctgactctcctcctacacattctctgtttgcattttctacaactggcaagagaaaaccgttctatgggccaaat

SEQ ID NO: 46195 - DNA, 201 bp, Homo sapiens
ggtgcaccctggtcagggaagtcactttttggtgggtagagtgatctaagaaataaagtgtggggataaacagtcactttcttaggtagaaaagtattaaraaaagaatctcaaaccagtgggaaatcagatattttgggacttcaggtatttttaacagcccttggtaagaaatattgccaaagactttttgagcgtata

SEQ ID NO: 46196 - DNA, 201 bp, Homo sapiens
gacagctagtaagattttttttcctggcacagcctggcttcaccagcatgtcacagaggagactgccccacagttctcaccaggatctaggagcttctctmcaaacccagcaggtcctggatcatgggccttgtctgagatgtgtgcggtctgagtgtgaccaacaggctgctccaccaagcaccgttggtcgatttcttt

SEQ ID NO: 46197 - DNA, 201 bp, Homo sapiens
ctttggtcctggcaacttttcagccccttctttcatttcctctgtagccaaggatcagacttgttctcagtatttccacacttagggtggtacactctttytgggggtgattttcatctgttccccaaccaggctctgctgcctgactctcttttctggaaaggtttctgctgctttcagacgttcatttttctccctatg

SEQ ID NO: 46198 - DNA, 201 bp, Homo sapiens
ttaatattctcctctgctcttctaacccgtatcatgattacttgttacacttaccttctcacactgatatcttcatttctgcaactataggaatggcgtcytgcagttggctaaaatattgcactccgcacgcatacctcactattattgaatacagttcttggtttgacatttcaggtatacttatgagaaaagataggt

SEQ ID NO: 46199 - DNA, 201 bp, Homo sapiens
ttttatttctttttttgtctgagtttttccttattcatggggcggtagatggtgaatgagttccccaagaggctggtactgctagatgagggcttcctgtktttttcctgctgaagtttcttctgatatcctacaggggatcaggatggcagttgaatgaataaattgctgccaggaaggagggaactcctccaggaaggg

SEQ ID NO: 46200 - DNA, 201 bp, Homo sapiens
agggacacaatgcatctgcccccaatgtcagggaggccacagacaggtaaacagaataaatagaatgcagcacagaggaaatgtgaatcaagcactggagragctcaaaacccaggacctaaggaggctgtctgggatttttagctattgtgtaaaataggggccaagaaactagagcctgcaggccaaatatggcctgtt

SEQ ID NO: 46201 - DNA, 201 bp, Homo sapiens
accttcagtcaccttctgtaggcctccagacagtccacagattttcccatccagtccttacaccttcatggaccatcctctcaatgggtttctgctgcctrcaacccttggtggcccattctggttcccaccgccaggccagccttctcttgggtgtgtccttggccttcactgcccccatgcctttactctccccacatt

SEQ ID NO: 46202 - DNA, 201 bp, Homo sapiens
gagtacggttgttttaaataaatggaaccttttggggagacagggagggtggatgtgtcttctgattttatgagtctcttttgtttctagagaatctttcrtttctgttgcttgctttttcttttcctcctttcaccatcaagcatccaggggaggtgaccctccaagttacctccctccctccgaagtggtgccctccca

SEQ ID NO: 46203 - DNA, 201 bp, Homo sapiens
ttgggattaagtgaaaaagggcctactcctctttaaacgcgggacttgagcagctcatgcctagcataaataggtgcttcgtagttctttgatgaatgacratgtgtgctgcattttcttctatgttattatttgcttatctatctgttcattcattcactaagtttatttataaatacatgaaagccttttttttcaatt

SEQ ID NO: 46204 - DNA, 201 bp, Homo sapiens
ataaacctttatatttttaaactttttcactttcttaataacatttagcttaaaacacaaacacatttcacagctgtacaaaaaaaatgtttctttataacattattctgttagcttttttctatttttaaatctttttttttttttttttttactttttcaacttttttgttaaaaactaagacaaactttggctggtgc

SEQ ID NO: 46205 - DNA, 201 bp, Homo sapiens
ccgataacattctgggcatgtgcacctaccctgagcatgatgtgagaggaggctgcctagtttcaggtagacacaggtgccctttgccctggcagagaagsttaccctcatggcctgcaggacagcaggctggggggtgtctgccctgcacggatggggttttttgacccgtctgttctctcattctatcctttctgctac

SEQ ID NO: 46206 - DNA, 201 bp, Homo sapiens
gaggctgagacaggaggattacttgaatctgggaggcagcctgggtgacagagtggagactccatctcaaaaaacagaatatgacatagttccacgtttcrggagcttccattgtttgtgccctatattgtcgtcttctgtgggaaggcaatgtgttgactgagtgccggctggctggcaggagttacggattgggaattg

SEQ ID NO: 46207 - DNA, 201 bp, Homo sapiens
gcatgtgcacctaccctgagcatgatgtgagaggaggctgcctagtttcaggtagacacaggtgccctttgccctggcagagaagcttaccctcatggccygcaggacagcaggctggggggtgtctgccctgcacggatggggttttttgacccgtctgttctctcattctatcctttctgctacatcaaggatgtttat

SEQ ID NO: 46208 - DNA, 201 bp, Homo sapiens
atctctaatgcattgaagaccactaggatttaaagaggagtattatgttggcgtttgggaggagggttttttcccgataagtttaactaaaattccaaagkttgcacttctacatgacttgtgtcattcagactattacaagattctgctcactccggaggcttgtactaattaagcccaagagacttacagtaccttagg

SEQ ID NO: 46209 - DNA, 201 bp, Homo sapiens
ttgctataatttttgtggctgcaaaagggtaacctggtgtgaaggaaaggtgctcactgactccagcttgaattccagctctgccctgtacaaactttgtsactttggagaagctgcatgatttctccttgcacggtagggataatgcatctctaaaaggattggtacaacctagaggtacagtccctgtaaacccgctag

SEQ ID NO: 46210 - DNA, 201 bp, Homo sapiens
agcagtcattagagggctctttgagttttctgctggctggtttggtgagaggcccaagcgccctgcatgagttctttacactgctgtgttggggtggggtrggagaatcaggcctacagaggagaagaagactggtgctttggagagtgttcatagcaccagcactaagagttaagcttggggaaaggagaagaaaggaga

SEQ ID NO: 46211 - DNA, 201 bp, Homo sapiens
tgggaggagggttttttcccgataagtttaactaaaattccaaaggttgcacttctacatgacttgtgtcattcagactattacaagattctgctcactcyggaggcttgtactaattaagcccaagagacttacagtaccttaggcctgacttctgttaaagttttacttaatataccaatttttaggccacttatgggt

SEQ ID NO: 46212 - DNA, 201 bp, Homo sapiens
gcctgtgcaagcattgggtggatacaacctttcatcccagatccatctgtcatgtgcagcctcagacacacacatgcatgcacgtgcacacacctgctctrggaagtgttgctgggacagaacacctaggcgggtaagttttcaggagacttcctgctctccccctcccacatctataatgctgggtctgtgaagccagtt

SEQ ID NO: 46213 - DNA, 201 bp, Homo sapiens
tgtgtaaatgctgctgcgtgctgaaggcgctccttcagactgacaaggggccagtacagagtgtggaatgcaggataagcttccaatagtgacaaatgacyacagtctcttagagaaaaacaaaattggatccatggaggtgaggtcaagaccgtcaaccaaattagtctagagaatagtcacttttagaaatctcagtaa

SEQ ID NO: 46214 - DNA, 201 bp, Homo sapiens
ctgcatcctagaagccacttagttccaaaggtgatgtctttgaaacaactcttgactccatgcccacttcccaacccaccaccacttcctttaagccattrtgacctctcatcctacagagcctcatgaccactccctctgcctccttgtaatgtgtgctggagccagttcatactgacttgtgagaactgattgtttaat

SEQ ID NO: 46215 - DNA, 201 bp, Homo sapiens
tttgatgattgtctaaaataatggcattttaaaatggccacttaattcactgtttacagttcctgtttgatgactaatgatattaaaatatgtccagttaycttggttggagacctcgaacttattgctgtaaacatatccttctcttcagttcattctgtcccctgactgctgatacactttttttatcacttcctctgt

SEQ ID NO: 46216 - DNA, 201 bp, Homo sapiens
agtaaggggggaactgccccatgattcaattacctctcaccaggtccctcccacaacacatgggaattatggaagctacaattcaagatgagatttgggtmgggacacagccaaaccatatcagggtggttatgggaagctgagaaaccagggtagttatgggaatctgagaaaccaaacctgtaagtcagggaaaccctc

SEQ ID NO: 46217 - DNA, 201 bp, Homo sapiens
caaagccaaacaggaccccctaaccatacatcatggtgagccgtggggagccagcctgaaggtcaacaccaggttcatagcttgggtgtataaggaacacracgttgtgtgacatgtcagaaaaagatgaggccacagtcatcctgccagtaactggaacaggagccccacctgtgactcttaggactacctgagttcctt

SEQ ID NO: 46218 - DNA, 201 bp, Homo sapiens
tttgcttcactctggatgatgggggcactgacaggcccctgaccgaggttgtgagctggagagaggctgcccctcggccctcctcctgagcagcctggcckcagcgtggccattctcacccacaggcagtgctgagaactgtggggtggagatgatgcccgtgactgtcacattgtttttatcctcatccttataccatct

SEQ ID NO: 46219 - DNA, 201 bp, Homo sapiens
tggtctctctgattttacagataagaaaaagaagttcttttgtccagacacaatttccagtgttattttccctgtaattgtaggcagtgagctatcagagrcaattcttattaaaagtagggaaattttacctcttcctagttgggtgaagtttattacagagtaaccagtattttatatcctcttttcagaggcctacag

SEQ ID NO: 46220 - DNA, 201 bp, Homo sapiens
atgataggaaaattactaaggaagataaaaattaggaaaagagatagtataataaatattttaagctagattatttaagataaggtgctatagctatggtrttcagattaactttataatagttccacctttactagttcaatagttcccccgagaatgtccctcaagttttaatgtttattttcttaaattctttttttt

SEQ ID NO: 46221 - DNA, 201 bp, Homo sapiens
tcggtggccagtcctgttgaatgaaatctgagcactgagctggatttgcgtgccttgtaggtgactggtgcagttgcagcaccaggatagatagtgccccrtattccgatttttacctgggattaccagccaggctggagtctcagcacaggaaccgagcgtagggatttgtgaatgaatgagtgttcgtgttttaagaga

SEQ ID NO: 46222 - DNA, 201 bp, Homo sapiens
acctgggtaggagtttaactcattttgctttatcaagaagattcccaaataagagcttaattcactctaacccattactgggaatgttggaaatgaaaccsctggttcattgacttaacactactttgcattgtgtggatctcagaaagtatatatttgaagtgaaatttgagaccagagttatttatgcaaatcttacag

SEQ ID NO: 46223 - DNA, 201 bp, Homo sapiens
caaaaaacagaatatgacatagttccacgtttcgggagcttccattgtttgtgccctatattgtcgtcttctgtgggaaggcaatgtgttgactgagtgcyggctggctggcaggagttacggattgggaattgggttcttccaggtgagacactcctactgggagagcatgaagaactgtgagcctgaggggtaagtcag

SEQ ID NO: 46224 - DNA, 201 bp, Homo sapiens
taaaaaacattcctcagtatttcacatttacttatgcaaaagcttcttgtcttttaggttgtaaactttgttatgaagtctcttaaactttgtacattctycttattttcccaatatattagtgcatatcattgtattgcgataagcctgaaacagagagggccacactgtctttcagattggcagagggtgctttaaaaa

SEQ ID NO: 46225 - DNA, 201 bp, Homo sapiens
taaattgtctataattgagcatttgaagagctttgtaggaaatgtttttaactcctaggcttaaattcagattattctgtagcacagaaaaattttataaygtatctgaaacaaacaggttatatgttagccttataaataacttaaatttagttatatcttttatctttctgcatttctgtaggctgtcaaaatgagaca

SEQ ID NO: 46226 - DNA, 201 bp, Homo sapiens
cccctcgttaatatcctagccaactcatacacatgaggttgtatttagttcccagagcagaggtgagtcaagactcgcatgttcaagaggactttaccgarcctcagagatgacagaatagaacaggccgagggagcactctgaaactagaccctctggtttgcccttgggtgctgcagtacttgtctagtctaccagaga

SEQ ID NO: 46227 - DNA, 201 bp, Homo sapiens
ccctacaagccaccgccttgcccagtcctacccttgttccaggcagcctcacagtgtgtgtgtgtgtgtgtgtgtgtgtgtgtgtgtgtgtgttgttttastggagtctagatagagcacttttggaagggacacaggagataatgtaacccaacaccctggccatgattgacagaggaaaacactgagaaccatcacagc

SEQ ID NO: 46228 - DNA, 201 bp, Homo sapiens
ttaataacatttagcttaaaacacaaacacatttcacagctgtacaaaaaaaatgtttctttataacattattctgttagcttttttctatttttaaatctttttttttttttttttttactttttcaacttttttgttaaaaactaagacaaactttggctggtgcctacacagagtcaggatcatcaatatcactgact

SEQ ID NO: 46229 - DNA, 201 bp, Homo sapiens
tggaattttttataataattgcttagtctttgtcagataattccagcatctttgtcatttttgtgttgacatctatattactgagggctcttcatagaaayagaaccaataggatacacatagatatacagaaagtggtttattacaaggaattggctcatgtagttatggaggcagagaattctcatgatctgacatctg

SEQ ID NO: 46230 - DNA, 201 bp, Homo sapiens
ttattatttctagtgctaatgacttccttttgtcatttgacagacatttattgagcattagcacaaaaccattaacaacaaaaaaaattgataatgagaargaataggtggaaaactgcatctaaagttcagatctcatcgtgagaaaacattttataaattgtctataattgagcatttgaagagctttgtaggaaatgt

SEQ ID NO: 46231 - DNA, 201 bp, Homo sapiens
cactaggcaataggaattaggttataatctcgcaggaccaccattgtatattgagtccattgttgaaatatcgttatgagttgcattactgtatcttaaawtgagtaatttataagcaacagaaatgtattgctgacagttctggaggctgagaagtccaagatcaaggtgccagcaggttctgtgtctggtgagggcctg

SEQ ID NO: 46232 - DNA, 201 bp, Homo sapiens
atttttaatgtggctactagaagttttaaattacacatgtggtttgcatgtgtggctcacacaatatttttattggacagacctggtctggactttccctmccctgccaaatcctatcacagattcacctcacttgcccttttgcaggtgacgggatgctaatgagctacagacttcctctcgtttctagcaatgagtcag

SEQ ID NO: 46233 - DNA, 201 bp, Homo sapiens
atttacaaactattatttgattcaacaaagaagttcctcacatcactgacaaatgagtgaaatttctatgtacatctttgttatttgtctttcatcttacttttttttttttttttgacatggagtctcgctctattgcccaggctagagtgcagtggcgcgatctcggctcactgcaagctccgcctcccaggttcacgc

SEQ ID NO: 46234 - DNA, 201 bp, Homo sapiens
gctagagtgcagtggcgcgatctcggctcactgcaagctccgcctcccaggttcacgccattctcccgcctcagcctcccaagtagctgggactacaggcrcccgctacctcacccagctaattttttgtatttttagtagagatagggtttcactatgttggccaggatggtctcgatctcctgaccttgtgatccaccc

SEQ ID NO: 46235 - DNA, 201 bp, Homo sapiens
aggcaggagactcacttgaatccaggaggcggaggttgccgtgagccgagatcccaccattacactccagcctgggtgacagagcaagactccatcgcagaaaaaaaaaaaaaaaagaatatgtcattgtagggagagatcctctgcaaaagtgaaaaggcaacgaaaggcaggagaggagataatcaagcatggctggtc

SEQ ID NO: 46236 - DNA, 201 bp, Homo sapiens
tgaaagcatactttccagctagtcttcctggtgatgaccttgacctttgatctggaaataccaactggaagcctggggagttccttctctttttctctcttttttttttttttttttttgacagagtctcgctctgtcaccaggctggagtgcaggggcgcaatctcgactcactgcaacctccgactcccgggttcaagc

SEQ ID NO: 46237 - DNA, 201 bp, Homo sapiens
taatgggaaagcagcaatagatgatatataaatgatgggcaaggctatgttctaatgaaattgtatttacagaaacaggtggccagtacatactgacttgygaaaactgattgtttgattttctggaattttgtgattcagttgttaaaccagccattattaaaaattaaattacataaacatgcaattaaacaaatgcta

SEQ ID NO: 46238 - DNA, 201 bp, Homo sapiens
aaactcagtattggccaagttatgaagtgtggtggttcttacattgtagatatttgaaagacattagagagaaactagacaagagaaaaaagataaaacatttaagcctgaatagtagcttgcattaagtgtttttctgtgagataaggacacataaatgattatcactgggctaaacaatgacagtacttctctgtaaag

SEQ ID NO: 46239 - DNA, 201 bp, Homo sapiens
catacatgatggtaagctatagtaatgtgctatgtggccatatgctaaattatggcctggaccgtaatttcctgacctccgctttatatcagtaaaatgtrtaataaacttatgttcggctatctttgctttttcagcaagctggtggttaaactcttagcagcatactgttgactactatcctatctggtccccagtcct

SEQ ID NO: 46240 - DNA, 201 bp, Homo sapiens
ccagcctgaaggtcaacaccaggttcatagcttgggtgtataaggaacacaacgttgtgtgacatgtcagaaaaagatgaggccacagtcatcctgccagkaactggaacaggagccccacctgtgactcttaggactacctgagttccttgcaaattgttgtatgaatagaaaacgagatgtttcataaaatcagccagg

SEQ ID NO: 46241 - DNA, 201 bp, Homo sapiens
ttagccaccttatgtgatagaggggacaagaaatggctgcagggaatcggaatctcagtttctgattagccaaacctcccatgttcagagaacaggaaccratactctccccttggcctctttcacggaagctaagaggagccagagtaacccccgagaagccttggctggggggcccgtaggatgttaggaagatgatgg

SEQ ID NO: 46242 - DNA, 201 bp, Homo sapiens
tttcaaagcctggccaagatggtgaaaccccgtctttactaaaaatacaaaaattagtcgggtgtggtggcgggcatctgtaatcccagctactctggagsctgaggcagagaattgcttgaacctgggaggtggaggttgcagtgagccaagatcgcaccattgcactccagcctgggcaacagagtgagactccatctc

SEQ ID NO: 46243 - DNA, 201 bp, Homo sapiens
aatgagatagcataggatgcctagaactttctctggcagttaccattaatgatagcagttgctgttgtgtgggaatagaagatgataaaatgctcccctacatcttctatgtgacttaagccaagcagcctactgggctctgtaacacagcaggaacttgtgtccaaggatacaaggcccaaccacctgtaggactgactt

SEQ ID NO: 46244 - DNA, 201 bp, Homo sapiens
aacatctttacttctgccttcatttcattatttacccagtagtcattcaggagcaggttgttcagttttcatgtagttgtgcggttttgagtgagtgaggttttttttttttttttttttttgagatggaatcttgcactgtcgcagtgcaatggcacgatctcagctcactgcaacctccgcctctcaggttcaagtgat

SEQ ID NO: 46245 - DNA, 201 bp, Homo sapiens
ccgtggggagccagcctgaaggtcaacaccaggttcatagcttgggtgtataaggaacacaacgttgtgtgacatgtcagaaaaagatgaggccacagtcwtcctgccagtaactggaacaggagccccacctgtgactcttaggactacctgagttccttgcaaattgttgtatgaatagaaaacgagatgtttcataaa

SEQ ID NO: 46246 - DNA, 201 bp, Homo sapiens
gttagggcaggctgatagaaggatggcctttgtataattctcacaaggaagaccaggccactgtggaactgccaggggtagggaccatgccttcatcgtcrtcatcttatatctgtctcctaggtcctggcacacagaaaatatctattgaataaatacttgcatccaggcagagagaagccatggtgtttgggtagcagc

SEQ ID NO: 46247 - DNA, 201 bp, Homo sapiens
tagagcatgttactgtactgaatactgtaaatacttttaacacaatggcatttgtgaatttaaacatagaaaggcacagtaaaaatgcagtataaaaagakttaaaatggtgcacttgtataaggcacttagcatgaatggagcttgcaggactgggagttgctctgggtgagctggtgagtgaatggagagggaacatga

SEQ ID NO: 46248 - DNA, 201 bp, Homo sapiens
ttggtgtcatatctaagaattcattgcctaatctaaggttgtaaacatttacttctttgttttcttctaagagttttatagttttagatcttacatttagctctatgatccattttgggttaatttttgtttatggtgtgaggtaggggctttatttttatctagttgtcttagcagcatttgttaaaaaatactcttctc

SEQ ID NO: 46249 - DNA, 201 bp, Homo sapiens
acatctttacttctgccttcatttcattatttacccagtagtcattcaggagcaggttgttcagttttcatgtagttgtgcggttttgagtgagtgaggttttttttttttttttttttttgagatggaatcttgcactgtcgcagtgcaatggcacgatctcagctcactgcaacctccgcctctcaggttcaagtgatt

SEQ ID NO: 46250 - DNA, 201 bp, Homo sapiens
aggagttggatttttctctaaattccactggtaactcttaccttttagtaactgagcacagcacagctacagctccataccataggtgaccacgtggccgyccaggaatcaatcaaaagttcctcattctctatccttttatcctttccctttctatccatctagttttatctgtatcatttttcattcattttaaaacaa

SEQ ID NO: 46251 - DNA, 201 bp, Homo sapiens
agcttgggcttccagagcagccagtggcccaagagaagtctgacctgggcaaagctgctctcctctctggactcagagagcactgtgatgatgtggctctscctgtcttgtcagccatgtttccagcacttagcatgaagcctggtgcacaggaggtgcttccgtaggggtagatgatgtgctgggcagtcagccctcttc

SEQ ID NO: 46252 - DNA, 201 bp, Homo sapiens
ttaatcttttccttttttattgtttcttgtttctgcttattatcaagttgggaatgtttttgaagttacattttcttttctctaatataggtatacttctrttcttttagtggttaccctgaaattattattactattattattgagacaaagtcttgttctgtcacccaggctggagtgcagtggcacgatctcggctca

SEQ ID NO: 46253 - DNA, 201 bp, Homo sapiens
cgcctatgcttggggaactcactgctgtggaaatacagcctcgtgggtgtgtgggggtctgcctggcctgcagcagctccatgaggccagagcggggcctmtgtatgttctttcatcttctgatgaatgttgtccctcagagggaattgtctgaacagtggccccagagacatgttctatattaggaatttaaagtgacat

SEQ ID NO: 46254 - DNA, 201 bp, Homo sapiens
tcacatggtctcattcaaacatagagtttgactcaatgattcatgcaataagaatctactgagtacctcctatgttcagggctctatgctaagtgttgcargggagagagagaaggcaccatgttccctgaccacagagagaggtctggaaggtcagttttattgtctataacacactaactttcagtgtattgacatcta

SEQ ID NO: 46255 - DNA, 201 bp, Homo sapiens
ctccatgaggccagagcggggcctatgtatgttctttcatcttctgatgaatgttgtccctcagagggaattgtctgaacagtggccccagagacatgttytatattaggaatttaaagtgacattaaaaactgcaacatctttaaaacatccaaccaaaggttctaggggcttcggggctctaggccttgctcctggatg

SEQ ID NO: 46256 - DNA, 201 bp, Homo sapiens
tctgaaaaatcaagtggccttttcttcatccatacctggaacacgtttacttccccagtgtgcagaatgtatgtgtttctgcttagagagtcccgtccccrttcccgtcatgctgggctttccaactggacatggaaatggatccccacagctgtgacctaagctttttcttagcaaggtcacacatctcctttcaaagcc

SEQ ID NO: 46257 - DNA, 201 bp, Homo sapiens
tgctggcagtgcagctatggacaagttttttaaccatctaagcctcagtttccatgtctataaaatagggataatgcccaactccaaagagtttctctaaygggttattgagtgagacagtatgtttctagtgcattcagtatagtggctgccccttaaaaaactcccattaaactatagctgtaatcagcatcactttcc

SEQ ID NO: 46258 - DNA, 201 bp, Homo sapiens
gcccagcactcagccaagttttgtctcactacacaggtcatcccaggcagcattcagtatcttctccatcttgacctcttctttccccaagggccttacayggtgctaggtaggtgactaatacattcagactaaattagattacctgaaattattcataattaggttaccagcatcatgtcttataaatcaatcactaga

SEQ ID NO: 46259 - DNA, 201 bp, Homo sapiens
ccatgtctataaaatagggataatgcccaactccaaagagtttctctaacgggttattgagtgagacagtatgtttctagtgcattcagtatagtggctgscccttaaaaaactcccattaaactatagctgtaatcagcatcactttcctagggacatttaaggaaagttctcagaccattttttttcagctcaaatgac

SEQ ID NO: 46260 - DNA, 201 bp, Homo sapiens
tataaaatagggataatgcccaactccaaagagtttctctaacgggttattgagtgagacagtatgtttctagtgcattcagtatagtggctgccccttaraaaactcccattaaactatagctgtaatcagcatcactttcctagggacatttaaggaaagttctcagaccattttttttcagctcaaatgaccactccc

SEQ ID NO: 46261 - DNA, 201 bp, Homo sapiens
cactaggatgcacttgtagctttgtatgtctcctggccctatctctgcaccatcaccatttctaaagcattgcctgtcttacacaaaggccccaaggcccrtaagaaatagtaatgattttaaacaggattccaggagagtggagcccatgaatctgcattgttgcttacagaattacagcaagattgggaacatgagagt

SEQ ID NO: 46262 - DNA, 201 bp, Homo sapiens
ttcctagggacatttaaggaaagttctcagaccattttttttcagctcaaatgaccactcccctgatcaaattggccacttgtttagtattatgcagacasagcttatgtgatctatatatgtggtctgctttagaagctccattaccaggtgtttgcttaaagccaaaccaaatattccaaaaactggatgtttaatggt

SEQ ID NO: 46263 - DNA, 201 bp, Homo sapiens
atccacgtgctcatatcacaaggttggcaagccagaagaaaagcagaaatcccttaaaatgtccttgaatcttcctttatggcaaccttatcatactgaaygccctccccatcttgtttttcttttcttggctagataccatgtaggacagataaacccaagagagtgggccgaaagtctaggggagacactggttgaata

SEQ ID NO: 46264 - DNA, 201 bp, Homo sapiens
taaaagtgacatttaaaaattagctaccacgtatgcaaatacttctgaaaacttttatgtcaaatttaatgatttgatcaattaggaaatagcaaatatayccatagacatcagttgcatagacttgaatttcacaattaaaaagtgagtatatccttgggtattttactgataattttcactgtggctcatttttttttt

SEQ ID NO: 46265 - DNA, 201 bp, Homo sapiens
tgatccatttgaaggtcatctgtatttttttctctggctgtttttaggattttctttgtctttggttccctgcagtttcactgtgatgtgtgtaggtgtgwctttcttcttatataagtgccacactcctaagtaaaaatgcccatctttgccgcttaaagagcaagtcctcttgaagttctggggcatgccccccttctt

SEQ ID NO: 46266 - DNA, 201 bp, Homo sapiens
aatatattggttcaaagtaattatgaagaaaacagtgttccatgtgtgttgcgatcttattgtaaatgagtataaattttaaagggtaaaggatcgtagtwatcaagtcacacttgaaaattcttcacctggagacacctaatgattaatgtaaatgaggttggagaggaaagactatgagaggtgctatttgctgctgtt

SEQ ID NO: 46267 - DNA, 201 bp, Homo sapiens
tgacctgtgacataatatcctcaactgaggactccttccttttttctgatgtaatagtaatttttaaaatgctttcctggaaactgattgaaatgggcatkgttgccacttcatagaaatacactgaatgttgactctaaggcttacatatgctttggagacagtgttataaggtttcaccaaaatagaaggaagatggaa

SEQ ID NO: 46268 - DNA, 201 bp, Homo sapiens
taaatgtgtccttttctcacacatggctcagaaatgtgccaagtttttcacattttttgtgctcttcattggtgatttcatggcttaaaatggccccccarccatagtgctgaagcgctgtctattcctaggggaaagaaggctgtgatgtgccttttgaagaaagcacatgtgttagacgagcttcattcaggcatgagt

SEQ ID NO: 46269 - DNA, 201 bp, Homo sapiens
tatgggaaaatatgatcgtttattaatttggttttttaaaatttactaaacatctattacccagaaagcactatagaaaatgcttttgagagatgcagttwtgaactagcaatcgcccttgtccttcaggaagctgacaggctaggaggggagatatgataggtagagatgactttaaacacaacaatgtgagatgctgta

SEQ ID NO: 46270 - DNA, 201 bp, Homo sapiens
ggccttcccttctttctggctgccctggtaccctctagagcctcctatctgctgctcggaggcagtgcctgcagcggctggactcctgcagcagctggagktggaggaaagattcttaggccgtgagtcctcttcttccgacagcgaatttgagccctggtggagcaatgtccggcacgctcaggaaagtgtgaaatctag

SEQ ID NO: 46271 - DNA, 201 bp, Homo sapiens
ggtgacaaatgatggcaagcatcttctttggtgaggtgtctgttcagatcttttgtccatttgttaattgggtgtttgttttcttaatgttgagttttcartgttctttgtgtatgttggatataagtccggtatcacatttatgtttgaaaatattctctcctcatatgtggtttgtgtttttattcttcccacagctta

SEQ ID NO: 46272 - DNA, 201 bp, Homo sapiens
cccaggttgagaacttctagaccagaggattggaagcaggaaggagaagggaagctcatgggctgcccagtgagctcttgggccctgaaaggtccagggtrtcagagttgccaggaggtgctggagggcagccagaccacagccaggtaaggctggaggctggagtgagggcagcgccagccagcagggcccacaactgag

SEQ ID NO: 46273 - DNA, 201 bp, Homo sapiens
cattcaggagcaggttgttcagttttcatgtagttgtgcggttttgagtgagtgaggttttttttttttttttttttttgagatggaatcttgcactgtcrcagtgcaatggcacgatctcagctcactgcaacctccgcctctcaggttcaagtgattctcctgcctcagcctcctgaggagctgggattacaggtgtgc

SEQ ID NO: 46274 - DNA, 201 bp, Homo sapiens
ggagtactgaggagagaaatcactggttcttctttgggtgaagttggacttgaaccattgtcagagggcaagggcgttggagcaggcccttgaaggatgcrttagctgctgaggcaggaaagggctttccaggtcaactgctttccttcctgaatccttagcttccctcttgtctgaggaaggctctaaaactcgatgcca

SEQ ID NO: 46275 - DNA, 201 bp, Homo sapiens
aatttctgacagatttccaactatcaaaaaaaaaagttgcatatatcagtatgtttcaccccttgtaacttcagcatgcacattattaactagagtttaayatttgttttcatctattctaaggtagaagttacatacagcaaaatacgtacatcttaggcatagccttccgtgaggtttttaacttttttttaattatac

SEQ ID NO: 46276 - DNA, 201 bp, Homo sapiens
tttttttttttttttttttttttttgagacggagtctcgctctgtcgcccaggccggactgcggactgcagtggcgcaatctcggctcactgcaagctccrcttcccgggttcacgccattctcctgcctcagcctcccgagtagctgggactacaggcgcccgccaccgcgcccggctaattttttgtatttttagtaga

SEQ ID NO: 46277 - DNA, 201 bp, Homo sapiens
cctcccacgagctcacagcatgccttcctgctgggtaggtcagacaggagttagaatactggatggcaggcagagaactgttgtggctatgagagaaagtygtagggtctttcctgcctttaggaagaaaaatgatatatcttctagcttgaaagttgcttttaaaactccatgctgtgacacagtggccattgcctgtct

SEQ ID NO: 46278 - DNA, 201 bp, Homo sapiens
cttagcagagcttgcacgctgtgctgggagatccgctgctctcctcagagctgtcaggccgggatgtttaagtctgctgaagctgtgcccacagctgcccyttccccaacatgctctgtcccagggagatgggggttttatctataagtccctgactgggaatgctgcctttttttcagagatggcctgcccagagaggag

SEQ ID NO: 46279 - DNA, 201 bp, Homo sapiens
ggggtttcactgtgttagccaggatggtctcaatctcctgacctcatgatccgcccgcctcagcctcccaaagtgctgggattataggcgtgagccaccgygcccggccaattcaatttattttttatttatttatttttttgagacggagtctccctctgtcgcccaggccagagtgcagtggtgctatcttggctcact

SEQ ID NO: 46280 - DNA, 201 bp, Homo sapiens
ctacccttgggtttcatgaggaaaaagagattcttccctaaaagaggagtctttgatgccgtctgttttccccaagggatcccaggctgttggaaattccttttttttagatccctcgtgtggcaagaagtagtaggaacagacagaagtaaatggagaaacagaatttggtcagaagttttacagagagtgcagaggcct

SEQ ID NO: 46281 - DNA, 201 bp, Homo sapiens
acagaaggaataagacagcccctgttctattctactcttattaagtcaagtggacaatactcagatatatggaaacagaaagaaaagcaaagaggtgtggytagaccccatcttaaagacaaaagaaaaagaagaggctgggcgcagtggctcacgcctgtaatcccagcactttgggaggctgaagcaggtggatcacct

SEQ ID NO: 46282 - DNA, 201 bp, Homo sapiens
gtgacaagctctggtacaacatgttgtcattattttcactgaacacagtgcctgacactttgtaagtgctgtacaaatagtagctgctcttatttttatgrttgctattattactctttgggtaatcaaaatgagattttggttatttagatttagatatttttgaaacatgtaatttttttaatggaaaatatatccgac

SEQ ID NO: 46283 - DNA, 201 bp, Homo sapiens
tgcaacctctgcctcccaggttcaagcgatcctcctgcctcagcctcccaagtagctgggattacaggcatgcaccaccatgcctggctaattttttgttkgtttttttgagacagtctcgctctgtcacccaggctggagtgcagtggcacgatcttggctcattgcatgcaacctctgcgtgctgggttcaagcgagtc

SEQ ID NO: 46284 - DNA, 201 bp, Homo sapiens
acattaaccagaatgtttttgaagtgaggtattgaagggtgagatggaaagaagaataaagaatggccccacctgagtagcagggcattgactgttccatraattccaaggtggaaggagtatcacagagccctgagtgaaggtttctgctggacaagagaagcagggaggatgagggtgtgctggaccgaggtgacataa

SEQ ID NO: 46285 - DNA, 201 bp, Homo sapiens
acagaaaggacaagggagggactttccagtccttctgtacacagtaggaagactgagtatgaaagtggctgacataggccaggtgcgatggctcatgcctrtgatcccagcagtttgggaggctgaggcaggcggatcacctgaggtcaggagttcgaggccagcctgatcaacatggtgaaaccccctctctactaaaaa

SEQ ID NO: 46286 - DNA, 201 bp, Homo sapiens
tcatcattgctgtttagcttgactgttttcctcaagaacatcgatctgaaggattcataaggagcttatctgaacagatttatctaagaaaaaaaaaaaamgacataaaataagcgaaacaactaggaccaaattacagataaactagttagcttcacagcctctatggctacatggttcttctggccgatggtatgacac

SEQ ID NO: 46287 - DNA, 201 bp, Homo sapiens
tgaggaaaagttagtttttgttttcatctttttttataattagccatcaccagataaagtagtttcattctaatttagctgtcaaagacagattattgctrtcctcaaaaagatatgtttcagctttctttgaggtctttgtagttacctttgaaaagcaggtatctcttgctttgtacaggtccaatgtgcacagatttc

SEQ ID NO: 46288 - DNA, 201 bp, Homo sapiens
tgtgagcatgaagtgctttcttgatagaaaatgacatgagatagaagtgctttcttttgcagtgtagaaaccacagaaggtgaacagcttttgtctttgatttttttgttgtgtgtgtttatgtgatttctatggagagaggggaacaagactgcagtttagtgttagacctgtgagatattccagtaggtatgtcaggta

SEQ ID NO: 46289 - DNA, 201 bp, Homo sapiens
tcatttaggctatcaaattttttggcaaaagtggatcataatatcctctcatcatccttttaatgtctgtagactttgtagtgtaaggccgggtgtcgtgsctcacgcctgtaatcccagctctttgggaggccgaggttaggagtttgagactcagcctgaccaacatggtgaaacaccgtctctgctaaaaatacaaaa

SEQ ID NO: 46290 - DNA, 201 bp, Homo sapiens
atccaacatgtaacttcaggggagtccttcattaattaatactactttaaaccttagcacacatcgtctgggaatgacaaataagcatttctttttttttwaatttaattttattattattatactttaagttttagggtacatgtgcacaacgtgcaggtttgttacatatgtatacatgtgccatgttggtgtgcattt

SEQ ID NO: 46291 - DNA, 201 bp, Homo sapiens
tagataaaaggggggctacagaaatggaataggaaaagactttctggaagaacaaagcattctgagcaaaattaacaaagggaggggaaatagaatttttrtaaaaagggaagagcaatatgtagttcactttaattgtagcagtgtagagagttaaaggagagaaatctagaaagcagtagactgtaaatggacatgtga

SEQ ID NO: 46292 - DNA, 201 bp, Homo sapiens
ttttttttttttttgagacggagttttgcccttgttgcccaggctggagtgcagtggtgcagtctcggctcaccgcaacctccgcctcccaggttcaagcsattctcctgcctccacctcctgcgtagctgggattacaggcatgtgccaccacgcctggctaattttgtatttttagtagagatgggatttctccatgtg

SEQ ID NO: 46293 - DNA, 201 bp, Homo sapiens
aaagttattctttcccttggtcttcttttactgcttggtcctcttttacctggtactcttttactcttctacagctctagtcatttcaccattgtatgaayagttttgttgtatctgagccatttgctaccagcacactcaaaatcttttcagagctaggcaaattggtaatagttgtgatcacaggccactttctgctgt

SEQ ID NO: 46294 - DNA, 201 bp, Homo sapiens
ggccaaattaggtgaagggtctcatttcctaggatttcttcacaggtggcatccgtcctcagatgggctacctaggactagggatggctgcaggtttcaargagcgagtagcttgaatgtgtgattcaaggttatttagtatcaaatttgagaatgccccaaacttaccttttaactgctcgaccgcatggcaccaccttt

SEQ ID NO: 46295 - DNA, 201 bp, Homo sapiens
gtatcaaatttgagaatgccccaaacttaccttttaactgctcgaccgcatggcaccaccttttgggaaatactgtctttgggcacttctgaactagttcrctgagagccagagctttatctcttgttctcagtcacatcccagtgcctagaaaattgcctagcacatagtatatgctcaacaaacacctgctgaatgaat

SEQ ID NO: 46296 - DNA, 201 bp, Homo sapiens
attgttatattcttactgtattagtcaaagattgaggcataatggtgtcaaggaaatataaattgctgagattcttgtttagaaacccataattcagccakacaggtgagagacaagaaatgtttcaccttttttgacttctaggtttggcatattgagtttcttgtgttaataccacagctacaccaagtaaaaggttat

SEQ ID NO: 46297 - DNA, 201 bp, Homo sapiens
ctcacatttggaaactttgagggagacatgtttttgctgtgagagacctcacgggttctggctctcatgccatgttagagtagtgttgaatgagcagagakactatggcccctgagtgagatcctttgtggagagtattagtaagatgtgggatctgcctgggtatccacagctccctcctttgtgctagtgagccaagag

SEQ ID NO: 46298 - DNA, 201 bp, Homo sapiens
ttttcactttattggtgtttctcaaactgtagtgtgtaattgaatcacctggagattaaatggcaaaatgtagattccaattcagtagtcagagagcttgmgagtcagtagttctaacaagcttcaggtgttgccaatgccgccggtacactgagcacaccttaaatacaaaggcttaatgtgttaatggggtgggcccca

SEQ ID NO: 46299 - DNA, 201 bp, Homo sapiens
ttggctaggagttggttattgctgaagccgggtaaggagtacgtgagtttcattatattattgtttctacttttctatatacttccaattttcaattaatraaagtatttttcagctgggcatgtggctcatgcttgtgatcccagcactttgggaggccgaggtgggcggatcatgaggtcaggagttcgagaccagcct

SEQ ID NO: 46300 - DNA, 201 bp, Homo sapiens
taggtattttagtgctaagttcaaagaggtggcctccagggacttaaaggcaaataccacttgcaactggaatcaaatatatgtattgtaaatgtaaaccrtaatctaacctgtgttaactatctcattaataattttacttatttaaaaacaaagctaattaggaaattagaaatacttgtaattgcagtgagtaacaat

SEQ ID NO: 46301 - DNA, 201 bp, Homo sapiens
gcggagcgagagaagagcaagtaaaaccaagaatctcttgccatacacacgttacaggcaggacaattgtggctgttgttgttacttctgtatttactcartttttaaaattaagctcttggcctaaagatccaacatgtaacttcaggggagtccttcattaattaatactactttaaaccttagcacacatcgtctggg

SEQ ID NO: 46302 - DNA, 201 bp, Homo sapiens
gagttagctctggatgaactgattcatttagcagaagtggaatgctttgaagctagatggaagaggtcactaattaaatgctagaccaagacagagtccarttgcatggggagctggaattttcttgaatgttagtaagtgaaataaaaggtgagaaaatggctttttagactttggtaccctgacaagaaattagtggat

SEQ ID NO: 46303 - DNA, 201 bp, Homo sapiens
aagccatgttccctccctcccctgctgctgatgcaggacaggcaagtccccaaactggggctcagcccgggagggttcttggcctcgcccaggaaataatkcaagggcaagctggtggtgttaaacagcaacttctattgaagcagcagttgtactgcagtggcagagggactgctgcttgcagagcggggctaccccatg

SEQ ID NO: 46304 - DNA, 201 bp, Homo sapiens
tccaatctgtagaggagggccaggggaggtgaatctgcaagggagcctgaggaagcctactcactgagacaggagaacattcaccaggagcccgcagggakaaaagcatgcttcaggaagaagggcggtgccgtgaaagcactggtcattttgaataagagatggttacccactgatttcttttggattctgggcatatat

SEQ ID NO: 46305 - DNA, 201 bp, Homo sapiens
ttcttttgcagtgtagaaaccacagaaggtgaacagcttttgtctttgatttttttgttgtgtgtgtttatgtgatttctatggagagaggggaacaagaytgcagtttagtgttagacctgtgagatattccagtaggtatgtcaggtagggaattgaatgtacaagcctggaggtcaaaggaagttgagggctgggagg

SEQ ID NO: 46306 - DNA, 201 bp, Homo sapiens
atcccagctactcaggaggctgaggcatgggattcgcttgaacccaggaggcggaggttgtggtgagctagatcgtgcctccagcctgggcaacaagagcraaactccatctcaaaataaaaataaaaataaaaaaaatttaaaaagtggctgacatagcaagaaccaaagatgctagagacaagatgataattcacaggg

SEQ ID NO: 46307 - DNA, 201 bp, Homo sapiens
gaacaggcatccttgccctcctgagaaccccccacagagggccaggaacctcagatgagcagtcattagagggctctttgagttttctgctggctggtttrgtgagaggcccaagcgccctgcatgagttctttacactgctgtgttggggtggggtaggagaatcaggcctacagaggagaagaagactggtgctttgga

SEQ ID NO: 46308 - DNA, 201 bp, Homo sapiens
tgggtgtcaaggctgatccccccaccccaccatattaatgtctgattgtttccagctccacttattacaaagactattcttccccattgaattgctttgakgcctttgctactgattttttttatatttgttgcagcttgtttggtggccaggtatgtagtcagtttttagattaatactccacaaaaagtgataaaaaga

SEQ ID NO: 46309 - DNA, 201 bp, Homo sapiens
tatctcagcccctgcatactggtgcggacacgagaacctaggtcccctgaggctttttccttttcacaaggacaaaatccaaatgcaaattcatggctcaracttcagaatttcaaggatctgcaaccatggtccaagagtcatattgcatagggaaaaaaggaggcagttagggccctgacattatatctgctcttgtgt

SEQ ID NO: 46310 - DNA, 201 bp, Homo sapiens
cacctgtcatttattaccattctgtataatgtgcttacttaatattctatttattgtgtgtgcctctaccactacaatgcaaagagtctttattttgttcrtcaacataccataagcagttaatagcagtgtttctgaaaattagtgatagctgttgtaatgcccaacaagagaattgttatattcttactgtattagtca

SEQ ID NO: 46311 - DNA, 201 bp, Homo sapiens
gattctggcaaagattggatgttaaaattcatttttgaggttgttttgagttcccttacttccttatgtctataggtattttagtgctaagttcaaagagktggcctccagggacttaaaggcaaataccacttgcaactggaatcaaatatatgtattgtaaatgtaaaccataatctaacctgtgttaactatctcatt

SEQ ID NO: 46312 - DNA, 201 bp, Homo sapiens
aggtggcctccagggacttaaaggcaaataccacttgcaactggaatcaaatatatgtattgtaaatgtaaaccataatctaacctgtgttaactatctcrttaataattttacttatttaaaaacaaagctaattaggaaattagaaatacttgtaattgcagtgagtaacaatcaccaccagagtgaatgggcaccttc

SEQ ID NO: 46313 - DNA, 201 bp, Homo sapiens
atttggcacaaattctgcgacaaaggccaggaaagtctggcccaggggacttgaaatgcctcattccaaagccatgtggatacaacaggaaatcatggctkcaaagtcttaccctcactgaagactcctacttacctgctactccttgagtgtctccctaggggctatgtcttctcactttgtttgatacccaccatggga

SEQ ID NO: 46314 - DNA, 201 bp, Homo sapiens
ccagagctcacactcatgacaaagtccagaagcaaatacatgttgtttaactccaaactctatattgggttcactaaagttagatttcccaagctagtgtyccacagaacaccactgtaccaaaagctattaatacatggtccatgaaaaaagccttctatgatcaaataagtttggggaatcagtgaaaactcagtttcc

SEQ ID NO: 46315 - DNA, 201 bp, Homo sapiens
aactggagtgcagtggcagtcctggctcaatgcagactcaaaactccaggccccaagcgaacctcctgccttgacctcccatatcactgggattacaggcrtgagccattgggcttggcctgaaactttttttaagtgcaaacatgtggcagcaaataatataatgactatggctattaatacagtttggtgctagttcat

SEQ ID NO: 46316 - DNA, 201 bp, Homo sapiens
tgaaaaaagccttctatgatcaaataagtttggggaatcagtgaaaactcagtttccccctcctctcacacctgagaatccacagagcacttttgcaacaytgcatattagcattttaaatactctgagaagtcccatagtaaagaaacctgctaactttgtttatcccaacattttctttccattttttgcaaaaactaa

SEQ ID NO: 46317 - DNA, 201 bp, Homo sapiens
tgtcttataactgttgtgatttaattttgagctttgcttcaacttagacttccagattggttgggttattcaggattcaaatctctttcactaataataawaaaaaaaagagaatgataatagatataaagcatgcttctaacaggctcttcctttattccaggacggcttgagaagactgtcaggaaacgagtatgtgtt

SEQ ID NO: 46318 - DNA, 201 bp, Homo sapiens
ttttaaacaggcaatgaatggcagctggccaacagcagtatctaagccagaaggcccattatataaagaaataaattggaagcatttcttcttttgacagyattttccactatttacagaattttaaaattgtaacctgggaaaatgcttaatttttgcacaattagatcgagattaggaatagccttgagaattattttc

SEQ ID NO: 46319 - DNA, 201 bp, Homo sapiens
gtagattaattgttattattcctgggggtctctactgtttttaattgaaggttaaaagacttagtacttttattttagatgtttacacaataaatagaatyagaaagagggggattttactgtggtttaattcttcaactgtgtattacccaccataaaaaatgaacagcgcaacacctcattgcattgacaggcaattcc

SEQ ID NO: 46320 - DNA, 201 bp, Homo sapiens
tcagctcactgcaaactccacctcccaggttccaacagttctcctgcctcagcctcctgagtagctgggactacaggcgtaggccaccatgcccagccgattttttttttttttttgtatttttagtagagacagggtttcaccatgttggccaggatggtctcaatctcctgacctcgtgatccacccgcctcaacctcc

SEQ ID NO: 46321 - DNA, 201 bp, Homo sapiens
gctcctttcttttataccacatgatgtttcacagctgaagccacatgctaccagttgagaacagcacccaattcattaatgccaagaccaaggtgatcaawagcctctgcagtcttgagttagaggtgaacctcactcaagcggaaccactctaggaaaacattgattaaatttttgataaattagggaatgcttagtaac

SEQ ID NO: 46322 - DNA, 201 bp, Homo sapiens
ttctaccagatctgctggcactgacaaagagggtcaggaagtattttcttacttctcttgtgtcatctgtcacccctaatttctttgtgataagctaaaattttttttttttttttttttttttgagatgaagtctcactctgtcacccaggttggagtgcaatggcatgatcttggctcactgcaacctctgcctcccag

SEQ ID NO: 46323 - DNA, 201 bp, Homo sapiens
gtccagtggcttagaaaaatgccagaagccattctgtcagaattctctagaggaggtagtaaaaccagcctgcagttttttattaaaggaactcaccatawgatatatacagatgtgatggtgaggaatgtcacctccacagagacaggagaagacagtcacaaggagcagctctaatcccttaggatctgcatgaagccc

SEQ ID NO: 46324 - DNA, 201 bp, Homo sapiens
tcagcctcccgagtagctgggattgcaggcacatgccaccaagcccaggctaatttttgtatgtttagtagagatggggtttcaccatgttggtcaggctsatctcgaactcctgacctcagataatccacccacctcgacctcccaaactgctgggattacaggtgtgagccactgcttccagccaggctaaaattctta

SEQ ID NO: 46325 - DNA, 201 bp, Homo sapiens
gcaggagcacagttaggagtggaatggattggaagtgcagagtggtgctgtggagcacgtctctcctgggtgagttgatgtgacccacagggaaagtcatrttttccaatcttggctagaaaataaaaagcagaggaagtgttatgaggcagagattcaaatcaacatgatactgtctgaaaaatcaagtggccttttctt

SEQ ID NO: 46326 - DNA, 201 bp, Homo sapiens
agtggtatgataccaagtatcagaatcagcacccatgtatatttcttttctgtcttggtgctacagcatttggagaacttggaatacatgaaaacaaatgrcaacagcttgtgggtggctttgagagctatgtaaaggcagtcactgaggacaggggcccagagtgttgcaagaggtgttttgttccggtgtttaggagct

SEQ ID NO: 46327 - DNA, 201 bp, Homo sapiens
cagcctcccgagtagctgggattgcaggcacatgccaccaagcccaggctaatttttgtatgtttagtagagatggggtttcaccatgttggtcaggctcrtctcgaactcctgacctcagataatccacccacctcgacctcccaaactgctgggattacaggtgtgagccactgcttccagccaggctaaaattcttaa

SEQ ID NO: 46328 - DNA, 201 bp, Homo sapiens
agggaaagtcatattttccaatcttggctagaaaataaaaagcagaggaagtgttatgaggcagagattcaaatcaacatgatactgtctgaaaaatcaartggccttttcttcatccatacctggaacacgtttacttccccagtgtgcagaatgtatgtgtttctgcttagagagtcccgtccccattcccgtcatgct

SEQ ID NO: 46329 - DNA, 201 bp, Homo sapiens
ggcctgcaagctgagagctcagggcagagtggtggggatcagaggtgcacctggagagctggcagggaccaggccatgcagcagagcctcatagccagctygctgcctggaattgaccctaagaccaacgggaagtgggagttttaaacaggagaatgacaggattaaatacatagtttgcaagcttacactggctgatga

SEQ ID NO: 46330 - DNA, 201 bp, Homo sapiens
caagcccaggctaatttttgtatgtttagtagagatggggtttcaccatgttggtcaggctcatctcgaactcctgacctcagataatccacccacctcgrcctcccaaactgctgggattacaggtgtgagccactgcttccagccaggctaaaattcttaatgtcactatgacaaagcatgcccaacccagctgtagag

SEQ ID NO: 46331 - DNA, 201 bp, Homo sapiens
gtaagtgaaataaaaggtgagaaaatggctttttagactttggtaccctgacaagaaattagtggattaagagaagtttcttatcgcaggcatcatcttgytattctttgatgattttcagtttcccaaagaagaatttttcttaagcatctgttttagatatgttttaatggcttcaaataatctcatctttctgcataa

SEQ ID NO: 46332 - DNA, 201 bp, Homo sapiens
ggggatcagaggtgcacctggagagctggcagggaccaggccatgcagcagagcctcatagccagcttgctgcctggaattgaccctaagaccaacgggawgtgggagttttaaacaggagaatgacaggattaaatacatagtttgcaagcttacactggctgatgagaatagactgggttgggcaggtattgccaagct

SEQ ID NO: 46333 - DNA, 201 bp, Homo sapiens
aacccaaaagatggaagccagtcccaaaagaaaccaagagagtgtgtgctccagcccagttatgctcattacatgtttcagcctcttgcctaaaacccacrccttaggatatagcccagcagtgtgtccatgatgcctgctggggtgggaaagactgaatgaagttgagaagtacttagtgtttccctagagataagaaca

SEQ ID NO: 46334 - DNA, 201 bp, Homo sapiens
atgtttcaccccttgtaacttcagcatgcacattattaactagagtttaatatttgttttcatctattctaaggtagaagttacatacagcaaaatacgtrcatcttaggcatagccttccgtgaggtttttaacttttttttaattatacttcaagttctggggtacatgtgcagaatgtgcagatttgttacataagta

SEQ ID NO: 46335 - DNA, 201 bp, Homo sapiens
gcacaaaaaccgagaaatcttccattcattcactaggttattcctgggtgtctacatggcgcgttatgggaacacaggcattagtgaagacatcgcggccrcggggagttccagtccaataggggagagatgtagataggtccacatgttagtaaaaaatgaagtgtatctcaaggaagtttatgttaagtgctacagacg

SEQ ID NO: 46336 - DNA, 201 bp, Homo sapiens
tgtgtccatgatgcctgctggggtgggaaagactgaatgaagttgagaagtacttagtgtttccctagagataagaacatgcctctaaaacactatgtatkttttcattaggtgctaactggtatttccactgagtatccacccagtaggctcctgagtataaaataagtatagcttcaccttagcaggacctgccctgtg

SEQ ID NO: 46337 - DNA, 201 bp, Homo sapiens
tttgcccattcagtatgatattggctgtgggtttgtcataaatagctgttactattttgagatacgttcaatcaatacctagtttattgagagtttttagwgtgaaggcctgttgaattttgttgaaggccttttctgcatctattgaggtaatcatgtggtttttgtcattgtttctgtttatgtgatgggtcacagtta

SEQ ID NO: 46338 - DNA, 201 bp, Homo sapiens
tccccccacacagtgtgagggctcaaggaacaggacatggagaaggtacattttttgagaaaggtcataaaatgttggagttgaagaggatgaagcaataygagctggctgtcccttggggagtggtagttcaaatacattaaagtagagaggagcagaaatgcccacagccagagagaaaaacaaatgcatgttgtttca

SEQ ID NO: 46339 - DNA, 201 bp, Homo sapiens
ccacacagtgtgagggctcaaggaacaggacatggagaaggtacattttttgagaaaggtcataaaatgttggagttgaagaggatgaagcaatacgagcyggctgtcccttggggagtggtagttcaaatacattaaagtagagaggagcagaaatgcccacagccagagagaaaaacaaatgcatgttgtttcacaaat

SEQ ID NO: 46340 - DNA, 201 bp, Homo sapiens
acattaaagtagagaggagcagaaatgcccacagccagagagaaaaacaaatgcatgttgtttcacaaattactcaggagtaattctgttcttggagatcrtggttcccttccaagatatctcagaataagcagaggccagaccaagagaataggtcaaagcaagctgctgattcacacctagattcaagtgtgtgggcct

SEQ ID NO: 46341 - DNA, 201 bp, Homo sapiens
ctcgctcatttgatttttatttggcaaatgggaggacacgttctggggtgtgaggaggggatggttagtgcctgtgatagaaaagagagatgaggctggtracttaagagagtcaacagaaaggacaagggagggactttccagtccttctgtacacagtaggaagactgagtatgaaagtggctgacataggccaggtgc

SEQ ID NO: 46342 - DNA, 201 bp, Homo sapiens
aactctcccataacagggaagcaaagctgccacggagaactgttaaggaaattaagccccaggactgttggggaaaggaagaaactgtgttctcatgggaragtaacgagcagctgccagtcgagctctttgcgtttttgctctctgggttatttccatatatcttagcaatagatatacaatgacataaaaacacatctt

SEQ ID NO: 46343 - DNA, 201 bp, Homo sapiens
tagtggtgacaggtgaagccaggagcagaagaacatctctaaggggtgtgtgatgtgcatgtagtgaaaggacagagggtccaagcctgagcctgaaggcrtagtctcagccagggggtgggcagtggaaatagggccagtaaagaggacagaagagctgggggtgaccatgagagtgcagtgtcacatgaaccaagaaca

SEQ ID NO: 46344 - DNA, 201 bp, Homo sapiens
tcagcctcctgggtagctgggattacaggcatgctcaaccatgcccggctaatttttgtatttttagtagagatggggtttcaccatgttggtcagggtgrtctcgaactcctgacttcgtgatctgcccgtctcagcctcccaaagtgctggacttataggcatgagccactgtgcccagcctaattttatgtatttttt

SEQ ID NO: 46345 - DNA, 201 bp, Homo sapiens
atccaacctcaaactggtctagaattgctgccatctgaagcgatagcatcttgtctggaaggctgagattgcacatctgctcacagttaggagaaacaacwggaactctttgggtgcaaatgctattgagaaaatttaaccaaagttccattgtttccttcttacacattttacaacctgtccatggggctctggaaggct

SEQ ID NO: 46346 - DNA, 201 bp, Homo sapiens
cagggaccacctggtgttcttcagtgctggccctgatagaggccatttgcccattaggtcagggtgcccccagtagcttgggctcattccaggagaagcaygctgcacctacaacagctctcctggcattactgtggcacaccatcagctgagactgatcttcatgtggtggttctccttttttgggcaaaatcctgtctt

SEQ ID NO: 46347 - DNA, 201 bp, Homo sapiens
tgccccactaacagtgttggggtcagttataaaacaagaaatgcaggatcccaaagaaagcacacttattatttctagtgctaatgacttccttttgtcayttgacagacatttattgagcattagcacaaaaccattaacaacaaaaaaaattgataatgagaaagaataggtggaaaactgcatctaaagttcagatct

SEQ ID NO: 46348 - DNA, 201 bp, Homo sapiens
ctggcttaccacacgtcagagtgggcaggcctgtgcacacctaccccaaagtccgaggaagctgagaggccaaagaaagaggctgatgaatcccgttcctyggaatgaaacatctaataggaacttatgaacagaagccacgtctgtgccttggatggtggcaagacaagataacggatccctgttccattacccacagac

SEQ ID NO: 46349 - DNA, 201 bp, Homo sapiens
aacctttgccccacaagagattggaatgtaagcttctctcgctatcttcttgccctctcccttcaagggcagctccaggcagctcccatctctgtggtacmtgccccaactctcctaaaaacccttctgcaccttctctggtggcaacttgtggaggcctaggagtttctttccacaacccagcaagagttctgcctggga

SEQ ID NO: 46350 - DNA, 201 bp, Homo sapiens
caccacaagatttcctccattttttggtctctcagctcctggcctggcttaccacacgtcagagtgggcaggcctgtgcacacctaccccaaagtccgagraagctgagaggccaaagaaagaggctgatgaatcccgttcctcggaatgaaacatctaataggaacttatgaacagaagccacgtctgtgccttggatgg

SEQ ID NO: 46351 - DNA, 201 bp, Homo sapiens
ttttattttagatgtttacacaataaatagaattagaaagagggggattttactgtggtttaattcttcaactgtgtattacccaccataaaaaatgaacrgcgcaacacctcattgcattgacaggcaattccattatttgattttaaataagtgcttctggttttttaggcaacattacatgtgatggcatatgttagg

SEQ ID NO: 46352 - DNA, 201 bp, Homo sapiens
cagatgtcctacacactcatctgtcttatttttcaagttaacctaccccattcattgagtggctacaaagatttaatggtctgagcacttgaaagtaggtkgatttagcagtgaagccgcatgattataagtttaatagaactaaatgtgccccactaacagtgttggggtcagttataaaacaagaaatgcaggatccca

SEQ ID NO: 46353 - DNA, 201 bp, Homo sapiens
tgagctggggatcgtgcatcaacccaaacatgttttaccactctgcagcatttaaaaccaaagacactgctccaaattagctactttcacaattcaacaamaggttttatccagggagctgatgatgcctatctacaaaagggaacaattccttcacacagtaccctctggtttcagcagttacttgggttttgcccttcc

SEQ ID NO: 46354 - DNA, 201 bp, Homo sapiens
cttcatctggggtgctccacgtagcattggggccgaccccattctcagggtaaacagatctgacagaggcttttatccagtccaccaggctggctgttccytcaggaataacctcccatgtgtctggatcacatatagccatctgtgattgttcagtagtgagctggggatcgtgcatcaacccaaacatgttttaccact

SEQ ID NO: 46355 - DNA, 201 bp, Homo sapiens
aaaagacttagtacttttattttagatgtttacacaataaatagaattagaaagagggggattttactgtggtttaattcttcaactgtgtattacccacmataaaaaatgaacagcgcaacacctcattgcattgacaggcaattccattatttgattttaaataagtgcttctggttttttaggcaacattacatgtga

SEQ ID NO: 46356 - DNA, 201 bp, Homo sapiens
ttattttagatgtttacacaataaatagaattagaaagagggggattttactgtggtttaattcttcaactgtgtattacccaccataaaaaatgaacagygcaacacctcattgcattgacaggcaattccattatttgattttaaataagtgcttctggttttttaggcaacattacatgtgatggcatatgttaggtg

SEQ ID NO: 46357 - DNA, 201 bp, Homo sapiens
attcttcaactgtgtattacccaccataaaaaatgaacagcgcaacacctcattgcattgacaggcaattccattatttgattttaaataagtgcttctgkttttttaggcaacattacatgtgatggcatatgttaggtgccaggagatgccctaatacagattctgcagtgcacatggggcactggggggctgtcccag

SEQ ID NO: 46358 - DNA, 201 bp, Homo sapiens
agcagggcaaaagcaggcctggaaatttgaaataaatatccccagccaacacaatagcataaagaaaagccttcaggttattgtactgctgaaatctgttyagagccagggcaccaaagactttttaaggtcttatcagattcagaactttgcaagtttctaagtacattatgtaagtactatacttctgacccctcactt

SEQ ID NO: 46359 - DNA, 201 bp, Homo sapiens
atccccagccaacacaatagcataaagaaaagccttcaggttattgtactgctgaaatctgtttagagccagggcaccaaagactttttaaggtcttatcmgattcagaactttgcaagtttctaagtacattatgtaagtactatacttctgacccctcacttactagaactggttgggggcattggacccgttgttgag

SEQ ID NO: 46360 - DNA, 201 bp, Homo sapiens
tgtactgctgaaatctgtttagagccagggcaccaaagactttttaaggtcttatcagattcagaactttgcaagtttctaagtacattatgtaagtactrtacttctgacccctcacttactagaactggttgggggcattggacccgttgttgaggtcataatgaaaaggctcaagttcttactacaaatcagtgtcaa

SEQ ID NO: 46361 - DNA, 201 bp, Homo sapiens
agaactggttgggggcattggacccgttgttgaggtcataatgaaaaggctcaagttcttactacaaatcagtgtcaaattggataatggacttgacccasgaaggtagtggccccaggaaagaaggtttgcctggcacagagattatcttgccttctgcacaagtttcagctgttgctttttggtgggttctgcctcaac

SEQ ID NO: 46362 - DNA, 201 bp, Homo sapiens
tgaaaaggctcaagttcttactacaaatcagtgtcaaattggataatggacttgacccacgaaggtagtggccccaggaaagaaggtttgcctggcacagrgattatcttgccttctgcacaagtttcagctgttgctttttggtgggttctgcctcaaccttattcaagttatcgcccttttgggtgtgtgtgtgaacat

SEQ ID NO: 46363 - DNA, 201 bp, Homo sapiens
ggcaccaaagacagtgggcaacacacagcgaagcccacagcagaagcctcacatttgtctgccctgaaatctcccagtgcacacatacacaccttgttctmataccagaccaatgacatcaatagcccaccctgcctaggccctgtcatcagcactttcattaggttgtctcatttctattcaataagggtaggcaagaga

SEQ ID NO: 46364 - DNA, 201 bp, Homo sapiens
attgttagaatatgttttatggctgccccgtgaaatgtatctgaaggcttcctcatgttgctggctcttagtggcccacctgcccacaggtctgcctcttsgacctcagagagagccagacgtgtttctgttacagaccaagcacaaaaatcccacatctcccccacttataccccgacttggacaatcgattctattcat

SEQ ID NO: 46365 - DNA, 201 bp, Homo sapiens
tattattacttcactttaggataatggcctccagctctagccatgttgctgcaaatgacatgatttcattcttttttatggctgcatagtattccatggtrtatatgcaccacattttcttcatccagtccaccaatgatgggcacctgggttgattccatgtctttgctaccatgaattgtgctgtcataaacatgcaag

SEQ ID NO: 46366 - DNA, 201 bp, Homo sapiens
gcacctgggttgattccatgtctttgctaccatgaattgtgctgtcataaacatgcaagtacaggtgtctcttcagtagaatgatttattttcctttgggyatatacccagtaatgggacggctgggttgaatagcaatttctatttttagttctttgagaaatctccgaactgctttccacaggggctagctgatctaat

SEQ ID NO: 46367 - DNA, 201 bp, Homo sapiens
ctttacatggtcattttttcatttttatttttatagaatataaaaatgcagatttcttgcatgcatatattgtgtactggctttcagtgtacccatcaccygaaaagtgaaaaatgtacccactacgtaagttttcaaccctcgtgcatggtcattattacagtctgattctactatgcaaagtgaggattgccgatagct

SEQ ID NO: 46368 - DNA, 201 bp, Homo sapiens
aacatctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgc

SEQ ID NO: 46369 - DNA, 201 bp, Homo sapiens
ccaaggcataggaaagatgctcacttcgtatcataacttatacaactagaagaaggtggcaagcactgtccaaactactcttgataaatttttttaaatamataaaacatcttaattttcaatgtttctaatattttaagttacagtatattaaataaattttagctttatattttttcatttccctatatatttataacc

SEQ ID NO: 46370 - DNA, 201 bp, Homo sapiens
acatctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgca

SEQ ID NO: 46371 - DNA, 201 bp, Homo sapiens
gtgtgtgtgtattttctgccttatactaaggcgctactctaggtttggagtgataaaaaaaatgaatatgatggccgggcatggtggctcatgcctgtaawcccagcactttgggaggctgaggcgggtggatcacgaggtcaggagttcgagactatcctgaccaacatggtgaaaccccatctctcctaaaaatacaaa

SEQ ID NO: 46372 - DNA, 201 bp, Homo sapiens
catctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgcaa

SEQ ID NO: 46373 - DNA, 201 bp, Homo sapiens
tgtggtatcattaaccacattcttctggccttgtattccctgtatgttggtagttagatctagaggcttgataggattcaggtttatttactttttttttkggggaagactactttataggtagtgtcatggacctccatcaggaggcacatgatgtctggttgtgtctcttggagacgttagcagccactgatgattgtt

SEQ ID NO: 46374 - DNA, 201 bp, Homo sapiens
atctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgcaac

SEQ ID NO: 46375 - DNA, 201 bp, Homo sapiens
ttgtggagtaggaagtggggagctacgatttattgtcaggcccagttcccagtgatttacttaatcctcctctacatatgagggatttgatattttctccwtttttgcagaggaggaaacaggctcaaaacaactaaacttgccagagctcacactcatgacaaagtccagaagcaaatacatgttgtttaactccaaact

SEQ ID NO: 46376 - DNA, 201 bp, Homo sapiens
tttcccatgacataaatcctggttcttaacatcatcatgataattcctcatttgttagatcccacatgcgcgtgcacacacacacacacacacacacacacacacacatctcagaataccagtgatcaacacgacttcatgatcaatatgaacactgaaaacagtttgatttttttccagtgatttttgatattagggtct

SEQ ID NO: 46377 - DNA, 201 bp, Homo sapiens
tctgttattttctgactttttaatagccattctgactagtttgagatggtatctcattgtggttttgatttgcatgtctgattagtgatgctggacttttgttttgtttagtttttttttttttttttttttttttttgagacagtcttgctctgttgcccaggctggagtgcagtggcatgacctcagctcactgcaacc

SEQ ID NO: 46378 - DNA, 201 bp, Homo sapiens
atcctcctctacatatgagggatttgatattttctccatttttgcagaggaggaaacaggctcaaaacaactaaacttgccagagctcacactcatgacaragtccagaagcaaatacatgttgtttaactccaaactctatattgggttcactaaagttagatttcccaagctagtgttccacagaacaccactgtacca

SEQ ID NO: 46379 - DNA, 201 bp, Homo sapiens
tcccatgacataaatcctggttcttaacatcatcatgataattcctcatttgttagatcccacatgcgcgtgcacacacacacacacacacacacacacasacacatctcagaataccagtgatcaacacgacttcatgatcaatatgaacactgaaaacagtttgatttttttccagtgatttttgatattagggtctgt

SEQ ID NO: 46380 - DNA, 201 bp, Homo sapiens
ttttaatagccattctgactagtttgagatggtatctcattgtggttttgatttgcatgtctgattagtgatgctggacttttgttttgtttagttttttkttttttttttttttttttttgagacagtcttgctctgttgcccaggctggagtgcagtggcatgacctcagctcactgcaaccctcacctcccaggcttg

SEQ ID NO: 46381 - DNA, 201 bp, Homo sapiens
aaagccttctatgatcaaataagtttggggaatcagtgaaaactcagtttccccctcctctcacacctgagaatccacagagcacttttgcaacattgcayattagcattttaaatactctgagaagtcccatagtaaagaaacctgctaactttgtttatcccaacattttctttccattttttgcaaaaactaatccat

SEQ ID NO: 46382 - DNA, 201 bp, Homo sapiens
tttcacttacaccttcattcgtctatttgtttggcagatattgattgaagtgggggcctaatatgtgtcagtcaatgtttgagacactgagttacagcagaaaaaaaaaaaaaactaaaaattcttgttttctgagtacttacattttaactgggggagatcaccaagaaaaaaaatttaacaaccttatttggttggtac

SEQ ID NO: 46383 - DNA, 201 bp, Homo sapiens
atccatctaaaagctcaaatggaatctaaccatgtttaactttgctctgtaaatcaaacagaaagtatttcccttatgtgtatgtttatggcttcctctcyttccttagctcttcccagcttccacgtaagaattgtggaggaccagaggcccagggaaagccagggagaagccaaccactccagatatgtggagccaacc

SEQ ID NO: 46384 - DNA, 201 bp, Homo sapiens
gggcaaccttaggtgatatcattggtcacaaatgcattacagaaaatgttttctcttagttaaattgatatatctagctcctaagttgattgattcaatayaattgaagactgaactataatggattttgagtattctatattttatttagtatttatatatataaatatgtaactatattttattgagtatttatagtta

SEQ ID NO: 46385 - DNA, 201 bp, Homo sapiens
cagtttggtgctagttcattgagtcatgctaaggtgttagcagttttacccactattgcttcttctcagtgtaaatgtcagtagttttggtatgagaattygtgtttgtatgacattgaacagagctttgactttgcaatgataaaagcagatcccagaaaaggggctaagtaccctgagatcaatgtgtcaggagatgct

SEQ ID NO: 46386 - DNA, 201 bp, Homo sapiens
agttccttatttcttttaatttgcttttatcaaacttttttccaaactgtaaaagcaatttgtatttttttgcaacaaaacaaacaatatgcgggtatacaaagaaaaagtcaacattctatttccactccctctcaaagtgaccagtgtttacattgggtacgtatatgaggtcttcccacacttttattcacaatcata

SEQ ID NO: 46387 - DNA, 201 bp, Homo sapiens
tgcagtgagccaagtttgcacccactgctctccagcctggacgacagagtgagactgtctccaaaaaaaaaaaagaaagaaagaaaaagaaaaagagtggktaggactagaatctaagtttttctctctccagtttccccatttctaccaaggataaattatagtaccttgctatttcaggaataatgaaaaataaaaaat

SEQ ID NO: 46388 - DNA, 201 bp, Homo sapiens
tataaatacatgaaagccttttttttcaattgagatgaaactaaaattagccattttaaagtgaacaattcagtgacacttagcacatacacagtgttgtrcagccaccacctctctctagttagagtgagaacctgttgcaaaacaaacaagcaaaaagccattttcatcattcccaaatgtgttcccattaagtggtca

SEQ ID NO: 46389 - DNA, 201 bp, Homo sapiens
gttgtacagccaccacctctctctagttagagtgagaacctgttgcaaaacaaacaagcaaaaagccattttcatcattcccaaatgtgttcccattaagyggtcactcctagtcctcctccccacagccctgacaaccaccagtctgcattctggctcaatcaattgacctattctagatatttcatatacatggaatca

SEQ ID NO: 46390 - DNA, 201 bp, Homo sapiens
gcggacaggcctatgcagacctaccccccaaagtctgaggaagctgagaggccaaagaaagagactgacaactctagttgtcagaaaggaacattaataaraacttaagaacagaagccctgtctgtgtctctggcagcagtgagacaagatggtagatctgtgcaccattacccccagacccagggcttatataccatac

SEQ ID NO: 46391 - DNA, 201 bp, Homo sapiens
ctgtcaacaggctgatgttcaggggttcatagctgaatcccagggattttgaagcttttaaacaggcaatgaatggcagctggccaacagcagtatctaarccagaaggcccattatataaagaaataaattggaagcatttcttcttttgacagtattttccactatttacagaattttaaaattgtaacctgggaaaat

SEQ ID NO: 46392 - DNA, 201 bp, Homo sapiens
cttaaccatagattagagtttgagtgtatactgtcacggttggcttctctcactcataatgtttttgaggttcatcttcactgtatcattttttttccttkttattactgaatattcctttgcatcagtctatcgcagtgtggagaatctacttctgctgatggactccagggctgtttccagcttttggctgctttgaac

SEQ ID NO: 46393 - DNA, 201 bp, Homo sapiens
ttctattcatgaagcacatttgctttgcacctccctgttttgcagtgtgcagctggatttgatttcagaaatgaggagaaggggctccctgcccactagcygcccctccacctgtaatctaacaaacgacttctagaatagggaacagagtctttcattctccagttatcaattggtggttagaaaacctgtatccttggg

SEQ ID NO: 46394 - DNA, 201 bp, Homo sapiens
tagttacctaagtaggtcttacacttggtagattgacagctgttatacacaattccctagttatggtttgaagcagtgtattatcttatgcccaggctcayagtagggtgtcccagggactgtgacatgacattaacctcactcctctgtttcaggctgttctgatttcgtcttgtttattttcataggttttgaaactac

SEQ ID NO: 46395 - DNA, 201 bp, Homo sapiens
cttgtaacttcagcatgcacattattaactagagtttaatatttgttttcatctattctaaggtagaagttacatacagcaaaatacgtacatcttaggcmtagccttccgtgaggtttttaacttttttttaattatacttcaagttctggggtacatgtgcagaatgtgcagatttgttacataagtatacatgtgcca

SEQ ID NO: 46396 - DNA, 201 bp, Homo sapiens
agaaaagataggttacgattcatttttttcaccaaagccttttgaaagccttagagaacaaagaagtattactctgtgatcttaaacataacaacaggtawctacatgtgttgtattctcatattgtcccaagcacttcgagaaatgcctcacataaactatctgttttgatctttacaaaaacctgtgaaatacgtatta

SEQ ID NO: 46397 - DNA, 201 bp, Homo sapiens
taagtatacatgtgccatggtggtttcctgcacccatcaacccttcacattaggtatttctcctaatgctgtccctcccctaacccccaccccaccctcckacaggccccagtgtgtgatgtgtgatgttcccctcactgtgtccatgtgttctcattgttcaactcccacttatgagtgagaacatgtggtgtttggttg

SEQ ID NO: 46398 - DNA, 201 bp, Homo sapiens
gctcactggtggcatatgctttttgttagtttttacattaacatgaccgtgcgttttcagtgttaaattcaagtctgcaaagatttaggccaaaattcttyaaatgtttgcctgcccccaccaccctggaaaatagggacaagggtgaaggtttagttattgaaatgttgggggaatctaaaactgttttcttcctttcct

SEQ ID NO: 46399 - DNA, 201 bp, Homo sapiens
ttttggaagggacacaggagataatgtaacccaacaccctggccatgattgacagaggaaaacactgagaaccatcacagctactcagcatgttggtggcmgtggtggagtagaatccaggcatcctgctttttcagtctggtgcactttccactcagcatagcactatattatttatagactttatacctggacccctgt

SEQ ID NO: 46400 - DNA, 201 bp, Homo sapiens
atggcttcaactcttcaaaatgtaagtcaaaaacacaattaacacagtccctctgagggtgagggggatcccgtcaagatctgaagcaaggtcactcctgygatttcacctgtgtagcttgaaaatgccaggagaggaagatggcctcagaacagagccaacccacagctcactgtgagtcctgacacagtcacatccact

SEQ ID NO: 46401 - DNA, 201 bp, Homo sapiens
ggctctgcgtgatagccattgtgtttcaggggtggaaactgagctgtgaaggcttaaaataaccagtccctattgctttattgcccagtaatgagtgccamcaagtaacaaggtcacgatcctctcacctcttccactccctgctcccaactcatcccagactcctgctggtatgtggacttgtgttcagaatcttttccc

SEQ ID NO: 46402 - DNA, 201 bp, Homo sapiens
tgaccagaaaagcttggcccaaagaatatggaaggagacgcagacgaacagagactggcataaatggtggtattttagagaatccaaagcctttacttctstgttcactgagctcttggaaaacctcaaagttggaaggtgttttaaaaaacaaagaatgttcctgattcacattaaaagcataccagtacctgaagacta

SEQ ID NO: 46403 - DNA, 201 bp, Homo sapiens
aacagaaaatcttccagggaccaaaaccccctgcttgtttatagaaatgcttgcactctggggaggaaacacaggcctgttcataaataaatgctcagtcrtaagagttagctctggatgaactgattcatttagcagaagtggaatgctttgaagctagatggaagaggtcactaattaaatgctagaccaagacagagt

SEQ ID NO: 46404 - DNA, 201 bp, Homo sapiens
agtatttatagtaaacagtattactttgataagtagtcaaaaacctccagaacatattctgcccattgatagtctaataaataggtccagtcttaaacccyccaaatgtcatgcagccttttggcttggcagagctctggagacctaattgtttttacacaatcaatttgatggtgtctttaaaagtggagaataacaatc

SEQ ID NO: 46405 - DNA, 201 bp, Homo sapiens
cctgcgacagagctggttatagatgcaatattgctcggactccagagtcagcccttgaatgctttcttgataagcatcatgaaattattgtaattgatcayagacaaactcagaacttcgatgcagaagcagtgtgcaggtaccttctctaatttaatatgcttagtaaatgttcactttacatcttaaaacgaatttcat

SEQ ID NO: 46406 - DNA, 201 bp, Homo sapiens
tggctcacagaggcagccacgaggcactacaccaagtattatataaaagccattaaatttgaatgcccttggacaagcttttcttaaaaaaaaaaaaaaagtttatatacatgtttaaaatttttattaaaatccaaattttctgggtgtaagcccatgcagtatgttgtgccatgcaccatctatacgtaatattttggg

SEQ ID NO: 46407 - DNA, 201 bp, Homo sapiens
cgggcaagagcctccactgtggtttccatgggaaggcttgggtgaggcagggtgagcagggttaggctaggctagtcggattaatttcagaaaggtctggkacatattggtggttctagttgtctggtacctggccctagggtgattagggttggggaattgtggcctggagtgtaagagccaaaggtggtggtggttggg

SEQ ID NO: 46408 - DNA, 201 bp, Homo sapiens
ggatctgtggtcttgttttcacacatgtggccacatcagcattgcactgggtacaacaatacagcaggcattgggaaatgtaacgagagcatgtgggaatrttccttctcagccttctgagaccctctgcaggagcagctgtcatccttgactgaaggattttaagagctctctttgtccatgtaggagtggcagggggtt

SEQ ID NO: 46409 - DNA, 201 bp, Homo sapiens
ggaacttgtgtccaaggatacaaggcccaaccacctgtaggactgacttcactctaataatggcagcaactatgtcctccttgcagcccttccaggttccygtgcccccttaagagaaacatgtatgaagagggagtttgtacccttttaaataatttctaaatccttatctgcatataagccatcctgttaggcctaaat

SEQ ID NO: 46410 - DNA, 201 bp, Homo sapiens
gaaaaaccaagcaaggaaatgtgctatttgatttatgagcaaatggaaaaagaaaatagtgttttatagttgcttggaaaaagaaatgcaaatctaggaarggaaaaaaaaaaaggaagagattagcttgggaaaatttgatgaaaacaaatttaggaacagagagagagagaaaaataaacaccagccacaactatttgt

SEQ ID NO: 46411 - DNA, 201 bp, Homo sapiens
caggctttcagatgatatgtgtatcagatagtttatattatataaactattataactgcctcttacacagagttgtttacttaaatgtcatgtgctgaggrgggccgtattaggaaaatgcaacactctctaataatttccgtgactagtaagagaaggaagccagttataaaacactgctggaccagaatgaccctataa

SEQ ID NO: 46412 - DNA, 201 bp, Homo sapiens
gtaaatgctgctgcgtgctgaaggcgctccttcagactgacaaggggccagtacagagtgtggaatgcaggataagcttccaatagtgacaaatgaccacagtctcttagagaaaaacaaaattggatccatggaggtgaggtcaagaccgtcaaccaaattagtctagagaatagtcacttttagaaatctcagtaaagt

SEQ ID NO: 46413 - DNA, 201 bp, Homo sapiens
ttgactgttttcctcaagaacatcgatctgaaggattcataaggagcttatctgaacagatttatctaagaaaaaaaaaaaaagacataaaataagcgaarcaactaggaccaaattacagataaactagttagcttcacagcctctatggctacatggttcttctggccgatggtatgacacctaagttagaacacagcc

SEQ ID NO: 46414 - DNA, 201 bp, Homo sapiens
tagcttgactgttttcctcaagaacatcgatctgaaggattcataaggagcttatctgaacagatttatctaagaaaaaaaaaaaaagacataaaataagygaaacaactaggaccaaattacagataaactagttagcttcacagcctctatggctacatggttcttctggccgatggtatgacacctaagttagaacac

SEQ ID NO: 46415 - DNA, 201 bp, Homo sapiens
actctcaagataacagcattaatccattcctgagggcagagccccatgacctaatcacgtcttaaagatcccacctcttaatatagtcaaaatggcgactraatttcaacatgaattttggaggggaaattcaaatcatagcacccctcaccactgctcctagtgtagacactcatcatcttttgtcaacaccagtagttc

SEQ ID NO: 46416 - DNA, 201 bp, Homo sapiens
tccatggcgaggatccactccatgaccatcgaggctcccatcacaaaggtgagtggcggctgctgcctgcactctgcagtcaggggccctcacacagggcygtgctctgaaaatacatcacactgacatcatggagctcggtctagtggaagaagcaaataacaggcaaataaacacatagcaaataaacacctcatccta

SEQ ID NO: 46417 - DNA, 201 bp, Homo sapiens
agttctcaacaacaaagaattatctgggctgggcgcggtggcttactcctgtaatcccagcactttgggaggccgaggcgggcgaatcacttgaggtcagkaattcaagaccagtctcgccaacgtggtgaaaacctgtctctactaaaaatacaaaaattagttgggcgtgtggtgcgaaaaaaaaaaattctctagccc

SEQ ID NO: 46418 - DNA, 201 bp, Homo sapiens
cagtgccttacatgtagcagataattcatagatggtggctgagtgaatgaatgactctccagactactaagcatccacattgaatgccgtcctaatccccyaacctcatttctgttgtctctactagtttttccactttcatctctaattttgtcttttgcctttgctgttttttttcactccatggatgagtgttactgt

SEQ ID NO: 46419 - DNA, 201 bp, Homo sapiens
gaggtgtttatagtattatctgatggtagtttgtatttctgtgggatcagtggtgctgtcccctttatcatcttttattgtgtctatttgattcttctctsttttcgtctttataagtctagctagtggtctattttaattttttcaaaaaaccagcttctggattcattgatttttttggagagtttttcttgtctctgt

SEQ ID NO: 46420 - DNA, 201 bp, Homo sapiens
ttcttatttgggaagccctctgaagcctcattggtgacactgagtcttaagtctcaagttcccagggctgctgagaaaagcccagcagtattcggcccatyacaccggtcatgcttagttattttgttttagcagtgaagcactggcaccactgagccagcatggttacttaaatgaagatgataggatgatacaagatag

SEQ ID NO: 46421 - DNA, 201 bp, Homo sapiens
tctcagagacttgtcacttctcagatgttagtgatgctaatctttgagcatccacagcacctggtccagtggtgtatttttaaaacactcagtacattgayggtaagcctgtttataaacaagtctctctcccactctagactgagcatttgtgactgggccttattcacatttggtacgtagagttcctggaacataaat

SEQ ID NO: 46422 - DNA, 201 bp, Homo sapiens
gtgttttaatcagtatgttagcttggttaaacagtttattgcttgttattccaaaattccagtctcaagatcacttcataatattccaactaaagtagaayttcccataagttcaatgtgtatcagaaagagttctcttttctattgactgaaaaaccttcttttgacaaccacagtttgaatatgagtagctgtcaggat

SEQ ID NO: 46423 - DNA, 201 bp, Homo sapiens
ttgtggggtcattaactttgaataaatgcctaaggatgacctctttttacaattgtccttaccaaaaagatcatacatgtgcaagcttactgataaagttycattttctcacaattctgtgtacatacgattttggtttcaacagaaaaaaaataatcaaatcagttttgactttttgataccaaggatcttaaaaaataa

SEQ ID NO: 46424 - DNA, 201 bp, Homo sapiens
tctaagaatgaaatttggggacttgaatgattcaaggtcaaatattaaacattagctccttcaccaatacctgtcattgtcattagaaaggaaggcctctygtttacgctactgtgattcacagtgtcctttgtcggtcaagaggccccctctgtggcttggctttagctgtcagatggaagcctcaaacttttgcacttt

SEQ ID NO: 46425 - DNA, 201 bp, Homo sapiens
tacctgacatcatgtgacaggttgcagtcaaaattttgtttaacgcacaaaattaccaaaaatattgtataaaactaccttcaggctatatgtataaggtgtatatgaaaaataaatgaattttgtgtttagacttgggttcagtccccaagatagctcattaggtatatgcacatattccaaaatccaaaaaaaatcaga

SEQ ID NO: 46426 - DNA, 201 bp, Homo sapiens
ctatgattgacagactagaagacacagcagatcttcagagagactttccataagtagaaaggtcaatataggggatttttctttttcagttctgaagatarcaggtagccatattcaattcagatcggggttgtgtaaaatatatttttatcctgaatcaggaggagaagactccactcaagaacaaccttttccaatgct

SEQ ID NO: 46427 - DNA, 201 bp, Homo sapiens
tgctcacatagcatctgttaattataaggggccagttatatgtcattcatagctggctctctttaacaccacttctttctctcatactgaaaaaaaaaaaagcctgaatttgagtgaaagcaatattatggggacaactttaaattgattctgagtcattaaaaattatttacaaacttgtggatgacattaacagtaaat

SEQ ID NO: 46428 - DNA, 201 bp, Homo sapiens
ttcttagagttcatgattctaagaagcatatttttttctattttgacatctctaaaatttggacacatcatataattgtgtgtttcaattgtaattggcartatgttttccttaatggtaaataaaataagagtgtcttacaattgatgtcttagatttgatgaaatacggtacatttctaaacaatcataaagttttaag

SEQ ID NO: 46429 - DNA, 201 bp, Homo sapiens
agatattagagataaatcaaccaagtgtactatagaagccttatttggatccttctaactgtttaaaaaattacgatcagctaaatttgatcattgactgrgtatttgatgacattaaggaagtaaatgttaacttaggtgtgatgtaaaagagtccttagagatgcattctgaaatactgacaaaatgaaatacagtgac

SEQ ID NO: 46430 - DNA, 201 bp, Homo sapiens
aggagagacaactagggtacatgtgcacaacatgcaggtttgttacatatgtatacatgtgccgtgttggtgtgctgcaccgattaactcatcatttacaktaggtatgtctcctaatgctatccctcccccctacccccaccccacgacaggccctggtgtgtgatgttccccttcctgtgtccaagtgttctcattctt

SEQ ID NO: 46431 - DNA, 201 bp, Homo sapiens
attcttttctttaagaatgttgaatattggcccccattatcttctggcttgtagagtttctgccaagagatctgctgttagtctgatgggcttcccttcgwgggtaacccgacctttctctctggctgcccttaacattttttccttcatttcaactttggtgaatctgacaattatgtgtcttggagttgctcttctcga

SEQ ID NO: 46432 - DNA, 201 bp, Homo sapiens
aaggcagaatctctggtagccatctcatggcactgtgctgttcaaaatatcaacttagtcaagtttcaggggaagaaagtgccatgtactatatatacttytatctaacttaacagtggattttttaagaaggcattaaaaagtattgatttgattaaaatctctatactttatgtgacctgaaatgatgtgccttttaca

SEQ ID NO: 46433 - DNA, 201 bp, Homo sapiens
aaattcttttctttaagaatgttgaatattggcccccattatcttctggcttgtagagtttctgccaagagatctgctgttagtctgatgggcttcccttygtgggtaacccgacctttctctctggctgcccttaacattttttccttcatttcaactttggtgaatctgacaattatgtgtcttggagttgctcttctc

SEQ ID NO: 46434 - DNA, 201 bp, Homo sapiens
tctccgtgcatgagatgggtttcctgaatacagcacactgatgggtcttgactctttatccaatttgccagtctgtgtcttttaattggagcatttagccyatttacatttaaggttaatattgttatgtgtgaatttgatcctgtcattatgatgttagctggttattttgcttgttagttgatgcagtttcttcctagc

SEQ ID NO: 46435 - DNA, 201 bp, Homo sapiens
gatatcccctttatcattttttattgcgtctatttgattcttctctcttttcttctttattagtcttactagcgttctatcaattttgttgatcttttcamaaaaccggttccgggattcattaattttttgaagggttttttgtgtctctatttccttcagttctgctctgatcttagttatttcttgccttctgctggc

SEQ ID NO: 46436 - DNA, 201 bp, Homo sapiens
agaattcggctgtgaatccatctggtcctggatttttttttggttggtaagctattaattattgcgtcaatttcagatcctgttattggtctattcagagrttcagcttcttcctggtttagtcttgggagggtgtatgtgtcaaggaacttatccatttcttctagattttctagtttatttgcatagaggtgtttttag

SEQ ID NO: 46437 - DNA, 201 bp, Homo sapiens
cttgtacctctggtagaattcggctgtgaatccatctggtcctggatttttttttggttggtaagctattaattattgcgtcaatttcagatcctgttatyggtctattcagagattcagcttcttcctggtttagtcttgggagggtgtatgtgtcaaggaacttatccatttcttctagattttctagtttatttgcat

SEQ ID NO: 46438 - DNA, 201 bp, Homo sapiens
cctgacatcatgtgacaggttgcagtcaaaattttgtttaacgcacaaaattaccaaaaatattgtataaaactaccttcaggctatatgtataaggtgtatatgaaaaataaatgaattttgtgtttagacttgggttcagtccccaagatagctcattaggtatatgcacatattccaaaatccaaaaaaaatcagaaa

SEQ ID NO: 46439 - DNA, 201 bp, Homo sapiens
ttaagaaggcattaaaaagtattgatttgattaaaatctctatactttatgtgacctgaaatgatgtgccttttacattcctttaaaaatattcttgctayctgaaaaactaaggtcgttaagtttccaatgaaaatatgtggcttgaaggaacaaagagaaaaaaatttaatgtatttgggggaaattccttttggtaaa

SEQ ID NO: 46440 - DNA, 201 bp, Homo sapiens
actatagcacacagtaaatgttggccggatttattcggctgtacacatgagccactggatttgtctggatgcagaagtctactgcggtacaccttcttcakcaagctcttgggaaagcaggggagatttcctggtaccctaggaagtggaggatactaaagccatgtcacagggaggggcattattcttcgtgcgcgcttg

SEQ ID NO: 46441 - DNA, 201 bp, Homo sapiens; identical to SEQ ID NO: 10397

SEQ ID NO: 46442 - DNA, 201 bp, Homo sapiens
ggcagagtagatttaacataattcttaagggccttaagatttttggactggtaaataaactctgacttcaacttaaaggcaccaactacactcgctggcaytgaacttcttctccccagctatgaagtcctagatgacatctcttctaatagaagaccatttcatcttcacaaactcagttgtttagtgtagtcgccttca

SEQ ID NO: 46443 - DNA, 201 bp, Homo sapiens
tgttgtcccttgcactctgacgttaatggggatagtttcatgaaccaacctctgcttgcttccagcttttcttctgtagcatcctcacctctcagtcttcraagaaagaattgaagaattaattaggctttggcttaagggaatgttgtggcttgtttaatctatatagaccactcagactttctccatctcagcagtaag

SEQ ID NO: 46444 - DNA, 201 bp, Homo sapiens
cttttacttgcacatttacaggctactgtaggttattaattggcttaatttcgatattgttgtgtctcagggaatagggaggtctaagaagagggagagaytggaaaccgctagttggtggaacagttagaatatacacaagatttatcaattaagttcactgtcttatacgggcatggtttgcagtaccctaaaacaatt

SEQ ID NO: 46445 - DNA, 201 bp, Homo sapiens
atacattttgcattctttctagagttttcctccaacgacagaaaaacactgcagtaagctttggcagcgtgtcctttgaagaggcagagactcgtttatcyagctatcaaaaatccatcaagtcttctgcacacaagcttctgtgccagctgctggggatgcaaagaatgcaccccaccccacttggccacaaaaagctga

SEQ ID NO: 46446 - DNA, 201 bp, Homo sapiens
agagaaagtgccactgttttttagtaatgtaagcaagttttggaaaagatagtagtagcagtagatgttccctcatttactttaaggataactgatctccrtattggagctcttttcttttttttcttaatgtaaaaagaattgctgtgtgccaataggtagaatagttgatcttttcccaaaaaggcagaatctctggta

SEQ ID NO: 46447 - DNA, 201 bp, Homo sapiens
tttaaacttgctgtcttctaaatgcaattttaagtttaaagaatcaatagaaattgatgttttataccaaagaacacttaagaccttgagtcctgccctcyccaccatcactatacaaataaaaagaaatcaataggcccagaaacataagctgctaaagatttatttccagcaactatttttgatattcaaggtactatt

SEQ ID NO: 46448 - DNA, 201 bp, Homo sapiens
ccttcacatgagtaagaactattaaatgagcatttagctattggacataagaattattgtgaaaacaatttattttttacaaatctttattaagctttgcygtagttttcagcccactgttggaaggaacgagagaatactttctcagagatgttcaaagagaagatgtttagagggaattatttttatacattaagatgg

SEQ ID NO: 46449 - DNA, 201 bp, Homo sapiens
ttgtctcatatatattactggcctgtcatcactgttttcctgttgtgatgcaagtcaaccaaatcatggcatgttaaacaatcatctgcagcctttttttkggcaatgttacttgttgctatgtcctgagagacactccatttattaaagtggtcatttttgtggggaactaattatttctggaaaggtaagattttggac

SEQ ID NO: 46450 - DNA, 201 bp, Homo sapiens
taccatgcttcttaacttttgcttgaaaagatttgtctcatatatattactggcctgtcatcactgttttcctgttgtgatgcaagtcaaccaaatcatgscatgttaaacaatcatctgcagccttttttttggcaatgttacttgttgctatgtcctgagagacactccatttattaaagtggtcatttttgtggggaa

SEQ ID NO: 46451 - DNA, 201 bp, Homo sapiens
ctttatttccttcttctgcctaattgccctggccagaacttccaacactatgttgaataggagtggtgagagagggcatccctgtcttgtgccagttttcraagggaatgcttccagtttttgcccattcagtatgatattggctgtgggtttgtcacagatagctcttattagtttgagatatgtcccatccatacctaa

SEQ ID NO: 46452 - DNA, 201 bp, Homo sapiens
ctgtgggtttcttataaatagctcttattattttgagatatgttctatcaatacctagtttattgagaatttttaatatgaaaggatgttaaattttatcraaggccttttctgcatctattaagataatcatgtggtttttgtcattggttctgtttgtgtgatggattacgtttattgatttgcatatgttgaatcagc

SEQ ID NO: 46453 - DNA, 201 bp, Homo sapiens
tctgtaaagagtaaaaagccatatgtgggtatgttagttaccgattgctctgtcagctgtcacaccaaacttagtggcttaacacaaccccatctatttakctcattattctgcaggatggcaattggggctaggctcagctgggtgagtctgtctttgcaccaggagcaactgatcttggctagattcacttatgcctct

SEQ ID NO: 46454 - DNA, 201 bp, Homo sapiens
cttcctcttttcctaattgaataccctttatttccttcttctgcctaattgccctggccagaacttccaacactatgttgaataggagtggtgagagaggkcatccctgtcttgtgccagttttcaaagggaatgcttccagtttttgcccattcagtatgatattggctgtgggtttgtcacagatagctcttattagtt

SEQ ID NO: 46455 - DNA, 201 bp, Homo sapiens
tatgtacattatgcattgtcaaattagagaaatacctttccagttttaaaattttatatcattatcctttttttgtttcttagtttttgaagacattacaytctgggttttttttggtcagctgttataatccaggtttcacgcttcaagtctttagataataacatcttattgaaaattttgcagaaggattttcttgtt

SEQ ID NO: 46456 - DNA, 201 bp, Homo sapiens
gctgagacagtggggttttctagatatacaatcatgtcatctgcaaacagggacaatttgacttcctcttttcctaattgaataccctttatttccttctyctgcctaattgccctggccagaacttccaacactatgttgaataggagtggtgagagagggcatccctgtcttgtgccagttttcaaagggaatgcttcc

SEQ ID NO: 46457 - DNA, 201 bp, Homo sapiens
atcctttttttgtttcttagtttttgaagacattacattctgggttttttttggtcagctgttataatccaggtttcacgcttcaagtctttagataatawcatcttattgaaaattttgcagaaggattttcttgttttctcagtggctcagctaaaatcagtgagtggaaaattttctcggattggtttttgaagatac

SEQ ID NO: 46458 - DNA, 201 bp, Homo sapiens
attggtgtaaaagaatgcttgtgatttttgcacattgattttgtatcctgagactttgctgaagttgcctatcagcttaaggaggttttgggctgagacartggggttttctagatatacaatcatgtcatctgcaaacagggacaatttgacttcctcttttcctaattgaataccctttatttccttcttctgcctaat

SEQ ID NO: 46459 - DNA, 201 bp, Homo sapiens
aggaaaggctgctttttaagagttctctactggatgtaaataactagggctttgtactattgccttgcttagttatttgctgagggtccttcatgaagaayatgcacctggcttctactatctggcttaaatcccagtgactaggagccgattgagctagtataactttggcttgaaggcagaaatggatcctgaagtcaa

SEQ ID NO: 46460 - DNA, 201 bp, Homo sapiens
ctcttttatttcattgagcagtggtttgtagttctccttgaagaggtccttcccatcccttgtaagttggattcctaggtattttattctctttgaagcarttgtgaatgggagttcactcatgatttggctctctgtctgttattggtgtaaaagaatgcttgtgatttttgcacattgattttgtatcctgagactttg

SEQ ID NO: 46461 - DNA, 201 bp, Homo sapiens
tctctactggatgtaaataactagggctttgtactattgccttgcttagttatttgctgagggtccttcatgaagaacatgcacctggcttctactatctkgcttaaatcccagtgactaggagccgattgagctagtataactttggcttgaaggcagaaatggatcctgaagtcaacagctggaggcagtcagataact

SEQ ID NO: 46462 - DNA, 201 bp, Homo sapiens
ctttctgcatatgactagccagttttcccagcaccatttattaaatagggaatcctttccccatttcttgtttttgtcaggtttgtcaaagatcagatggktgtagatatgcggcgttatttctgagggctctgttctattccattggtctatatctctgtttttggtaccagtatcatgctgttttggtaccagtatcat

SEQ ID NO: 46463 - DNA, 201 bp, Homo sapiens
tttccatttctgatttggagatggttgaagtgtatgcttgactgactaggatttagtttaagataaactgataaagtatagctagttttttgttatccatsataataggatgggtaattgtaatttgtgaatgatatctcaaccctttattagtttttttatgacaggtactaatatgtgtcaaagttatactggtttgta

SEQ ID NO: 46464 - DNA, 201 bp, Homo sapiens
tgtcttgaaagggggtctggaaggcaggtattggcgtctgccacacttccatagttgtaagttggtctattttatttttaacttgcatgaacatactcatkggctatgtctttgggcagctttttaagaaactgtaagtatgccattggttaatagttatttgatggcttgaaaaagttaatatttttagagctattaacg

SEQ ID NO: 46465 - DNA, 201 bp, Homo sapiens
tgttgtttcctgactttttaatgatcgccattctaactggtgtgagatggtatatcattgtggttttgatttgcatttctctgatggccagtgatgatgcrcattttctcatgtgtcttttggctgcataaatatcttcttttgagaagtgtctgttcatatcctttacccacttgttgatagggttgtttatttttttct

SEQ ID NO: 46466 - DNA, 201 bp, Homo sapiens
ctggcatttttttaaagcacttatatccagtgtgacgttgactttagacaactttattatagtaaattttactaaaatctgttaaccaaatagcttttctwtttctaaaggcccctaatccaccatgtgtggtgaatgtgttgattgaatttctgttgttttgcatcgtgccctgaatcaagcggggaatttcggcagtgt

SEQ ID NO: 46467 - DNA, 201 bp, Homo sapiens
atagtattccatggtgtatatgtgccacattttcttaatccagtctatcattgttggacatttgggttggttccaagtctttgctattgtgaacagtgccrcaataaacacacgtgtgcatgtgtctttatagcagcatgatttataatcctttgggtatatacccagtaatgggattgctgggtcaaatggtatttctag

SEQ ID NO: 46468 - DNA, 201 bp, Homo sapiens
agtgtcatcacacagatgcgtgtgccacccttgctgcttttctccttatttctaataattttgtcctttcagcttgtgttttggagctgtagctgagtttygtttagttggataagatgttgcagggtttgggaggatgacaggagtgagtgaaaaggtaattgctgcttcatgcattagcatagaatcaaattttaggat

SEQ ID NO: 46469 - DNA, 201 bp, Homo sapiens
acaaaggacatgaactcatcatgttttatggctgcatagtattccatggtgtatatgtgccacattttcttaatccagtctatcattgttggacatttggkttggttccaagtctttgctattgtgaacagtgccgcaataaacacacgtgtgcatgtgtctttatagcagcatgatttataatcctttgggtatataccc

SEQ ID NO: 46470 - DNA, 201 bp, Homo sapiens
taattttgtcctttcagcttgtgttttggagctgtagctgagttttgtttagttggataagatgttgcagggtttgggaggatgacaggagtgagtgaaamggtaattgctgcttcatgcattagcatagaatcaaattttaggataaggacagcaagtgtctaacagtatttcagtttcaaatttgtcatcttagcagta

SEQ ID NO: 46471 - DNA, 201 bp, Homo sapiens
tgatcctgtcattatgatgttagctggttattttgcttgttagttgatgcagtttcttcctagtctcgatggtctttacattttggcatgattttgcagcrgctggtactggttgttcctttccatgtttagcacttccttcaggagctcttttagagcaggcctggtggtgacagaatctctcagcatttgcttgtctgt

SEQ ID NO: 46472 - DNA, 201 bp, Homo sapiens
aagataatttgagtctatttctggccttcttattctgttacattaatctttctgttggcttgcctaggtacctcactgttctaattactgtggttttatasggcattactactagacattccattcagttatatctttacatagataaaatgatcgataatgaggcatatgtgaactttgcctagatttgagttttgtcac

SEQ ID NO: 46473 - DNA, 201 bp, Homo sapiens
gccttcttattctgttacattaatctttctgttggcttgcctaggtacctcactgttctaattactgtggttttatagggcattactactagacattccawtcagttatatctttacatagataaaatgatcgataatgaggcatatgtgaactttgcctagatttgagttttgtcaccggctcccacgtcggagagctga

SEQ ID NO: 46474 - DNA, 201 bp, Homo sapiens
tgcaaatttagcattggccctcagtggtgcgctctttttgtattactgattttctgttctgacaggcagttaatctcatgctcagaagatggcagtgtacrcatttgggagttaagagaaaaacagcagcttgcagctgagcctgtaccaacaggtgtgtgtcttctctcaaaaaggtagtctttttctctccttttttct

SEQ ID NO: 46475 - DNA, 201 bp, Homo sapiens
tctgtaatttggtcctagttgtttcgcttattttatgtctttttttttttttcttagataaatctgttcagataagctccttatgaatccttcagatcgaygttcttgaggaaaacagtcaagctaaacagcaatgatgacttttatggtaaaggatgagctgatcactagctaagctacttagtcaccatcctgggagat

SEQ ID NO: 46476 - DNA, 201 bp, Homo sapiens
tggggttatgtgctctgaaccccttcaaatgaaataatgaatttagatggcctaaatcataacatatacacatacacacacaagatagccagaaattatayttccggatggagtatacaatctgcctttggggtggtcttaccaaaaagtcagatatggatcttatttagtctctagatttaactatcaattaacaaaaaa

SEQ ID NO: 46477 - DNA, 201 bp, Homo sapiens
acagaggacagaggtgcatgttggataacagcacaggaaaaaaaacccagactgtgagaactcgacaagacaggtgaatttttttttcaacaaataaattrcaaggaaaaacagatggagaaaaaaatcattagaataaaagagatattagagataaatcaaccaagtgtactatagaagccttatttggatccttctaac

SEQ ID NO: 46478 - DNA, 201 bp, Homo sapiens
aagtcagatatggatcttatttagtctctagatttaactatcaattaacaaaaaatacagaggacagaggtgcatgttggataacagcacaggaaaaaaawcccagactgtgagaactcgacaagacaggtgaatttttttttcaacaaataaattgcaaggaaaaacagatggagaaaaaaatcattagaataaaagaga

SEQ ID NO: 46479 - DNA, 201 bp, Homo sapiens
tactgaaggttggggtggctgtggcagttccttaaaataagatagcgatgaagttttccaaatcaattgacttcctttcacaaatgagatctctgtaacaygtaatactatttaatagcattttacccacagtagaacttctttcaaaatttagagtctgtcatctcaaatcctgatgctcctttatgaactaagtttata

SEQ ID NO: 46480 - DNA, 201 bp, Homo sapiens
gaaggaacattgttgtgcatgttgttgatatttcagtggtagcaggagccctgtgaattgaatttagttactaataggagctagcttagctccacgtagayattttaaagtatcagaaacataatgacttaggaaaactaaatccatacattgctagggtttacaatttaaccactcagttcaacatttgattactaatag

SEQ ID NO: 46481 - DNA, 201 bp, Homo sapiens
gttatgtctctgcccggctttggtatcaggatgatgctggcctcatgagttaaggaggattccctctttttctgttgattggagtagtttcagaaggaatkgtaccagcttctccttgtacctctggtagaattcggctgtgaatccatctggtcctggatttttttttggttggtaagctattaattattgcgtcaattt

SEQ ID NO: 46482 - DNA, 201 bp, Homo sapiens
tcataatgatacttaaaaaagagaactcacctttggagaatgctggggaactaactcattctgttgaaaatcggtaaataaaagggcagagtcaaaatctrtactgcctttcttatataaactgtgtcttgggatcagtaataattgacgagaagaaatttctctgaagaattcaagctaggaagaatgatagaattagaa

SEQ ID NO: 46483 - DNA, 201 bp, Homo sapiens
ttatgtgctctgaaccccttcaaatgaaataatgaatttagatggcctaaatcataacatatacacatacacacacaagatagccagaaattatatttcckgatggagtatacaatctgcctttggggtggtcttaccaaaaagtcagatatggatcttatttagtctctagatttaactatcaattaacaaaaaatacag

SEQ ID NO: 46484 - DNA, 201 bp, Homo sapiens
gcgattcttctgcctcagcctcccgagtagctgggactacaggcatgtgccaccacaccgagctaatttttgtatttttaatagagacagggtttcaccayattggccaggctggtctcgaactcctgatctcgtgttccgcctgcctcggcctcccaaagtgctgggattacaggtgtgagctaccaaacccagccagga

SEQ ID NO: 46485 - DNA, 201 bp, Homo sapiens
ccagcctcccattcagatacaggcttacctcaaaaataagagcagaccagtatgttccctctctgtgaacagatgaatcttcagaaaacccacaaggggcygggtatgatggctcatgcctgtaatcccagaactttgggaggccaaggcgggtggatcacaaggtaaggagtttgagaccagcctgcccaacatggtgaa

SEQ ID NO: 46486 - DNA, 201 bp, Homo sapiens
tacctaagcaagtctgggcaatggcgggcgcccctcccccagcctggctgctgccttgcagtttgatctcagactgctgtgctagcaattagcgagactcygtgggcgtaggaccctccaagtgaggtgcaggatataatctcctggtgcgccgttttttaagcccgtcggaaaagcgcagtattagggtgggagtgaccc

SEQ ID NO: 46487 - DNA, 201 bp, Homo sapiens
tctgtcacccctttctttgactaggaaagggaactccctgaccccttgagcttcccgagtgaggcaatgcgtcgccctgcttcggctcgcgcacggtgcaygcacccactgacctgcgcccactgtctggcactccctagtgagacgaacccggtacctcagatggaaatgcagaaatcacccgtcttctgcgtcgctcac

SEQ ID NO: 46488 - DNA, 201 bp, Homo sapiens
cccactgtctggcactccctagtgagacgaacccggtacctcagatggaaatgcagaaatcacccgtcttctgcgtcgctcacgctgggagctgtagaccsgagctgttcctattgggccatcttggctcctcctcctactgtaatcttgatgtgtagtttagctttctatctgtgatttgggaagggaagaacttaccaa

SEQ ID NO: 46489 - DNA, 201 bp, Homo sapiens
tccctagtgagacgaacccggtacctcagatggaaatgcagaaatcacccgtcttctgcgtcgctcacgctgggagctgtagaccggagctgttcctattsggccatcttggctcctcctcctactgtaatcttgatgtgtagtttagctttctatctgtgatttgggaagggaagaacttaccaaatgttttacctttgc

SEQ ID NO: 46490 - DNA, 201 bp, Homo sapiens
ccgagaaccgcagggactggccgaggtaaaccccgggtgggtctgctctgcgtccgtcgagcttgctggaggggcggcttcgttccggttcggccttcctsggttccgaccgcggggacccgggcggaggcggggctggctgctgagctcgtgccacgcgctgttctcacgacggtgggggcggagggcgcgggagccgga

SEQ ID NO: 46491 - DNA, 201 bp, Homo sapiens
tagatttgctgctgagcttctagggacgaacatatggacagggactatcattattttctatgcaggatatttttatagtgaagcacccagagaagagaggkagcaagaggagggaagggggctgcttaggacattgtgaagtataattcacactgttttcccaagggcatttttttaaatggagagaatcaatttatagca

SEQ ID NO: 46492 - DNA, 201 bp, Homo sapiens
gcggggacccgggcggaggcggggctggctgctgagctcgtgccacgcgctgttctcacgacggtgggggcggagggcgcgggagccggagctcctcagasccggcgggaccccaggcgcaccctggagctgcagacccccggccccgtcccacggctagctgaatcgtgagatcctggctcagggacgctcagctggtca

SEQ ID NO: 46493 - DNA, 201 bp, Homo sapiens
caggtactgtccacttagcccttgactaaaataagtctggaacctcttcacatttaaattttgtttttctgatctcatgttattgtaagtacagagcacartaattttggaaatgattctttttctaggtttttttaacatgtggggatttggaagagtcagcaaacaagccagccaacctgttaaaaagcagcaagaaaa

SEQ ID NO: 46494 - DNA, 201 bp, Homo sapiens
cgaacgagttgtgaccgcagctttccacttttggtttatttgaattggtgtctcttcctggcgtctactgatacttggtcagggaatataaaattaatttwcttatccaacaaccgaaaaaggatataattatttttaaaaagtaatctgcttcaaggtcaagaacatgattttctaattaactgctgtttttggtttcat

SEQ ID NO: 46495 - DNA, 201 bp, Homo sapiens
gccgctgcccggatgttgcgatggctgatcgggggaggccgagaaccgcagggactggccgaggtaaaccccgggtgggtctgctctgcgtccgtcgagcytgctggaggggcggcttcgttccggttcggccttcctgggttccgaccgcggggacccgggcggaggcggggctggctgctgagctcgtgccacgcgctg

SEQ ID NO: 46496 - DNA, 201 bp, Homo sapiens
taggattgcaacccctgcctttttttgttttccatttgcttggtagatcttcctccatctttttattttgagcctatgtgtgtctctgcacgtgagatggrtttcctgaatacagcacactgatgggtcttgactctttatccaatttgccagtctgtgtcttttaattggagcatttagtccatttacatttaaagttaa

SEQ ID NO: 46497 - DNA, 201 bp, Homo sapiens
agaaggaattgtaccagttcctccttgtaccactggtagaattcggctgtgaatccatctggtcctggactctttttggttggtaaactattgattattgmcacaatttcagatcctgttattggtctattcagagattgaacttcttcctggtttagtcttgggagggtgtatgtgtcgaggaatttatccatttcttct

SEQ ID NO: 46498 - DNA, 201 bp, Homo sapiens
atgatggattacatttattgatttgcgtatattgaaccagccttgcatcccagtgatgaagcccacttgatcatggtggataagctttttgatgtgctgcyggattcggtttgccattattttattgaggatttttgcatcagtgttcatcaaggatattggtctaaaattctctttttcggttatgtctctgcccggctt

SEQ ID NO: 46499 - DNA, 201 bp, Homo sapiens
taaagtagttttttccaattctgtgaagaaagtcattggtagcttgatggggatggcactgaatctataaattaccttgggcagtatggccattttcacgrtactgattcttcctacccatgagcatggaatgttcttccatttgtttgtatcctcttttatttcattgagcagtggtttgtagttctccttgaagaggtc

SEQ ID NO: 46500 - DNA, 201 bp, Homo sapiens
gactggggctggaccgggcaagacgccgccgctgcccggatgttgcgatggctgatcgggggaggccgagaaccgcagggactggccgaggtaaaccccgrgtgggtctgctctgcgtccgtcgagcttgctggaggggcggcttcgttccggttcggccttcctgggttccgaccgcggggacccgggcggaggcggggc

SEQ ID NO: 46501 - DNA, 201 bp, Homo sapiens
gtttttgtcaggtttgtcaaagatcagatagttgtagatatgcggcgttatttctgagggctctgttcttttccattgatctatatctctgttttggtacsagtaccatgctgttttggttactgtagccttgtagtatagtttgaagtcaggtagtgtgatgcctccagctttgctcttttggcttaggattgacttggt

SEQ ID NO: 46502 - DNA, 201 bp, Homo sapiens
aaacaacccagaaaacccacaagggtctgaactgagcatgcctaattcattgtctcaagcaagtggggcagagagagaccaagaatgtttctctagtagtrggagtcctccatggaaacttgagtgcaggggaatggaggttcacctaatagaagtcacacagatttttttggtattctaatactgtaatctttttttttt

SEQ ID NO: 46503 - DNA, 201 bp, Homo sapiens
tgggcaacagggcgagactttgtctcaaaaaaaaaaacaacccagaaaacccacaagggtctgaactgagcatgcctaattcattgtctcaagcaagtggsgcagagagagaccaagaatgtttctctagtagtgggagtcctccatggaaacttgagtgcaggggaatggaggttcacctaatagaagtcacacagattt

SEQ ID NO: 46504 - DNA, 201 bp, Homo sapiens
tagccagttttcccagcaccatttattaaatagggaatcgtttccccatttcttgtttttgtcaggtttgtcaaagatcagatagttgtagatatgcggcrttatttctgagggctctgttcttttccattgatctatatctctgttttggtaccagtaccatgctgttttggttactgtagccttgtagtatagtttgaa

SEQ ID NO: 46505 - DNA, 201 bp, Homo sapiens
ttggtctattcagagattcagcttcttcctggtttagtcttgggagggtgtatgtgtcaaggaacttatccatttcttctagattttctagtttatttgcrtagaggtgtttttagtattctctgatggtagtttgtatttctgtgggattggtggtgatatcccctttatcattttttattgcgtctatttgattcttct

SEQ ID NO: 46506 - DNA, 201 bp, Homo sapiens
tttgtcaattttggcttttgtagccattgcttttggtgttttagacatgaagtccttgcccatgcctatgtcctgaatggtaatggttaggttttcttctrgggtttttatggttttaggtctaacgtttatgtctttaatccatcttgaattgatttttgtataaggtgtaaggaagggatccagtttcagctttctcca

SEQ ID NO: 46507 - DNA, 201 bp, Homo sapiens
gtttcttttgctgtgcagaagctctttagtttaattagatcccatttgtcaattttggcttttgtagccattgcttttggtgttttagacatgaagtcctygcccatgcctatgtcctgaatggtaatggttaggttttcttctagggtttttatggttttaggtctaacgtttatgtctttaatccatcttgaattgatt

SEQ ID NO: 46508 - DNA, 201 bp, Homo sapiens
ttgctattgtgaatagtgccgcaataaacatacgtatgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaagagtgtaaaagtg

SEQ ID NO: 46509 - DNA, 201 bp, Homo sapiens
agtattccatggtgtatatgtgccacattttcttaatccagtctatcattgttggacatttgggttggttccaagtccttgctattgtgaatagtgccgcrataaacatacgtatgcatgtgtctttatagcagcatgatttatagtcctttgggtatatacccagtaatgggatggctgggtcaaatggtatttctagtt

SEQ ID NO: 46510 - DNA, 201 bp, Homo sapiens
tgactttttaataattgccattctgactggtgtgagatggtatctcattgtgattctgatttgcatttctctaatgatcagtgatgttgagctttttttcrtatgttttttggccacataaatgtcttgagaagtgcctgttcatattttgcccactttttgatggggttgtttttttcttgtaaatttaagttccttgta

SEQ ID NO: 46511 - DNA, 201 bp, Homo sapiens
gagtatatctacttttatagagagctgaagccagtgtttatcttgggaaatttagaattcagacattttttccatagccattatacagtataagtaatggytaagtaaaaccaatacttgaaaaatcagattatgaaaaaatctggaagaactatgagaattcatgtactttacaaaaatagctattctgtagttgaacaa

SEQ ID NO: 46512 - DNA, 201 bp, Homo sapiens
aactctatgactataaaattatactacagataataaataagccaaaggcgtatttaggaatcaaacatgaccaagtagtctgttaaaatttgaaaatgatytgctgacagtctcatcttgcagtacataggcacgttagccatgatgtggatgtcagtgatcctgaaatgtttatgttgtacagttccctgcttcacttgc

SEQ ID NO: 46513 - DNA, 201 bp, Homo sapiens
tatgtaatcaggtactaaataatgcagtatagactatgacatgtcacagaaattcagaaaaagcttcaaagggagaaaatgccccaagtaaggggaagggrcttgcccagtgaaggaataggctggaagctaagaataggaaaacagagtgttgacaaaaggcagcatgaatactatggggtgaagagttgtatcagaaaa

SEQ ID NO: 46514 - DNA, 201 bp, Homo sapiens
gctcagtttttaactttgtgtttatggttgggaggtgagcatggactgtggtagacagaagggcaaagatagcatttacgtggtggcaaggagcaccttgsctaggccggagcgctgggttcctgtgaacagacactagtaggggataaagcctgggaacgtggtttggggtcagattatggatgtccttgaatgtaaggc

SEQ ID NO: 46515 - DNA, 201 bp, Homo sapiens
ctgcttcacttgcaggagctctgctcctttctcctcacccattaccaatgaaagatatggccagttgcttgggattgtacatcacagggcaaatctgtttkcagaggggtggccccagggcaaccttagaattgtatgagagaataccaacaagtgtggataatgaataccagatttgctaaaaagattggaatgcccagg

SEQ ID NO: 46516 - DNA, 201 bp, Homo sapiens
tgaaaaacattaaaaatataaaagttaatattaaaatctttccactatccagtattaaacaccagtccacatctttctaggtgattttctgggcctatgtrtgtgtgtacatgtgtattaatacggtttactgttttgtaacaatatgtcataaatatatttccatatctaagtttatattgttaagcatacttttataac

SEQ ID NO: 46517 - DNA, 201 bp, Homo sapiens
ccttatttggatccttctaactgtttaaaaaattacgatcagctaaatttgatcattgactgggtatttgatgacattaaggaagtaaatgttaacttagrtgtgatgtaaaagagtccttagagatgcattctgaaatactgacaaaatgaaatacagtgactaggatttgcttcaaaataatttacagaggggttggac

SEQ ID NO: 46518 - DNA, 201 bp, Homo sapiens
ttttgagctagccatcttgtaaatgggtgatggtgattatcttaagggatccctggtaaataagtgtgaattgctgaatctaccactttatcacaatagtraaaaaaagtacaaaaaaacccaaccccatattctgctcttaataaatcaataatgtcttccaaaagtctcagaaacctacatttaacaatcattttccat

SEQ ID NO: 46519 - DNA, 201 bp, Homo sapiens
tcttttttaaggaaaagaaattgttgaagtagatctaattaaggaattggttgcgtcagcatctatggctcctgaaaatgctttgacgtttccttcaactsctttacaagtccctatctggatgcttctctaattttcttcaagtagttctagcatacaaacatatactttaaatgaaaattgtgattttttttgttgtta

SEQ ID NO: 46520 - DNA, 201 bp, Homo sapiens
aattggtgtctcttcctggcgtctactgatacttggtcagggaatataaaattaatttacttatccaacaaccgaaaaaggatataattatttttaaaaagtaatctgcttcaaggtcaagaacatgattttctaattaactgctgtttttggtttcatagtcacactttcttcatgggcccgaataattgaatagaccgt

SEQ ID NO: 46521 - DNA, 201 bp, Homo sapiens
ttccacttttggtttatttgaattggtgtctcttcctggcgtctactgatacttggtcagggaatataaaattaatttacttatccaacaaccgaaaaagsatataattatttttaaaaagtaatctgcttcaaggtcaagaacatgattttctaattaactgctgtttttggtttcatagtcacactttcttcatgggcc

SEQ ID NO: 46522 - DNA, 201 bp, Homo sapiens
tggtgcgaaaaaaaaaaattctctagcccaaaatgtcagcatcaagtttgagaaatccagagttgatttcatgccttcatttattcatttagcaagcatgyattgagtgcttgtaatggatgaggcactgtttcactattttatgtctttgatttgcagttttgtttctgccacattttaactgagaaacatgcattctaa

SEQ ID NO: 46523 - DNA, 201 bp, Homo sapiens
gacattgaatacaggaagatttatggttcaggtttatggactatactttttatgtcctttaaggtaacatttgaatttttgggaccttcacttagttgaarggccttcacatgagtaagaactattaaatgagcatttagctattggacataagaattattgtgaaaacaatttattttttacaaatctttattaagcttt

SEQ ID NO: 46524 - DNA, 201 bp, Homo sapiens
atacaggaagatttatggttcaggtttatggactatactttttatgtcctttaaggtaacatttgaatttttgggaccttcacttagttgaaaggccttcwcatgagtaagaactattaaatgagcatttagctattggacataagaattattgtgaaaacaatttattttttacaaatctttattaagctttgctgtagt

SEQ ID NO: 46525 - DNA, 201 bp, Homo sapiens
acctttaaaattaatacatcttttctaaaaatttaaaaactgtgatcattagtaacatttagtagaaattgaaattggcctctgcatctcgatgaaatatrtatctagagtcttttttgcccaaagtcagggtgtcgtgtctggtgatttgagggttatgtttgtttgtttgcattctcagaaatattcttaatagtttaa

SEQ ID NO: 46526 - DNA, 201 bp, Homo sapiens; identical to SEQ ID NO: 10384

SEQ ID NO: 46527 - DNA, 201 bp, Homo sapiens
tctaaactctcagctgttctcagtcatctctcattgtgaactcatgaaagtcaaacatgataaaacaatcataagaagttaaaaattagggttagaaaaaragtatgtattttaaacttgctgtcttctaaatgcaattttaagtttaaagaatcaatagaaattgatgttttataccaaagaacacttaagaccttgagt

SEQ ID NO: 46528 - DNA, 201 bp, Homo sapiens
gtattttttgaacatgaagtgagggtcgtattgatgagagatcactaaagaaggttaagcctcagcaaaagtcttccaaaaaatgggctgtgctaaaattkcatgtaatactctagcgtttgacacattaaactaaactgagttcataacacattttaagaagagttttctccgttgctcatttgaccattccttgctcct

SEQ ID NO: 46529 - DNA, 201 bp, Homo sapiens
ttgattctgagtcattaaaaattatttacaaacttgtggatgacattaacagtaaattatttgacatgcttatgatgtgattatttatactactttgttgsgttagtataataagatggtgaattttagtataatatggtgatgaataatcctgtatgacaggttattccttttgatagtgtttatgttcagaatatcttc

SEQ ID NO: 46530 - DNA, 201 bp, Homo sapiens
aacacattttaagaagagttttctccgttgctcatttgaccattccttgctccttcaggaaacagacaaggttatgtaggatggtgatcatgactggaaargaatcagatgacccatgatgaagtgccagattggagaacaaaatgtgcctctaggatggttggtgaagctgtacattcacaagaaagtaaataaactcag

SEQ ID NO: 46531 - DNA, 201 bp, Homo sapiens
ctaaatgctcagagctttctttagtgctttgacattttggggtttcagagattagtactgtaatttgggctaaaggctaggaatgggaaaggtaatggtgkctttctgatgtcacatgagggctggaaatccattacactaggaagggtgagtgctagttttatgcccatttctgaacttcttcccctagaatgtatttgc

SEQ ID NO: 46532 - DNA, 201 bp, Homo sapiens
gaatgcccaggtgtgtattgattatgtgtggattgtgtgataaagatatgatgatgtagttgagtatgtattcatataaatactatctggggatacatttrcatatcactgttaattgacacattaatatttgaaaagagctaattaggataaatccatatacagtggggaccagtatttcataatgaagagggaaagttt

SEQ ID NO: 46533 - DNA, 201 bp, Homo sapiens
tattggcgtctgccacacttccatagttgtaagttggtctattttatttttaacttgcatgaacatactcattggctatgtctttgggcagctttttaagraactgtaagtatgccattggttaatagttatttgatggcttgaaaaagttaatatttttagagctattaacgtacttatgcctggaaaaaagggtataac

SEQ ID NO: 46534 - DNA, 201 bp, Homo sapiens
caactacaaaatacccttactctaggcatttgaaaattattttcttgaacatctttcaaatgtagctttaaaaatccatctggcaacttgagcatagatayaggaagtaactgcaatgaattgcaacatatcacatatgtttaaatccatgtgttcataatgatacttaaaaaagagaactcacctttggagaatgctggg

SEQ ID NO: 46535 - DNA, 201 bp, Homo sapiens
acaaaagacaggttaatgagcgaaaaagaagtatatcaatgcatacgttgcatacacacacacacacacacacacacacacacacacacacgagtattcargtaactcgtaggggtggttaaaacttgggcttaggctgggcacggtgactcagccctgtaatcctaacactttgggaggctgagatgggaggattccttg

SEQ ID NO: 46536 - DNA, 201 bp, Homo sapiens
ttctcataattaggggatgagaggatgaaacattctaggaggtctgccataggtctttgttaaaccatgtttcaccttgttgaacttgtttttcatgaatrtaagttttgcttagtcatttaattgtgtagtctcaaggagtatttttaacaacttgggttttttttgttttttgtgttttttttgagatggagtcttgct

SEQ ID NO: 46537 - DNA, 201 bp, Homo sapiens
aaaactggattaccagatatggctcttttttttttttttttttttttgagacggagtctcgctctgtcgcccaggctggagtgcagtggtgtgaccttggytcactccaaccaccgcttcccaggttcaagcgattcttctgcctcagcctcccgagtagctgggactacaggcatgtgccaccacaccgagctaattttt

SEQ ID NO: 46538 - DNA, 201 bp, Homo sapiens
acttagacatacaaaagacaggttaatgagcgaaaaagaagtatatcaatgcatacgttgcatacacacacacacacacacacacacacacacacacacacgagtattcaagtaactcgtaggggtggttaaaacttgggcttaggctgggcacggtgactcagccctgtaatcctaacactttgggaggctgagatggga

SEQ ID NO: 46539 - DNA, 201 bp, Homo sapiens
aacttagacatacaaaagacaggttaatgagcgaaaaagaagtatatcaatgcatacgttgcatacacacacacacacacacacacacacacacacacacacgagtattcaagtaactcgtaggggtggttaaaacttgggcttaggctgggcacggtgactcagccctgtaatcctaacactttgggaggctgagatggg

SEQ ID NO: 46540 - DNA, 201 bp, Homo sapiens
tttttttcactccatggatgagtgttactgtaattattcctaactctgaccaccacttctgctgtctattaaccttgtcttttctctgcttttttttttttaatttaatttaatttttaaaatagagacagggtctcactatgttgcccaggctggtgggcaactcctgggctcaagctgtcttcccaccttggcctccca

SEQ ID NO: 46541 - DNA, 201 bp, Homo sapiens
gtgatactaccagacaagttcagagaatatcatgcttccagtctactgtaaaggtaaaatcttaagtaaatatgagtttttatgacaatctatttttgtcycagaagacatggtttaaagagttagacgaaattacttttgtgggtcttatgaattatttctttccacacacttgtagtcatttgcttcgtgtaagatcag

SEQ ID NO: 46542 - DNA, 201 bp, Homo sapiens
tgtatcacttgtaggtctcctgattgcttaagatgtggaatgcaagtaattttgcttgcatttttcaggcagaagaagctaggtaattttcccaaggatayagtgttatttaaatgaaaactcaggttatccctcaacagcttccactgcagggccaggctgctagctatagcttttctctagatatatttcagtgaggaa

SEQ ID NO: 46543 - DNA, 201 bp, Homo sapiens
acattgaatgccgtcctaatcccccaacctcatttctgttgtctctactagtttttccactttcatctctaattttgtcttttgcctttgctgttttttttcactccatggatgagtgttactgtaattattcctaactctgaccaccacttctgctgtctattaaccttgtcttttctctgcttttttttttttaattta

SEQ ID NO: 46544 - DNA, 201 bp, Homo sapiens
ctttttttaaagtgaggtttaataggatacaatttacataaaataaaattcaccctttttgtaaatttattgtgatttgaaaatactaaaattcatgattygaatttgtggtaggagaagtgttttatgtggaactggcagttatttagttgataaaagaagaaataatatttagtagtagaacatgataccttaaggctt

SEQ ID NO: 46545 - DNA, 201 bp, Homo sapiens
gttggggtacagtgtcatagttatctttgctttcctctaacaagtagctcagtttttaactttgtgtttatggttgggaggtgagcatggactgtggtagrcagaagggcaaagatagcatttacgtggtggcaaggagcaccttggctaggccggagcgctgggttcctgtgaacagacactagtaggggataaagcctg

SEQ ID NO: 46546 - DNA, 201 bp, Homo sapiens
taattttctttacagatgtttctatactttgaagatcatggactagtgacgtgctccgctgatcatctcattattttgtggaaaaatggagagcgagaatytggattgcgcagtttaagattatttcaaaaattagaggagaatggtgacttataccttgctgtctagtttaaggaattaaaaatacacatgcatgaacct

SEQ ID NO: 46547 - DNA, 201 bp, Homo sapiens; identical to SEQ ID NO: 10394

SEQ ID NO: 46548 - DNA, 201 bp, Homo sapiens
tctttcaaaatttagagtctgtcatctcaaatcctgatgctcctttatgaactaagtttatagaatattctaaatcctttgttgtcatttcaactatgttkacagcatcttcactgtggaaatgactgtctccagaaaccactttctatacacattcttaagcaacttctcatctattaaagtttgatcatgagattacag

SEQ ID NO: 46549 - DNA, 201 bp, Homo sapiens
gtgtcataccatcggccagaagaaccatgtagccatagaggctgtgaagctaactagtttatctgtaatttggtcctagttgtttcgcttattttatgtckttttttttttttcttagataaatctgttcagataagctccttatgaatccttcagatcgatgttcttgaggaaaacagtcaagctaaacagcaatgatga

SEQ ID NO: 46550 - DNA, 201 bp, Homo sapiens
acttccgcatgtctttgcagttgacggtattgtcagtttttaaaaatttcttatttcagattaatcctaaatccttgagattgtggattattgaatagccrtatatggtatatacgacattttggataattctgttttaacctggttctttggttaatcatgttatttgcttaaccaggtctcccattcctggcaagtttt

SEQ ID NO: 46551 - DNA, 201 bp, Homo sapiens
cagagcctcccttcctgatcatttgttactcaaattattcttttttgaagtatcttcctctcaccttaattttggattgttatctagtctgactgtgtcasatctttatttttcaatggctttgcctgtgataaaatcagttctttaacattattttcaccacattcacgaagtcctgcaatcttggaaagatttgccatt

SEQ ID NO: 46552 - DNA, 201 bp, Homo sapiens
gcctgtgataaaatcagttctttaacattattttcaccacattcacgaagtcctgcaatcttggaaagatttgccatttacattgtatttttgcatgtttmctacttggtaaattagtcagagactgatggatgaagacattggatgggtaggaatagatgttggtgttaaataacgatggagtggagactgactttctaa

SEQ ID NO: 46553 - DNA, 201 bp, Homo sapiens
attcacgaagtcctgcaatcttggaaagatttgccatttacattgtatttttgcatgtttactacttggtaaattagtcagagactgatggatgaagacaytggatgggtaggaatagatgttggtgttaaataacgatggagtggagactgactttctaagtggttaataaatgtgtggatatatatacttatttgtgtg

SEQ ID NO: 46554 - DNA, 201 bp, Homo sapiens
agtcagagactgatggatgaagacattggatgggtaggaatagatgttggtgttaaataacgatggagtggagactgactttctaagtggttaataaatgwgtggatatatatacttatttgtgtgtaggtacatatacagttgttatggtgacttttattttcttctatgaccttataactgtggagacttaaataacaa

SEQ ID NO: 46555 - DNA, 201 bp, Homo sapiens
tttacacaattatatttttaaatttatagaaaaaaatactcaaaattttctataaaaatatactaaaaattagcattttgttttagaaaataaaactatarttatggctgtactttcagtgcttgtttagattctgtgtgattgcttaagttaaattctgaataagtaattttaaatggaatgtatatgtatcttctatat

SEQ ID NO: 46556 - DNA, 201 bp, Homo sapiens
accactaataaggtttgatagttcttaatcttagtaattaaatgtcaccagtgatttttttttcttgaccctttctccctaaccagatttgcatctgctgrtgatgatggaattgtagttgtgtggaatgcccaggtgtgtattgattatgtgtggattgtgtgataaagatatgatgatgtagttgagtatgtattcata

SEQ ID NO: 46557 - DNA, 201 bp, Homo sapiens
aagaaatgaacaagctgtagtggcctaaggagccactacatacactattagtctttagctgatagggtcttgtctgtatattcttgttatagcaaaaatgrtttttgttctgttacttataagataccatttattaggtatctgaaaagtattagactggaaataggaggttaaggcttgttattgatggaaactccatga

SEQ ID NO: 46558 - DNA, 201 bp, Homo sapiens
ctgcccgccttggcatcccaaagtgctgggattactggcatgagccactgtttccggtcatattaatttttaaaagtatatgcttatctgaaagttctgtktaaacagtttcaagcattggtgaagttttggagtaagcccaaaagtataggtgtttcttaggctcttacagaaccaagatacagacttgaacatgcttta

SEQ ID NO: 46559 - DNA, 201 bp, Homo sapiens
atggtttttgttctgttacttataagataccatttattaggtatctgaaaagtattagactggaaataggaggttaaggcttgttattgatggaaactccrtgactattgctgttctttccagagttactctatcaggttgtataaaattgatgaaatgggaaaatgtggacttaaaaataatttattttactatctcagt

SEQ ID NO: 46560 - DNA, 201 bp, Homo sapiens
ccttggcatcccaaagtgctgggattactggcatgagccactgtttccggtcatattaatttttaaaagtatatgcttatctgaaagttctgtttaaacastttcaagcattggtgaagttttggagtaagcccaaaagtataggtgtttcttaggctcttacagaaccaagatacagacttgaacatgctttaaatgagt

SEQ ID NO: 46561 - DNA, 201 bp, Homo sapiens
atgggaaaatgtggacttaaaaataatttattttactatctcagtttgcttttcaatttagggaaacaacgatgagttggactggagaataatttacattytttttccccactatacagcagaagaaaccaaatggtcccaacccataaaaatctttggagcatctgagtctgatagaaaagtgaattactgtttgttcag

SEQ ID NO: 46562 - DNA, 201 bp, Homo sapiens
tgtgggtcttatgaattatttctttccacacacttgtagtcatttgcttcgtgtaagatcagatttttgagagcacatgtattaagtgttagaatgtttcmatttgaaattagagcaagggataatcccaatagcaagataaggaaaaaaggtagtacctggtatgttttttgtaggtagttccaggaagagatattactt

SEQ ID NO: 46563 - DNA, 201 bp, Homo sapiens
gacctgtgtgtgtggaaccgaaaattagatctcctgtgtaagactagccacctttctgatacaggtaaaaaacatcaaggtaattttgaactatgattgasagactagaagacacagcagatcttcagagagactttccataagtagaaaggtcaatataggggatttttctttttcagttctgaagataacaggtagcca

SEQ ID NO: 46564 - DNA, 201 bp, Homo sapiens
ctttgttttgcaagttatgtttaagtactatatattaaatcattacaatactgccatttatcagtgtctcaagagttaacagaaggctttgagggtatctrtgggaaagccttgagaaggccatgggttactattggtgagctgttcatcatttgggttttccaaattactggaggccagattgttaatagtgttattaga

SEQ ID NO: 46565 - DNA, 201 bp, Homo sapiens
taagtttctaacctgatatacatttcaaataaattttgcagtgtttaactgttcttcagagactagatgtttggctttctggtgggaatgacctgtgtgtrtggaaccgaaaattagatctcctgtgtaagactagccacctttctgatacaggtaaaaaacatcaaggtaattttgaactatgattgacagactagaaga

SEQ ID NO: 46566 - DNA, 201 bp, Homo sapiens
aaaaatgtcaagaaaaggtttaaatggggataaactctctatacatacatacatatatacatacacacatatatgtatgtttgtgtgtgattatgatacartgtaaacaagggcataaaattctctcagatggttaggtcagagttgctttattactactctgtagaggcaaatatgggataaagctctctttttcagtat

SEQ ID NO: 46567 - DNA, 201 bp, Homo sapiens
atttgggttttccaaattactggaggccagattgttaatagtgttattagatccttatgtcatgatgtcctttcataagccctgcttgatttatggactgstggagcttttacaagcagttattctgtgtttggaaataagcaaagacaatcttagtcaatgtgatacaatggaaggagccctggactaaaacacagggca

SEQ ID NO: 46568 - DNA, 201 bp, Homo sapiens
tgctacatctggattgttgggcttctagtattttcacatataatttagtgaaagatttttaaacaagctgttttctgcatttagaattcttctcttgctayccaccctgctgttctcccatgtcctctgccttctctgtaccattcctttgccttccttgcagcaccatttcctccttcttgtacatgggaaaatacaaaa

SEQ ID NO: 46569 - DNA, 201 bp, Homo sapiens
gtcagtcctttgatggatgggaaggataagcaaatgactagaccgttttctacacttgcatatatattataaattacatatatatcataatggaaaaattraacaggtttttttttttttgccaacacgtggtggttctaatatatcaactcttttattcatactgacagaagcaaaattgtaacatgccttgtagaagtt

SEQ ID NO: 46570 - DNA, 201 bp, Homo sapiens
ccgttttctacacttgcatatatattataaattacatatatatcataatggaaaaattaaacaggtttttttttttttgccaacacgtggtggttctaatwtatcaactcttttattcatactgacagaagcaaaattgtaacatgccttgtagaagttatagttacgctaaaatcattaacctctttacttaaataagtg

SEQ ID NO: 46571 - DNA, 201 bp, Homo sapiens
atactttcgtaatttgaaaaggacatgatctcagagacttgtcacttctcagatgttagtgatgctaatctttgagcatccacagcacctggtccagtggygtatttttaaaacactcagtacattgacggtaagcctgtttataaacaagtctctctcccactctagactgagcatttgtgactgggccttattcacatt

SEQ ID NO: 46572 - DNA, 201 bp, Homo sapiens
gtactgtaatttgggctaaaggctaggaatgggaaaggtaatggtggctttctgatgtcacatgagggctggaaatccattacactaggaagggtgagtgytagttttatgcccatttctgaacttcttcccctagaatgtatttgctgcagttggaaggggtttatacgtgtatagccttcaaatgaagcgtgtgattgc

SEQ ID NO: 46573 - DNA, 201 bp, Homo sapiens
ctgctccgcgcgcgtccaccaggggccgctcgagctacctaagctccgtgcgctacccggcggcgctcccgcgcgtgctcactcggagcagcgcgcgcccsgcaatcgccgcagccgcccccgccgtcggccgccgcaccccaagcgactgcccaaactaagcctccgtggctgggtacgggagcgctttggggacaaaaa

SEQ ID NO: 46574 - DNA, 201 bp, Homo sapiens
gttatgtagtggggggagaatatgatccatttttctttgtaccactctttaaaaacaaaacaaaagattaggataggaacaggacttagaaacactaatayattcaaagattgtttctttgtatcccaactttattttgaaaaaagttaaatatacatgataaagacagtatggtttcagaaaagatagagactagatcac

SEQ ID NO: 46575 - DNA, 201 bp, Homo sapiens
gctgaggtggaaggatcacttgagtccaggagttcgaggctgcagtgagttgtaattgtgccactgcactctagcctgggcgatagagcaagaccctgtckcaaaaaaaataataaaataaaaatttttaaaaatggtgaaagacaaataatttcccccaaagatcaggcacaagataaggatgtctgctgtcagcacatc

SEQ ID NO: 46576 - DNA, 201 bp, Homo sapiens
ggagttcgaggctgcagtgagttgtaattgtgccactgcactctagcctgggcgatagagcaagaccctgtctcaaaaaaaataataaaataaaaattttwaaaaatggtgaaagacaaataatttcccccaaagatcaggcacaagataaggatgtctgctgtcagcacatctgtttaacattgtactggaggttctagc

SEQ ID NO: 46577 - DNA, 201 bp, Homo sapiens
cataaaattctctcagatggttaggtcagagttgctttattactactctgtagaggcaaatatgggataaagctctctttttcagtatcagtgtaatcttygcaaaaatagaatttaaaatactctattagaccactcctaagacactatagcaatattttgaggcagtgattaaaattacatacagaagttagtagctgg

SEQ ID NO: 46578 - DNA, 201 bp, Homo sapiens
tattcccaaataacatgatcttgtgtatatagaaaatcctaagtccacaaccaaactattgaggctagtaaatggatttagcaaggtttcaggatataatrtcaacacacagaaatcaattgtatttctattcactagcaatgaacattccaaaaattaagaaacaattccatttacagttgcatccaaaagaataaaata

SEQ ID NO: 46579 - DNA, 201 bp, Homo sapiens
atactcagaaatagatttagtctgggcggggtggcttatgcctataatcctagcactttgggaggccaaggtgggaggattgcttgaggtcaggagttcaygactaacctggccaacatagcaataccccatcactattaaaagaaatttgaagtagtatgagacttatataccaaaaactacaaaacattgttgaaagat

SEQ ID NO: 46580 - DNA, 201 bp, Homo sapiens
aagctacagtagtcaagacagtgtgatattggcataatgacagacatgcagatcaatggaaccgaattaaaggcccagaagtaaagtctcacatagccaaytgattttttgacaagagcgccaagaacctttaatgggagaaagaatagtctcttcaaaaaatgatgctgtgtcaattggacatccacatacaaaataatg

SEQ ID NO: 46581 - DNA, 201 bp, Homo sapiens
gttgtgtaaaatatatttttatcctgaatcaggaggagaagactccactcaagaacaaccttttccaatgctcttgggctgttttcctgaactgtgtttgrtgagcacgctgatacctagaagcagacccttacgactttacagtagcatttgtggggtcattaactttgaataaatgcctaaggatgacctctttttaca

SEQ ID NO: 46582 - DNA, 201 bp, Homo sapiens
cagaatgaaaagtttttgtgcttcaaagtgaaaagacaacatacagaattggagaaaatattttcaaattgtatatctgataagggacttgtgtctacaayatatgaagaattcaataaaaaagcaaatactccaattaaaaatagacaagatttgaaagaaagaaatttctccaaagaagataaacaaatagcaaataag

SEQ ID NO: 46583 - DNA, 201 bp, Homo sapiens
aaaatactaccaggggcgcaaagataatatttgatgtctttttaaaatggctacacgtttattattcaatttgatttttagtcactcatttaatgcatgargaatccaagataaaggttaaactacttcctaaagaccacctggctagcaacaggcagagccaaaatcagaacttgggtttctagactaagtgcattatac

SEQ ID NO: 46584 - DNA, 201 bp, Homo sapiens
agaatgggtttattgtgggacataactactttaagtcaaggcacatctgtataataaaaatataacaaaaggcattggccatgataaggttaactagtttrtgaaattagtttcaatttttaatacatgcatatacatttgtatacgtagtacatacatgtatgtaaatgtgttttcagacatggtgtaaaatgtatttct

SEQ ID NO: 46585 - DNA, 201 bp, Homo sapiens
agtgggcgaggagagtactattaaaggtaaagggcttatatggtacttgaaacactcactttcctgactaccaaatgtatagaattgagaagacttgggcrttatttattctaaagatacagagaaactaaggtcatagtttcaatttgatttaaaaaggggtttaagcaattgtgtattagtaatttattactgagtaac

SEQ ID NO: 46586 - DNA, 201 bp, Homo sapiens
atcttcagatttttaagattgtgtatttgtacatatatgtatgtaacaaccttgtacatttatgtatttccttcaggataaattcctagaagtggaattgmtggatcgagatttacatttttcaaggttttgatacatattagcaaattaatctttgaaaaaaatactaatgtatagtagggcattaggcaatacaggaat

SEQ ID NO: 46587 - DNA, 201 bp, Homo sapiens
ctttttcagttctgaagataacaggtagccatattcaattcagatcggggttgtgtaaaatatatttttatcctgaatcaggaggagaagactccactcargaacaaccttttccaatgctcttgggctgttttcctgaactgtgtttggtgagcacgctgatacctagaagcagacccttacgactttacagtagcattt

SEQ ID NO: 46588 - DNA, 201 bp, Homo sapiens
aaacactgtgaaaaagagttcttttgaagatctgacacatttcctagtgaggcaaagaaaattaaaaattttaggagtgtttctcagtctgctggcatctkggggcaagataaattgagtgagaattgttggattccatcttataggacttgggagtgatgctcttgaagcactttagatctgttttgctgtgagagatta

SEQ ID NO: 46589 - DNA, 201 bp, Homo sapiens
tttttggaggtattagtgctttggttgaaatacctaagaactgtgttgtggcagcagttggcaaagaactgagtgagtatgaatttttttctttttgtgtrttttgaacgagaattgtatacacatgctggaaggactaaagtaattttttatttaagggacattgcgtgtgccccactcttggcttcttgggattgttga

SEQ ID NO: 46590 - DNA, 201 bp, Homo sapiens
ctctgatctgaaaaaacaaatctcttagcatcaggggctcagaaaatgtttttaaagggcaattaacttttctaaatgtaatcacaagaaatgtttatgayttgtacccttcgaggagaaggagttggggaggcttttctctattttgtgactttctatactgtttaatttttctaacggcatgcacgttatttttattaa

SEQ ID NO: 46591 - DNA, 201 bp, Homo sapiens
ttagtacattggctagcagtgttcattaatgccctggcattgggcctcggctgcattgctgattgcagagtactaatcctgagagtcaaggggatcattcmagatttaagattccagcaagccttgggggcatgctttggttcagttactataggtctgagttgagtttgtagtcttggaggctgtgtgagaaaggttgga

SEQ ID NO: 46592 - DNA, 201 bp, Homo sapiens
ttctttagtgctttgacattttggggtttcagagattagtactgtaatttgggctaaaggctaggaatgggaaaggtaatggtggctttctgatgtcacaygagggctggaaatccattacactaggaagggtgagtgctagttttatgcccatttctgaacttcttcccctagaatgtatttgctgcagttggaaggggt

SEQ ID NO: 46593 - DNA, 201 bp, Homo sapiens
tggccacaaaaagctgacagccacatttttaaaaatatattttgtttacctttaggctcaccctgtgtcactaaagataatattcgtaaagtataacaatyttctttgggtgacaaaacagtaactgtcttaccatcccaagcatcaaacatgtctgttatgaagtagtcaatgaaagagatctgagacttggggatgcta

SEQ ID NO: 46594 - DNA, 201 bp, Homo sapiens
tgtatttgctgcagttggaaggggtttatacgtgtatagccttcaaatgaagcgtgtgattgcctgccagaaaactgcacatgactccaatgtcctgcacrttgccagacttccaaacaggtacaagttcccatctgttctgcaatagatgaaagcaagtcacagttcccagggctaccagtgtaatttctcaagtggcca

SEQ ID NO: 46595 - DNA, 201 bp, Homo sapiens
cagctgagtcttatcctgtggtcttcagaaatgtatatgtcatttcagagaaaactcttgttttttttcccgagagggagttttgctcttgttgcccaggytggagtacaatggcgcaatctccactcactgcaacctctacctcctgggttcaagcgattctctttcctcggcctcccgagtagctgggattacagatac

SEQ ID NO: 46596 - DNA, 201 bp, Homo sapiens
ggcacaaattcagtgagtgggtaaataaacttgacctctcatggtagaagtaactaagtcctattgctaatggtggtggcaatattgggagggggaataayttgtggccagtttgtgatctaccacagtgagtctaagatagatgaagaagcctgctttttggcttttgtaatacagtgatgatatgacttcatgattcac

SEQ ID NO: 46597 - DNA, 201 bp, Homo sapiens
tactgtccacttagcccttgactaaaataagtctggaacctcttcacatttaaattttgtttttctgatctcatgttattgtaagtacagagcacagtaaktttggaaatgattctttttctaggtttttttaacatgtggggatttggaagagtcagcaaacaagccagccaacctgttaaaaagcagcaagaaaatgct

SEQ ID NO: 46598 - DNA, 201 bp, Homo sapiens
caatgtgtatcagaaagagttctcttttctattgactgaaaaaccttcttttgacaaccacagtttgaatatgagtagctgtcaggattaaataacctggwtagagatttgtagtttggtaaaatattgtcagagacacagaaagaagcatggcatgacctatcttctagagagaaatgtgagaaagaaaagatactttcg

SEQ ID NO: 46599 - DNA, 201 bp, Homo sapiens
gtttttgttttgccaagcagctacttactaggatctcttcccctggcaccccactctgcttccgttagagccctttaccactccacattcctaaaagtatkcacctttatcttcttccatcctttaactaactttcatgttttaatctatttgaaacttattttggtgtatggtacaagataaggttcttttacttttatt

SEQ ID NO: 46600 - DNA, 201 bp, Homo sapiens
cctggatagagatttgtagtttggtaaaatattgtcagagacacagaaagaagcatggcatgacctatcttctagagagaaatgtgagaaagaaaagatamtttcgtaatttgaaaaggacatgatctcagagacttgtcacttctcagatgttagtgatgctaatctttgagcatccacagcacctggtccagtggtgta

SEQ ID NO: 46601 - DNA, 201 bp, Homo sapiens
atttaatggtatatgcctaggaatcagaagctttttaaaaaagaagttgcttatgtcttcactgagttgaagttaaacttggatttgcagcttattctgtmgcaatgcttacatgagtaagagacatgagtagagaaagctgatgttggaggtgattgagggatgtgggctagtcactgattagggagggagtgagttgag

SEQ ID NO: 46602 - DNA, 201 bp, Homo sapiens
gctgcacctatcaacctgtcctctcagtttcctccccttccccacaacaggtgctggtgtgtgttgttcccctctctgtgtccatatgttctcattgttcrgtttccagttagagtgagaatatgcggcatttgattttctgttcctgtgttagtttgctgagaatgatggcttccagcttcatgactatgtccctgcaaa

SEQ ID NO: 46603 - DNA, 201 bp, Homo sapiens
tcatgactatgtccctgcaaaggacatgatctcattcctttttatggctgcatagtattccatggtgtatatgtgccacattttctttatccaatctatcrttgatgggcatttggattggttccatatctttgttcttgtaaatagtgatgtagtaaacatacatgtgcatgtgtctttgtagtagaatgattgatatcc

SEQ ID NO: 46604 - DNA, 201 bp, Homo sapiens
aaaatggctacacgtttattattcaatttgatttttagtcactcatttaatgcatgaggaatccaagataaaggttaaactacttcctaaagaccacctgkctagcaacaggcagagccaaaatcagaacttgggtttctagactaagtgcattatactcttctgtcttaccctaaatatgtaataatttaaataaattac

SEQ ID NO: 46605 - DNA, 201 bp, Homo sapiens
ggaatccaagataaaggttaaactacttcctaaagaccacctggctagcaacaggcagagccaaaatcagaacttgggtttctagactaagtgcattatastcttctgtcttaccctaaatatgtaataatttaaataaattacatttatttgaaataagactagcagttgtacattttctattaaatatatagtgtgtaa

SEQ ID NO: 46606 - DNA, 201 bp, Homo sapiens
gttaatattaaaatctttccactatccagtattaaacaccagtccacatctttctaggtgattttctgggcctatgtatgtgtgtacatgtgtattaatayggtttactgttttgtaacaatatgtcataaatatatttccatatctaagtttatattgttaagcatacttttataacttaatttttaataacagcattac

SEQ ID NO: 46607 - DNA, 201 bp, Homo sapiens
tgtaacaaccttgtacatttatgtatttccttcaggataaattcctagaagtggaattgttggatcgagatttacatttttcaaggttttgatacatattrgcaaattaatctttgaaaaaaatactaatgtatagtagggcattaggcaatacaggaatgtgctgatttcttatgcttttgccagtactgtgttgggtat

SEQ ID NO: 46608 - DNA, 201 bp, Homo sapiens
ttccttcaggataaattcctagaagtggaattgttggatcgagatttacatttttcaaggttttgatacatattagcaaattaatctttgaaaaaaatacyaatgtatagtagggcattaggcaatacaggaatgtgctgatttcttatgcttttgccagtactgtgttgggtattttcctgttttatatttcctgattca

SEQ ID NO: 46609 - DNA, 201 bp, Homo sapiens
ctaagaatgaaatttggggacttgaatgattcaaggtcaaatattaaacattagctccttcaccaatacctgtcattgtcattagaaaggaaggcctcttrtttacgctactgtgattcacagtgtcctttgtcggtcaagaggccccctctgtggcttggctttagctgtcagatggaagcctcaaacttttgcacttta

SEQ ID NO: 46610 - DNA, 201 bp, Homo sapiens
ttttaactttgtgtttatggttgggaggtgagcatggactgtggtagacagaagggcaaagatagcatttacgtggtggcaaggagcaccttggctaggcyggagcgctgggttcctgtgaacagacactagtaggggataaagcctgggaacgtggtttggggtcagattatggatgtccttgaatgtaaggctgaggag

SEQ ID NO: 46611 - DNA, 201 bp, Homo sapiens
gcattatttagtacctgattacataatctctcattggtacctttattgtttcaattatgatttgcttttcagaatcttcttgagggtagggaccataaacstagtgctgacacttaatacctatggattgagtatatctacttttatagagagctgaagccagtgtttatcttgggaaatttagaattcagacattttttc

SEQ ID NO: 46612 - DNA, 201 bp, Homo sapiens
cccaaaatattacgtatagatggtgcatggcacaacatactgcatgggcttacacccagaaaatttggattttaataaaaattttaaacatgtatataaactttttttttttttttaagaaaagcttgtccaagggcattcaaatttaatggcttttatataatacttggtgtagtgcctcgtggctgcctctgtgagcca

SEQ ID NO: 46613 - DNA, 201 bp, Homo sapiens
gggtatgttagttaccgattgctctgtcagctgtcacaccaaacttagtggcttaacacaaccccatctatttagctcattattctgcaggatggcaattsgggctaggctcagctgggtgagtctgtctttgcaccaggagcaactgatcttggctagattcacttatgcctctgtcagctggtagattggcgggggctg

SEQ ID NO: 46614 - DNA, 201 bp, Homo sapiens
cttcctgctgttgttgtcccttgcactctgacgttaatggggatagtttcatgaaccaacctctgcttgcttccagcttttcttctgtagcatcctcaccyctcagtcttcgaagaaagaattgaagaattaattaggctttggcttaagggaatgttgtggcttgtttaatctatatagaccactcagactttctccatc

SEQ ID NO: 46615 - DNA, 201 bp, Homo sapiens
attacataatctctcattggtacctttattgtttcaattatgatttgcttttcagaatcttcttgagggtagggaccataaacctagtgctgacacttaayacctatggattgagtatatctacttttatagagagctgaagccagtgtttatcttgggaaatttagaattcagacattttttccatagccattatacagt

SEQ ID NO: 46616 - DNA, 201 bp, Homo sapiens
ccacaactggacacccaacaagaaataaaactctgtcaaaaatcaaatgacatttctattcatcatttcacatgtgatgaagaggtaaaaaatgtatacaytatctataaacttgcctttgacatatataacccaatttctgattttaaaaatttaatcccatgttggacataaaaaaggtatcattcatggtttcaggtt

SEQ ID NO: 46617 - DNA, 201 bp, Homo sapiens
cagtgtttatcttgggaaatttagaattcagacattttttccatagccattatacagtataagtaatggttaagtaaaaccaatacttgaaaaatcagatkatgaaaaaatctggaagaactatgagaattcatgtactttacaaaaatagctattctgtagttgaacaatattaacaaaattctgattaaaatattagat

SEQ ID NO: 46618 - DNA, 201 bp, Homo sapiens
ttttagatttctttgattattaaaggagttgaacatcttttcacgtttactgaccatttgtatttgttttgccttttcaggtccttttcccatttttttttctgctgtatttatcttgttcttaataatttccaagaactccttatgtatcaagtataataaacctgttttgtcatccaagttgcaaatttttcccagctt

SEQ ID NO: 46619 - DNA, 201 bp, Homo sapiens
ttaaaatattagatattatttgtatgtgacttaccaatactgaaaaatgaaatgaagttctacacccagatccaaaggagtctttaaggcacatatctcasacgcacatgtgttaatgtggtattagacacttctctgcttttcggggtccctataatcagttttaattttctttacagatgtttctatactttgaagatc

SEQ ID NO: 46620 - DNA, 201 bp, Homo sapiens
cagatgggtagattgcaaaaattttctcccattttgtaggttgccttttcactctgatggtagtttcttttgctgtgcagaagctctttagtttcattagwtcccatttgtcagctttggcttttgttgcagttgcttttggcatctttgtcatgaagtctttgcccatgcctgtgttctgaatggtattgcctaggtttt

SEQ ID NO: 46621 - DNA, 201 bp, Homo sapiens; identical to SEQ ID NO: 10398

SEQ ID NO: 46622 - DNA, 201 bp, Homo sapiens
accgacctttgtcagatgggtagattgcaaaaattttctcccattttgtaggttgccttttcactctgatggtagtttcttttgctgtgcagaagctcttyagtttcattagttcccatttgtcagctttggcttttgttgcagttgcttttggcatctttgtcatgaagtctttgcccatgcctgtgttctgaatggtat

SEQ ID NO: 46623 - DNA, 201 bp, Homo sapiens; identical to SEQ ID NO: 10399

SEQ ID NO: 46624 - DNA, 201 bp, Homo sapiens
tggtgtgtgttgttcccctctctgtgtccatatgttctcattgttcagtttccagttagagtgagaatatgcggcatttgattttctgttcctgtgttagwttgctgagaatgatggcttccagcttcatgactatgtccctgcaaaggacatgatctcattcctttttatggctgcatagtattccatggtgtatatgtg

SEQ ID NO: 46625 - DNA, 201 bp, Homo sapiens
agcgattcttctgcctcagcctcccaaatagctggaactacaggcgcatatcaccatgcccagctaatttttgtatttttagtagagacggggtttctccrtattggccaggctggtctcgaactcctgacctcatgatccacctgcctcagcctcccacagtgctgagattacaggcatgagccaccaagcccggccggc

SEQ ID NO: 46626 - DNA, 201 bp, Homo sapiens
ttatagggtcattctggtccagcagtgttttataactggcttccttctcttactagtcacggaaattattagagagtgttgcattttcctaatacggcccycctcagcacatgacatttaagtaaacaactctgtgtaagaggcagttataatagtttatataatataaactatctgatacacatatcatctgaaagcctg

SEQ ID NO: 46627 - DNA, 201 bp, Homo sapiens
tgtttacgctactgtgattcacagtgtcctttgtcggtcaagaggccccctctgtggcttggctttagctgtcagatggaagcctcaaacttttgcacttyaggtcatctagtgtcttccagtgtttgtagttgtcagccaaatgttgcatcagggctggcagatgtgcaaaggctgcaaagacagaaaagaatcaaaaga

SEQ ID NO: 46628 - DNA, 201 bp, Homo sapiens
gcttaggaggagcagcggcagcatccttgttagtgagcatttcctgtatttcaggcactgtgctaaacactggctgctggagtttacagagagagatgaawacagtccttgccctcatggatcttacccttgagtggagagaaggggtatagacctaataggctgttaccctaggctgcatttgatggacccaagtaagca

SEQ ID NO: 46629 - DNA, 201 bp, Homo sapiens
acctgacatcatgtgacaggttgcagtcaaaattttgtttaacgcacaaaattaccaaaaatattgtataaaactaccttcaggctatatgtataaggtgtatatgaaaaataaatgaattttgtgtttagacttgggttcagtccccaagatagctcattaggtatatgcacatattccaaaatccaaaaaaaatcagaa

SEQ ID NO: 46630 - DNA, 201 bp, Homo sapiens
ggctgtgttctaacttaggtgtcataccatcggccagaagaaccatgtagccatagaggctgtgaagctaactagtttatctgtaatttggtcctagttgyttcgcttattttatgtctttttttttttttcttagataaatctgttcagataagctccttatgaatccttcagatcgatgttcttgaggaaaacagtcaa

SEQ ID NO: 46631 - DNA, 201 bp, Homo sapiens
gtgttctaacttaggtgtcataccatcggccagaagaaccatgtagccatagaggctgtgaagctaactagtttatctgtaatttggtcctagttgtttcrcttattttatgtctttttttttttttcttagataaatctgttcagataagctccttatgaatccttcagatcgatgttcttgaggaaaacagtcaagcta

SEQ ID NO: 46632 - DNA, 201 bp, Homo sapiens
aaaactttaggccaaagaggtaaaataaaaacagctgttgggagtgaaaaatggctgtaggaatttagttacaagtacttcacaaaaacattttcatcacwtttacataatatagcattacaatacaaagctggctgctgtcctgaccaagcaagttctcttatcatctaacaaaaataatttagatacatttctttgcat

SEQ ID NO: 46633 - DNA, 201 bp, Homo sapiens
tcatctagtgtcttccagtgtttgtagttgtcagccaaatgttgcatcagggctggcagatgtgcaaaggctgcaaagacagaaaagaatcaaaagaaacyggtgaacttagaccccaggagcatttataagcctgggggtgtctgggacaagtttgggatcagaattagaggaggcacaccctgggcgaagcatgaggac

SEQ ID NO: 46634 - DNA, 201 bp, Homo sapiens
gatgattctaggacaggtgcttgcaaaaatttcaaaggctactactgcatgtgagtcacgtgaggaatgagcaagggactggagtaacatgaccttgattstaatattgactccatgtttcatttcttgtgtgactttaatctctttaattttaaattccttatctggaaaatggcaatgatgcttgcctttcttaacacg

SEQ ID NO: 46635 - DNA, 201 bp, Homo sapiens
ggagagaatcaatttatagcatttgagctaatgtaacgagtaacatgtggctttcctaaagggtgcttttagtttgcgttgtaacgtcatgctaaattgtratttttgtcagttcctgctaagagctgaataaaagcagttgagggctccactgatttctttcactgcaaatttagcattggccctcagtggtgcgctctt

SEQ ID NO: 46636 - DNA, 201 bp, Homo sapiens
cttaatactgccctaatgtagaactgccacttcatttcaagtaagatagagattttcttgttttgagggaaaacttactttctggtaatctgaatgaccaratggcctaatgaagtattcatttatattgtctataattctgactgatacacaaaatttgtaccgtcagatgtcaaaccaaagtgttctttacccttgatg

SEQ ID NO: 46637 - DNA, 201 bp, Homo sapiens
cagtgagccgagaacatgccactgcactccagcctgggtgacacagcaagactgtctcaaaaaaaaaaaaaaaaaaaaaaagttttttcctaagaaacaartgccaaagtatgaaaattcaaaaaatacaaaattttaatcttatttaacaaaatttaggttatcactagctatgccctgacttccaaaatgaataaatga

SEQ ID NO: 46638 - DNA, 201 bp, Homo sapiens
atgcattgcttttaagaatggtcttaatcaccattatttaggagctggagatagctgacagtaagggcagtgtgaataatgttgactatatgacaacagtmaacagaggatgcatgaagggttgtggttatatgtgtatacagttaaagccttaacagaatcgaattccaggggcctttatcaaattcatgaacagagtcc

SEQ ID NO: 46639 - DNA, 201 bp, Homo sapiens
ggggcagagagagaccaagaatgtttctctagtagtgggagtcctccatggaaacttgagtgcaggggaatggaggttcacctaatagaagtcacacagakttttttggtattctaatactgtaatctttttttttttttttaattatactttaagttttagggtacatgtgcacaatgtgcaggttagttacatatgtat

SEQ ID NO: 46640 - DNA, 201 bp, Homo sapiens
ttgaaaattatgaaatgcgtaagcttttaacatgtagaaatccagatacattaatatttgctgcaggcatcattgcctgtagtgaaggaataagatcagtkgaggtaacagattagctgtgagaactaataacagtgtaatcagggccctaaggaatttcttaaattgttcttccctgtttcatagccaaagaacaaaaaa

SEQ ID NO: 46641 - DNA, 201 bp, Homo sapiens
tgacctatcttctagagagaaatgtgagaaagaaaagatactttcgtaatttgaaaaggacatgatctcagagacttgtcacttctcagatgttagtgatrctaatctttgagcatccacagcacctggtccagtggtgtatttttaaaacactcagtacattgacggtaagcctgtttataaacaagtctctctcccact

SEQ ID NO: 46642 - DNA, 201 bp, Homo sapiens
ataaaacagtgtcagcttcttaggaattttcctgagtgaaagtgttgagacctgaacacttttaaaaagcatctccagcttcgttgataaaatctaggctrtctttgcagtgtcacctgaatttcctcatttctttttttttctttgagacagcatctcactctgttgcccaggctggagtgcagtcttgggtcactgtac

SEQ ID NO: 46643 - DNA, 201 bp, Homo sapiens
gacacattcagtatgggttttagtagatcatctcaaacatctcaagcatttgaaagaaatagtttaaagtagtatgaataaggcttttttttggagatggstttttcagtatggtaggtatttttcacttaatgaaatgcttgtttttagagcaggagtagtattttatcctcttagagcattgtaataaaattttatctg

SEQ ID NO: 46644 - DNA, 201 bp, Homo sapiens
attcttagcttccagcctattccttcactgggcaagccccttccccttacttggggcattttctccctttgaagctttttctgaatttctgtgacatgtcrtagtctatactgcattatttagtacctgattacataatctctcattggtacctttattgtttcaattatgatttgcttttcagaatcttcttgagggtag

SEQ ID NO: 46645 - DNA, 201 bp, Homo sapiens
gcgcaccctggagctgcagacccccggccccgtcccacggctagctgaatcgtgagatcctggctcagggacgctcagctggtcagcagtcctattgggasctgtgacaacttagggcttctggctaccgaaactatcttcatttccacttaaaaagtatacgatttagctagaaacgaacgagttgtgaccgcagctttc

SEQ ID NO: 46646 - DNA, 201 bp, Homo sapiens
gattaaaatattagatattatttgtatgtgacttaccaatactgaaaaatgaaatgaagttctacacccagatccaaaggagtctttaaggcacatatctsacacgcacatgtgttaatgtggtattagacacttctctgcttttcggggtccctataatcagttttaattttctttacagatgtttctatactttgaaga

SEQ ID NO: 46647 - DNA, 201 bp, Homo sapiens
gtgaccgcagctttccacttttggtttatttgaattggtgtctcttcctggcgtctactgatacttggtcagggaatataaaattaatttacttatccaasaaccgaaaaaggatataattatttttaaaaagtaatctgcttcaaggtcaagaacatgattttctaattaactgctgtttttggtttcatagtcacactt

SEQ ID NO: 46648 - DNA, 201 bp, Homo sapiens
gtcaccatgttggccaggctggtcctcatttctattttcatccttgctctactggcgcaacccctctacctgtgtactgaattttgtgttttccagtttcygaaggaattctgctcccatgtttcctcccttcactcctgcatcctcagctgagtcttatcctgtggtcttcagaaatgtatatgtcatttcagagaaaac

SEQ ID NO: 46649 - DNA, 201 bp, Homo sapiens; identical to SEQ ID NO: 10390

SEQ ID NO: 46650 - DNA, 201 bp, Homo sapiens
gtatttgtttagattgttaaaagtaagaaattggattgttgagagtaggcagtcttctcaattttaacttccgcatgtctttgcagttgacggtattgtcwgtttttaaaaatttcttatttcagattaatcctaaatccttgagattgtggattattgaatagccatatatggtatatacgacattttggataattctgt

SEQ ID NO: 46651 - DNA, 201 bp, Homo sapiens
gcaattctcctgcctcagtctcccaagtagctgggattacaggtgcccgccaccacgcccagctaatttttgtacttttagtagagatggggtgtcaccaygttggccaggctggtcctcatttctattttcatccttgctctactggcgcaacccctctacctgtgtactgaattttgtgttttccagtttccgaaggaa

SEQ ID NO: 46652 - DNA, 201 bp, Homo sapiens
ggaagacagaataaatacaaaatcaatgctttgtggtggtggttttttttttggaaaacatttatgcatgttttaaatttatatatttcttcatataaatstaattgagttgtataactgctgtgaatttgtacattatcggaacctatgattgtccctaatttatgcaataactttgtatccaggcttctcgtttaagca

SEQ ID NO: 46653 - DNA, 201 bp, Homo sapiens
aggatgcatgaagggttgtggttatatgtgtatacagttaaagccttaacagaatcgaattccaggggcctttatcaaattcatgaacagagtcctgtttytcctgcctttgaaggataatagtttgttagctttaatgaaacctatgccttgattttcattgtgcaaatatgaaagttttagttgaaaattatgaaatgc

SEQ ID NO: 46654 - DNA, 201 bp, Homo sapiens
ccctctgtggctgggtaattaatatggtgtgaaccagtgattagcaagtagagagaacctgcctgccacagacttaacccttccctgcatctgggaagaaytgctgccttcttagttcgtctttctccagtggtcacatgggcagagagtttttccctttggggaggtgggatatttttcagtctccactcaacctcctcc

SEQ ID NO: 46655 - DNA, 201 bp, Homo sapiens
accctgggtagatcccagagccagagatgtgggccctgcccagcatccctgagacccataccagctgtacttttctttcccagatgcagtgcccaggcccrtggtacaagtgttcattgctgtagaaagggatgctcagccctccaagacctgccaggttttcttgtcctgttgggcccccaacatcagcgaaataaccta

SEQ ID NO: 46656 - DNA, 201 bp, Homo sapiens
agacagcggcaacttctccgtgttgatggtggacacaaggggccagccctggacccagaccctccagctcaaggtgtacggtgagtgtgtctgacactggytgcctggccctcttcccccacaaagcaccagacgagcatcctgagtcatagcagccagggagagctgggttccagaaagctctggtctctgaccatgttg

SEQ ID NO: 46657 - DNA, 201 bp, Homo sapiens
gtgttgatggtggacacaaggggccagccctggacccagaccctccagctcaaggtgtacggtgagtgtgtctgacactggctgcctggccctcttccccmacaaagcaccagacgagcatcctgagtcatagcagccagggagagctgggttccagaaagctctggtctctgaccatgttgccgactcagggaacagctg

SEQ ID NO: 46658 - DNA, 201 bp, Homo sapiens
cccagctgcctatgccagacgtctgggcagggatccctcgacctgggtgagaacccagaagctgagggtgggtaggaaagactagaacaagctcttgggcracattttaagctaggcagatacaaagagatgcagggtcctgggagggaggaggtggcagcttgaggggtattcttatctgtgagacatgagctgttttgt

SEQ ID NO: 46659 - DNA, 201 bp, Homo sapiens
gacatcctgttctgagtcaagattcctccttctgaacatgggactttccagaaggaccacagctcctcccgtgcatccactcggcctgggaggttctggaktttggctgtcgagggagtttgcctgcctctccagagaaagatggtcatgaggcccctgtggagtctgcttctctgggaaggtaagtggggcaggcagata

SEQ ID NO: 46660 - DNA, 201 bp, Homo sapiens
agaaagggagtcagcaaggaggagtcactgagccctcactatggtgggtgtgtcccagaaggcagggtctgggtccagcctctaagcatggggacaggcartgctgattcctgttcattctctccagcagagagaagggcaagagggaacagctgagcctgcactccacctgaaggccccatctgctgtgggagggtattg

SEQ ID NO: 46661 - DNA, 201 bp, Homo sapiens
gtggaaagccagacaagattttggaacaagagaggcctagccagaggtggcatctaaccctgggtagatcccagagccagagatgtgggccctgcccagcmtccctgagacccataccagctgtacttttctttcccagatgcagtgcccaggcccgtggtacaagtgttcattgctgtagaaagggatgctcagccctcc

SEQ ID NO: 46662 - DNA, 201 bp, Homo sapiens
tgttttcaacagcctgtgggggagctgaggtccctccctacaggcctttataaggggaggcaagtactaagtagggatgagagaggctaaatgtggcccaygtggacttaggggtggccgacggtggtgtgatgttgggatggctgatacacggggtctcctccacaccgggcgatccctctatccatctgatgcctgagt

SEQ ID NO: 46663 - DNA, 201 bp, Homo sapiens
gcagagtgtgttttcaacagcctgtgggggagctgaggtccctccctacaggcctttataaggggaggcaagtactaagtagggatgagagaggctaaatrtggcccacgtggacttaggggtggccgacggtggtgtgatgttgggatggctgatacacggggtctcctccacaccgggcgatccctctatccatctgat

SEQ ID NO: 46664 - DNA, 201 bp, Homo sapiens
atttactcctgtgcactcccctctgtggctgggtaattaatatggtgtgaaccagtgattagcaagtagagagaacctgcctgccacagacttaacccttycctgcatctgggaagaattgctgccttcttagttcgtctttctccagtggtcacatgggcagagagtttttccctttggggaggtgggatatttttcagt

SEQ ID NO: 46665 - DNA, 201 bp, Homo sapiens
gtcatgctgtgggagtctccccactacttacccgtgtgctcagcctgcccctcctggcacataatgttgactaaggcacagcccaaggggaggcagccacyataactttcctagatctagggatagttattttttgtcattttagaggcccttccttcaggctgcatgcagaacagatgcaggtagccatgaagccaaatc

SEQ ID NO: 46666 - DNA, 201 bp, Homo sapiens
gagggtattgccctggcccctggcccctggcccctgccccaagagtccccaggatttgtgataagaaagtggaagccaggaaaacagcagggaaaaaatasctttattgagatataattcacatagcatacaattcacctatttaaagtatacaattcgatgccttttagtgtattcgcagagttgggcatccaccttcac

SEQ ID NO: 46667 - DNA, 201 bp, Homo sapiens
ggtaccatttaccaaacctggaaatacagaaagagttagttttggctgggcgtggtggctcacgcctgtaaccccagcactttgggaggccgaggcaggtygattacctgaggtcaggagttcaagaccagcctgaccaacctggagaaaccccatctctactaaaaatacaaaattagccaggcatggtggcacatgcct

SEQ ID NO: 46668 - DNA, 201 bp, Homo sapiens
ggaaatcacaccttaacctcaaaaaaggccttggtctgtttggtgagacaaaaataatttgccttttttttttttctttgagacggagtcttgctctgtcycccaggctggaatgcaatggtgcatctcagctcactgtaacctctgcctcctgggttcaagcgattctcctgtctcagcctcctgagtagctgggattac

SEQ ID NO: 46669 - DNA, 201 bp, Homo sapiens
tttaagaatggaaagcagaggtagcagctgggaagagggtagccatgagggagataaagattgtaagcaaattggggagatgtcttgaatccccccaagasagctaactggctgtccttgggcgagccactcagggtgccaatgcaattgcaaggtgcctttctggatgcacgcagccctgagcctcatcttggcaagcag

SEQ ID NO: 46670 - DNA, 201 bp, Homo sapiens
atataccatcttctgtgaactccttaaggtcaggggctgagcctttcatctctgtgtccctaggtcctggcacctaagtagatgctcaataaatgcctgakgaatgaatgacggaattggcaatggagtcgtaaatgagttccctcccttgccctctccacccccatgacaggcagcttcccagttctgccctttcctcag

SEQ ID NO: 46671 - DNA, 201 bp, Homo sapiens
agccatgagggagataaagattgtaagcaaattggggagatgtcttgaatccccccaagacagctaactggctgtccttgggcgagccactcagggtgccratgcaattgcaaggtgcctttctggatgcacgcagccctgagcctcatcttggcaagcagagtgctggctggatttcagcaccccccaccccctgccacc

SEQ ID NO: 46672 - DNA, 201 bp, Homo sapiens; identical to SEQ ID NO: 10416

SEQ ID NO: 46673 - DNA, 201 bp, Homo sapiens; identical to SEQ ID NO: 10417

SEQ ID NO: 46674 - DNA, 201 bp, Homo sapiens
acactggttataattattggtttatatataccatcttctgtgaactccttaaggtcaggggctgagcctttcatctctgtgtccctaggtcctggcacctragtagatgctcaataaatgcctgaggaatgaatgacggaattggcaatggagtcgtaaatgagttccctcccttgccctctccacccccatgacaggcag

SEQ ID NO: 46675 - DNA, 201 bp, Homo sapiens
ccaggcttttttcacttagtgtcatgtcctcaaggctcataaaatagcatctttggccactgagaagggacccaacaacctgggatagtagaaagctccaygcagggagtccagaagctggttctggctctgcctcatggcttctgtccagtgatttaactgggtccaccacagtcctaactttccataccttctacaatt

SEQ ID NO: 46676 - DNA, 201 bp, Homo sapiens
ggatgttttcacttttgggacatcctgttctgagtcaagattcctccttctgaacatgggactttccagaaggaccacagctcctcccgtgcatccactcrgcctgggaggttctggattttggctgtcgagggagtttgcctgcctctccagagaaagatggtcatgaggcccctgtggagtctgcttctctgggaaggt

SEQ ID NO: 46677 - DNA, 201 bp, Homo sapiens
aggctccctggagactctgtaccattcccgcttcctgggccgagcccagctacacagcaacctcagcctggagctcgggccgctggagtctggagacagcrgcaacttctccgtgttgatggtggacacaaggggccagccctggacccagaccctccagctcaaggtgtacggtgagtgtgtctgacactggctgcctgg

SEQ ID NO: 46678 - DNA, 201 bp, Homo sapiens
tggaagcaaacgatggggagaaagagctcacggtctagtgggagatgctgactcataaacaggcaataagaatagagggataagggtagtcagcatggtgrccccaggccactgtgagaacacaagagagaatatgtaacctctcttggttacattacctatgagggataggggaggtcggaggaggcagtgatgctacaa

SEQ ID NO: 46679 - DNA, 201 bp, Homo sapiens
gagcagtaaaaacggagccagtgggtgatactgctggtttggagagaaagtcggctgtgagaatggtgaggacccggcagtgttagcatgcagaaactctrcagagtttgaggagagtagcagagggcagggcagagcagggttccccacaatcagcagagtgtgttttcaacagcctgtgggggagctgaggtccctccc

SEQ ID NO: 46680 - DNA, 201 bp, Homo sapiens
gaccaggagaaatgttcctttacctaaggtgaccttgggctaacacactgaggattcagaggcctgcaggcaggccaaggattccaagactccaaacactrgaggggtaactttctttctgatgtccttaccagggaaaaagaaaaaggatgtccatgctgacagagtgggtccagagacagagaacccccttgtgcagga

SEQ ID NO: 46681 - DNA, 201 bp, Homo sapiens; identical to SEQ ID NO: 10420

SEQ ID NO: 46682 - DNA, 201 bp, Homo sapiens
ttttgtggcccagagcagtaaaaacggagccagtgggtgatactgctggtttggagagaaagtcggctgtgagaatggtgaggacccggcagtgttagcaygcagaaactctgcagagtttgaggagagtagcagagggcagggcagagcagggttccccacaatcagcagagtgtgttttcaacagcctgtgggggagct

SEQ ID NO: 46683 - DNA, 201 bp, Homo sapiens
agctgagggtgggtaggaaagactagaacaagctcttgggcaacattttaagctaggcagatacaaagagatgcagggtcctgggagggaggaggtggcascttgaggggtattcttatctgtgagacatgagctgttttgtggcccagagcagtaaaaacggagccagtgggtgatactgctggtttggagagaaagtcg

SEQ ID NO: 46684 - DNA, 201 bp, Homo sapiens
attgtctccaaccctgtcagctgggacttggccacagtcacgccctgggatagctgtcatcatgaggcaggtatgctaagggccagcagtcagtggttgarggcttatgaagcatcaagtccacctctaaccccacccctccatgttcagcaccagggaaggcctcctacaaagatgtgctgctggtggtggtgcctgtct

SEQ ID NO: 46685 - DNA, 201 bp, Homo sapiens
acagcctccagggcacacatctgacattgttcttgctacactggttataattattggtttatatataccatcttctgtgaactccttaaggtcaggggctragcctttcatctctgtgtccctaggtcctggcacctaagtagatgctcaataaatgcctgaggaatgaatgacggaattggcaatggagtcgtaaatgag

SEQ ID NO: 46686 - DNA, 201 bp, Homo sapiens
gggggaccggaattatcatggccgactgagcaaccatccagatcatgtctcattgaccaaaacttcatcacctcttattcttccctacaccctgtgccagygacaggcatagggtcagtcctcagcagggtaggtcatttattcaataccatttactaggcttctcccacagtctgttcttaaacagtggtgggcactgga

SEQ ID NO: 46687 - DNA, 201 bp, Homo sapiens
ggaccacagctcctcccgtgcatccactcggcctgggaggttctggattttggctgtcgagggagtttgcctgcctctccagagaaagatggtcatgaggmccctgtggagtctgcttctctgggaaggtaagtggggcaggcagatagcctgtcctcggagagctgaaggcccctccccagctgcctatgccagacgtct

SEQ ID NO: 46688 - DNA, 201 bp, Homo sapiens
taattgcacgaagctgccaagcagccgtccttaggagttctgctttgacaatagataagaacgatttgaattagcagatcagttactagaaatgtcaatgkgtgtttctactgtgcttgatcgtgtttggaagcagcttgtcctcttaagtgatgtaaatatcccccctgtaatctttgtttatactattagtgtgcccag

SEQ ID NO: 46689 - DNA, 201 bp, Homo sapiens
tgtgtgggggctgttgtcgccacgtgttagccaaccatgtgcatgtgaaagaggctgacttacaagaatctgctcctgtaagcccagagaggcccagggayaacttccactttattctggatgttttcacttttgggacatcctgttctgagtcaagattcctccttctgaacatgggactttccagaaggaccacagctc

SEQ ID NO: 46690 - DNA, 201 bp, Homo sapiens
tgtctcactagtgttttgccacctgtatgtagcccgtggacagcagactcttctgcagctcttacccttctcacagaggttgtggtgaattgatttaaatrtttaaaggttctaagagacttgccaacagaagagcataataaagagaacaagaaaatctcgaaagccatattttataattatatgaaaaccatcattcac

SEQ ID NO: 46691 - DNA, 201 bp, Homo sapiens
atatctctgctgaagaggacaggacatcctcaagggatcccatggacaccctgtgttggggagtggggaggaagaagtgaccagaaggggcagggagcagyggacagtccaccccggttcctcacatgctggggaaccctgtcactgtacctcgcccccggtaggtcacgttctttctaaatgagagcatgatttctctcc

SEQ ID NO: 46692 - DNA, 201 bp, Homo sapiens
gtgagctgcatactccatcgctagatcgaaagccaaatagttttgttgcggtgagtgtcaccacccctcctcaggcattctggacgaagcatgcacagacrgagatcattgaggtgggtgctggtggtctctctctgaggggctgtgggacatgctctagtggtgtctcttgtcctgatgttcagttacttgtgcatctgt

SEQ ID NO: 46693 - DNA, 201 bp, Homo sapiens
tgtagggcagaggttccatccttggagaatcaagccaagaagagcaaaggctactgctcccatccagcaccctgttcataaagtggaagtgtcactccgasagaagtgggacacagtctgtgcgcccagctctagaacagtgactccaacattttcccaagtaggagaggtaggctataataacagaaagctctgaagctc

SEQ ID NO: 46694 - DNA, 201 bp, Homo sapiens
tgagtacatgcactgtgtgtgtgtgtgtgtgtgtgtgtgtgtgtgtgtgtgtgtgtgtgtgtaaatggtgtagtttgttggctgtcagccttactaggagkctggtttggagcctgttgccttagctctgtggggtgatgatgggaatagtgaaaaagagggtgacaaaagcagagagtctcaaagaggggacagaactca

SEQ ID NO: 46695 - DNA, 201 bp, Homo sapiens
tactcctctcatggcctcagcctggagggagctgatgtgggaggaatctgtgggccctgacctggaatgctgcacagtggcctctgccagtgacaggggcrggcaaggctgagtctagaagcaaatgccagcccacaaatgtgcagtgattggcgcctacagaggccagggatagctaagtactgtggagatataaaatgt

SEQ ID NO: 46696 - DNA, 201 bp, Homo sapiens
gtactcctctcatggcctcagcctggagggagctgatgtgggaggaatctgtgggccctgacctggaatgctgcacagtggcctctgccagtgacaggggygggcaaggctgagtctagaagcaaatgccagcccacaaatgtgcagtgattggcgcctacagaggccagggatagctaagtactgtggagatataaaatg

SEQ ID NO: 46697 - DNA, 201 bp, Homo sapiens
tcagttgcccacagggcctgaggtctggggtgaggaacacctggtccagatcaaagagcttttagggtgtggggctggatttttgcatacaggttacatcrggagtccaggagtaaaattaattcttagaaggccagattacataaaaggcaaggcagagagggttctgcaaacactaaccgcctcttgggtgtctgatgg

SEQ ID NO: 46698 - DNA, 201 bp, Homo sapiens
gatgaggcttcacttttccacaccttcctgaccctccctgtccccaaagcagcgatgcatctgaaatggcctaaaaaggcgtggaaacccaggggttcctrttctggcagaagttcctcagttgcccacagggcctgaggtctggggtgaggaacacctggtccagatcaaagagcttttagggtgtggggctggattttt

SEQ ID NO: 46699 - DNA, 201 bp, Homo sapiens
aggaagcttgggagacagaggagggccaggagatccatcctgggtgcaacttcatgctgcattctgtgtgtgccgagagccacagaggggatttaagccasggagttattagcccattagatttacaaattaagagagacctctaaaaccccatgggcggtgtttcaagttctgaggtcatctttctttctcagctattta

SEQ ID NO: 46700 - DNA, 201 bp, Homo sapiens
atgaagtgattcaacacactgggaggtgaatgactttgtggcttgggcagcatatttattgtagagttcatggtggatattcatcttaagacttctgttaygatgtatttaggccactgtttctgctgaatgttctggagtcatctgaatctcacagttttcttgtgcatttccttatacattatcagatggttcttcctg

SEQ ID NO: 46701 - DNA, 201 bp, Homo sapiens
tcctgcagtggctcagctttgttaaagatgaagagttaaagatgacttaggcccttctcctaaggagctacaggagacaagggtgtacactgtatcagaakttttttttctttgtggcaacagaaagggccatgtcacaataagcagagggtatttatttctgtctggaagtgggtgaaactttacagggaaattgctgtt

SEQ ID NO: 46702 - DNA, 201 bp, Homo sapiens
cgctgcagcctcaaactctagggctcaagcagttctcccacctcagcctcccaattagcaaggactacaggcatatgccactgtgcccagctaattaaacaaaaatttttttttttttttttttttgtttaaatgaggtcttgttatgttgcccaggctggtctggaactcctggcctcaaatgatcctcctgccttaacc

SEQ ID NO: 46703 - DNA, 201 bp, Homo sapiens
gtttggaggggacaaacattgtcctcttgtgcctgtgccacacttgcccctccgtccccctcatctgctgatgattcatcacactgttaacttggtctctmcatctgtttaaacgctttctcctttcccctattatgttgctgttaagactgtgaagctgtcagcaatgttagcgacaccgtccacatgtggggacaacag

SEQ ID NO: 46704 - DNA, 201 bp, Homo sapiens
ttttcaaagtgctgggattactggtgtgatccaccatgtccagccaacacacagacattttattttttatttatttttaatttttaattttttaaaatttytattcaagacagaatcgtgctctgttgcaatcttggctcactgcaacctccacctcccgggttcaagccattctcctgcctcagcctcccaagtggctgg

SEQ ID NO: 46705 - DNA, 201 bp, Homo sapiens; identical to SEQ ID NO: 10421

SEQ ID NO: 46706 - DNA, 201 bp, Homo sapiens
actgagctctaaccacattagcactaattattgcggaaggaagggcacctgaggaggaaacatgctagagaagggtccacacagcatgtttcaaaatgcartggttcatgaaatcaatttgaggttgtaactggcattaaaaagctttttgaaatagcaaatatccaagtacgtttcctatgggaaggataagcatttttt

SEQ ID NO: 46707 - DNA, 201 bp, Homo sapiens; identical to SEQ ID NO: 10426

SEQ ID NO: 46708 - DNA, 201 bp, Homo sapiens
cagtaccagaccatcatcctcacataccaggagaacctgaccgacctccatcagtacagaggtgggtgcacccccatgctgtcaccacacacgcgtgcgcrcacacacacacacacactctcactctcactcagtcactccctctgctttcccagccagggatctggaacacagggtcacttacacattcccactgacaga

SEQ ID NO: 46709 - DNA, 201 bp, Homo sapiens
gaacatgtgcccaaggtggtcaggctacaacttagttttatatgttttaaggagacataagatatcaatcagtacatgtaagatgtatattagtttggtcygggacaacttgaaatgatgggacttcagcttataggtggattcagagattttctgattgacggttgaaagtgttaagttattacctgaagacctggaatc

SEQ ID NO: 46710 - DNA, 201 bp, Homo sapiens
tgtcacggtgatgtctttatgcacaggcactcactctgaagtcactcaccctctcaccagctcatggtggagatgcagtaaaaagatcttgaataaatgayttctgctagttcctctctgagtcctgtagtggctctaggtcaaaagcagtaaaacctaaccagaggaaaaaaccagaggggaaaatattttggacacacg

SEQ ID NO: 46711 - DNA, 201 bp, Homo sapiens
catcccctggggataaggggttgtggggcagcagtgccagccactcaggtactgagtccttccatccccagtttgagcagagctgctctccttttcaggcwcttatttctttttgtttgtgtgtatgaataaagggtccctggctgaatagctggaatatctttagtcaggtctaagcctatatctcatggatggggagac

SEQ ID NO: 46712 - DNA, 201 bp, Homo sapiens
gcagagaccatgagaacaggagcttgtcttacttgatagtgcaaacagtcttacaaatagtgttcaaccatcgattgcccaaaacacgtgttttgtgactrttattgtaggtgcctttgaactgtatggtgtgttaaataactccattggagggaggaagatctttgtgttttgagttgattatttaattattctttaatt

SEQ ID NO: 46713 - DNA, 201 bp, Homo sapiens
cgtcagaactgttaagaaggtgtcctcatgctctttagcagggaccggagttcaaacagcagatttgtcacatgctcgccacaagctgggccccctactayccactttatgtggattctctaatctgatccccacagcagccctgggaaatgggcaccggtttcacacccacttggcaggtgaggaaactgaggcatggag

SEQ ID NO: 46714 - DNA, 201 bp, Homo sapiens
gacaaaaatttagaacctgattaagtgagaccttgtaaatagaaagcctgaagttccagggtgtccccaggttccctggatgaatcagatgagcccaggcyaccatcagccacccttcgggatgtcagggtaaagctgactgaggctggggtagcatcagctgtgtcatatcaggattcaagggcttcaggaagccctggc

SEQ ID NO: 46715 - DNA, 201 bp, Homo sapiens
cactggatggttgagaacaacagagaagaaggcaccaaagtgaatgcccgggcttttagcctgcttggaaagggagtcagaggtggccttagccaagggcrggtggagggagagatgagttggttgaggccccagcagcccacccaggtggagctgtccagtcagcttgaccacctggatctggatctccagagagaaaaa

SEQ ID NO: 46716 - DNA, 201 bp, Homo sapiens
taaagcactgtgttaaggactgaattgtgtctctccttcagattcatatgttgaagtactaacccccaatgtgaccgtatttggagatggcgtctgtaaasagataattaaggttaaattaggacataaaagtagaaccctaatctcatagaactggtgtccttataagaagagacctcatgaaagagatgacagagaaaa

SEQ ID NO: 46717 - DNA, 201 bp, Homo sapiens
gtcaccatccctgagggccgggggaggagaacccatgaggcaggtctgcagccagttcatttgcagcctgtctcccttgtcatcccacctcagtgttcggyggtgccatctgccgcatgtaccggtttccaaccactgatggtaaccatttgcggatcctggagcagatggcagagagcgtgctctccctgcacgtgcccc

SEQ ID NO: 46718 - DNA, 201 bp, Homo sapiens
cctaacttaacgtttaaacaaggcttgagcctgggcaaaatagtgaaacttcatctttactaaaaattaaaaaattagctgggcatggtggtgcacacacwtctgtagtcccagctgctcaggaggctgaggcaggaggatagcttcagcccaggagttcaaagttgcagtgagctatgattgtaccgctgcactccagtc

SEQ ID NO: 46719 - DNA, 201 bp, Homo sapiens
cagcctcaaactctagggctcaagcagttctcccacctcagcctcccaattagcaaggactacaggcatatgccactgtgcccagctaattaaacaaaaawttttttttttttttttttttgtttaaatgaggtcttgttatgttgcccaggctggtctggaactcctggcctcaaatgatcctcctgccttaacctccga

SEQ ID NO: 46720 - DNA, 201 bp, Homo sapiens
gtgtttgggtggaagaagaaaagggaagagaaatcaccatctttggcaatgaataaggcacacccagcctgctttggggtttagagcctcctgcactcccrcctccaccatagaggagccagactgggttcatgctccacagtcttccagctgcgtctcctggaatgaacctttgagtaacaactctgagtgagtgatgat

SEQ ID NO: 46721 - DNA, 201 bp, Homo sapiens
acctaaaaccagaggagactttcagtggtgagggccagtgggagtggagctgggggcgtgaggagcaggcacaaagtcctgagcctggtcctgctctggcrtattgttcgtggtagtaagccatctgagccaaatcctcctgatgaggagtcctctgcacagccacactgacagacaggagagacagtggcaggcagtgtg

SEQ ID NO: 46722 - DNA, 201 bp, Homo sapiens
aagactgaagtccttttgtgtctctgctaagtgttcaccccaacactgaatgtttcaaacaggattccattttcacagctaaaataaacaggttatacacyactttgccagagatctacatgtagtaaagttgctgaatgtgtgaccactttgtgtttccatgggacctagaggaccaagatgtctctccctgatttcagt

SEQ ID NO: 46723 - DNA, 201 bp, Homo sapiens
aatgtaagaatcagatatatgctggtgatgctgtgtgaagcagcagagctgctgtgaactctctggggtcccaaaagtctaggaagtttggaaaatcctcytccttgtctaggcctgtgcttccctgtcctctctgtttgctttgcttcctctgtctttctcctttccttgctcttggttatcttctgaaagatgaggctt

SEQ ID NO: 46724 - DNA, 201 bp, Homo sapiens
gtttttaaggaaaataccatcatgaagctaatcccagggaatttacctatatttctattcatatgcacatgttattctctaattttttttttttagtattwtgatatagtttcagacttacagaaaagttgcaagaataagccaaaggtttctcagattctccaaatgtggacattctgttacactgctttatcattctct

SEQ ID NO: 46725 - DNA, 201 bp, Homo sapiens
gaaatgatgggacttcagcttataggtggattcagagattttctgattgacggttgaaagtgttaagttattacctgaagacctggaatcatagaagggawtgtttgggttaagataaggggttgtggagaccagggttttatcatgcagatgcagcttccaggtagtaggctttagagctcttatacgacctaaaatcgt

SEQ ID NO: 46726 - DNA, 201 bp, Homo sapiens
tgcttttctcacctggggtgggggctttgggaggaggggagcagtactacccatagtgggcagggatgggcctctggggcggggggagcctgtgtgtccaycttgcctgccactaattttaaataacagtgtggaatgctgttataatggtttttattttaaatttttttccacaaatgcactatcttctcatttttttat

SEQ ID NO: 46727 - DNA, 201 bp, Homo sapiens
cagtttagtattccagaaaagttgccacaacatcatcaactactcatggtgtcaggaggctttgactttcactgagaaaaaaatagcacaaatctgcagcraaaaaggcttgattatgttggtgcttctgtagaacttgattaatgagctggtcttgagagagccttcgaaacggctttttttttcagtgtcctaaaacag

SEQ ID NO: 46728 - DNA, 201 bp, Homo sapiens
cttgatggcctgccgcctcttgtcggaggggtcacatgagtgcgcagagtgaggaatgggagctgctcacttcatgggttattgcttcttttttcttgacyccaagaaaaaattccagccccctagacagctcccacacattctgtctcctcttctgcttaagtgcagtttttcctcctaatgaactctggtcttcaaatg

SEQ ID NO: 46729 - DNA, 201 bp, Homo sapiens
ccaactagattcagaaccaagggcagatattatagtgcctccctgttttcaaaactggatattttgtagtattgctgttaaactgaatattagcgtttttwaaaaaaaaatcactttaaggaaggatgaaataaaataatacacgagagctatttgtaaactgtagagcactagaaaaatgggatgtgtatgacagagaac

SEQ ID NO: 46730 - DNA, 201 bp, Homo sapiens
taggatgtatagtgcacaaagcactttttataacttttactcacataaggaattgaaaatccttgtaggaaaattaggaaatacagataagcccctacacwagttcctcagaaccctcccacaaagaatcccccagtttcctaatgtgaacaggtagcgctgcggacatttggatacatactgtctagataagagacatgc

SEQ ID NO: 46731 - DNA, 201 bp, Homo sapiens
ttcttggtctcctcctctcttgaccctcttctgtggattggaaacattgtgagaaactacgtcccttgcttgcattggcagcagacactgttgaagtcctsggagaacacgatgctgtgaacagaccgaggggaggaatggtggctgctcctcacaagaggaaggggtcctgggcacatttggactttgcctcctggagtg

SEQ ID NO: 46732 - DNA, 201 bp, Homo sapiens
aggagaccagtgacaaagtggccccctggagagccacagtgcgatggcaggcctgtcactgagcccagacccgcaagggccccatccgcctgcccctagcmcacttgggttgtgtgctcaggacagccgttacagttacagctgttaggatgtatagtgcacaaagcactttttataacttttactcacataaggaattga

SEQ ID NO: 46733 - DNA, 201 bp, Homo sapiens
ccctgtggtccatgcctcaaaacacctcatcattagtattacttctgagccctgcctaaacatagcagcgtggaccagctctcagtcctttctcttcctgkccctaccccaccttcctgttggctactctgctcccatggatggttgagagggagaccctcttctgtgtggctagccaaggttgcacattggctgcaccca

SEQ ID NO: 46734 - DNA, 201 bp, Homo sapiens
tccttccatccccagtttgagcagagctgctctccttttcaggctcttatttctttttgtttgtgtgtatgaataaagggtccctggctgaatagctggartatctttagtcaggtctaagcctatatctcatggatggggagacccagcagtgcaccacaagtggctggtgtccctctgggatggaagcctggcactgca

SEQ ID NO: 46735 - DNA, 201 bp, Homo sapiens
ttgtttagagaacttgattcaggaaaaaggaaccatctttggtaaaatgagagggatcatgtaagggaaagggctttgagaaaaatatttagttacgtcaygtgtcagagttaactctagttgggttagagttaaatgtacaaaatagacatcattctttttaaaggagctaaaggcggctgatgattgaacagatagagc

SEQ ID NO: 46736 - DNA, 201 bp, Homo sapiens
ctaatcagtggacaggatcagagccctgcagcagcccttagtttgtttagagaacttgattcaggaaaaaggaaccatctttggtaaaatgagagggatcwtgtaagggaaagggctttgagaaaaatatttagttacgtcatgtgtcagagttaactctagttgggttagagttaaatgtacaaaatagacatcattctt

SEQ ID NO: 46737 - DNA, 201 bp, Homo sapiens
gggtggatggcttgagcccaggagtttgaggctacaataagcctgatgtcattgcactccagcctaggagacagaacaagaccctgtctctaaaagctggaaaaaaaaaaaagtacaaaaccccaaaactccaaaggactgagttctgggagcttttggatagctgagcatgcagaggttcccggagagtggcacataggg

SEQ ID NO: 46738 - DNA, 201 bp, Homo sapiens
cggggtttcaggtgagggagtttgacacttcactggttcatatgtgacatactccagaggtatttgcgacctggtttagtcctgacccctttattgttctmgtggagatactttccttcctctcttcttctgtttgaaactaggactccacatcttgccctagaattgccacccacctgtgtgacgcctgggcctccgagt

SEQ ID NO: 46739 - DNA, 201 bp, Homo sapiens
cctggcttgaacctgtccctgtcccttgatgttgggaagcagagattccctgtcatgtcagatgactcagaggggccctaggatgctgaggcaccaagtgrgggctgtcatttacacaccgtctgtcgataacattggtaccaagcagtatagggtcttttatcctggagattctgaacctctgtgatggacccctgaggt

SEQ ID NO: 46740 - DNA, 201 bp, Homo sapiens
gccctgggggccgctttgctctccggagtccttcccctgccccccattcgccagcttgtccacccatataagtttctcagcccccttgcctcaagcttctscagctcctccaagcatggcctgtactctccctgtacagctcggtgctaaaggaagcaacctcagtaacactccagctccaggtccctctctggcctagca

SEQ ID NO: 46741 - DNA, 201 bp, Homo sapiens
agggatatgccaacacccagccctggcttgaacctgtccctgtcccttgatgttgggaagcagagattccctgtcatgtcagatgactcagaggggccctrggatgctgaggcaccaagtgagggctgtcatttacacaccgtctgtcgataacattggtaccaagcagtatagggtcttttatcctggagattctgaacc

SEQ ID NO: 46742 - DNA, 201 bp, Homo sapiens
cacgcaccctcaaagcggggggtggttgggggagggcattaatgtatacatgagggatctgcccccatgacccaaatacttcccattaggccccacttctracattcgggattaaatttcagtgtggagtttggaggggacaaacattgtcctcttgtgcctgtgccacacttgcccctccgtccccctcatctgctgatg

SEQ ID NO: 46743 - DNA, 201 bp, Homo sapiens
ggctgctatttaatctttcaatttatggtataaaatcctttatagtacaggtaatgctgcagtgagcatccttgtctgagatcccaccgagagtagtggcytcagtcttccaatcagtggcttttctctcacttggctggcctcttgaagcgaacagagtgtgtgtgtgtcctggtagctgagtaaactccagctccgcac

SEQ ID NO: 46744 - DNA, 201 bp, Homo sapiens
cctttaggtatctggtctccagccacagtcagggaggctctcagctggggtgctgggacccagccctggggtgtgtgtggggaggagccctgcttgggggmggggtggcgctcctggagacctctcctggctcagaggggagtgatgggcattctgaagcgtgtccagcagggcccacctccctctgcgctcatggtttcc

SEQ ID NO: 46745 - DNA, 201 bp, Homo sapiens
gtggccaaagggcagtgcaacttctgagctgctcccgtctgttcaggtgaaagaggagagtagagatagtaggtctgttccctaccttccagggagacctrgagacctggcccaggactgtgggcatcctgagagtggctctggcttccccagtgggtcatatttgccgccctctttccctgagggatcagcagtgaaggg

SEQ ID NO: 46746 - DNA, 201 bp, Homo sapiens
acaacctaaggatggtacagttccccagttattaaaattttgcatacttactataaagggtttagtaaaacatagtctagaggaagaaaaccagaaaagcrtgatgtgtccatctcccagtgcttaacatttttatacgtgttcttttcctctctcccactccgcgtgagtgcttctatgtctttatattggtagatctta

SEQ ID NO: 46747 - DNA, 201 bp, Homo sapiens
tgtgggctgcatcaggatctttccaggtatgccaggaggcacagaacccacgtataacctgcagcccacagtttctgtgacacagaaagtgtggtcaggtrctgggaaatcattgtctcatagataaaacatctgacacgcaccagcttttctgaaacaactaatggttgcaaatggaattcggggtacacaggatagcaa

SEQ ID NO: 46748 - DNA, 201 bp, Homo sapiens
gcacagaacccacgtataacctgcagcccacagtttctgtgacacagaaagtgtggtcaggtgctgggaaatcattgtctcatagataaaacatctgacaygcaccagcttttctgaaacaactaatggttgcaaatggaattcggggtacacaggatagcaacagatttcttcctgtccttgaagaaaactgtctccttt

SEQ ID NO: 46749 - DNA, 201 bp, Homo sapiens
ccagtttggtggcaggggcaccaccagggtagtgtgggaatgtccaagtgttttgctggcccatgcccaggccatggtaaaagccctccctgttgtggatrtgtagatctgaggaggagcaggggtttggttgtggggtcagggacttcttagcaatctcaaaaacaaaatatttttaaaataaagaaattgtcttgcatg

SEQ ID NO: 46750 - DNA, 201 bp, Homo sapiens
taaagaaatggatgtggacaaattcaaagagaaagaaacattgtgtttctactgagctccttatagaattagtctgcttacctggccaccttactcatcawgtagctacttttttcatttagattattctgtctcagggtgtttaatctgcttgggtaagtcttgtttcccaactagattcagaaccaagggcagatatta

SEQ ID NO: 46751 - DNA, 201 bp, Homo sapiens
  misc_feature (1)...(201): n = A,T,C or G, or insertion/deletion polymorphism (see Tables 1-2)
gtgctgcctttctgtggagcctcgcctctaagcacggcccatgtttctgttggcagatctgccgccgccttaatggggtccggttcaccagctgcaagagngctaaggaccgtacagccatgtcggtgacactggagcagtgcctgatcctgcaacacgagcatggcatggccccgcaggtcttcacccaggccctggagt

SEQ ID NO: 46752 - DNA, 201 bp, Homo sapiens
atgaagaggaagacaagtgggttttcctcccgtgttggaggtctctccttcccctgcctcctgtgccttctatggccttgggatgcttgagaccagtcagwgctctgtttgctgttagattttccagggctatgtgtatttggggacgtgggagctctggtgctggggcaagtagatatggattttggagctgccgccctg

SEQ ID NO: 46753 - DNA, 201 bp, Homo sapiens
aaaactaagctagaaatagtactggggaaggaaggtgggggtggggaaggaagtgagtgcaaggtggggccgttctgagggctgaaaacttgggagctgtrgggaatagtcctcctccaggtgtgcaggggtaagaattgaacacagttgcacacaaggcttggcaagggcagaggagtctctgacttgactttataccca

SEQ ID NO: 46754 - DNA, 201 bp, Homo sapiens
ttcatatttcatctccatgtgaccttgaaaaaaatcactctgagcatccgtgacctcatccgtgcaactccttttaaaaattattcttagaagaaccccartgaataagcaaaagtggagctctgatgtgttaatcctcacccctcaactccagctccggggagcctgagaggttcctgaggtggagggacctgcagtact

SEQ ID NO: 46755 - DNA, 201 bp, Homo sapiens
aaatggcattacattaagctaaaaagcttctgcacagcaaaggaaacaacaaagtgaaaagacaaactgcaggattgaagaaaatatttgcaaactatacrttagacaaggggttaacatcagaaacatacaaggaactcaaacaactcaattgcaggaaacaatccaatttaaaaatgggcaaaagacctgaatagacat

SEQ ID NO: 46756 - DNA, 201 bp, Homo sapiens
attcagaaccaagggcagatattatagtgcctccctgttttcaaaactggatattttgtagtattgctgttaaactgaatattagcgttttttaaaaaaawatcactttaaggaaggatgaaataaaataatacacgagagctatttgtaaactgtagagcactagaaaaatgggatgtgtatgacagagaactatcagcc

SEQ ID NO: 46757 - DNA, 201 bp, Homo sapiens
ctgttcttcatgtgtcctctgtcctctggaagatgacttcctgagggagaggccacagcacatatgtctgtgtcccctcccctagccccagcccagggctyactgagggtctgtggtgggtcttcaaatctgtgcatcctcagtaggaagcatctgcagaaaggaggagtgaggtttgagaacctgatattctcctcttac

SEQ ID NO: 46758 - DNA, 201 bp, Homo sapiens
gaaagaggaaagtgtttacccgctgccagctccggtcctgggatcctcctagagcgctttccctgagacacctggtagttttcctgacctccggttgctgyagcgcccctctttttgcacctcactaggtggtattctgatgtctcctgaaaaccccctgcccctttcctgcccctcccatagccctcacgcaggtggtgt

SEQ ID NO: 46759 - DNA, 201 bp, Homo sapiens
ggcacacaagcccttttgtccaggtggctggaacctaggtctgcttccacttctgggtgagaaggtgccacacctttgggtttggtcatcgtgtgtgtgtggtgtgtgtgtgtgtgtgtgtatgtttaaaattaaaagtaaaaattttccccatatacatgtacacatatatgcaagtgtggtattataggtgcaagggtg

SEQ ID NO: 46760 - DNA, 201 bp, Homo sapiens
tgcccaaggctgtggaagcccacctcttgcatcagcatgacctggatatgagacatggagtcaaaggagatcattttggagccttaaggtttgactgcccygttggatttcagacttgcctgggaccggtagcccctttattttggccaatttctcccatttggaatggctgtgtttacccaatacctgcacccccattgt

SEQ ID NO: 46761 - DNA, 201 bp, Homo sapiens
agatcattttggagccttaaggtttgactgccctgttggatttcagacttgcctgggaccggtagcccctttattttggccaatttctcccatttggaatrgctgtgtttacccaatacctgcacccccattgtatctagaaagtaactaacttgcttttgattttacaggctcataggcagaagggacgtgccttgtctc

SEQ ID NO: 46762 - DNA, 201 bp, Homo sapiens
tctaattccagagatctcacattatattatttaaaatgtgtagttttcaacaagaagttatgagatgttgcaaaaaagaaagtatggctcatacacagatrgaaaaaacccatacagtcagtagaaaccatccctaggaggcacaaatgtttaacttagtagacaaagatttttaaatcagctattttaagtatgttcaaa

SEQ ID NO: 46763 - DNA, 201 bp, Homo sapiens
caaaaaaaattagctgggcgtggtggcaggcgcctgtagtcccagctactcgggaggctgaggcaggagaattggcgtgaacccgggaggcggagcttgcwgtgagccgagatcgcaccactgcactccagcctgggcaacagagcgagactgtctcaaaaaaaaaaaaaaaaaaatttctattcatcaaaaatatctttc

SEQ ID NO: 46764 - DNA, 201 bp, Homo sapiens
ggacactcgccatcttggcagacaaggtaggaggggtgccctgctacatatgggctggggagtttccttgggtttctggaagccaccaggcagcccaggtktacctaagatggtccacaaagagcgtgacattgggatgactttgaaggtctaccttaggtccatttcgcacaaaggcccagggaggttttgtgatttgtc

SEQ ID NO: 46765 - DNA, 201 bp, Homo sapiens
ataggacaataaagaatctgagagcagaggctcacttattcccttgagggcttacagtggttcccaagagaaaggccaagagaaaggattagatggattaracactaagtgtctaaagacacttagtgctttagacagtgtctcagtgagaagtggcagggattgctttctagggtccgttaggggaaggatacttgttga

SEQ ID NO: 46766 - DNA, 201 bp, Homo sapiens
tcacctctcccactttgccttccagttcctctccccagaggcaagcagtttgcccagcatttttgtgagcccttcgggggcagtctgccatatacagacayggacgttttcataccctctttcttctggagtgtgcattcgtttgagcagcttgtttggaaagctgtatatgcaggttgtgaagtcacttttggttttgat

SEQ ID NO: 46767 - DNA, 201 bp, Homo sapiens
atgtgtgactgagctgggtgggtgatgagggcactggatcaatggtcctgtcctgcaaaatgaggagcagattgtgatccacctcagaagtggtgctccaggcaaccgccctatgtagactctgctggcttggcatcctttagagtccctggccagtcagttgagcaccataggcatcgagcctggagcatgttgtttcct

SEQ ID NO: 46768 - DNA, 201 bp, Homo sapiens
tacattgatatttttcatcacatttactcatctgggtggcatttatattgccatatcctttacagttattgattaactgttggcagcttgtttttgaacartgatcctgtaagcttcattgccttgtaagaggtaagacctaattccttcttgtcacctccaattggctgctactttgcaagagtggtgctcattaatcaa

SEQ ID NO: 46769 - DNA, 201 bp, Homo sapiens
gacatccaacttgtttcagtttttaaaaattcctcctgttgagtgtgaaacccatgaaatgagtcctcaggcacagcttgtgtaatgggctgatttattgyatgtggatctgtaatggtctatgtcagacttcttttttctcttttaaaaagcagagtttttttgtttgtttgttttatgtatttatttaagccgccttta

SEQ ID NO: 46770 - DNA, 201 bp, Homo sapiens
ggcttaacatctcaagagttcagtgaggcagagtggagggggaggctttccaccaagactgtttcatcctgttttcgtttttaaatgaaaagctccttttyagtttagtattccagaaaagttgccacaacatcatcaactactcatggtgtcaggaggctttgactttcactgagaaaaaaatagcacaaatctgcagcg

SEQ ID NO: 46771 - DNA, 201 bp, Homo sapiens
tgaccttcagaggaaatgcttattggagcattttggatttcagatttttggattaggtgtgctgaatctgtacgtatataatgcaaatatttcaaaatctwaaaaaaattccaaaccctaaccacttctggtgtcaagtatttcagataagggatactcaacctgtgctaataatgattttggcatgtactctataataat

SEQ ID NO: 46772 - DNA, 201 bp, Homo sapiens
ataatgcaaatatttcaaaatcttaaaaaaattccaaaccctaaccacttctggtgtcaagtatttcagataagggatactcaacctgtgctaataatgaytttggcatgtactctataataataaaatgtttattaggcagtcctttatgtgaaaaatgataggaataacaatacagtgaatcgcaactcagctttagac

SEQ ID NO: 46773 - DNA, 201 bp, Homo sapiens
tgacctcacatgatccgcgcgcctcagcctcccaaactgctgggattaccggtgtgagccaccgacaactgcattttttacttctgatgttttggtcttaygataggttttttgggatgtaacaccattgtaagttgagaagcatactgagtgaatttcacaccatcctaaagtcgaaaaatcattgaactcttgtaagtt

SEQ ID NO: 46774 - DNA, 201 bp, Homo sapiens
cagctaaaaaatccccttggaattagtgtcagaaagtccctttttaaaaattaataaacttaaatttttttagagcagttttagttcacagacaaattgartggaaagtacagagagttcctatatgtctcttatcttcacacataaagtcttttaattgggctatcgtaactttcaaggacaaaaggacagtattctcct

SEQ ID NO: 46775 - DNA, 201 bp, Homo sapiens
gtgcctcagatgggaggagaccagggactctgagccaaatggctgtgaggggggatcctgtgctgcacaggatctgtaccacatcatgttctggtcatctytcaggcacgcctgtaacagtgatacatgattcctgccaatggaatgcatttaaactgatcagcaacactgtagaaatgcctttatgctcggaagagggag

SEQ ID NO: 46776 - DNA, 201 bp, Homo sapiens
agacgcggccgccccagcagggagccgggtgccgagcgggcgcgtggccgcgggacgcagacgcggtgcctgcccgatgcggctccagggctgggtctacsggctcctgaagctggaggccttgccgtgtttggggtggaaacataaccgggtgaaagtaaacatgcatctccgtgtgggaaatctggtctccatcctcga

SEQ ID NO: 46777 - DNA, 201 bp, Homo sapiens
ttagcctgatctttgctgctggttgagaagaggtgccacatgagaagaaggcagatgttgctgttgagcatgaaggtgctgcgtgtcagttggcacttgtscctacatggttgaacttactcaaccacagctctggtgggtagctacagagcactgcccaaggaagggcatgggcctcagaggcacagcttattgcactct

SEQ ID NO: 46778 - DNA, 201 bp, Homo sapiens
cactgtgttgcccaggctggtctcagactcctactctcgccatcctcctgcgttggccgaccacagtgctgagtttacaggcgtgagccactgtgcccgamtaatgctgcagccttcttaatgtatcccatcaggaggcatatgctgtgattatcccattctctggccctgctaactttgatcacttgaattaaggtggtg

SEQ ID NO: 46779 - DNA, 201 bp, Homo sapiens
aacagaccgaggggaggaatggtggctgctcctcacaagaggaaggggtcctgggcacatttggactttgcctcctggagtggcccacaatgcgggcactyccctgtggcagggagggggagtcaaggaaaggaactcagcattttcagggctgcattttcacacagcaagccctaaagctgcgtttgtttcctgaaacaa

SEQ ID NO: 46780 - DNA, 201 bp, Homo sapiens
ctcacagatggctccagtacaagcgctgtgggggccagcctcaggggaggttaggaaaagccaaggtgagaacctcacatgccaaggtgacaacctcacakggctgacagcccatgtactgagctctatgcggatgttttctgtgtttcttcacatatgtgcttgctcctcagtgtgtcctggtgagaccagtgttatttc

SEQ ID NO: 46781 - DNA, 201 bp, Homo sapiens
atggagctggtggttggcacctgactgtgctgccatggctgggagtcaggacgtgatctgagaaaactgaaagaggtgaaaggtcagatcagtggctgagkgggtcagggaggcagctaggggcgtcactgatcatgggcaaggctgagcagggaacggaagagcgtaccctgtgagaagtcaccattcagatacgtgcac

SEQ ID NO: 46782 - DNA, 201 bp, Homo sapiens
aactgacactatgaaactgctgaagaaaacataggtgaggcgcttcaggacattggtacgggcaaggctttttgaataagatctcaaaagcacaggcaacmaaagcaaaaatagaaaaatggcattacattaagctaaaaagcttctgcacagcaaaggaaacaacaaagtgaaaagacaaactgcaggattgaagaaaat

SEQ ID NO: 46783 - DNA, 201 bp, Homo sapiens
ctgatgtgttaatcctcacccctcaactccagctccggggagcctgagaggttcctgaggtggagggacctgcagtactcccgctaggcctctggcaaacstttcccaggactgctgctgaaggccttgccacctcactagtcctgtgtgaatcctaacacccctcccgtcctgccagtgccctctccaccacccctttcc

SEQ ID NO: 46784 - DNA, 201 bp, Homo sapiens
ttacagtctggaggctgggaagtcctggagcatggtgcccgcatctggtgagggtcttcccatggtggaagagtggaaggtggaagccagcatgagagacrgagaggaaatcgggctaaactcccgatttatcgggaatccactcccctcactcctacagaaacagcattaatccattcatgaggacagagtcctcgtgtc

SEQ ID NO: 46785 - DNA, 201 bp, Homo sapiens
ccagttaatcaaaaacaaattgtatttccaaaaagggggcggaggaggagctttgtgcacttccttaggattttcacatcgtgggtagtaacatagtcagrtggcagatttttctgtttggattaaagtttctattttcagcaaccacttccctgaaagcatgctgctccctgacccgagggtctcatgagcagccatcct

SEQ ID NO: 46786 - DNA, 201 bp, Homo sapiens
ctcatggggccctccagcccgttctcttcctggcctgtgacgatagcgggttaagtttgtacttttaacagtaattaaccttcttcaaggccttgtttgcygttataagtgttccctgttctctgggtactcacagccccttccttgctgtccttgatccagcggcatggcctgagtgcctccatccccctgtttctggat

SEQ ID NO: 46787 - DNA, 201 bp, Homo sapiens
cttgtttggaaagctgtatatgcaggttgtgaagtcacttttggttttgatttcagcctcccattctttccctttctgcatttgtggtatctaatatcacyttgacagcctcaagagcggcctgtgtgtgtgggttttggtgtccatggtgcagtgggcgagggccacccgcagccttcccagtgcttggtgaggcccaag

SEQ ID NO: 46788 - DNA, 201 bp, Homo sapiens
gctccaacaaggcctctttttgatctcccatgtgactccattttctcgttctctcctgtggctgggcctgtttctgcctgccgtggagcagaagtatggtycacatgggtggagacctacaggggccaaggagggctgggccttgaaagtgatgagcttgagtccctgttggggtccggggttgggggaagggcacaaggt

SEQ ID NO: 46789 - DNA, 201 bp, Homo sapiens
aagcttctcagcccatttgctgccacagtgacagcaataggctgtggtggggtaggacgggggtggggtaggacgggatccggtgggtggggcagggagargggcccccattgcacttgggctttttctttgggttgataacgatagttcatatttcatctccatgtgaccttgaaaaaaatcactctgagcatccgtgac

SEQ ID NO: 46790 - DNA, 201 bp, Homo sapiens
ggtatctcatcatatgtggaatatttctgttagaccatctgagaattttaagctctggtggatggaagtaaggttgcttttgaacagaagtctgccatgcygctgcttctcacaggctgcagcctcaggttgagcgctcaggaaccaaggtcaacgctcagtgtgtgtttgccaagtagactgtgtagatttgaagtgctt

SEQ ID NO: 46791 - DNA, 201 bp, Homo sapiens
aggtggtgtcagctgctgttatggaagctgtctattattaattcaccctagcatattgaacgcccttctttccctctctcatgttgcttgcatctctaaakggtgtattctcaaaccaattaatttgaattttcaagaaggatgacctaagtgtataaactctggaaatgtgaaggaagtatttaggcagatggttgtttc

SEQ ID NO: 46792 - DNA, 201 bp, Homo sapiens
ctggccccagaggtctctgaggtcccatcaccttctgatgactctgtctgcagggatgagtctgttgttactgagccgctagccttcagcttcctctcccrtggtcattcccgaggctgcccactccccctagttgcccacaagccttatgaactcccatctccgttcctcctgtgtggcctgttctggttccctctcctc

SEQ ID NO: 46793 - DNA, 201 bp, Homo sapiens
cgatgtgatcgtctcatctctttgaatgtcatttactctttgtgctttctttgaatgtgtttggaacagaaaactaatcagagtctggttttaaaggattsatttctttcccgtgttgattctgtagcttgcagtgagctgcatactccatcgctagatcgaaagccaaatagttttgttgcggtgagtgtcaccacccct

SEQ ID NO: 46794 - DNA, 201 bp, Homo sapiens
gggagataactgaatcatggggggtggattctcccatactgttctcatgatagtaagtctcatgagatctgatggtttgatgaagggaaactcatttcacytggctctcattctctcttgctttctgcgatgtaagatgtgccttttgccttctgctatgattgtgaggcctccccaaccacatggaactgagtccattaa

SEQ ID NO: 46795 - DNA, 201 bp, Homo sapiens
agggtgctgggggcctggtgggcttggagccagagccccgagaggcatgaggaaggccttcctgagacccctcccaggtcccctccaccttgtccgtgttyctgcagcatgtggcctttccatcctagttaatacctgggcctttgaggcagcattttttgtttttgtattttatgctagagaagcatatttgactttgtt

SEQ ID NO: 46796 - DNA, 201 bp, Homo sapiens
cccttgagattttttacctacagagacctctagacaaggtgtttcctcccatggagaccagatgaggcaggtgagcgggcagaaggcaccttggcctgagwagttcttggtctcctcctctcttgaccctcttctgtggattggaaacattgtgagaaactacgtcccttgcttgcattggcagcagacactgttgaagtc

SEQ ID NO: 46797 - DNA, 201 bp, Homo sapiens
cactgtgccccatggtttccttgtctgtctcgcctgagaggagccctgtgtgcacagtgaatgctgactgactggtcagtcagctcggccctgctgccccyaggaccctgatgacccagtacggctagggctttgtatttcagcagaaaagaagcacagttgcagcaccactcattaaagcatgttgtgcatcacaggtct

SEQ ID NO: 46798 - DNA, 201 bp, Homo sapiens
tgtcaccgcagccattctggctctggcccattcagtttatggcatcagtggctgcattttacttaccctgtgcccatccccatgtttgtgccatgtcataraaagtcctcctaggtgcccgttgttctcttatttgctgggcttcaagaattggtggccctgaagcccccaagggtcccaggacccctgttaggtgtagac

SEQ ID NO: 46799 - DNA, 201 bp, Homo sapiens
agtagccagagagggtttgtggtccttgtacagctttctgatgcttcttttctcagtttaaaataaaatcaaaatatgaccgcaaaaacacccagccatcwgatctgcttttgcgtggcaggaggatctgccttatggagcctgtgctgctctgtttatgtgtgactgagctgggtgggtgatgagggcactggatcaatg

SEQ ID NO: 46800 - DNA, 201 bp, Homo sapiens
tctgatgtgttaatcctcacccctcaactccagctccggggagcctgagaggttcctgaggtggagggacctgcagtactcccgctaggcctctggcaaaygtttcccaggactgctgctgaaggccttgccacctcactagtcctgtgtgaatcctaacacccctcccgtcctgccagtgccctctccaccacccctttc

SEQ ID NO: 46801 - DNA, 201 bp, Homo sapiens
ccccaccccaatgggggaaagggaaggaggggttggggaaaccgggcatagagttcagctttgttgcccctggctgcaaggccttgtgttggctgagtttygctctctagccctcagttccctattgtataaaaggcaacattggcacctgcatgctctctttctcaggatcagataagaatatactaaaaagtggatcag

SEQ ID NO: 46802 - DNA, 201 bp, Homo sapiens
gtaaagaagaataaggacattattgaacattttcagagaactagaaaccatgaaaagaaccaaatagatattctagaattaaaagaaaaatttcaagaagsaaatttacaaaatgaagccagagcaataaaaataatggaaaaaaaaatcagaggagagtaaaaacagcatagtgagaggtctaatgttacatttattttg

SEQ ID NO: 46803 - DNA, 201 bp, Homo sapiens
ccagtttttgaaacattcagggggctgtacagagctactgtcctgagcaggaaatttccaggtagggagggtggtgaagggcatttcagacaaagacatgrcagaagcattgcacatggtgaaatgtggccaggtgcacagtgctgggggcggagagctaagaggactggccttgctgccagcctgctctgtgaccagagt

SEQ ID NO: 46804 - DNA, 201 bp, Homo sapiens
aaggtggggtctcacgatgttgcccaggctgatcttgaactcccaggctcaagcaatccacccaccttggcctaccaaagtgctaggattataggccaccmtgcttggctgaattgattttttaaaatcctattttgagattgtctttttaagatgaaatggtcttagaaggcagctattcatttggaagagtgattgcag

SEQ ID NO: 46805 - DNA, 201 bp, Homo sapiens
gtactaaatttgataactagttgatttcactgctagtcttagaacagcataaaaccatcaagttatactgtgctgtgggaagtcatttatgtttaaaatcrcttttgctggttagttttatgtctacacctgaacatttcccagagaactccccggacgcgctcactgagtaggtgaggccccctggctgctcatcctccc

SEQ ID NO: 46806 - DNA, 201 bp, Homo sapiens
gcctcacataacctgattagcagatcaatatgtaagagccacagttctatatcactgtgggtttctatctttgttagcaacatggtctcagggcatctggrttaacgaagaggtcgaactcttgaacttgcagatgcctttgtattctctttcccctttgccagtttgaaaagtcacttccaaagacgattagagaggaag

SEQ ID NO: 46807 - DNA, 201 bp, Homo sapiens; identical to SEQ ID NO: 10429

SEQ ID NO: 46808 - DNA, 201 bp, Homo sapiens
agtttaaaatatgatagacaaaatttaaaaaattctatgaagtttggaagttagtcaaggaattcttccagaaagtaagattttaaaaacaaagtagaaartgggtaagaaatagaaatggaaattttgagagtaaatccagaaggtccgatatttagaagaaaaaacagaagagaatgttaagggaggaaatgcaaagaa

SEQ ID NO: 46809 - DNA, 201 bp, Homo sapiens
acttattcccttgagggcttacagtggttcccaagagaaaggccaagagaaaggattagatggattagacactaagtgtctaaagacacttagtgctttaracagtgtctcagtgagaagtggcagggattgctttctagggtccgttaggggaaggatacttgttgaaacccctctcactttgatctagaatccaaaagg

SEQ ID NO: 46810 - DNA, 201 bp, Homo sapiens
ttagtgctttagacagtgtctcagtgagaagtggcagggattgctttctagggtccgttaggggaaggatacttgttgaaacccctctcactttgatctaraatccaaaaggctaaatctaaacctctagagtaaaggaaccagaagcaggtgttcatagggactacaggttcattaagtttctgaaagtaaatgaaaata

SEQ ID NO: 46811 - DNA, 201 bp, Homo sapiens
attagcactaattattgcggaaggaagggcacctgaggaggaaacatgctagagaagggtccacacagcatgtttcaaaatgcagtggttcatgaaatcartttgaggttgtaactggcattaaaaagctttttgaaatagcaaatatccaagtacgtttcctatgggaaggataagcattttttggtaaaacatctagtt

SEQ ID NO: 46812 - DNA, 201 bp, Homo sapiens
tatattagtttggtccgggacaacttgaaatgatgggacttcagcttataggtggattcagagattttctgattgacggttgaaagtgttaagttattacytgaagacctggaatcatagaagggattgtttgggttaagataaggggttgtggagaccagggttttatcatgcagatgcagcttccaggtagtaggcttt

SEQ ID NO: 46813 - DNA, 201 bp, Homo sapiens
ctctcgaacaagttcaacggaaacaattcattctgaccacctctgaacacaaagacctcaggagaccagtgacaaagtggccccctggagagccacagtgygatggcaggcctgtcactgagcccagacccgcaagggccccatccgcctgcccctagcacacttgggttgtgtgctcaggacagccgttacagttacagc

SEQ ID NO: 46814 - DNA, 201 bp, Homo sapiens
tgacaggaagttcggcaggtttctcaggcctcatttttgaggtatcctcttggttttggggcctcatctggcattgcttgctcaggccaggcccagcaagyggggtgtagggcagggcacacactggctacgggggtctctgcagcaggacagagggggctccctacttttatttttcctggggggttgctaaacccccct

SEQ ID NO: 46815 - DNA, 201 bp, Homo sapiens
ccaggcactgtggatgatacagagcccaccagggcacagtccctgccctgaggaattgaccagctggtgggtggggaggcagaaatgaatatggctacccstgtgcacagcagagtatgggaagtattggagtaggaaggtaaggagagcaccaggaggctgggatcctatctggctgtgagagtcagagcaggcttccta

SEQ ID NO: 46816 - DNA, 201 bp, Homo sapiens
ttgagggcttacagtggttcccaagagaaaggccaagagaaaggattagatggattagacactaagtgtctaaagacacttagtgctttagacagtgtctyagtgagaagtggcagggattgctttctagggtccgttaggggaaggatacttgttgaaacccctctcactttgatctagaatccaaaaggctaaatctaa

SEQ ID NO: 46817 - DNA, 201 bp, Homo sapiens
acaaatacgcctttctgcctaagctcacccccctgcacagcgtcctggctgctctatatagtgtcttagccaggctagcaggagttcccatgactgtcctyaccatgatggcatcgtcactgcatcccctgggttgagggggtgggtggtgagggcatggggtgaatgcaaaacactgtacggcaaggcaaaggacattgc

SEQ ID NO: 46818 - DNA, 201 bp, Homo sapiens
ccactccccctagttgcccacaagccttatgaactcccatctccgttcctcctgtgtggcctgttctggttccctctcctccctgtcaggctcactgtatstttgtttcccatgatcctgcagtcagggaagaccaagccccagttactttcctgatgagctcaaagtccagaatgcagtcacgtgactggggtgggaagc

SEQ ID NO: 46819 - DNA, 201 bp, Homo sapiens
agctctgacagcagaccgccatgtacagtgttcctgttgtctttgtctgtggtattgtgaaattgatgtggtaatcaaatgacgaatgaggcctggtgcgygggagtgagaggggtcatgtatgggaacactgggttgattcacctcaagaaaaagccccagaatccctggctgcagaacccaggggtgccgctgcctgga

SEQ ID NO: 46820 - DNA, 201 bp, Homo sapiens
gtgcccagagcagaagagtctgtgctgtgagcacacccacggcagcgtgcacagactcgagtcccccagcagattctcttggctgccctggatggagatasggtgaaactctgctggggagagcacagtccagtggagaagccaatctgatgtggacagatgagctctgtggcaagtgtccaaggaaccaggctggtggtg

SEQ ID NO: 46821 - DNA, 201 bp, Homo sapiens
cccacaaggagttttgtgttccattgtccagctgcatgctggcctgctgccaggctgtgctgcagattcttcaaccagtgctctctggatgcctgttagcytctttccagcctgtgcttcacactaatacgttagttttgtgaaggaagctgcaccccccttgctctgaggtctgggcctaggctctggctggattgagca

SEQ ID NO: 46822 - DNA, 201 bp, Homo sapiens
gagcacctacggtgaggcgcccgggccaggatcgggagccccacttgcgtgtgtggtttccatcctttcttgctaggcacttttctcactataccagtaatgcgtgcttattgaaataaatccaaaatatataacagcagaccagatggcagacctggcagttacacacgcacacgccttggtttgttgttgttgctggtt

SEQ ID NO: 46823 - DNA, 201 bp, Homo sapiens
tcatcccacactggagggtgtcagacttttttaagactctttcattctttttgtttgtgtcattactttaagtgacagaagcagttccatagtcattttcrtggtttggggagaccctttcttggatcatagtaattcttacaataatgcctgtgctctaaccaccagttttaggggattgtgggccgcgacttggcctcc

SEQ ID NO: 46824 - DNA, 201 bp, Homo sapiens; identical to SEQ ID NO: 10422

SEQ ID NO: 46825 - DNA, 201 bp, Homo sapiens; identical to SEQ ID NO: 10423

SEQ ID NO: 46826 - DNA, 201 bp, Homo sapiens
gtgccactgaagcccctttgagcagtggcagcagaggaagggggcggtggggggctgggcatgatctgactgccatttggtgagcaggcacctgaccctgwacctcttcaccccacgctcccacagctgaccgccctcatctgcggcttcatcattaagctgaggaactgcctgcatgacgacggcttcctgcgccagctc

SEQ ID NO: 46827 - DNA, 201 bp, Homo sapiens
tgacttgtcaaaatgcagttccacttgtattaatattgaccctgttcatcgtcaccaggactgcatcttgcaccactgtgccgtcttctaggcacacacgrcccgttatctcccttggaaaaattcctctcactggaaatgtacaattaaaggatgattgaaatgtttaactcttggagtttttagtattaccaaactcct

SEQ ID NO: 46828 - DNA, 201 bp, Homo sapiens
caaattagttacaacaaccaggtggatacttttctaaactatcggagcttagcttttgaataaaaaatactgtcttaccaaaagtattttacatgttcttsataatgagactgtcattttcactttaaaaggcttgagcaattgccactgatgttttttttttttaaatgcgtgacataatggtcttcatacaatttgaat

SEQ ID NO: 46829 - DNA, 201 bp, Homo sapiens
gatggcgaatgaggggtggaccctaccttggagggaaagctggtcccagagtgccggcctctctgtgcaggcgctgccacagccactagggggcgccacgygtcagaaggtatcatcccctctgtgttacactagtgtcctctgatgggggtttccaaagagggaacccacatcggctgggctttgcattgggcaggcttc

SEQ ID NO: 46830 - DNA, 201 bp, Homo sapiens
tgaacacaaagacctcaggagaccagtgacaaagtggccccctggagagccacagtgcgatggcaggcctgtcactgagcccagacccgcaagggccccayccgcctgcccctagcacacttgggttgtgtgctcaggacagccgttacagttacagctgttaggatgtatagtgcacaaagcactttttataacttttac

SEQ ID NO: 46831 - DNA, 201 bp, Homo sapiens
aggcctctttttgatctcccatgtgactccattttctcgttctctcctgtggctgggcctgtttctgcctgccgtggagcagaagtatggtccacatgggkggagacctacaggggccaaggagggctgggccttgaaagtgatgagcttgagtccctgttggggtccggggttgggggaagggcacaaggtacacagctg

SEQ ID NO: 46832 - DNA, 201 bp, Homo sapiens
gaggcgcctatgtcagggagaggcgcagcctcactggagccccagcagggaggtggcccaggggagggaaaatgatggtgcctgcatccagtagctgcggrtcccacagacttgcaggagcagtttctagagagggctgagccagagccaggtgcattgaatagaggggagggtggaggatgcaacactgaggacagagag

SEQ ID NO: 46833 - DNA, 201 bp, Homo sapiens
tccatttctgtgcagattgcagtccccctcctgaagagtccagcccaggtacgtggtttccgttcaaggctcctgctgatgcccttttaattgatactcargtagtgttttgtagctaaattacaaaagattgccttatgatcccagagttgggaaagtattccaggacctccttcgttgtgaggcataaaacacttttcg

SEQ ID NO: 46834 - DNA, 201 bp, Homo sapiens
cagcaagaaaggtaacccggacagccacgcctactggatcagaccagaagaccccttctgtgatgtcccctcctcaccatgcccctccaccatgccctccrctgcatgccatcctcatctgaccacacgtgcgtatgcatccatgcttcccatatgctgcctccatttcaccttgtgctgcttccatttgtctgtgtctct

SEQ ID NO: 46835 - DNA, 201 bp, Homo sapiens
gatacttcccctgcaaatgctgttgtcctgggtagacctcctgggcctctctggggaaaccagttagcccacagcctgatgcatctgtgtcttgctttcakagtgtgtgagctggaggagctgggagagctgtccccttgctgggagagcctccggcgccaaattgtcacccagtaccagaccatcatcctcacataccag

SEQ ID NO: 46836 - DNA, 201 bp, Homo sapiens
tctcttatgcagcagaggcatgttgccttgggacttggtaacacagagaatgggaccctgttcctgggcttctggtggtctgagtcaggtggtttggcagracccttcagggtaggacactggcatgaagcagcatgcttcagaacagtctcctgtctgcagagacacagcataccaggacactgtcctgcagatggcctt

SEQ ID NO: 46837 - DNA, 201 bp, Homo sapiens
ggggtgcagtgctgggctttaagcccattctccatttctgagataaggcaggggcctccccagcccctggcctgggctcagcagccttggtttgtgtgcayctgcagacacggcagctggtcacggtctgcgactgcaagctcctggccaactccatccatgggctgaacgctgcacggcctgactacattgcctccaagg

SEQ ID NO: 46838 - DNA, 201 bp, Homo sapiens
aattagaaggcaggctttcctagtgcttagaaaaataaacagagcctgcctgactccacttgtctgaagcacgttattattaactttcaacttattatcasttctgctcttaacgtggcgctgtagaaggaaatgatgtgtgtggtgttaatcttcagtgcctcttcaggcccacgtgccatcctgctgaaggtgcaggac

SEQ ID NO: 46839 - DNA, 201 bp, Homo sapiens
aaaaagatcttgaataaatgagttctgctagttcctctctgagtcctgtagtggctctaggtcaaaagcagtaaaacctaaccagaggaaaaaaccagagyggaaaatattttggacacacgagaagctatgtagacaggaagcaagtgggagctccttggagaggggagttgcttgagactgaagttcagggaaaggacc

SEQ ID NO: 46840 - DNA, 201 bp, Homo sapiens; identical to SEQ ID NO: 10433

SEQ ID NO: 46841 - DNA, 201 bp, Homo sapiens
ctttgcgttctgggccttgatgacttaaattgcagattctaattaaatgtccccaaataactatgaagtgcttctaaggtctttttgacctaaaagtttcygtgacctgtgaactctctcaagtgtaaaattagtctgtagatgtacccctttaagcatttctatctccagaaacctcatgatgcctaggatataaaccac

SEQ ID NO: 46842 - DNA, 201 bp, Homo sapiens
cgggctctcgaacaagttcaacggaaacaattcattctgaccacctctgaacacaaagacctcaggagaccagtgacaaagtggccccctggagagccacmgtgcgatggcaggcctgtcactgagcccagacccgcaagggccccatccgcctgcccctagcacacttgggttgtgtgctcaggacagccgttacagtta

SEQ ID NO: 46843 - DNA, 201 bp, Homo sapiens
ggagtggaggtgactggcagagatgcagttggagccagagagcctggaaaaatacagatgcctgggccccaccccagagtgtggtgggcaggacctgggcwttagggtttcagaaactccccaggtggtccctgtgtgccacagccagggtggtaaacatagcatgaagtcaaggtcctgcgaggacttggcagctgaagg

SEQ ID NO: 46844 - DNA, 201 bp, Homo sapiens
ggtgcaaatcttcagtgacacaagagtatggctgttagagaaggaggaagacagttccccatgatcacacccccagcatggctgtcatcttgatgcagccrcctgctggctgtcccctctgtacagtacctctttaaatggctgcaaacagagcaaaggtgggctatttctttaaaaacacatgatgcagaactcacgtaa

SEQ ID NO: 46845 - DNA, 201 bp, Homo sapiens
cccttcttctgtaaatggcctctatgtctccacttaagtactgcttataagttaatagatgaggttgtgaggtggaagattacgatcatttgggtgattaygggatatgattgttcaatacctgttcatacatttacatacacaagtaaaaatacagatacatgcaaatacagataaaagactgagtcatagtttaatatt

SEQ ID NO: 46846 - DNA, 201 bp, Homo sapiens
ggctgggatgtgggccgcccactttgcattctgtcctgagaagccatgagcagctgcagccacacctctcctgaaagggaagaaggagagaagcagagctygggttagaggctgttctagtggctggggcaagtcagggtccagcttccaggtggccagctctgggcaagggaagcaggagcaggcaccaggccaggcctg

SEQ ID NO: 46847 - DNA, 201 bp, Homo sapiens
ctgtggacttgctaaatttaagcctgctttttccattacagatacaaatcctgtccacaaacagttagcgtgcctgcatgtacaattaggccacctccaamttttgagctgctacatatacttaaacatttgcattaaccaaacactgagtgtagggaattcttttatatgtttcagtatttctttaggttggtttctcag

SEQ ID NO: 46848 - DNA, 201 bp, Homo sapiens
caatgggccagctcagccatgttcctgctgaggtgtttagctcagcccagactcctgagacaaatacgcctttctgcctaagctcacccccctgcacagcrtcctggctgctctatatagtgtcttagccaggctagcaggagttcccatgactgtccttaccatgatggcatcgtcactgcatcccctgggttgaggggg

SEQ ID NO: 46849 - DNA, 201 bp, Homo sapiens
ctttgctgtcgattctctactagcctatgtgacatggctccttcccatgctgtcgtagtcactgacacaagatgtgtttggtggcatgcattgtgcacctsctggtaggacttgggggaatcacagaggcaggacccaccctcggccaggtgagcggcccactcacttccctttgtggtgcttagagaggaagatgcgggg

SEQ ID NO: 46850 - DNA, 201 bp, Homo sapiens
ataaagacattttcaaaccttaaaagctgaaagaatgtcagcaccacacttacagtataaacagtgctaagagatgttcctaagtagaaggctgatgattycagatggacgttcaccaatagagaaagcattgaaaattcaaagacataagatttggggtaaacatctgggttatagctgcatgaatagcaactatagaaa

SEQ ID NO: 46851 - DNA, 201 bp, Homo sapiens
attctagaattaaaagaaaaatttcaagaagcaaatttacaaaatgaagccagagcaataaaaataatggaaaaaaaaatcagaggagagtaaaaacagcrtagtgagaggtctaatgttacatttattttgtatctttaagaaggaacacagaaaagggtcagaagcaatatttatagttgagcatttctcccaaagtaa

SEQ ID NO: 46852 - DNA, 201 bp, Homo sapiens
ttatggctcacacctgtaatcccaccactttgggaggtcaaggtgggaggattgcttgaagtcaggagtttgagaccagcctgggcaacatagtgagaccycatctctaattttaaaaaattagtaattatccagatgtggtggcacacacgtgtggtcccagctactcaggaggctgagatgggtggatggcttgagccc

SEQ ID NO: 46853 - DNA, 201 bp, Homo sapiens
gacagagaggaaatcgggctaaactcccgatttatcgggaatccactcccctcactcctacagaaacagcattaatccattcatgaggacagagtcctcgygtcctaatcacctcttaagtgccccgcctcccactactgttagaatgacaattaagttttcaacacaggaactttggagaacacgttcaaactgtatcaa

SEQ ID NO: 46854 - DNA, 201 bp, Homo sapiens; identical to SEQ ID NO: 10432

SEQ ID NO: 46855 - DNA, 201 bp, Homo sapiens
tatcttaacttgtaaaggttggttctttctagagacagcaggagttgtagcatatagggttggaaaaacctgaaacaccttctcgctgcttaatctagttytgagagcagagtgtgagctctggagctctgagccatgtgaagcgtgtgactcagcctgtggcagtgttttacccagagccctccctttccatagcacagc

SEQ ID NO: 46856 - DNA, 201 bp, Homo sapiens
ttctgagatatagcgggcagagcactggcatcagatagactggactgcaaacacagcctctccccctgcagctctgtggccttggcttgcctaagcctcaktttgctcattgggatcatggattcctgtgcaaggatttcataagacagtgtatttgaacccagatgtgtgccccacactcagaacctcctcttttctctt

SEQ ID NO: 46857 - DNA, 201 bp, Homo sapiens
tgtgcggttggattggaagaggggaggcaagccgctgatggccagagtgaggctgtgacacttcagatgagatgttgtttcactctgactccagcctggtwgtgacagtgagcgtggagagagggatgaggcgttaggggggtttgggctgaggatgcactcctcagcggccacgtgcagctggcgctggggaggtgaggg

SEQ ID NO: 46858 - DNA, 201 bp, Homo sapiens
ccgcacccagatcatttccagagccccggaagccctctcaccctccccagtcagtacccaccccttcaggataccactctccatactctggatgccacagmttcgtttggcctgtgcttgaacttcgtatgaatggatttgcctagaatggtcttaacttttccccttgacgttgtttctgagactcatcccattgtttca

SEQ ID NO: 46859 - DNA, 201 bp, Homo sapiens
acccagccctggcttgaacctgtccctgtcccttgatgttgggaagcagagattccctgtcatgtcagatgactcagaggggccctaggatgctgaggcaycaagtgagggctgtcatttacacaccgtctgtcgataacattggtaccaagcagtatagggtcttttatcctggagattctgaacctctgtgatggaccc

SEQ ID NO: 46860 - DNA, 201 bp, Homo sapiens
ggagttcaggggcgggtgactgggtaacttggaaatacaggactgggccttaggagtgtcattagggccaggccaagaggggttttggcatcatctcctgsatggccttagtggataaaactgacaaggctgcagagtggagggatatgccaacacccagccctggcttgaacctgtccctgtcccttgatgttgggaagc

SEQ ID NO: 46861 - DNA, 201 bp, Homo sapiens
taacctgcagcccacagtttctgtgacacagaaagtgtggtcaggtgctgggaaatcattgtctcatagataaaacatctgacacgcaccagcttttctgwaacaactaatggttgcaaatggaattcggggtacacaggatagcaacagatttcttcctgtccttgaagaaaactgtctcctttgtccctgtttgaccaa

SEQ ID NO: 46862 - DNA, 201 bp, Homo sapiens
gccccccattcgccagcttgtccacccatataagtttctcagcccccttgcctcaagcttctccagctcctccaagcatggcctgtactctccctgtacarctcggtgctaaaggaagcaacctcagtaacactccagctccaggtccctctctggcctagcagggatggagtctacctggctggtgctgaagagtcccaa

SEQ ID NO: 46863 - DNA, 201 bp, Homo sapiens
tgtcttaatccattttctgctactccaacaacataccacagcctgggtagtttgtaaagaaaagcaacttatttcttacagtctggaggctgggaagtccwggagcatggtgcccgcatctggtgagggtcttcccatggtggaagagtggaaggtggaagccagcatgagagacagagaggaaatcgggctaaactcccg

SEQ ID NO: 46864 - DNA, 201 bp, Homo sapiens
tgtgggggccagcctcaggggaggttaggaaaagccaaggtgagaacctcacatgccaaggtgacaacctcacatggctgacagcccatgtactgagctcyatgcggatgttttctgtgtttcttcacatatgtgcttgctcctcagtgtgtcctggtgagaccagtgttatttccgttatacagaaactgaggctgagag

SEQ ID NO: 46865 - DNA, 201 bp, Homo sapiens; identical to SEQ ID NO: 10427

SEQ ID NO: 46866 - DNA, 201 bp, Homo sapiens
aatttttttttttttgagatggagtctcgctttgttgcccaggctggagtgcagtagtgcgatctgggctcactgcaacctccacctcccgggttaaagcrattcttctgcctcagcctcccaagtagctgggactacaggcacgtgccaccacgcccagctaattttttgtatttttagtagaaaggggtttcaccacgt

SEQ ID NO: 46867 - DNA, 201 bp, Homo sapiens
atttgtgtctgcaggtgagaagggatacgcattgccagcatgttacttctcttcctgtgcttgattcaatttttttttttttgagatggagtctcgctttrttgcccaggctggagtgcagtagtgcgatctgggctcactgcaacctccacctcccgggttaaagcgattcttctgcctcagcctcccaagtagctggga

SEQ ID NO: 46868 - DNA, 201 bp, Homo sapiens
tgatgcaaaggccacaccagataaaagtctaaacagcaaagaggccagggcaggagcaggatgaagacactgctaggaggttcacaggccccgtcattgcwgttggacacagactgtgaggactgtgggagggacgctggtcaaattcccagggtatgggagttggggtactaagggagttgaagtcgtacttgtggggaa

SEQ ID NO: 46869 - DNA, 201 bp, Homo sapiens
catgggtagtgttgaagcccccatgctacaacgtgacccccacccccagcctggggggcctggctcaagctggagagaactgggagagcacccatgcaggyggcctctggtggctggagctggagagtttcaagttgggggctgtctcagctcccaccatgtggactggctcatttgcagagtgggaggatgatggacatg

SEQ ID NO: 46870 - DNA, 201 bp, Homo sapiens
gttgtgtctcatgagtgggctgaccttggtggaggcttgcgtttcccatgtggggcctgactttttatgtgtccagccagagtgatgagctcgttcactttccctgcagtgcttccttgttgaacctgaaagagaggacgtgggagcttttgtaggagagagaggacacatgctttattcttgaactgtgaggtgtatgtc

SEQ ID NO: 46871 - DNA, 201 bp, Homo sapiens
ggttgctcactgacctggcataaactagaacacaaagcttcccatttagaaaaggttcaggcagcctcctgctgggatctgcccaacccctctaggaggtkgcatggatgcccacctcttcttccaagggtgcactttgcctttaggtttggggaaaagtactgggcgagcctttgggactgttgtgtctcatgagtgggc

SEQ ID NO: 46872 - DNA, 201 bp, Homo sapiens
tttctgctccctcttgttgaatcacatttcgctgcttttctctgtgggtacttggtccctgagtaccccacatctgcccatttccctgtgtgctctgggcrgctcggaggagagatttgtcacaaggaccttcaaaaggtttctgataacagcccacaccccttccttttgtctctcctcactctagcttccctttgtatt

SEQ ID NO: 46873 - DNA, 201 bp, Homo sapiens
cagaatcttcctgggagaggacacagatgttgggcttaacaaagactttaaaactgctattatatttgttccactggtctacgtgtctatttttataccaktaccttactggtgcccagaaataaatttatacatttgtagccaacttatttttgacaaaggtgccaagaacaggcaatggggaaaggacagtgttgtcag

SEQ ID NO: 46874 - DNA, 201 bp, Homo sapiens
gacagagtcttgagactacaaaacagtcaagacatttccccaagcaaactcagaaaaatattaagcctagacaatgtagagcgttagtagttagggaatgyagtatttcaattccagatctaccatttataagctgtgtgtttttgggtaaggtactctgagacttagtgttctaatctgtaaaaggggataattccttcc

SEQ ID NO: 46875 - DNA, 201 bp, Homo sapiens
tagctcctaattatgagtgagaacatatgatgtttggttttccattcctgagttacttcacttagaataatagtcttcaatcccatccagattgttgcaartgccattaattcactccttttgactgctgagtactattctaccatatatatatgtatgtatacacacaccacagtttctttattcactcattgattgatg

SEQ ID NO: 46876 - DNA, 201 bp, Homo sapiens
tttgtcaataaagctttaatggaacataagcatggccattcattaatatatgatcaatagattttttttggtacaagggcagaattgagtagttgcaatasaaacagtgtggattacaatgcctaaaatatttactacctggttctttatagacaaaatttacagactcctgaggcagggttttatcaattcctttccatg

SEQ ID NO: 46877 - DNA, 201 bp, Homo sapiens
atgtgtgtgcaagtatctttttcgtataatgacttcttttcctctgtgtagatactcagtagtgggactgctggagtgcagttttattccaagtgagagcytgtcagtgagaagcttagttgcccaaaggcaggtaacaggctcacacctaggagagtgtgttctcaaacctgtgatcttcacttctgtcatcattatggt

SEQ ID NO: 46878 - DNA, 201 bp, Homo sapiens
ttgctataagggctacacgtcggaaatgggatctaagtaaacgtagagtccacaagtttcaggacttatatagatgagtgaatctcagattttcacgtgcmtacagattacctgaggatcttgtaaaaaatgtagtttctgatttcaagtctctgggatagggcctaggactcagcatttataacgacatcctaagagatg

SEQ ID NO: 46879 - DNA, 201 bp, Homo sapiens
tcctatcaatcaataacacacatgtgacctaagcaagagccctgagtgggacaaaacaaaggatttgggttaaaagcccaggctttggagccagacctacrgagggaagaatctcgactctcctatcacgtgaaccatatgaaattgccattcttacaggtgaaaaagaggtgaacattggcaatttcatggttcattcta

SEQ ID NO: 46880 - DNA, 201 bp, Homo sapiens
aaaaaaaaattccatgagcacttggtaaccatctactttatgttgaattatttcctagggtaaattctcagtcagtagtaggaggaatatttttcccattsaatgtagtttgagaagcccaatgaccaaatcatgagatgttgccattctctatgaaaatcacaaaggatgactccctaaatacattttatgtctacagag

SEQ ID NO: 46881 - DNA, 201 bp, Homo sapiens
tcccaaatacacctattattaccccaaagagtaggaagccgatcttatctagattcactcagcaaatctagaatctcccaagagactccaaatttagtacrttaatttttcttaagtataacattgctcagtaactatgtgggtgaagatctgaaagttctgcagcactgtttcatttataaaaataaaggtaacggtact

SEQ ID NO: 46882 - DNA, 201 bp, Homo sapiens
tagtcccaggtactcaggaggctgaggcaagagaatcgcttgaacccaggaggtggaggttgcagtgagctgagactactgcactccagcctggtgacagrtgcactccagcctggtgacagagtgagacttcatctcaaaaaaaaaaatgtgtttagagtttagatctcaggttaggggatcttgctacacacacacaca

SEQ ID NO: 46883 - DNA, 201 bp, Homo sapiens
gtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacacacacac

SEQ ID NO: 46884 - DNA, 201 bp, Homo sapiens
tgagtagctgggattataggcacccaccaccatgcctggctaattttttgtatttttagtagagatgggatttcaccgtgttggccagcctggtctcgaastcctgacctcaggtgatccacctacctcggcctcccaaagtgctgggattacaggcatgaaccactgctcccagcccaccataagtactttaatatgcta

SEQ ID NO: 46885 - DNA, 201 bp, Homo sapiens
tgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacacacaca

SEQ ID NO: 46886 - DNA, 201 bp, Homo sapiens
gcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacacac

SEQ ID NO: 46887 - DNA, 201 bp, Homo sapiens
gtgtggaatgcatggctgagtgatgaatgcatgggtgggggatgaatgcatgggtgggtgatgaatgcatgggtgagtgatgaatgcataggtgagtgaggaatgcatgggtggatgatgaatgcatgggtggatgatgaatgcatggatgagtgtggaatgcatgggtgagtgataaatgcatgagtcggtggatgaatg

SEQ ID NO: 46888 - DNA, 201 bp, Homo sapiens
tctatttttatttttaaataaaactttgtaattggtaaagtcacagaatcagtgtgcatatgatcaaagtctataaaataatgaaccatgcataattgcarcagagttaccaaggaaggctgtaaggatgatctcactggtgcagccaataccccagtaatcaatatggatgcctgggtgacaactccttccttcctaact

SEQ ID NO: 46889 - DNA, 201 bp, Homo sapiens
cgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacaca

SEQ ID NO: 46890 - DNA, 201 bp, Homo sapiens
gcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacac

SEQ ID NO: 46891 - DNA, 201 bp, Homo sapiens
cgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacaca

SEQ ID NO: 46892 - DNA, 201 bp, Homo sapiens
acaaaggctgcttaatccatgatgctgtagtcatttgttggcttgtttattttaatccccaatttacaacaaaatgtgttttttttttcttacagagaacmcacaatcctattaacagcgaacttctcttgaatgaaggcattacagcagatttaaatccatgcattacaattttagcaatttaatgaacatcctatttgg

SEQ ID NO: 46893 - DNA, 201 bp, Homo sapiens
tgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgctaca

SEQ ID NO: 46894 - DNA, 201 bp, Homo sapiens
tcagttatgtcatcattaaaatgtacatgagctagaatcttatgcctgcctggttctgtgagttcaaaataagagaaactcaggaaggttgagttgagcckcatgctgaaaagagggggagaagaggggatgacttggagccaggaaggcttgtgggacagagcttcttaacctggggtgttcacccttggtccctggatg

SEQ ID NO: 46895 - DNA, 201 bp, Homo sapiens
tggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgct

SEQ ID NO: 46896 - DNA, 201 bp, Homo sapiens
gtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttgc

SEQ ID NO: 46897 - DNA, 201 bp, Homo sapiens
gggtgcagggcctttgcactgggcttattcacaggcaaaatatttttccttattttaaagaaatggaaagaagtcttcctagaagccagggtctgtgatasatgacagagtgaccatagcactcaggggtgcagagggtgtgtggattctgatgacagattgcctgtctgattttgcagaattagctccaacatggttttg

SEQ ID NO: 46898 - DNA, 201 bp, Homo sapiens
aaaaacattagccaggtgtggtggtgggtgcctgtaatcccagctacttggaaggctaagaaaggagaattggttgaacccaggagacggaggttgcggtsagctgagatcatgccgctgtactccagcctgggtgacagagcgagactctgtctcaaaaaaaaaataaaataaaaaagaagtatagaggtcatttttaat

SEQ ID NO: 46899 - DNA, 201 bp, Homo sapiens
cagttctctgtaatgttcagaaatgcagaggtcagcggaggtgggtggatcacctgagggtcaggagttggagaccagcctggccaacatggtgaaacccygtctctactaaaactaaaaaaaaaaaaaacattagccaggtgtggtggtgggtgcctgtaatcccagctacttggaaggctaagaaaggagaattggttg

SEQ ID NO: 46900 - DNA, 201 bp, Homo sapiens
aacccacactctaggggacaggaactagactccacctgtgaacgagaggagcgtcagaaatattagcatggccatttttggaaaatgctatagagccaaartctgcatgaagagagaacagattgggaatcagaggtacttgagttcagattccagctccattgctcattagctctgtggcatggggaaatcagtgaaccc

SEQ ID NO: 46901 - DNA, 201 bp, Homo sapiens
aaacaaagagtaactcaggaatttatgccaaaacatgttgataaaatatatggcttcgggaacttccatgtaggatacagtacggaagtgtccccactgtraaactagaaaaatctagttaaattataaaaatcagataatataaaaaaatcttaattgtaaaggaatcagggagctgcagaagcattgacaactagataa

SEQ ID NO: 46902 - DNA, 201 bp, Homo sapiens
tattgcactcattcatgaaggccgtcataaacgctaacccacactctaggggacaggaactagactccacctgtgaacgagaggagcgtcagaaatattakcatggccatttttggaaaatgctatagagccaaagtctgcatgaagagagaacagattgggaatcagaggtacttgagttcagattccagctccattgct

SEQ ID NO: 46903 - DNA, 201 bp, Homo sapiens
aagaacataaattaaaaagcccttataaatcagagcaacttttatttaaaagctcctttttgcctcaccaaaaacttacctctagtattatgtttaacccrgaaaagccaacactatctattagatcaaagttagtaggccaagcaaggtggcttacacctgtaatcctagcactttgggaggctgaggttggcagattgc

SEQ ID NO: 46904 - DNA, 201 bp, Homo sapiens
ctggttgcctctttcagcccccattcatgcataacaaatcacacacaaacttagtgactggaaacaacatcgttttcgtgtctctgtggttttaatggctsaggaatgtgagcagggcacactgggagcagcctatctctgtgcctcaatgtctgaggccttagctggaatccccaaggcctgggagctgatgtcatctga

SEQ ID NO: 46905 - DNA, 201 bp, Homo sapiens
cagaggactggtccttcttgttttcggagggtgggtgttgagattacgtcccagaagaagctggcaagatagaaatggaataaggagagattttgattagsgagttgcccatgcagaagagatgcgacttatcagaacagaaaagctttccaaaaggaagaggtctggacagagtactgagtacagaatcagggatgaaaa

SEQ ID NO: 46906 - DNA, 201 bp, Homo sapiens
ttgtttaggtgggagagtagataagtctgccctagggctggttgcctctttcagcccccattcatgcataacaaatcacacacaaacttagtgactggaarcaacatcgttttcgtgtctctgtggttttaatggctcaggaatgtgagcagggcacactgggagcagcctatctctgtgcctcaatgtctgaggccttag

SEQ ID NO: 46907 - DNA, 201 bp, Homo sapiens
aatgactatttcatcaacgtaaacagggagtgagtttcagaggactggtccttcttgttttcggagggtgggtgttgagattacgtcccagaagaagctgrcaagatagaaatggaataaggagagattttgattagggagttgcccatgcagaagagatgcgacttatcagaacagaaaagctttccaaaaggaagaggt

SEQ ID NO: 46908 - DNA, 201 bp, Homo sapiens
gttttcttcacactctcttgtattatcaagttgttaatgttgaacacatacattacttttataaacagaaaagtactttttaagaaacaaggggcaaggaractaagaaaaccatcctttcttggcagactccctcagaggtactatgtttcttttctacagttctctcaggactcaaatgcttgcctagaccaacaggcc

SEQ ID NO: 46909 - DNA, 201 bp, Homo sapiens
tctagtagaataaagatgtgagaagttgggaagttggtcagcattagtggaagctagcatggcaggttctttgtgtgcaaagataagggcagagaagcgtrtggataccggactgttctaaggttggaactgggtcttgtgctgaatgcccagcacctaccatggtgcctgacttagagcaggcactcacatgcctgtaga

SEQ ID NO: 46910 - DNA, 201 bp, Homo sapiens
aattacaacatcagatagtaaatgccttggtgaagatacgcatcccaagggcaggaagctccccaccttgatcactgcaaactccccagtccctaacagartactgggaagatagaaggtggtcaaagcatatgtatggaatgaacactggaaatcagtacacagggctgggaatgtgtgattctgagcactccgtgatgg

SEQ ID NO: 46911 - DNA, 201 bp, Homo sapiens
aatcacacgtggagaagactttgaataaaatgtctaaggataggagcgggctttcaggctcctggaattatttggtgatttttcatgttttcttcacactstcttgtattatcaagttgttaatgttgaacacatacattacttttataaacagaaaagtactttttaagaaacaaggggcaaggagactaagaaaaccat

SEQ ID NO: 46912 - DNA, 201 bp, Homo sapiens
acctaactggctttttctgcccagtggttcttcaggcctaatttccattttaatttactttaacaattgatatgactgaactgtgtcctctcaatgttgaygtattggagtcctaatccctggttccatagcatgtaccttatttggaagcaggcttgttgcggatgtggttagttaaggtgaggtcatgctggagtaagg

SEQ ID NO: 46913 - DNA, 201 bp, Homo sapiens
cattcactcacccatctttaaccaaggcctgtatggccagacatgaggccactcactgcctacatgaagagggaaagacaaagtgtatccctgggagctcrctaccttgtgtgaaaattacaacatcagatagtaaatgccttggtgaagatacgcatcccaagggcaggaagctccccaccttgatcactgcaaactccc

SEQ ID NO: 46914 - DNA, 201 bp, Homo sapiens
caaatcaagcaaggttaaggtgacttatgacacctaactggctttttctgcccagtggttcttcaggcctaatttccattttaatttactttaacaattgwtatgactgaactgtgtcctctcaatgttgatgtattggagtcctaatccctggttccatagcatgtaccttatttggaagcaggcttgttgcggatgtgg

SEQ ID NO: 46915 - DNA, 201 bp, Homo sapiens
tacaggggaagacaataaggcttaggaagattcaggaaattacccaaagaaattcacactcagattcacactcaggaaatgtgactcaatgacagccgtcstcacctctctgctcttctgcctcccaaaccaaactgaagccagagaagcgtgccctgtgtgtgcagttaccagacccaatagcttgctctctccaacttc

SEQ ID NO: 46916 - DNA, 201 bp, Homo sapiens
acacacatgtgacctaagcaagagccctgagtgggacaaaacaaaggatttgggttaaaagcccaggctttggagccagacctacggagggaagaatctcractctcctatcacgtgaaccatatgaaattgccattcttacaggtgaaaaagaggtgaacattggcaatttcatggttcattctaatactctgacacctt

SEQ ID NO: 46917 - DNA, 201 bp, Homo sapiens
aggcactgttccctgagccttctgcattagatcacccctcatttcacagcaaccctgtgggtctctgattaccccttttatacaggggaagacaataaggmttaggaagattcaggaaattacccaaagaaattcacactcagattcacactcaggaaatgtgactcaatgacagccgtcctcacctctctgctcttctgc

SEQ ID NO: 46918 - DNA, 201 bp, Homo sapiens
atgactgttaaatgccatgttactgcgtgtttgcttgtttctcagccagagatgaagatgtcctcagaagattggagttggaacaggctgatgtaattccygataggggaaattagccttggggtcggcagaaccagctttatctgccttagtagatctgtgaccttgaacaaagcatttgtggttcttgaactttgttgc

SEQ ID NO: 46919 - DNA, 201 bp, Homo sapiens
aatcagcatatcctgagtctatgcaggccccagggtagagtgtacattgtccccaggagtcgaacggacctgggccatcctgcctccttccatctcctgtyttctttcactagcatgtctgatccacttccctaacacagccaggctaggttggccgctttctgctatagctacaccaaattgctcaaggttacgatatag

SEQ ID NO: 46920 - DNA, 201 bp, Homo sapiens
gctgatgtaattcccgataggggaaattagccttggggtcggcagaaccagctttatctgccttagtagatctgtgaccttgaacaaagcatttgtggttyttgaactttgttgcccttagaatcatctggggagctttgaaaaccctgaatgcccaagctgcactccaaaccaattaaatcaggatgtctcagagtgtga

SEQ ID NO: 46921 - DNA, 201 bp, Homo sapiens
gatgattcatttgatagaacagggaaccaggagaccctgaaacttcttgaggaggaaactgacacgatgaaatatcaggtagacaatgttcagcaactgaragctggaccagatcttgtgcttggtcctggagactcatggatgaataatacatggtccttgtgttcagagggctcatgaattatttggaaggttagtcaa

SEQ ID NO: 46922 - DNA, 201 bp, Homo sapiens
tatttccaagcacttcattttattacaacccggccttatctgtcaggtgcagctggcgaaactgaggcatgaagaggttaaacgaccttgtggaggcagcyacatacctggattagactgctgagttgcttctgactgattatttatttggtccactaagcaaagctgcttcctcactcagggctatggaaacatattttt

SEQ ID NO: 46923 - DNA, 201 bp, Homo sapiens
ctcactcagggctatggaaacatatttttctctgaacttcattagcacaaactcctcagaagaggttcaacttgaatcttggcaggtgggagaaccccacrttccttaattttctcttctccacccccacactggtctttgcacctgtggcacctggcccacactcggtacttagcacacatccatggaatgaataaatga

SEQ ID NO: 46924 - DNA, 201 bp, Homo sapiens
caaactcctcagaagaggttcaacttgaatcttggcaggtgggagaaccccacattccttaattttctcttctccacccccacactggtctttgcacctgyggcacctggcccacactcggtacttagcacacatccatggaatgaataaatgacaggatggctacccttttttttctgttttagttgtctaactacaacc

SEQ ID NO: 46925 - DNA, 201 bp, Homo sapiens
acagtcatgtgctgcaggtcacaggccaagtttgtgacaagaccggggtgtctgttcgggttttggagaaacaaggaccctagatagggtccattcattcrttcatttatttatttatttgttcattctccagacaaatcgttatcttggccccttctgctgcagccattgccactaagaaggcaggccctgcaggggaga

SEQ ID NO: 46926 - DNA, 201 bp, Homo sapiens
gttttagttgtctaactacaaccaggtctacttcatcatgctgattcttcaaattacttggcggcattttctttcccaaggtgcggaagcatcgcaatacrttgggactgcaagagccttagacccattttgtccagcccagcagcccagcgaatttacagggaacaagttaaataacggggcaactgctcagactcccag

SEQ ID NO: 46927 - DNA, 201 bp, Homo sapiens
ctttttggccagctgagtcttctcttccagtctagagaagtggaggaaaacaggggagcatctggggaccatagagccagcgtccacgccaggcagtgcaractcggcagctccatcagaaagggattcagctcaacctgggggccgattcattcaaaggacattgatctggcacccaacttgtgttagccactatttcac

SEQ ID NO: 46928 - DNA, 201 bp, Homo sapiens
agggtggggccatggcagggcttgactaggagcaaaggtgggactcgcatgctaaggagtgagcttagacatgatactcctgcggcgaaagggacaaatgrtggaggattttaggctgaaagtgacatgatcagatttggattttacagggactgatccggttgacatgcaggggatgaatgggagacagtgagttctgtc

SEQ ID NO: 46929 - DNA, 201 bp, Homo sapiens
tttggattttacagggactgatccggttgacatgcaggggatgaatgggagacagtgagttctgtctctgggtctttgaagccagagtgacacacatcagatagatgcagttttcacccaagaagacctgggtagtgaatgggattagtccaaactcatagtgaagatattaaatataccttgggatgaaaagagtagcag

SEQ ID NO: 46930 - DNA, 201 bp, Homo sapiens
ggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatcttg

SEQ ID NO: 46931 - DNA, 201 bp, Homo sapiens
tggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggatctt

SEQ ID NO: 46932 - DNA, 201 bp, Homo sapiens
gcgtggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttaggggat

SEQ ID NO: 46933 - DNA, 201 bp, Homo sapiens
ggcgtggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttagggga

SEQ ID NO: 46934 - DNA, 201 bp, Homo sapiens
gggcgtggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttagggg

SEQ ID NO: 46935 - DNA, 201 bp, Homo sapiens
gtaactctaatgcctgatatttgatttgcattaagcactgacaagaacctttcatgtctatttctgccctggggtcctaaaacataaattttaacattccwtgcttctccttgatgatcattcccacatagaaatggaactgcattaataatgattgttgaaaaaatgaataaatgattgttgaatgaataaccgaatgaa

SEQ ID NO: 46936 - DNA, 201 bp, Homo sapiens
ctgggcgtggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggttagg

SEQ ID NO: 46937 - DNA, 201 bp, Homo sapiens
ctactccatgtttccctttttctctgcagcttgagcctcaccttaaggcctaagtgagatatgcattctgtcccaaatgatggctcatggggacagaacayttctgagtcttcctttctgaccctctagttatatggcagtgattgcactgagggaaaaccaggaaataacaaaggaaactgcttaagcaagttgtgtttg

SEQ ID NO: 46938 - DNA, 201 bp, Homo sapiens
agctgggcgtggtggtgcgcgcctgtagtcccaggtactcaggaggctgaggcaagagaatcgcttgaacccaggaggtggaggttgcagtgagctgagactactgcactccagcctggtgacagatgcactccagcctggtgacagagtgagacttcatctcaaaaaaaaaaatgtgtttagagtttagatctcaggtta

SEQ ID NO: 46939 - DNA, 201 bp, Homo sapiens
gtcaagagatcgagaccagcctgaccaacatggtaaaaccttgtctctactaaaaatataaaaattagctgggcgtggtggtgcgcgcctgtagtcccagstactcaggaggctgaggcaagagaatcgcttgaacccaggaggtggaggttgcagtgagctgagactactgcactccagcctggtgacagatgcactcca

SEQ ID NO: 46940 - DNA, 201 bp, Homo sapiens
ctgcatagtattccctggtatatatgtgccacattttctttatccagtctatcattgatgggcatttgggttggtttcaagtctttgctattgtgaacagkgcatattcttttttttttttttttttttttttttttgagacggagtctcgctctgtcgcccaggccggactgcggactgcagtggcgcaatctcggctca

SEQ ID NO: 46941 - DNA, 201 bp, Homo sapiens
cagttcagttccttgtacataattcatgtgtcaattgatactcatgaaagttggtcttgaaatattgtatacagcccaaattaagagcttggcacccaatycccacttggactacaaatcacttcctcttgccaaattagagtctagagtaatttaccgtaagatgggcttttaaccctaatttctagacatactcagcag

SEQ ID NO: 46942 - DNA, 201 bp, Homo sapiens
taaaaatactgaggtgttttgtgcgttcatccctctcatatctcatgtatatatcatggagcttccagaggcttcctggtgtacatcattgaaccagactsaaagtagcagataagagaatccagcggattcccttaagtcaaacgtgaaagccctgcaatagccactctttctactatattttcttttgtttaggaaaat

SEQ ID NO: 46943 - DNA, 201 bp, Homo sapiens
tcactcatggttatgaccttgcatttggatggaaagtcatctacaaatatgttttcaccttctcagggcaggctgaacaaagcctgtctgaaggttgtcasataactatgttctccaaagtatggggagtttattaaaaactcagatgcctaaaccatactccgaacctactgaataaggatctctttctgtggggcccag

SEQ ID NO: 46944 - DNA, 201 bp, Homo sapiens
gctttgtgcaatatttgcttcgggggaaaaataaaagaatcaccaaatatgttacaaactctggatttaaaaaaaaaaaacagctctaagaaaatttttawtttttttagtgtgttctcgctatcttggagttatttctagtcatcgggatcttgcatgatttaaacaaggcccttaggtgaccatcaatttatatctaaa

SEQ ID NO: 46945 - DNA, 201 bp, Homo sapiens
ccacgcccggctaattttgtatttttagtatagatgggtttctccatgttgttcaggctggtcttgaactcccgacctcagataatccacacgcctcggcytcccaaaatgctgggattacaggcatgagccaccatgcccagccaccgccactcattttacacagtcccctgtatgtctcctagtgactgccctagaaat

SEQ ID NO: 46946 - DNA, 201 bp, Homo sapiens
ttggataagagtttggggacttccttcttagcacacaaaatccagtctttattccatttaggtgtgttcaaatggtgtcatctcagtgagccctcctctgyccctcttatttaaaattccatacttccagccctgtctgacccggcactccctatagacacatgctttatttttatccagagaacttgtctgtcacttccc

SEQ ID NO: 46947 - DNA, 201 bp, Homo sapiens
ccagggaaaattattgtctccatttcattttagggcctgaactttaggagaataaagttatcctaaagagagctgttggaacctgcctttctaaccagctycctattttctagaaaaggggtcactgtttgtaggaattgtctaggattcctgagaactgccatcaaacattcattttgcttttcctattgctaagcatta

SEQ ID NO: 46948 - DNA, 201 bp, Homo sapiens
atggccagcgagtatttggaagaaatagacaagtgatagggaatggctttggggagaattatctgcatataaggataagggatgagacagactcagcagcygtttcatgccagggcagagtagaaggccgtggagctgctaggtggttggcctggagaaaaaacaaggagttttttctgcaaagtgctggtaggagtttac

SEQ ID NO: 46949 - DNA, 201 bp, Homo sapiens
acctggcactttgggaggccagggcaggtgggtcacaaggtcaggagttcaagaccagcacagttccgtacaacggtgctgttaacttggcagcccgaccscaaatcagcatatcctgagtctatgcaggccccagggtagagtgtacattgtccccaggagtcgaacggacctgggccatcctgcctccttccatctcct

SEQ ID NO: 46950 - DNA, 201 bp, Homo sapiens
agtctctgaggaggtaatcttgttcaaataatagcttttcttgtaactatattttgtcaaattggttatttctgatgatgtatccccaattttctgaaatrttttaaaacttacattgtagctttctctcatttccttattcctatgttctcattctggtccatcatctgttcatttattcagtccattctttgtgtattc

SEQ ID NO: 46951 - DNA, 201 bp, Homo sapiens
cattacccagaaatccaaggcagaggaatcaaaactagaagggggcacagcacaggaggtaagaaaaggaaaaaataactgttgtgtctgctataagtgcrtatgtaggaatctatttggatgtatgtggaaaagtcacatcttcaaagccagatgattcatttgatagaacagggaaccaggagaccctgaaacttcttg

SEQ ID NO: 46952 - DNA, 201 bp, Homo sapiens
taaaatgagttaaatcaggttgatgttttggaccctgtgtctctgccattgctgggacaacttgggatgctgccagtcatgaaagagctaatgcaatgggkaggggtggatggaggtgtctgggacccaggactagatgtcctactaagatgggacagacagtgggagaggaaggtcaggctgggttgtttgattaagacc

SEQ ID NO: 46953 - DNA, 201 bp, Homo sapiens
tttacatcgtggatttgtatgaaataaataggataatgcatgaaccatgcttagcgtgagccataacacgcaaaagcaacataatcagtgtttgttaattktaacaaatcaagcccgggatattgacagacacctaaggcagacttgggagacaatgtctcttgctgctgcctcatgaggaaggtgaatgaccatgcattg

SEQ ID NO: 46954 - DNA, 201 bp, Homo sapiens
ggagggcaacctcttaggagagtgcatggtaatctatgcaagatggtggcctggaccagagactaggaggggatgagaaaaagagagttcctatatacttygaatgcagagctgacaggatttgccgttaactgagatgaggggattccagttggtttggggacatgttaagctgcaatgtgtattgtgtcaatcacacaa

SEQ ID NO: 46955 - DNA, 201 bp, Homo sapiens
ttggacacacttaaaacgaacatgtgtctgattttcctgatttgaaacacctgaaaatgtgcaacagggactgagtcaaccactttactttagagcaagcyggtggagaagaagcagaagttattttccaacaccaaaagtggatttatttttacggctaagctttctgaatgccagatgaactagacaagcgtgtgaaat

SEQ ID NO: 46956 - DNA, 201 bp, Homo sapiens
gggactgcaaagatgtctgaggcccattctttactcctccacatctcaagacctaagggagatagacaggcaaatcaataaccacagtgccttgctattgktgctgtccaaggtgggtgctgtgaagaagtgcttaagggcaagtgctgcagaggcaggcacacctggggtccttttcctggcctggggggtccaggaagg

SEQ ID NO: 46957 - DNA, 201 bp, Homo sapiens
gaaagctgtcctcatggagctgacgtgcagaaaggaggcaaagttcaaagtgccacgattgttctctgctcctttgagatcagactgtagggcacaagggyagaaggagggcaacctcttaggagagtgcatggtaatctatgcaagatggtggcctggaccagagactaggaggggatgagaaaaagagagttcctatat

SEQ ID NO: 46958 - DNA, 201 bp, Homo sapiens
tccagttacaaccaggaagcatctccagtgtgtgtatgtgggcacacactctcccatgtgtggcgtgcttagcactgaatacatgtcagccgtaattattrtgaaagtgactttatttgcctaaagacactctgacccaacctgccagattccattcccacctcggtgccagctctttccccagcatcaacggtccttatc

SEQ ID NO: 46959 - DNA, 201 bp, Homo sapiens
acaaatatttagtgtcgcatatgggctaagcagtgttcaagcagctggtgtcacagcagtgaacaaatttcttgccctcgcgtaacctacatcctaatgartgtttctgttccatctgtaatagtttggctgtgtcctcacccaagtctcatcttgaattcccacatattatgggagggaccctgtgggaggtaatcgaat

SEQ ID NO: 46960 - DNA, 201 bp, Homo sapiens
ggcctagctccatgggaaatattcaacattcatcctgtccgctgatctttacaacaatcctctgtactaggattttattgaagagacagctgagacttcasgggaggcagtgacttgctggtggtcccagagttatgatgcatcagggccaggacttgactgccacccatctttctatctaataaaaaaatagggaattta

SEQ ID NO: 46961 - DNA, 201 bp, Homo sapiens
aaatatgcacattcttgggccccacgccagatctactactaagaacctccatgggtgtgaactataatttgtaagcaaaatgtataagcaagctcccaggrtgaattttgatttggataagagtttggggacttccttcttagcacacaaaatccagtctttattccatttaggtgtgttcaaatggtgtcatctcagtga

SEQ ID NO: 46962 - DNA, 201 bp, Homo sapiens
gatggtggccaggcgagggtggtaggtgaattgctgtctgtcctgggtcgccatgaggcttgtggtgactgcatagatgcccattccctttgtcagccagmaatttcttattccctggctccccttctcaacaacccaagttgaccatcccttcttcagtgaccacagcctcccccaggtaacaatcccattgcagccccc

SEQ ID NO: 46963 - DNA, 201 bp, Homo sapiens
ttacttcgtatgtgttgtcatcttgtcatgctgtgttcatcatggcttttaatgtctacgtagcattccattatcacttttgatcaacagttccctgattkattttttatttttctatagtaaacattgaaggagaaaatataattgtcgctaaatatttcagccaaataagtctgagctatgcattattctaaggccctc

SEQ ID NO: 46964 - DNA, 201 bp, Homo sapiens
gcacattagtaagattgtgtgctttgtgagatcttggagggcttcttaatccaattacagcactccgaggggattaggaacagagacccatgtgtcagcarctccaggtggtctggccctgggcatcatacagctggagttagtagatcccaccttaggcaaatggaaataaacattagcatggccctgctcccttcctaa

SEQ ID NO: 46965 - DNA, 201 bp, Homo sapiens
gcatttctcaatacataattatactatcatcatactattataattttcacttataaacatttatttctcctattaaaactaaagatatggctgtcaaactrtgcacacatttattatccctttatattctaggtttatgttattgtggctataagaatctgctgtaaataattatatgaaatacgactctgatagaatttt

SEQ ID NO: 46966 - DNA, 201 bp, Homo sapiens
tgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaag

SEQ ID NO: 46967 - DNA, 201 bp, Homo sapiens
acctcccagggctggtgtgagggctgaaggcatagatgctggaagctcctggagcggtgtccagccggcgcaatgtaaggctcgatgctgctgcagctgtrttactattaatattaaagggaggctgcaccccgaggctgttttaggaaagaacaggccagacgccttccaggaagcatcagcaggagcctctcctggcgt

SEQ ID NO: 46968 - DNA, 201 bp, Homo sapiens
ttggacaactctatcacttactagctgtgtgtcctggagccagctacttagtccctcaccacctctgtttcttcatctatataatgggtcagtaatcccamccacatgaagttattgttagacttaaataagctgacccatgtaaagtgcttggaaattccctggcacaaagcaagtgctcaataaatattatctgtgact

SEQ ID NO: 46969 - DNA, 201 bp, Homo sapiens
gcctctctgtagcttccatcaggagtattttcaatttcctcctgtccctgacacagaggcccagcaacagacaaagcacattagtaagattgtgtgctttrtgagatcttggagggcttcttaatccaattacagcactccgaggggattaggaacagagacccatgtgtcagcagctccaggtggtctggccctgggcat

SEQ ID NO: 46970 - DNA, 201 bp, Homo sapiens
catgagtcacaaaaataaatgtagtgatgctcttaaagggtttagcaccaagctgggcccaaggaagcattctgtgtgtctattgaccaacttttacctaycctgacaccaaggagcttagagtttagtggagatggcagagccgtcagggcccgtgttaggctcccaaaggcatttttaccagtgcatgtgcctcgcaca

SEQ ID NO: 46971 - DNA, 201 bp, Homo sapiens
aggtgctgaatgctttctgtttattatcacgccgaatccttatgatttctttgtgaggtgcattctactagaccctccagttctcagataaggaagctgarggttagagagctaaggtaatgcacccaggttacagcaggttatcctcaagttccccacggagtagtgacattttgtcaccattgatgctatattactgat

SEQ ID NO: 46972 - DNA, 201 bp, Homo sapiens
aattgcttattcatacatagtacattcatatataggagtacattacaaacctagtctacatacacataagcacgtattaacaatcccttaattaactatcrcacatctactgttgtcaagtacacaataaaacctaatccatacgaatactgacccgtactagaaatccttaatattacgtagtacatacattcgttcatc

SEQ ID NO: 46973 - DNA, 201 bp, Homo sapiens
ctcctttaagtaaaatccaccttttctggaatcatgttggaaagcctgcaggcccacgatgagggactatcttatattctttaactcaggaatcctcgttyctgtttctgcatgtgggaccaaactgagccatgttcagtgtgccagaccaaacactctgaagctggactagagtaatagcaaactggagagtcgcatcct

SEQ ID NO: 46974 - DNA, 201 bp, Homo sapiens
aggcatgaaaaacactgtgtaccgagaagcccagcccctggaatccagcatgctggtgctacattccagctctgtctcttattaactgggccgcttttgayaagttgctaagcctctctgattcttggttacctcaaccttaaaacaaggatgatacccacttcatcaggttgtcatgagtcacaaaaataaatgtagtga

SEQ ID NO: 46975 - DNA, 201 bp, Homo sapiens
aaaatccatcatcattatccttgctaacaaatactgactccttgttatacatatgccaggctatttgccaagctccttaaatgcattatttatatcagtcwcagttgctacccattagactattgggaagagccttccaataagctgtatcttttatgtaaacatagactcaaaaatgtttgcaagttatatttctgatgg

SEQ ID NO: 46976 - DNA, 201 bp, Homo sapiens
ccacatttaaaaggggtagacccacagcagaggtcttggtcagaggtcagaaaggctgagaaaaatgggcagctggcatttcacaattagtcgtgaatgcrttttctattcctttcgagtttttattgcagaacctaatcatgaactccaccaaagtcacattagttcctgttcagtgtttcttatctcctgtgatgtgag

SEQ ID NO: 46977 - DNA, 201 bp, Homo sapiens
atatgttgaaccactaccaatcactcctggatcaacaggaaacttgctacctgatgagttgccttttttcttttttctttttttttttttttttttttttytttgctttttccatccccatgattgttccaacagaaggagaaaagatgtaataaacctttaccgggcaccgtctgcgtccaggcactctactcggccctg

SEQ ID NO: 46978 - DNA, 201 bp, Homo sapiens
aagagtacagtcactggaaggtggactgtcccaggtgggcatcttcctcaaaagccatggactcagcaccttctgtgtatctgcagccaacacatggaaayatctcataggaaatgaatcagagaagtgtgccctgaggggaagagggagcaattcctgccagggcatgcagtgaatgtttccctttcttgccctttggtt

SEQ ID NO: 46979 - DNA, 201 bp, Homo sapiens
aacctctctctcccggtgtccttatagcaaccccagggacagactccagttggctctatctgtgcctcatgtccatcctttgaaccaaccacgggccagtmgaatgtagtactcggattgaccaggcacctgaagtctaagacagcttccatcagtttcctgataactggcatttactgagcactttgtctgcactagatc

SEQ ID NO: 46980 - DNA, 201 bp, Homo sapiens
tgtctcaaagttatcccagaggatatcaaactgagaagacaagtatttcttgggaatgccacaatgtggatgacataattttgggtcagcccaggaaatcygggccctaagatagaaagaaaggaaaactgtgaattctgtatttggaatgtgaaccaagcatatgccgggagacatcctcgaaataccatttccattcag

SEQ ID NO: 46981 - DNA, 201 bp, Homo sapiens
cagaaagagtcctgtgaaaactcagttaaatagcacagctctggatacttgattatttttttaaggaggaaaaagagtgagacattgtcctgtaaaatcayccaaaccctggctttccctggaaatgtggcgcaggcaggcctaaccgtgctgagtattgtttctgaggactgcctccgagttcatgtctctaagcatttt

SEQ ID NO: 46982 - DNA, 201 bp, Homo sapiens
taaatcagcatgcagtgtacatgagtaatatattcataccaggcccagtgaaggagtagacacttatttagtgtgtttatgcagacatagatttaaaaatstataaccacattattatgggttctttacaattgtaggagcaggaagttcacacaggtcttccagcctgtctagcaggtggactgagagtcatgaatttca

SEQ ID NO: 46983 - DNA, 201 bp, Homo sapiens
tctctaaacttgagcaaatgctcagagcaagacctggtgctaggatcggaacagggaagacacatggaaatgaataaggtcacattctagataacttgcayatcacggccccatttttgtaataatccctttctccatcctccacccctatcctcacttccctcttctctatgaagaattcagtttaactgtgtaggttgg

SEQ ID NO: 46984 - DNA, 201 bp, Homo sapiens
gagaataaataatgcattattagaagaataaatcagcatgcagtgtacatgagtaatatattcataccaggcccagtgaaggagtagacacttatttagtktgtttatgcagacatagatttaaaaatgtataaccacattattatgggttctttacaattgtaggagcaggaagttcacacaggtcttccagcctgtcta

SEQ ID NO: 46985 - DNA, 201 bp, Homo sapiens
agggaatagataggagaaaaattttggattcacctttgattgtacttcctgatggagtcaggattggggtgaggagaattgcacgttaacaagcatagatygcacatggagtggctgtcctttgaggtagtgagtcccctcatggttgatgtgttccagcaggagctggtgagcaccttcaggaagagcacagagggattg

SEQ ID NO: 46986 - DNA, 201 bp, Homo sapiens
ttctctgcaccagcccagatggagagcgtcctgggcaaccaaagtccccaggagtatttgcacctctcaaccaagattcttagatcacagctcttaatcayttaccctgcagtccacccacaggagatgagctttatttcagttgtgtaaattagtgaaacagaaccccgaagagctgaaatgtcctcatatctgtcacga

SEQ ID NO: 46987 - DNA, 201 bp, Homo sapiens
agtcaggattggggtgaggagaattgcacgttaacaagcatagattgcacatggagtggctgtcctttgaggtagtgagtcccctcatggttgatgtgttmcagcaggagctggtgagcaccttcaggaagagcacagagggattgttactttatgtagttacattagaagtagggggtctgcaaactgtggcctgcaggc

SEQ ID NO: 46988 - DNA, 201 bp, Homo sapiens
tgtatttgtttcaatggtaaatccttttggaacatatagaatgcagagatttttttttccattaaaataaatgggtattggtggttaaaactgctggacagtaactgttctctgatttctatcttgtgtccaatgtcactgatgttgggtcttgtcttagtgcaagttcacatttttgacagaccatttggggtccgtcgt

SEQ ID NO: 46989 - DNA, 201 bp, Homo sapiens
gggagctaaacaatgagaacacatggacacaaggcgggcttttcagagggtagagggtaggagaagggagaggatcaggaaacataactaatgggtgctakgcttaatacctgattgatgaaataatgtttacaacaaacccccatgacacaagtttgcctgtgtaacaagcctgcccttgtacccttgaaattaaaagtg

SEQ ID NO: 46990 - DNA, 201 bp, Homo sapiens
aatcactaaattttgtacctcttaggactattcaaacccagcaatttgtctctgagaatgatagataaacatgaagatactggagaagtcaattatatatmcccctaaaatgccttcagcgtgttcaaaagcaccgagctctccgccatgatgtttgtaagggggtgacgttagatagtgatcaaagaaaagtctaataca

SEQ ID NO: 46991 - DNA, 201 bp, Homo sapiens
gatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagt

SEQ ID NO: 46992 - DNA, 201 bp, Homo sapiens
ctcccacctcaaggtcttcctattagctgaatacctgccttaggaaatccctcattttctctggctattttctgcatattcttttttttttttttttttttaagcagctttctagcttctctctggaagagtggaaagatgatggggctagcccatagtttctcaacctgggcaatattgacaatttgaactaggtaatct

SEQ ID NO: 46993 - DNA, 201 bp, Homo sapiens
gccactgcactccagcctgggcgacaaagcgagactccgtctccaaaaaaaaaaaaaaaaaaaattcctaagcctagctggggaaggtgaccacacccacytttaaacacggggcttgtaactcagctcacacccaacaaatcaggttgtaaagagggttcactaaaatacaaattaggctaaagcaggaggtaaagaagt

SEQ ID NO: 46994 - DNA, 201 bp, Homo sapiens
tataatacaaaatactatagtataatacaatataatgtgtatgtttctttttaaaaccttttcagtatacgttgaaggaaacaaagacccaagtttaatasggaaatgatttttgtaataaagtgaacaaactggataggttctcttgagctggttacagctgttttctgactgaattttaattataaaagatctagccag

SEQ ID NO: 46995 - DNA, 201 bp, Homo sapiens
aacccgggaggcggagcttgccgtgagcagagatcacgccactgcactccagcctgggcgacaaagcgagactccgtctccaaaaaaaaaaaaaaaaaaaattcctaagcctagctggggaaggtgaccacacccacctttaaacacggggcttgtaactcagctcacacccaacaaatcaggttgtaaagagggttcact

SEQ ID NO: 46996 - DNA, 201 bp, Homo sapiens
tgggcgtggtggcaggtgcctgcagttccagctactcgggaggctgaggcaggagaatggcatgaacccgggaggcggagcttgccgtgagcagagatcaygccactgcactccagcctgggcgacaaagcgagactccgtctccaaaaaaaaaaaaaaaaaaaattcctaagcctagctggggaaggtgaccacacccac

SEQ ID NO: 46997 - DNA, 201 bp, Homo sapiens
gaaatattttcaaaggccattctgggctgcacaaggatagaaacaaatgggaggtccattgggcaggacacacctgtttctacaagagcaacctacttttytgttttgttttaatcaagggagtgtcaagcaattgcttatttcataaacagggctgtgctgctatttttaaacagtgtgaagtccacaggtctgaataat

SEQ ID NO: 46998 - DNA, 201 bp, Homo sapiens
aggctcattaatcatgctcttgattttaataacaattttgtttgttttttctctagaaaagttacgaattaagttgtattccacggactgtatggaggggrgtgaagggaggaagtgtgtgtgtgatctcaaaagccatcatacatctttccggagagtttgaaaataataatctgaaaatccaaaggctgactcacaact

SEQ ID NO: 46999 - DNA, 201 bp, Homo sapiens
caagggcttctccacacctaggatttgatgtagaattactagggcagtatgtaaggacagagaaagaacagaggcagcggcaggcttctgacaagggaatmctggtaatcaggctctctgcataatttttggagatttggagatggagttagtggagggaaagaaagaaacggatataattagaaaaagaaaaaaatacta

SEQ ID NO: 47000 - DNA, 201 bp, Homo sapiens
gcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatact

SEQ ID NO: 47001 - DNA, 201 bp, Homo sapiens
attgctttttagctcagtcttcgagggagtgctggagcaactctgtgcatcggaatcacccgggatcccagcaggtctgggagggactgagattctgctcycaggtgatgctgatactgctgctccccaaagtgcgttaggccatacactgaacagcaaaggaagagaaaaatgcaaagttggaaccttgtgtttcctggc

SEQ ID NO: 47002 - DNA, 201 bp, Homo sapiens
tgatttctccttcacgcacctatgggtgtgaaatgagaaaaaaatatcacttgaaaccaaatcaaaagctacagcaattctggaattaataaaagctcacrtgtagaaggaagtgtgggtttatgggtagggtgaccatgcactacccaggtttgctttacctgaaggcagcggggcacacgtactgaggactattgggta

SEQ ID NO: 47003 - DNA, 201 bp, Homo sapiens
ttctggaaagaattaaattttttattagtatctatttctcatatttctccccagcacagtcagttctgcgtggcgcagccatcctaccaaggggagtctgwgggaaccaggacacttgattgctttttagctcagtcttcgagggagtgctggagcaactctgtgcatcggaatcacccgggatcccagcaggtctgggag

SEQ ID NO: 47004 - DNA, 201 bp, Homo sapiens
tttcccatggctgtcactgttcctcctcctggaggtgcagtatcaccgaggcttctctgtatttcctatcatgggtaatagtaacaatatcaataacacartgatgattatcatgtattgtttaactatgtgtcatacactatgtcaagcacttttcatatatgatcttggtaaatcctcatgccagcctttcgtgggtat

SEQ ID NO: 47005 - DNA, 201 bp, Homo sapiens
ccctagtggggtcgtctaagagcccttgggagggcacttatcttcatgtatatattacataaatcttatttcaaaagggatttctactataaatattagaycatctgtctctaaattctccaactgtttccatctatctctaaatttcccaactatctccatctatctctaaattctctgacagtgctgagatgtaacgaa

SEQ ID NO: 47006 - DNA, 201 bp, Homo sapiens
catagattacaggcagagaaacacttgaaaatcattcacttaagacaaagtcaatagaagacttctcagtctcaaatttttttttattttattattatacwgtaagttttagagtacatgtgcacaatgtgcaggttagttacataggtatacgtgattttgactgaggaaactcgcttcagtttgcttaaaactgaatgc

SEQ ID NO: 47007 - DNA, 201 bp, Homo sapiens
gaaaatgcatttcatttttagttttgcatatgtgcagttctgtatttggtgtagacagggtcatgtagaggaagagtacagtcactggaaggtggactgtsccaggtgggcatcttcctcaaaagccatggactcagcaccttctgtgtatctgcagccaacacatggaaacatctcataggaaatgaatcagagaagtgt

SEQ ID NO: 47008 - DNA, 201 bp, Homo sapiens
aataagcaaacagaggggagcagaaagagtcctgtgaaaactcagttaaatagcacagctctggatacttgattatttttttaaggaggaaaaagagtgasacattgtcctgtaaaatcatccaaaccctggctttccctggaaatgtggcgcaggcaggcctaaccgtgctgagtattgtttctgaggactgcctccgag

SEQ ID NO: 47009 - DNA, 201 bp, Homo sapiens
ggaaagactaaagtcacatgaataagatctcagccctgcatatgtaatggcaaaatgaatgatgtaggctcttcctttgagaaactaacagactgtggatscagctcattgtaaagaaacagccatatgagtgatgtaaagggtattaatccctcaatacaggatcatttatctgtagtaccactccattgctacattgtt

SEQ ID NO: 47010 - DNA, 201 bp, Homo sapiens
cgtgcatgacaaggtgctgaatgctttctgtttattatcacgccgaatccttatgatttctttgtgaggtgcattctactagaccctccagttctcagatmaggaagctgaaggttagagagctaaggtaatgcacccaggttacagcaggttatcctcaagttccccacggagtagtgacattttgtcaccattgatgct

SEQ ID NO: 47011 - DNA, 201 bp, Homo sapiens
tgccattgcccaagctgggaccagaacccctgagccatgttaagaaaaagtcaaccagatccaggcattgttacccttgaatggtaaaggtgatttagtgraatcttgatcaaggctcctgagccatttcctgtgggaaagtagacatctttgaatgactgcacagagaatcgtggtctttgccactctcccctacagttt

SEQ ID NO: 47012 - DNA, 201 bp, Homo sapiens
tcatatgtaccctacccttttcattatccttgaagagaaactcacctcccaccctggaatccactggagcagcctgtaccctgccaaccagtgccccccayaccaggactctctgccacgtgtgtgtactcaccaagtgctcctccatttcccattcctgagttggatctactccagggtcactcccttgcttcatggtag

SEQ ID NO: 47013 - DNA, 201 bp, Homo sapiens
aaaaaaaaaaaaaatagttcccaggcccctgttagacttcatgctccctggctttccctctctcctacaaatattagaatttgttgctcgcctgctatatsttggggcctgcatgctgtgtgttgtgaggagggcaggcaaagctcattgcccttgggatttgttacctggcaagaaagcaaacactgaaccagtaatgat

SEQ ID NO: 47014 - DNA, 201 bp, Homo sapiens
agggctgtttttatttccctgaatcccagttctgtttctgagttcttattcacagggcaggatgggctgacactgtagagacgtgtcctacagtgaaattmgagatgactcctaatttcagtcacatctccatcagtcagcccctcttaggtattgcacaagttccttagatgctttgggcctcagtgtcctcacttacag

SEQ ID NO: 47015 - DNA, 201 bp, Homo sapiens
aatatgtccttggagagtgaaatgaacgagtggctaggaacacacacatgggtgggggaattaacatactgacagggaatgaacaaatgggtggggtaatraatgcacaaatcagagacttaatacatagtatagacagggatgggcatgtggctaggggatgatggatggaggataaaagtgtggatagaggatgaatga

SEQ ID NO: 47016 - DNA, 201 bp, Homo sapiens
aggctctgacctccacctataggttcaattcccctccaccccaaggacttaaagaatttttccagacactttatgactcaccacctagtggctcttcccartgtgactccagctagccacaccaagtccctttcagactcatgaccttagcaggtgctgttccctctgcctagaactttcttcctttatgtcctcacctgg

SEQ ID NO: 47017 - DNA, 201 bp, Homo sapiens
ggaaaatgtcttcatgagcatattcagtgatttggcacttactccacatgagaacgtccctaccatgatgtccagtaaagaatgggctacgtgtcccgcaracttgattacctccctgctccagcttggctctttctacaagggctgtgctggcccaaacatcaatgtctcatttaacttttgaaaatcgtcctcttggca

SEQ ID NO: 47018 - DNA, 201 bp, Homo sapiens
accatcatttcacatgacctctgttttttagatggggaaactgaggcccaagagtgacagtcatgtgctgcaggtcacaggccaagtttgtgacaagaccrgggtgtctgttcgggttttggagaaacaaggaccctagatagggtccattcattcattcatttatttatttatttgttcattctccagacaaatcgttat

SEQ ID NO: 47019 - DNA, 201 bp, Homo sapiens
aagggctgtttttatttccctgaatcccagttctgtttctgagttcttattcacagggcaggatgggctgacactgtagagacgtgtcctacagtgaaatwagagatgactcctaatttcagtcacatctccatcagtcagcccctcttaggtattgcacaagttccttagatgctttgggcctcagtgtcctcacttaca

SEQ ID NO: 47020 - DNA, 201 bp, Homo sapiens
aatcaatctgttgggaagaggtttagaaaggaagaaatcacttaggaattctcttaccctgctttatttttcttcaaataatccaacaagctgggtatttkattatttatgtatctatgtagcatctcactcccacatagggacaacactcatgacagaaggggcctcctatggtttgtccgctgctgtgtccggcattaa

SEQ ID NO: 47021 - DNA, 201 bp, Homo sapiens
gtctagttttataccgttctataaatgaaagtaataaagcacagcaaagttgccgagcgcagtgggttcttaaacacctgcagcgtcatttctcatcagcmggtgggcggcagagttcacatccctgggccctgtcggggtctggccatctccaggtggtgacaggtggcatcagactggcctgaattcagccttggggct

SEQ ID NO: 47022 - DNA, 201 bp, Homo sapiens
aatattgtaattggaccacttagttttcatctttgatttgaggtatttgaaatgaatgtgagattaaagcaaatgaaggggcatgagaagtgttagcaatyctccagacagggaaaatttcttttcattctgtctccatgatatcaaactgaaatcctcagttaaccacagcaggggcaagtgcctgagttgaaaatgtct

SEQ ID NO: 47023 - DNA, 201 bp, Homo sapiens
tttctcttgtccttgtttgtgctgtggtgttagcatcacgagcctaaccaagtgtgtcaatctccctacagctctggagattagacctgtgctttctccasttagagacggctgtgagtgccatgctgggggtgggattctccatgggctgcaggggtctgtgtagtttctccattaacttcagcaacaccccatggaaat

SEQ ID NO: 47024 - DNA, 201 bp, Homo sapiens
gatggctccaccgttcattgtctccacccagctcttagttcatgttacatgggtgctcagcaaatgagtgtccgtctgtcctcctctgtctgcaggtgtgkttctgagtaggagcagcaagctgtccttccagggcatctgtggggcaggcatacctccttgaggtctcccatgggaggaggcaccaaacaaaataagcaa

SEQ ID NO: 47025 - DNA, 201 bp, Homo sapiens
atgaaagcagaaggtttctcttgtccttgtttgtgctgtggtgttagcatcacgagcctaaccaagtgtgtcaatctccctacagctctggagattagacmtgtgctttctccagttagagacggctgtgagtgccatgctgggggtgggattctccatgggctgcaggggtctgtgtagtttctccattaacttcagcaa

SEQ ID NO: 47026 - DNA, 201 bp, Homo sapiens
ttttgagttacaggaaaacaaaaatggtctgtggccaataaatgtctagttttataccgttctataaatgaaagtaataaagcacagcaaagttgccgagygcagtgggttcttaaacacctgcagcgtcatttctcatcagccggtgggcggcagagttcacatccctgggccctgtcggggtctggccatctccaggtg

SEQ ID NO: 47027 - DNA, 201 bp, Homo sapiens
cccttggctctggaagtccttccaggtcaacagctggccctggccacttgcctggaagctttcttccctgctccgagggggccctgctgagagtgagcccsccttccagggtggcgcaggccccagtaacccccactgcgctgcctgcgactcgaattctgttaatcagtttgccttgcgtctcccaacaccgacacccag

SEQ ID NO: 47028 - DNA, 201 bp, Homo sapiens
atttcttaactctgtgactattcctgttttctacttatgaagtccagcctcctcgccccccattcccctcaggtgtggcagtgaggttaaagtggccacasgctgctgttggagtgagccttcctgctccatgtgggttctataaaatgtgcccttggcacctgttcaatcagacccaatgaggattttggaacagtatgt

SEQ ID NO: 47029 - DNA, 201 bp, Homo sapiens
caatttgtgttatggactgtcaaaattaacatgagtatatgaggtaaggcatattggggaagaaagttccacagcgcaatatgcaaccgtggagtttctartcttaataattcagtgggtgccaacaagacgtggtctctattacagacttgaagctggtaatacttcatttttaaaaatgtaaccatttttgagttacag

SEQ ID NO: 47030 - DNA, 201 bp, Homo sapiens
aattaaaagtgttttctttttttttttttttttttttaaaaaaaaaaaaaaaggctgggcacggtggctcatgcctgtaatctgagtgccttgggaagccragccgagcagatcacttgaggtcaggagttcaagaccaacctggccaacatggcgaagccctgtctctactaaaaaaacaaaaattagccaggcatgatg

SEQ ID NO: 47031 - DNA, 201 bp, Homo sapiens
tgaagaagcgactaaagcagtgattgtagggcatttgaacttcatggaccagtaatttttttaaatcctagattgatgagagtgtattttaaaaaatttgstaagacttggtatgaattttttaaaagtaagtaaatgaagggaggggaaaacactaccgccatttacttttgccaggctttccttttaaaaggtcacttg

SEQ ID NO: 47032 - DNA, 201 bp, Homo sapiens
tgagcccctgagggcagaagctggcagcccttggctctggaagtccttccaggtcaacagctggccctggccacttgcctggaagctttcttccctgctcygagggggccctgctgagagtgagccccccttccagggtggcgcaggccccagtaacccccactgcgctgcctgcgactcgaattctgttaatcagtttgc

SEQ ID NO: 47033 - DNA, 201 bp, Homo sapiens
ttcaccaagagacaatatacccatataacaaacatgcacacatgcccccccaatctaaaataaaataatttttttaaaggtactccatcagaacacccccmacctcccgcaccctcaggtgtggcattacagaaacctcagcagcaaagccccttccccatccttctccaatcaccagagcactatgctgactcccagaaa

SEQ ID NO: 47034 - DNA, 201 bp, Homo sapiens
aagagaagagtgtatattaggaagtaactagcagccctgccacaaaaatgccctcatcctcactgccctccctcccttctcagaggaaggcactctcttaragttagtatataaccttcttgtctatgtttctataattaaataactatgttcctatccatttaaaatacatggttttattgatcttaaagttttaataaa

SEQ ID NO: 47035 - DNA, 201 bp, Homo sapiens
cagatgtaagaagagcttacactttttattatatctgacattcaatgggaaaccactggaaaggttggagattggggtgaccagtgtttctgagatgaagygaaaacacttagcctcttttcttcttatgtccattcttctgtgtattgataaagcctccatttttctgacattggaatgggaagagatgtttcagtctca

SEQ ID NO: 47036 - DNA, 201 bp, Homo sapiens
ctcacagaaagcgagtgaccccaagaagcctgcagaagggacttgtcaaacctttgatctctttcaccttcccaccaatacttgagcccctgagggcagargctggcagcccttggctctggaagtccttccaggtcaacagctggccctggccacttgcctggaagctttcttccctgctccgagggggccctgctgaga

SEQ ID NO: 47037 - DNA, 201 bp, Homo sapiens
aggcctgtgaatggttcacatcagcagtgggggtccccagtgaagtaggatcccaaaggccacagcaattggacggatactaatatccttcatgcttccaygggcatgaacttgaacttgcagtggaagcctctaaggcacagcaaggcaggagcagatatgaagtatgctttgcagctgtagcttctctagaatccaggg

SEQ ID NO: 47038 - DNA, 201 bp, Homo sapiens
cccaacccctgggccacggacggccccaacccctgggccacaacatcagattgttattggagcacaaatcctattgtgaactgcacacacaagggatctasgcggcacactccttatgagaatctaatgcctgaactgaggaggaacagtttcatctccaagccatcccccacctgttcatggaaaaattgtcttccacga

SEQ ID NO: 47039 - DNA, 201 bp, Homo sapiens
ttgcctttgccatgttatacgcctgcatcccctttgccttccaccatgattgtaagtttcctgagtcctccccagaagctgagcagatgccagcatcatgyttcctatacagcctgcagaaccgtgaaccaattaaacctgtctcttttataaatgacccactctcgggtatttttttatagcaatgcaagaacaacctaa

SEQ ID NO: 47040 - DNA, 201 bp, Homo sapiens
tgatgttgtctgacctagagatgaactaagtccagtctgggacaggctccccagggagcattttcatggaggtcagtgtgaacccccttttccagattggyggcagggccagctttaggtcccttgagattgtctgcatcccacttcctaagtaaacaaaataatgactagaaaagtcttttcaggaaagggaaaatgtgc

SEQ ID NO: 47041 - DNA, 201 bp, Homo sapiens
gggccagctttaggtcccttgagattgtctgcatcccacttcctaagtaaacaaaataatgactagaaaagtcttttcaggaaagggaaaatgtgcaaatwtacgagacaaaattgcttttctttcccagcagttttctcccttaggaccatttcacaggcctgagctaccctaggagtctgttttgcccacaggctatgc

SEQ ID NO: 47042 - DNA, 201 bp, Homo sapiens
ggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatac

SEQ ID NO: 47043 - DNA, 201 bp, Homo sapiens
cacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacaga

SEQ ID NO: 47044 - DNA, 201 bp, Homo sapiens
ttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaa

SEQ ID NO: 47045 - DNA, 201 bp, Homo sapiens
cttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggttta

SEQ ID NO: 47046 - DNA, 201 bp, Homo sapiens
ccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggttt

SEQ ID NO: 47047 - DNA, 201 bp, Homo sapiens
gccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtt

SEQ ID NO: 47048 - DNA, 201 bp, Homo sapiens
tctcatttacatttcccagaacatcaggttggagtgcagtgacgtgatgcaatcatagtttcctgcagccttgaacttctgagttcaaatgatccttctgyctcagcctcccaggtagctaggactacagacatacactaccacacctggctgagtttgtttgtttgtttgtgtgtttgtttgtttattttgtagcaatag

SEQ ID NO: 47049 - DNA, 201 bp, Homo sapiens
cagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacattgctttgtatcaggcagcatgta

SEQ ID NO: 47050 - DNA, 201 bp, Homo sapiens
aaaaaataagaaagaatataggctctggtgtcatactgcctgggttggagacccagctcttcaatttacatctgtatgacttcagttcattttttttttttcatttctacatggcttggtttccccatctgtaaattgtggatacttacactagctatctcataggttattgtgagaaataagtgagtctgtatgtatgaa

SEQ ID NO: 47051 - DNA, 201 bp, Homo sapiens
cccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaat

SEQ ID NO: 47052 - DNA, 201 bp, Homo sapiens
agacaggagagaatgagaaccaaatgaaaggggtttccccttataaaaccatcagatttcatgagacttattcactaccatgagaacagtatgggggaaastgcccccatgattcaattatttcccaccaggtccctcccacaacgtgtgggaattattaattcaagatgagatttgggttggggacgcagccaaaccata

SEQ ID NO: 47053 - DNA, 201 bp, Homo sapiens
tataaaaccatcagatttcatgagacttattcactaccatgagaacagtatgggggaaagtgcccccatgattcaattatttcccaccaggtccctcccayaacgtgtgggaattattaattcaagatgagatttgggttggggacgcagccaaaccatatcagtaggtcaaatgcaaagcctgaaatatggagaggaaga

SEQ ID NO: 47054 - DNA, 201 bp, Homo sapiens
acgtgtgggaattattaattcaagatgagatttgggttggggacgcagccaaaccatatcagtaggtcaaatgcaaagcctgaaatatggagaggaagacrtcagtataaatcctggttccgtcacttgaatacgttgccttgagcaaattattcccttgcagaatctcagtttttccacctgtaaaatggagacggcaaa

SEQ ID NO: 47055 - DNA, 201 bp, Homo sapiens
agtttacttacgttaatcataatgtcaaacatgtcaacagcatcctggagagccccccaagtttcctgtccacttgtccactgtacagccacctacccacrctttacgtactacccagctcttcctctaagtgggatcctcccagaaagccagagctccgctcctagagagcgtttgaggaacctgcatgtggtttgtctt

SEQ ID NO: 47056 - DNA, 201 bp, Homo sapiens
ttccgtcacttgaatacgttgccttgagcaaattattcccttgcagaatctcagtttttccacctgtaaaatggagacggcaaaaattaacagtcacctcrgggagtaattatgacaccagaatgagctaataaacatcactgttttgctcggtggtgaggttgagtccaaaccttagcagttatgattgtggttgttgct

SEQ ID NO: 47057 - DNA, 201 bp, Homo sapiens
tgcattgatccatttggctattgtgcactaattgcccaatattactttatgacatttttaagtctaaactgaaaggaaagctatgctcagtcatgtaatgytggcaaccatgctgcgcaaacatgggtcccctacatcaggggtccccaacccctgggccacggacggccccaacccctgggccacaacatcagattgtta

SEQ ID NO: 47058 - DNA, 201 bp, Homo sapiens
ctccatcagtcagcccctcttaggtattgcacaagttccttagatgctttgggcctcagtgtcctcacttacagaatagggattttggtaatgaaggccascagctccgtgcatgacaaggtgctgaatgctttctgtttattatcacgccgaatccttatgatttctttgtgaggtgcattctactagaccctccagttc

SEQ ID NO: 47059 - DNA, 201 bp, Homo sapiens
tcggacatgagctataagaccttgcatgagatgcactttctgagaccagcccctccattctcctttcatgccactctacactttcaactccagccaccccrgtccttgttaagttgctgagactatcatgcacaaaggtatttacacagttttgttttgggtttctttgttttttgttttgttttgttttgttttgttttt

SEQ ID NO: 47060 - DNA, 201 bp, Homo sapiens
tgcaaatgtgtttgaatcactgtatgctgtagtgcaactcatccccaaatggagaaggtgcacatttgggctgaaatgttgctttgtagatggacaatacracaagcatatgacggggaacttctggcaaacgataggaaaatggtcaaatgaaaagacaccagtaaaatgagagattggatgaaaagtgatcaggaagct

SEQ ID NO: 47061 - DNA, 201 bp, Homo sapiens
ctattactatatctataatctccctatatataaatttgatacgtatataatctgtgccatgtctagtgctctgctatattgcattgatccatttggctatwgtgcactaattgcccaatattactttatgacatttttaagtctaaactgaaaggaaagctatgctcagtcatgtaatgctggcaaccatgctgcgcaaac

SEQ ID NO: 47062 - DNA, 201 bp, Homo sapiens
cttttaggctttgacattccagcaaggaagcaggtgctgctgacagaaatgtggtagtttgagagaacaggattttaaagaagaacgaacccaattatttkgatccacagagtcttagaagatagaatgcagggaggaggcaagcagggaggaaagagaaggagcttttatgtttcctcattgttactccatcacactgtc

SEQ ID NO: 47063 - DNA, 201 bp, Homo sapiens
atgatgggtcctgtgatgtggccaatgtgaaccatgctgtatgtgcactggcctggaatagataacaacaataaaagaaggaagatgcccaagaagaagtsaaataacctcattgtaaagatgtgaaattgaggtttaaagagaacatgtgatatgcccaaggtcacagagttgatgagttacaatgctgggattggaact

SEQ ID NO: 47064 - DNA, 201 bp, Homo sapiens
tttaacactggctgctctttggagaatggactgtagcaagcagaagagaagcaaagaatcaggtgcattgcagtggtctacacaaaagacgatccctagtygtcttaccacctgcctcctacaataaccaaagaaagtggacccacaccacagctacctcggtccactgcatgtgtggaaggtgatgattctcttgggcat

SEQ ID NO: 47065 - DNA, 201 bp, Homo sapiens
aaaagagctctcctcttcctcagttctgcatttgctggcatggttctagtgaatgtaagaaaggcattttgcagccagcagatgcagtcaacgagcgcaasttgtaaaggctgcagaatgaagccctcaggttatctggcagaattctgctcctggaagaattctatttatgagatgctgctggaattgagcaataaaact

SEQ ID NO: 47066 - DNA, 201 bp, Homo sapiens
cagttctcataatgtaccctttgcaggatagactgtgaaaatctaattttggcaaaatgactgaaatcccagtgaatgattttttcttttcttatataaasctaagcatccaatagtgaaagtttatatgactcaaatggaagaagaattcatgacaaaaggtgtgattattcgcataagaccctgaaattcctttctggg

SEQ ID NO: 47067 - DNA, 201 bp, Homo sapiens
gcaactaaagggatgggaatgtctggagcagcatagaagtgggagtttggctgggacaagagagacaggtggctcttttgagagacctgcctatgggggakggatgaatgagcactttagaattctgggtcacccagcacatgggtcaaccaatgcatgttaaagaaggtttctactctcattcattccctcatgcatgca

SEQ ID NO: 47068 - DNA, 201 bp, Homo sapiens
agcacagtgcctgacatgtggttcagtaagggggccattgtgatgaagatggcatcccggagatacatctctgccgcagaacagctgggctaaaagagctstcctcttcctcagttctgcatttgctggcatggttctagtgaatgtaagaaaggcattttgcagccagcagatgcagtcaacgagcgcaagttgtaaagg

SEQ ID NO: 47069 - DNA, 201 bp, Homo sapiens
cactgacagtgtgacagcagggcccctgtcttgttcgtctcagtgctccccagggcccacatgcagtaccttgtacacagtgcaggcaccataaatacctrttgattgattctggacttgccattcattaagagaagttaatggaggttttctgattcccatcagatgaacaattttggaatgttttatcagtcaaatttc

SEQ ID NO: 47070 - DNA, 201 bp, Homo sapiens
ataagaccctgaaattcctttctgggtgaaataggccctttcttccttccataagaggctctgactgatgagttggcttttattaggcaatgtatgtctgrtgcaatatctgtggataaaaccaccagcccctatcaagtcaatcaaatatttactgagcacttattatgtccaagacactttggagaacaaagaaatata

SEQ ID NO: 47071 - DNA, 201 bp, Homo sapiens
ggctattcacaaggcaaacaaaaatcaagctatgcttgggaggcagagatccacattggaaccacacttctgctgctggaaagctgcatgactcaggcaasctcctagaccactctgagtctttgttttctcatgtgtaaaataaggtggtaatatctacctcccaggttgatgaggcaatggcagacagtaatgtatatg

SEQ ID NO: 47072 - DNA, 201 bp, Homo sapiens
agaagggctgtttttatttccctgaatcccagttctgtttctgagttcttattcacagggcaggatgggctgacactgtagagacgtgtcctacagtgaarttagagatgactcctaatttcagtcacatctccatcagtcagcccctcttaggtattgcacaagttccttagatgctttgggcctcagtgtcctcactta

SEQ ID NO: 47073 - DNA, 201 bp, Homo sapiens
gagatattttctatatttgtagctatcttattaaaaataaaatgggagcaggtttgcctcccataggtcccagctagacttttccctttagcttagtaatygggggtcccaagatttattttcctttcacaatgccaaggtcaataatatatggcaagcacagtgcctgacatgtggttcagtaagggggccattgtgatg

SEQ ID NO: 47074 - DNA, 201 bp, Homo sapiens
tccatcatggttcttgaaatacatgaaatacctaatcataggataggtttcatatgatcccacctcccctgctagacactgacagtgtgacagcagggccmctgtcttgttcgtctcagtgctccccagggcccacatgcagtaccttgtacacagtgcaggcaccataaatacctgttgattgattctggacttgccatt

SEQ ID NO: 47075 - DNA, 201 bp, Homo sapiens
ggccccacccctttcctgcccactattgaaagtgactacatggcaaagagcgcctatttcctagactaaatcattctcagacttaagttattagtgagcgytgttagactcaagttccttgatatctacatcacaactgagtagtttatctcagtggtaagtctcgaagtttgacttcgaagttactaagagccttccaat

SEQ ID NO: 47076 - DNA, 201 bp, Homo sapiens
tagaagggctgtttttatttccctgaatcccagttctgtttctgagttcttattcacagggcaggatgggctgacactgtagagacgtgtcctacagtgarattagagatgactcctaatttcagtcacatctccatcagtcagcccctcttaggtattgcacaagttccttagatgctttgggcctcagtgtcctcactt

SEQ ID NO: 47077 - DNA, 201 bp, Homo sapiens
atcataattttaaaaacccagggttctccaagggcttcagcagcatgccatctctccactttattaaaatgaatgaacagatgtacaatttatttctgccragccatcatctaaattcataagctatttctcatgtgtctgaaatccacgttggtttcccattttctttgccttagaaaaaaaattacactccctcattta

SEQ ID NO: 47078 - DNA, 201 bp, Homo sapiens
agtcctgtcctagaatttcaaaaacagtcagagaaagcaactgtgagaagatcacagcttctcatcctgttttgagtctcaccctcctctttgccctcacraaggatttcagtgattatgttcctgacaggatgcattttaattgttttctggtatgacttcccaatacatcaagttgtgttttctatatagccgctatcc

SEQ ID NO: 47079 - DNA, 201 bp, Homo sapiens
cctgaatctctttgtctgtatttctctgtattgcttggcagtcaatttggtcaaaagcaacaacgaaatgacccttacgaagtgtcaaatgtccctttatrtgagatataaatgtctttgcaaagacacttataaagttgtgaagacgttgtttccttactctaatagctgctgtattcacgtaggtttcaaaaatggggt

SEQ ID NO: 47080 - DNA, 201 bp, Homo sapiens
acaaacactattaattcaagctttccccacctccagagaatcagatgttaaacatttgccagtgttcctctggcaaagaaaaggaaaatagccagaggtargtgaaatcaaatgagagaagtccaaccttgcaaaactgagccaactgcactgatgtatcctgttgtctgtcccacaccctcgcaaggcttttggtctttg

SEQ ID NO: 47081 - DNA, 201 bp, Homo sapiens
ctagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctcact

SEQ ID NO: 47082 - DNA, 201 bp, Homo sapiens
tgcacttgtaattagctggagcacatctgacccatcgtcccctgagggagggcagcttggtggtccctagctcaagaaggggcagcccccaccccctgaamttagggaggggaggtctacagctttttccaggaggtacctcagcccaaagtctgtgaatccacaaaagcaaggtcggcctacccttttacgtaagccacg

SEQ ID NO: 47083 - DNA, 201 bp, Homo sapiens
gataaataaattagcacggtgtgatgttatgcacctataatcctagttacttgggaggctaaggtgggaggataacttgagcctgggagttcaaggctgcrgtgaactatgattacataactgcattccagcctgggtaacagagtgagacccagtctcaaaaaagtacatacacacatatataaacaaacacttaggttt

SEQ ID NO: 47084 - DNA, 201 bp, Homo sapiens
atgaaagctatcttgtggttgcaccttaaagcatctgtgtaatgcttttacccatactaagagtgttcaatccctgttttcacctaggattgataagtgtrtttctggatttcagaaatcggatagcttctgaagtctcagcctgttaatatggtaactaaatatgttaaggtcctagtctctcaatgtttaattactgtt

SEQ ID NO: 47085 - DNA, 201 bp, Homo sapiens
acatatgtacagtgtccaaccccacaaaggggatccctgttattcgtagggagatggtgtagcagtgttgccctagagccaattcatagcagtttgcaggrgccagttgttaccatctctttgtagctgtgcattcagtgacatcgtgggagtaactcgaaactggccacagtggaaatacttctatcatggaattagaca

SEQ ID NO: 47086 - DNA, 201 bp, Homo sapiens
catgcacttgtaattagctggagcacatctgacccatcgtcccctgagggagggcagcttggtggtccctagctcaagaaggggcagcccccaccccctgmacttagggaggggaggtctacagctttttccaggaggtacctcagcccaaagtctgtgaatccacaaaagcaaggtcggcctacccttttacgtaagcca

SEQ ID NO: 47087 - DNA, 201 bp, Homo sapiens
gatacatggatgtagcaaatttaaccttagacctagattacctataggatcagacttgatcagtcattaataatgataatgaaaattaatcatgaaagctrtcttgtggttgcaccttaaagcatctgtgtaatgcttttacccatactaagagtgttcaatccctgttttcacctaggattgataagtgtatttctggat

SEQ ID NO: 47088 - DNA, 201 bp, Homo sapiens
catttgtgccgctctttttcctccctcttttggcttcgaaaaagtggtgggtctcatgcacttgtaattagctggagcacatctgacccatcgtcccctgrgggagggcagcttggtggtccctagctcaagaaggggcagcccccaccccctgaacttagggaggggaggtctacagctttttccaggaggtacctcagc

SEQ ID NO: 47089 - DNA, 201 bp, Homo sapiens
agaaatgaccagtaacacggttctagaggaatttgccaatgctcattttttattctatgtggtggtgtttttttttttttttttctcattgcagaagacarattctatttccttactcctgagggaaaactaattccagcaaaggccatttgtctttggtaccttaagatctagataatttactgcaagtttatttttatt

SEQ ID NO: 47090 - DNA, 201 bp, Homo sapiens
tggtaccaaactccaagtcgtcctgttcttttccaagcgccatttctactgcttagaaaaagccacccaatctggatacatggatgtagcaaatttaaccytagacctagattacctataggatcagacttgatcagtcattaataatgataatgaaaattaatcatgaaagctatcttgtggttgcaccttaaagcatct

SEQ ID NO: 47091 - DNA, 201 bp, Homo sapiens
tggatgccaatgtgccttcctaaaatgctgcaaggctattctggaaaaacagttctggagacagattctggcattaactatctctgttaacatagtggtarctaggttcttcccacttctgcttgtttcagctaagtaaaatataagggagtccagtaattcatgaatggataaacaaattgtgatacatccttgcaatgg

SEQ ID NO: 47092 - DNA, 201 bp, Homo sapiens
tccgtgatgctgccacatgtgtcagggctgtgtggctgttacagaggaagggtctcgtggggagggagcagtgaaactggtggagcaagcaaggtcggacygacagactatcttctcggatgtaagagaggttgttctagggaagccgtgttcctggcgctgggaggctttacgaagagtttttgaaatctccagcttgaa

SEQ ID NO: 47093 - DNA, 201 bp, Homo sapiens
ttggggaatggggcagttcctgggaaagggacttattggtgggaatccagttctgctatgaatgctcctgactcctgcactcaaatcccaacagatgaaasggaggagagactgacagatgcagtgccttcctttatgtaacctccttgatccaaactacagtctgacccatgctttctggctttatattgtaccactacg

SEQ ID NO: 47094 - DNA, 201 bp, Homo sapiens
ataggtctgggtttccctttgaagtcatggaaatgttttggaactagacagaggtggtggttctacaacatcatgagtacactaaacatgactttaaaaaygtttcatatgtgagtttcacctcattttaaaaatcacagtgcacaaaaagaggtaagggaggccagagaaactggacaggaaaacccaggtgtgaggacc

SEQ ID NO: 47095 - DNA, 201 bp, Homo sapiens
cttcaggcccagcccatgtcacctttcccacttctgtcactctacttggtccccctggattttgtgcagtttttcaaaggtatgggcatttgctaaggctstctccctcctcttccccatgaacttccatcagacagaccttctctgaacagccttcatccgcaatctaaatgggatctcgttattatattcttccatgtt

SEQ ID NO: 47096 - DNA, 201 bp, Homo sapiens
cacacattcagggaatgggtagaagtggaattcacacccaggtcagtgtaagaccaaagaggctgtcagaatggtttgctgttccactcatggcgaacagsatttgaagttgttccagtccaagggagaccatcaggccatgcaggaataaaaaggccaaggggaggaaagaagatgctgtcttcattaaggcctgaagga

SEQ ID NO: 47097 - DNA, 201 bp, Homo sapiens
aactagacagaggtggtggttctacaacatcatgagtacactaaacatgactttaaaaatgtttcatatgtgagtttcacctcattttaaaaatcacagtrcacaaaaagaggtaagggaggccagagaaactggacaggaaaacccaggtgtgaggaccaggaggaagagggtggggcagaggggacaaggcagattcga

SEQ ID NO: 47098 - DNA, 201 bp, Homo sapiens
gcaaagcaaagaaaaatcactcaataaaaccactgttaatattttagcataatcttgatagtggaatgcctttattttttaaaaattgcattatgtatacrctaattttagtcagaatttgtacttcttaacatgcatactataccattagtatatttttacattctctaaagtgtgtctgcaatgcagtgttctactttc

SEQ ID NO: 47099 - DNA, 201 bp, Homo sapiens
ccttcaacattccataacgtggtggtggtattcccaccttaccccgggagaagctgagagtcacagggagcatttactttccaagttcacacattcagggmatgggtagaagtggaattcacacccaggtcagtgtaagaccaaagaggctgtcagaatggtttgctgttccactcatggcgaacaggatttgaagttgtt

SEQ ID NO: 47100 - DNA, 201 bp, Homo sapiens
gtacactaaacatgactttaaaaatgtttcatatgtgagtttcacctcattttaaaaatcacagtgcacaaaaagaggtaagggaggccagagaaactggrcaggaaaacccaggtgtgaggaccaggaggaagagggtggggcagaggggacaaggcagattcgaggggatgttccgccacattcttcagggtggcatgg

SEQ ID NO: 47101 - DNA, 201 bp, Homo sapiens
tccctctttcttcattttctcacacagattgtttagcattctattaatgccactgtcacaaggaaaagcaatacttttattacagtctctctcctctgtcrattctaggcttcttgagaaagtttgtaatgtatgcattcttcaaagaggtattgttattaatagaggctcagaagatggctgaatgaatgaagagtgtgt

SEQ ID NO: 47102 - DNA, 201 bp, Homo sapiens
aggaccaggaggaagagggtggggcagaggggacaaggcagattcgaggggatgttccgccacattcttcagggtggcatgggcagcttttatgtagatgraaacaattttaggaaattgcagcctaaagcggtgttcagtacacaagagaggccctcaagagaaggtcaccaagggaaggcagaagagcagcctctgcct

SEQ ID NO: 47103 - DNA, 201 bp, Homo sapiens
ttttctggtcttctttgcatgactcaatccctctttcttcattttctcacacagattgtttagcattctattaatgccactgtcacaaggaaaagcaatayttttattacagtctctctcctctgtcaattctaggcttcttgagaaagtttgtaatgtatgcattcttcaaagaggtattgttattaatagaggctcaga

SEQ ID NO: 47104 - DNA, 201 bp, Homo sapiens
actattgagcatttgaactgcagctagtgcagctgtagaactgagttcttaattactgttttttaaatttaaatagctgcatttggctgatggccttactrttggaaagcataggttttgaatgtcacaggtgaaaactgtctttagcatcacgtgggcctatgttttaacaccaattttgcctctcccttgctatgtaat

SEQ ID NO: 47105 - DNA, 201 bp, Homo sapiens
gtcacaaactgccattcaggcttcccgattgtgccattcagagactttttgctactactgactcctgccttcttcaccaggagctcagggactccaccttygtgagaaaaggagggcaagacacacagcaggattccagccaaacaatgacttaatgatggcatgcccctgcttggcatgcctagccttctctcctacctg

SEQ ID NO: 47106 - DNA, 201 bp, Homo sapiens
cttctgggatgcgccgtaataatcaaggaaatggatgggcagctgtggagttgatgagctggtgagctgggaggacaccagaggtaggatggggatgggaytcagggagctgaccactctggacacccgtgaggacagaaatatcacccatttgtgggtatgaaaacacaagaaagcaattcatgacactctatgcaaggt

SEQ ID NO: 47107 - DNA, 201 bp, Homo sapiens
agtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggcca

SEQ ID NO: 47108 - DNA, 201 bp, Homo sapiens
ccagagagtcgacatgcacatggtgacttctctacaatcaatacctccagcagccccccaaccctgtcccttccaggtactgtttttcccgaatcagagcytcctgcttcttttcttgggcactttagatccacggattaacacaattgtgccacttgccatacttctgggatgcgccgtaataatcaaggaaatggatgg

SEQ ID NO: 47109 - DNA, 201 bp, Homo sapiens
gtacagtggcatgatctcagctccctgcaaactccgcctcccgggttcaagtgattctcgtgtctcagcctcccaagtagctgggattacaggtgtacacmaccacacctggctaatttttgtgtttttagtagagacaaggtttcaccatgttgagcaggtgaccccaagtgatccacctgcctcggcctcccatagtgc

SEQ ID NO: 47110 - DNA, 201 bp, Homo sapiens
agcaaactgaaaataaatcttgccttatgttgccaacattgcatttttttttctttttcttaatttatctgtgaatattgtttttcttcttcttcttcttyttttttttaaatggagtttcacactgtcacccaggctggagtgcaattgcgcgatctcagctcactgcaacctccgcctcccgggttcaagcaattctcc

SEQ ID NO: 47111 - DNA, 201 bp, Homo sapiens
cctgacttcagtcgttcctttaagatgcccaccgtgacgggcccagagagtcgacatgcacatggtgacttctctacaatcaatacctccagcagcccccsaaccctgtcccttccaggtactgtttttcccgaatcagagcctcctgcttcttttcttgggcactttagatccacggattaacacaattgtgccacttgc

SEQ ID NO: 47112 - DNA, 201 bp, Homo sapiens
atgcagctgtgggcacatgaggagggggaaagatatcaatgcctctgatgaatgtctagcaaagttttccttgtgaaacctcatggaaagttccatgaggycagagatcacatctactttgttcactgttctatcctttgttgctgacacatagtggccattcagtaaacatctgttaaatcgaggaagcagtgaatgagt

SEQ ID NO: 47113 - DNA, 201 bp, Homo sapiens
cccggctaatgttttgtattttagtagagatggggtttcaccacattgcccaggctggtcttgaactactaagctctgagctcaggcaatccccccgcttyggcctcccaaagtgctaggattacagccgtgagccaacacacctggcccaatagttccaattttttatgtgtatatttttaaaaaattaagttgtgactt

SEQ ID NO: 47114 - DNA, 201 bp, Homo sapiens
tcctgtgaggagtgacagaggtaatgtgtggcatggagccatcagtgacatttggtgattgaatgttgctggtggcagtgtcttaatgatggagacaattsattgataggaggtcaactgccaagcagttaatccgatggcaaattccgctcataatggaagagctggcccatgcatgcaaaccagcatggtgggggattc

SEQ ID NO: 47115 - DNA, 201 bp, Homo sapiens
catgcccggctaatgttttgtattttagtagagatggggtttcaccacattgcccaggctggtcttgaactactaagctctgagctcaggcaatccccccrcttcggcctcccaaagtgctaggattacagccgtgagccaacacacctggcccaatagttccaattttttatgtgtatatttttaaaaaattaagttgtg

SEQ ID NO: 47116 - DNA, 201 bp, Homo sapiens
aaaacacctgtggaatctcttggtcagctggccagcaggagtttgaagccagggtgaactcaaagcattctcccaaagaagcctttttcaaccagggggcrctgacagaagttgtcaacacgtctggcaaagctttccagcatctgctatgatgtcttaatcctcctgtgaggagtgacagaggtaatgtgtggcatggag

SEQ ID NO: 47117 - DNA, 201 bp, Homo sapiens
gagtctcagtctgttgcccaagctggagtgcagtggcgtgatctcggctcactgcaacctccgcctcccaagttcaagcaattcgcctgcctcagcctccygagtagctgggactaaaagcgcacactgccatgcccggctaatgttttgtattttagtagagatggggtttcaccacattgcccaggctggtcttgaact

SEQ ID NO: 47118 - DNA, 201 bp, Homo sapiens
tgcattggtgctcaaacattggtgaagccccaagtacttgagagggacaaacaaaacacctgtggaatctcttggtcagctggccagcaggagtttgaagycagggtgaactcaaagcattctcccaaagaagcctttttcaaccagggggcactgacagaagttgtcaacacgtctggcaaagctttccagcatctgcta

SEQ ID NO: 47119 - DNA, 201 bp, Homo sapiens
gatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcct

SEQ ID NO: 47120 - DNA, 201 bp, Homo sapiens
cttggcctcccaaagtgcactgccttcattcattcttaaatcattcatttctttgtggaagccccttagctccatgtagtttatggatgtgtcagaacaarctgaatattgtttattcttttactttttaaagagatgagtatttgagtcctctgattcacagtgaatttcagaattctatcagctaaatacctcttgaag

SEQ ID NO: 47121 - DNA, 201 bp, Homo sapiens
ccattctcctgcctcagcctcccgagtagctgggactacaggcgcccgccaccacgcccagctaatttttttgtatttttagtagagatggggtttcactgtgttggctaggatggtctcgatttcctgacctcgtgatccgcccacctccgcctcccaaagtgttgggattacaggcgtgagccagcgcgcctggcctat

SEQ ID NO: 47122 - DNA, 201 bp, Homo sapiens
gttggcaggaagccattcaggagggatctacccccataagccaaatatctcccaccagcctccacctccaactctggggttcacatttctttctttctttytttttttttttttttttttttttttggagtctcactctgtcacccagactggagtgcagtggcatgatcttagctcactgcaacctctgccttccaggtt

SEQ ID NO: 47123 - DNA, 201 bp, Homo sapiens
gaagttgattgaggaactggagggaaagttaaggtcctaactttagtgattgggtttctgtgtcaccaccttggcccaggagactgttgataccccccccmtttgctttgtctccccatttcttttagtgtctctttccagctgagcagtcttctgactcccactagttcaagtttctgagggagaagctgattgagcgga

SEQ ID NO: 47124 - DNA, 201 bp, Homo sapiens
ggaagttgattgaggaactggagggaaagttaaggtcctaactttagtgattgggtttctgtgtcaccaccttggcccaggagactgttgatacccccccmctttgctttgtctccccatttcttttagtgtctctttccagctgagcagtcttctgactcccactagttcaagtttctgagggagaagctgattgagcgg

SEQ ID NO: 47125 - DNA, 201 bp, Homo sapiens
tgagttggcttttattaggcaatgtatgtctggtgcaatatctgtggataaaaccaccagcccctatcaagtcaatcaaatatttactgagcacttattawgtccaagacactttggagaacaaagaaatataacctggccttgcccttcaggctgtatcaattgagatagaatttggactgctgcaatcaattacacaga

SEQ ID NO: 47126 - DNA, 201 bp, Homo sapiens
ggtgcaatatctgtggataaaaccaccagcccctatcaagtcaatcaaatatttactgagcacttattatgtccaagacactttggagaacaaagaaatayaacctggccttgcccttcaggctgtatcaattgagatagaatttggactgctgcaatcaattacacagatgtctctcaaggtagtgtcttgatgcttgag

SEQ ID NO: 47127 - DNA, 201 bp, Homo sapiens
aggctgtatcaattgagatagaatttggactgctgcaatcaattacacagatgtctctcaaggtagtgtcttgatgcttgagggaaacaagacaaaatgckattaataatgacttagttttctttgtcaagcaatcggcttgccacatcattgaggtaacttcacattttcttgcatcttttacaattagcagcttcagct

SEQ ID NO: 47128 - DNA, 201 bp, Homo sapiens
tcagctgactctgcaacctgttgagaaagagggcccaggcaatgttgtccttggcatcttattcaggtctggcttccactgcagtgaatgcactcagatakccctttatcagctgagtccccttgagattaagtatttaatgtctcttgatctccagccttaggaaataacccaattcattactcagccattatgtaattc

SEQ ID NO: 47129 - DNA, 201 bp, Homo sapiens
tgcaacctgttgagaaagagggcccaggcaatgttgtccttggcatcttattcaggtctggcttccactgcagtgaatgcactcagatagccctttatcarctgagtccccttgagattaagtatttaatgtctcttgatctccagccttaggaaataacccaattcattactcagccattatgtaattcattactgtcat

SEQ ID NO: 47130 - DNA, 201 bp, Homo sapiens
gatggtttcgggatgacactgttccaccttagatcatcaggcatcagttagattctcttaagaaacgtgcagcctggatccctctcattcccagttcacartaaggtttccgttcctatgagaatctaatgccaccactgatctgacaggaggcggtgctcaggcggtcatgctcactcacaggatgctcacctcctgctg

SEQ ID NO: 47131 - DNA, 201 bp, Homo sapiens
aaccagtgacactgttatgcaaacatgaagtattgaactatatggaagtatttatctgtttaaacactgggggaagagacttttaaaatatggtttatatkctcggtggttcggtaaaggtttttctcctgctcctcatcccccagccaaccttctccaatatattcagccatggctgactttggaggataatgaaagcca

SEQ ID NO: 47132 - DNA, 201 bp, Homo sapiens
atttggcaatgtctggagataattttttgttgtgacagtgtggaccaggagtgggaggagaacatgactagcatctagtgggtgaaggccaggggtggtgktaacatcctacaatatacaggactgcctatcatagcagaattatctggcccaaaatttcagcagtaccactgttgagaaaccctgggtacctgcccatta

SEQ ID NO: 47133 - DNA, 201 bp, Homo sapiens
tgaacaaatggatgaagagcctcacaccaaggaaagcttacgttgctaccaactggtaccaaactccaagtcgtcctgttcttttccaagcgccatttctrctgcttagaaaaagccacccaatctggatacatggatgtagcaaatttaaccttagacctagattacctataggatcagacttgatcagtcattaataat

SEQ ID NO: 47134 - DNA, 201 bp, Homo sapiens
ctgtcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctc

SEQ ID NO: 47135 - DNA, 201 bp, Homo sapiens
ctttcaaccagcagaaacgaatttcctggaaggcattggtactcatcactgggggaggttccggggctttccagcttcaggtgcagctgcgtctaagccckcagacaatgtggacgggatgctccttgtctgcagctccagctgtcagctctgcctgtctctctatgttggctttattctctgctaggctctctccttgtg

SEQ ID NO: 47136 - DNA, 201 bp, Homo sapiens
gttttagcaggtcatttagtgtaagcccactagaaggaggcatgtggtgtggggtccaggacaggctgtgagtacatgttctgcaccagacataatttacwtggaggcttggggagaataagcttccaggtgaggaactcagtggctgagttgcaaagagctggaaatgagagaagcaaacttaatgactatgtacgtgct

SEQ ID NO: 47137 - DNA, 201 bp, Homo sapiens
actagcatctagtgggtgaaggccaggggtggtgttaacatcctacaatatacaggactgcctatcatagcagaattatctggcccaaaatttcagcagtrccactgttgagaaaccctgggtacctgcccattactgctcccttctaaaacaacacatatttcttcataggcccttgtgaatttatttgttttatttgat

SEQ ID NO: 47138 - DNA, 201 bp, Homo sapiens
atatttgtatatattcaggcctaggaatgcagggaaaaaagggataaaacacactgaatgaaaagagtgtgaacaaatggatgaagagcctcacaccaagkaaagcttacgttgctaccaactggtaccaaactccaagtcgtcctgttcttttccaagcgccatttctactgcttagaaaaagccacccaatctggatac

SEQ ID NO: 47139 - DNA, 201 bp, Homo sapiens
ggtccagataggaatgctgtagaagctccagggaggaagagactccaggggctcaagtggtttagcagggctagcaggactagcaggacaagacagagttygaatgagatcgttgcatctaagtggaataaggagaagctgataatgcaagaaggtcaaccatctcacacacatctagggaccgtggggaaacccattttg

SEQ ID NO: 47140 - DNA, 201 bp, Homo sapiens
tacaaggttagcacaatccaggaagagcaaacattgtgtgcagatgccctgaggcatacaagagcccggttgaggggctgagaggtggggccagggcgggktgggagaggtggcacacacccagggactctgtcccctattacagactccaggaagccatgcatttccctcgagttcccccaaatcactccccagtcacga

SEQ ID NO: 47141 - DNA, 201 bp, Homo sapiens
agctctctgccttggtgcctttgcgtatccatctctactgaggaactgggatgacttcagcatccggggtagatgcctggcatgaaccagaaaggatatcwgattagatctgtaggtgatggtgagaatggatacaggactgtttcagtcaagtacctacctctaaacaggagggcactgtggattttaggattggagatc

SEQ ID NO: 47142 - DNA, 201 bp, Homo sapiens
acttgagacagtgtttgctgtggagcaacatgtgtgtctggccggtaaacctgcaataactcagtgcgcagacattgccaggcaaggcctttctgggagamatgatccaatgaggggaaaaaatacttcagttttgttgagagatgatcttaatctgtttgagctgctatataaaaaaataccatagactaggtggcttaa

SEQ ID NO: 47143 - DNA, 201 bp, Homo sapiens
caaggattttgtgttttttttcttcgcggttgtttagttttgctttgggtgacaccccttctcatttgctgtgaagataccgcaggatgataaactccctsttctatactaagtcccatctgcaaggaaaggaaacttcactctgctccttccatcttgctgaatatttaaagggtattgacacaaggcgttttgataggc

SEQ ID NO: 47144 - DNA, 201 bp, Homo sapiens
cacaaaaaagcaacttaccatgaatcaatttaaagtgaagaccaaagtgtgactcaaaactgaaaaaatatatgtatttggttaagatgtaattgttaccraagcaccaggggtttggtctgggtcctgctgttcactgcacagaaagccaatcactgagataagacaaaagccagggaagaaggctttaatcgggtgctg

SEQ ID NO: 47145 - DNA, 201 bp, Homo sapiens
tggtacaaggttagcacaatccaggaagagcaaacattgtgtgcagatgccctgaggcatacaagagcccggttgaggggctgagaggtggggccagggckggttgggagaggtggcacacacccagggactctgtcccctattacagactccaggaagccatgcatttccctcgagttcccccaaatcactccccagtca

SEQ ID NO: 47146 - DNA, 201 bp, Homo sapiens
acctaaaggtaatcatcctggtttatttatttattcaaaaaatattgaaaaattcacactgtgagccgggtcctaactagccctgaggatagcagtgaacragacagtgtggagtttccattctagtgggaagaccggcaatgaacaagccaatgaatgtctgatcacacaaccggtgtgattacagcttacagctctttc

SEQ ID NO: 47147 - DNA, 201 bp, Homo sapiens
gatgaaggctccgacagctgaagaacttacccaggctccagaccccaactctcaaccctctgctaagctgcttctgtcccgtgaaaggattagcaatttaycagtccagtgccagtagagcccactattcaggcatttctgccggattcagtggcagccattatatgactctccagtggtctagcccttggggtcagctct

SEQ ID NO: 47148 - DNA, 201 bp, Homo sapiens
aaagtttaaggctatctcccttccttattcctctctctgattactgtcaatgctagctagttgatgtcagtaatgacaagtttgtattttaatttttaagmttgagtgatccatcacacctcaaccagagtaggtggttattcctactacctgcttggatgtcaaatgcatcagttggcaatttgtatttcttcagctttc

SEQ ID NO: 47149 - DNA, 201 bp, Homo sapiens
gtctattgctcccatctttgtgtctgtgtgtactcaatgtttagctcccacttagaactgagaacatgcagtatttggttttctgtccctgtgctaattcrcttaggttaatggcctccagctgcatccatgttgctgcaaagaacacaatttcatcctttttcacagctgcatagtattccatggtatacacgcactgca

SEQ ID NO: 47150 - DNA, 201 bp, Homo sapiens
gtagtctatacatgatgatcagagatggcctttctgaaagggagacatttaaacagagatctgatgaaagagaaggtcatgagctatacaaatatctgtaragagagaaagccccacaggtgtacagccagcaagatggtggaggatgcaggaggttgggtgcaggggaactgttgcaaatcgtagggccccagagtctga

SEQ ID NO: 47151 - DNA, 201 bp, Homo sapiens
gcccatagctcatgttgcaacgaaggctgtaacaggaaagcaggccctacatgactcttatcatttcatttatgtcccatgatttcttcaactcagttagktcaactgtggtggtttcagtgggatgctatctatgtatgttaattatctattgttgcattagaaattttccccaaatttagtggcttacaagcaagtatt

SEQ ID NO: 47152 - DNA, 201 bp, Homo sapiens
ttaggactttttggcaattcaatgagttctttctaaggtaaatgttttggtgtttaagctataacattatcatacctataataaaaacgacataaaacttrtaagatcctgtcctccagctggaaaatgagagatgggcaaatgctccagttttcacaaagggacaaaggtaaatggtaggagttaggagctgtcaagctg

SEQ ID NO: 47153 - DNA, 201 bp, Homo sapiens
ccaaacagtgccacagaacaaacgtaacaggatattaagataatctcttttgtctatgccaaatgtcatttagctgttgagagaggaatgtcccatctagkttttacaaacaataaataatacagcttatgaaggtccacatgggtgacactgatgcaatgtttcaacagttttccgaaaaaggaaaataaaatgagtcat

SEQ ID NO: 47154 - DNA, 201 bp, Homo sapiens
ccaggttaaaaggctactcttttcctttaaagtgacatatgaatctgctcaagcacttcaaaatacatggttaggaccctagagttctaggggagaagcarttctgcaggagaggtggcagaatctgtaaaatgcatcactatgagatcaggcctcgggacaaaagcgagagagaccaagagaaacctgctggggagagga

SEQ ID NO: 47155 - DNA, 201 bp, Homo sapiens
ttcctcatttgtagaaaggtagaaatgagagaatatgcttcctagagtcactgtcgagataaaatgaggtatagcatatgaagtacgtggaactgggcaamtaataaatacttgataaacattatttgtgtctttgggtattgataacttatatatgtcttatgcagtggtgctttgagaaaatgaggtacagagaggtga

SEQ ID NO: 47156 - DNA, 201 bp, Homo sapiens
gaaaccaggaggcggaggttgcagtggattgagatcacaccactgcactccagcctgggcgacagagtgagactttgcctaaaaaaaaaaaaaaaaaaagmgcccccccactcatccacacttactctcttacaatcctggaaggcaacttgtttcaatgggctagaggcaagttgttggctagaggagattccattgctg

SEQ ID NO: 47157 - DNA, 201 bp, Homo sapiens
cactaaaatatacggtggtattcttttaaaaaattcatacaattgaaccgggtacaaagaatcacctgggttttttgtttgtttgtttttgttttgttttygttttttggtttttggtttttttgagcttttagattcagggggtccatgggcaggtttattacctgggtctattgcgtgttgctgaagtttggggtatga

SEQ ID NO: 47158 - DNA, 201 bp, Homo sapiens
ctgtcgcccagtattttctaaagtatagagatgaggacagtggtgatgacaccgctgatgaggatggtgggaggaaggccatgatgaagaagaagattgtratgagaaagatattattatgacagtgatgtttccaaaatgtcagaggccaaattgacattcttatcgaaagggccacctcccctccaggttaaaaggcta

SEQ ID NO: 47159 - DNA, 201 bp, Homo sapiens
agagtcactgtcgagataaaatgaggtatagcatatgaagtacgtggaactgggcaaataataaatacttgataaacattatttgtgtctttgggtattgwtaacttatatatgtcttatgcagtggtgctttgagaaaatgaggtacagagaggtgaagtaactatgctcacgtcacatagccagaaggcagagggctag

SEQ ID NO: 47160 - DNA, 201 bp, Homo sapiens
ctgtgactttttaaaatcacaattcgatgaaaagttcaacacactaaaatatacggtggtattcttttaaaaaattcatacaattgaaccgggtacaaagratcacctgggttttttgtttgtttgtttttgttttgttttcgttttttggtttttggtttttttgagcttttagattcagggggtccatgggcaggttta

SEQ ID NO: 47161 - DNA, 201 bp, Homo sapiens
catgttaagtgctctacatcccagtctcttcacctgttaacgggctgatcgcagagcccacctcattaggtcattgtgaatgagctaatgactaaaagaamctagatagtgcctgtcgcccagtattttctaaagtatagagatgaggacagtggtgatgacaccgctgatgaggatggtgggaggaaggccatgatgaag

SEQ ID NO: 47162 - DNA, 201 bp, Homo sapiens
accaaaggcaattaataattgtttaatccttctggagagccatttgttgtggtgatattcacatgactgtctttaacaccatgacaccaggagggtcttayttcgccagccaccaagctggggacatcatgctgggtaattgtctgcaggtgcatttaactgaaaacctttctctaagattctggagttcacagcacacaa

SEQ ID NO: 47163 - DNA, 201 bp, Homo sapiens
cactactcctaagacccaggtcagacagcgaggcatcactgttaagagcatgggcgctatggttggacaactctatcacttactagctgtgtgtcctggasccagctacttagtccctcaccacctctgtttcttcatctatataatgggtcagtaatcccacccacatgaagttattgttagacttaaataagctgaccc

SEQ ID NO: 47164 - DNA, 201 bp, Homo sapiens
tactcactcctgatacagactgagtggctcaccctcattttctcacttcctccgtcctggtgttaataagactcatccttcatttttctgccgtttctgcrgttctttagagagtgcagaccactttcacatgcagcttctcatttcattctcataacctagaggacgggcacattatcctcctttacagatgagaaaatt

SEQ ID NO: 47165 - DNA, 201 bp, Homo sapiens
gcttatttcactttgcataatgcacttgaggttcatctatgtagtctcatatgacaggattttcttctttttcaagaatgcatcatagttcattgtgtggrtataccacattttctttttccattatccattcatctatcagtggacatttgggttgcttccacctcttgactattgtaaattacacttcactgggtatgc

SEQ ID NO: 47166 - DNA, 201 bp, Homo sapiens
aacatatacagccagtggctgtggtaaagtgggaatgactgctaatgggcatgaggtttcatttaagggtgatggagatgttctaaaattatatgtggtgrggattgcacaactctgtaaatttcctaacaatcactgtgttacacacttaaaacgggtgaatttcatggtacgtaaattatacctcaataatacttttaa

SEQ ID NO: 47167 - DNA, 201 bp, Homo sapiens
aattacacttcactgggtatgcaagtatctctttcagatccttcttcaaattctttcagatatgtagccaggagtgagattgctagatcatatggtaattstctttagctttttgagaaacctccatgttgttttctgtaatgattgtgctattttatattctcaccaagtgtatacaagtgtgacaatttcttcatgtct

SEQ ID NO: 47168 - DNA, 201 bp, Homo sapiens
gaaaagacaaacatatacagccagtggctgtggtaaagtgggaatgactgctaatgggcatgaggtttcatttaagggtgatggagatgttctaaaattakatgtggtgaggattgcacaactctgtaaatttcctaacaatcactgtgttacacacttaaaacgggtgaatttcatggtacgtaaattatacctcaataa

SEQ ID NO: 47169 - DNA, 201 bp, Homo sapiens
caaaaacaaacaaaaaaaatctgctcagcatgagaaatcaagttaatgaaaacgctaccgcattgaatttccaataagagaaaggcaaagcaaaacttgtyaactaaagaaaggggcattcactgtaatcccttcgaggagaggtggaagcaggagtaatacaaaagctcattactgtaatcaaggcatttgtaactgttg

SEQ ID NO: 47170 - DNA, 201 bp, Homo sapiens
gggctgggctgactgcatgagtctcacctttcactgttctcccttaattccctgcctgcctggaagacgtatttcagcttctgcaatgctttgccttgctraaaatatctcctcttagcaaacaagtttgcccagaagttatgaaagtaggagagggaacaaagatgatagaggtttgtggtttgtttatgaggttttcac

SEQ ID NO: 47171 - DNA, 201 bp, Homo sapiens
gcatcacatctttgcgtgaagcctgcaaaggctcgctattgccttggaagcaaatccagtcttcttaccttgacttacaagactgtccataattgggctgsgctgactgcatgagtctcacctttcactgttctcccttaattccctgcctgcctggaagacgtatttcagcttctgcaatgctttgccttgctaaaaata

SEQ ID NO: 47172 - DNA, 201 bp, Homo sapiens
cttgaactcaaacccgaagcatcacatctttgcgtgaagcctgcaaaggctcgctattgccttggaagcaaatccagtcttcttaccttgacttacaagastgtccataattgggctgggctgactgcatgagtctcacctttcactgttctcccttaattccctgcctgcctggaagacgtatttcagcttctgcaatgc

SEQ ID NO: 47173 - DNA, 201 bp, Homo sapiens
aggctgccatatgcttcacctgcttgtgccctcgagggtccccttctggggtccccagtctggcttatgatcatattccagcatagagcactccctaaccscactcccgtagcactgggactatagctttatttcttgcatcatttttctctacgctcaaaaaaaaaaaaaagcaaaaacaaacaaaaaaaatctgctcag

SEQ ID NO: 47174 - DNA, 201 bp, Homo sapiens
tctgcagttccattcatttgcaaaaatttgcagacaattaagctgtccccctgcagtataggtagctccttttagccaggggctggagatttgttctctcygggaaaatgttaaagctgtgattatctagttatacctgaataaatggatcaaaggacctctccagccaagcacagacctccttgaaaaggtagtctccag

SEQ ID NO: 47175 - DNA, 201 bp, Homo sapiens
gcaggctgccatatgcttcacctgcttgtgccctcgagggtccccttctggggtccccagtctggcttatgatcatattccagcatagagcactccctaascccactcccgtagcactgggactatagctttatttcttgcatcatttttctctacgctcaaaaaaaaaaaaaagcaaaaacaaacaaaaaaaatctgctc

SEQ ID NO: 47176 - DNA, 201 bp, Homo sapiens
tgctctcttgaaccaaaagatggacagattgccatttactgaggtggcaatgactgagagacacaggtactctgaagaatataaggaattttcttgtgccrtatgaaagtgccgttagaaaaataggttggtcattttctgacatcaaaagattttttccccaaattgtctgagttgcagccaatataaacataggccaag

SEQ ID NO: 47177 - DNA, 201 bp, Homo sapiens
tgggtggggggttaaccaggcacaagaggggagggacgggaagggaagtcacaaggtgagaagccctcagacaagcacctgcaattggagggtgcgtgcasctgagaagcagagccaggaggacagtgatagcacttgaggtcagagtggtcatcgggatccaagcctgctggatcttcctggccttaggaaacccagagg

SEQ ID NO: 47178 - DNA, 201 bp, Homo sapiens
gggagagcccacgggagcacctgtgagttggttccgagaaaacatcccactctccaggtcacctctctgtgcttcaccccacctctcattcttcttttgtscaaagcacctatttggaagtaaaatatcagctagaaaggaaaggagtttcagaagaaagtaccacatcagcgttttgaacaaattaagttgtgtgcaagc

SEQ ID NO: 47179 - DNA, 201 bp, Homo sapiens
tcctaggtggaaaacaatggtcctgtagtcctcatcaccatttcccatgtctgaaactgtctttgtctacctcttttcagttcttctcaacttcataaccyattcttgctgtatctaaaaagcattaatgatccactggcataagaattttgggttagctcaagccaggtaggatagacttgaccatatgttcgtgcaagt

SEQ ID NO: 47180 - DNA, 201 bp, Homo sapiens
tcagtgctctgacagatcaagagtgctctgaaagctcagaggagcaggaagagacccaggtgacctggtgagagccacgctgaatctcggttcacatgtcrttaacggagcttggtccttggagggccttgtggggaaggacgcagacaagctgtgatggagtccttgggtctcacctgggagagcccacgggagcacctg

SEQ ID NO: 47181 - DNA, 201 bp, Homo sapiens
agaaccacttgaacccaggaggtggaggttgcagtgagccgggatcatgccagtgtactccagcatgggcgacagggtgagactctgtgtcaaacaaacamacaaacaaaaaatcgatctttattgcaaattgaaagaagtgctaatccaatatcctggtaatcattatatttatcattttaaactcccactgtgccaaag

SEQ ID NO: 47182 - DNA, 201 bp, Homo sapiens
tagacaagggtaaaagaaagccttcagtagaatttcatctgagtattttctttgcccccttgtgtgtcattttctccttaagaaaactgaggaagaagtgygatttagtcccctcatctgcataattttcttccctgtgtggctgtgtgcttgtcagtgctctgacagatcaagagtgctctgaaagctcagaggagcagg

SEQ ID NO: 47183 - DNA, 201 bp, Homo sapiens
tcaccttccaaccccctgccttccaatattccacccctcttttttctgccctagaagagaaacctatgatccttgcattagaatggttttcctgccatcastattgcaaaatagacaagggtaaaagaaagccttcagtagaatttcatctgagtattttctttgcccccttgtgtgtcattttctccttaagaaaactga

SEQ ID NO: 47184 - DNA, 201 bp, Homo sapiens
tctgttaatgaagtttccagccaccttaccctggattctcaccttccaaccccctgccttccaatattccacccctcttttttctgccctagaagagaaamctatgatccttgcattagaatggttttcctgccatcactattgcaaaatagacaagggtaaaagaaagccttcagtagaatttcatctgagtattttctt

SEQ ID NO: 47185 - DNA, 201 bp, Homo sapiens
atttaccttcccctaatcccacccagttgtctcagctaatggcaatcttattttatacttgatgaaacaagcctgagcccaggttgttcttatccctgttytataggtgaaaatactgggcacaagagatttttccacaatcacatagctaatatatggaaaagctgggatttgagctcagctatatctaacatagaagtt

SEQ ID NO: 47186 - DNA, 201 bp, Homo sapiens
gtgtcaatggagaccagaagatgggttcctgaggcatttggagacatccaagtgaggagatggcttgttttcttcctaaattttcaccatcccccacaagrcagcctttttttttctctgttaatgaagtttccagccaccttaccctggattctcaccttccaaccccctgccttccaatattccacccctcttttttct

SEQ ID NO: 47187 - DNA, 201 bp, Homo sapiens
taccaggggttaggagttggacgtttcttttagggggacacaattcaacccctaaatggggatctcctgacagttcttaatagggtcaatatttcaatgcrtgcatttgttttttataatgatcttttctatgatactgggtgagataaaaaccaacttatttgcctttaagagcttctttgttttctgccatttgtgcta

SEQ ID NO: 47188 - DNA, 201 bp, Homo sapiens
gcaggcaggtgatgagaaatgcccctgagtaaagttaaacaggaccaggaggatggggaatttgtggggggcaggggagctggaggaggtgcatgatattstagtctatacatgatgatcagagatggcctttctgaaagggagacatttaaacagagatctgatgaaagagaaggtcatgagctatacaaatatctgtaa

SEQ ID NO: 47189 - DNA, 201 bp, Homo sapiens
tctaagattctggagttcacagcacacaaagaaaataggcatagcatcattccagtctgtctactttctgtgactgaggtgatttttttctggagctaaayctgtcttttccacttgttctactctcattcactcactggctaattcaacagatacctacttggctcttactacctatcaatcactattcaaggcactcag

SEQ ID NO: 47190 - DNA, 201 bp, Homo sapiens
gctgagaagggttatagcatcaaagacaaatatggctgaacatattggggatcatttaggttaaagaaatttaaatgaatttttcctgcgggacttctcaraggctttaatctgtgaatgtgcatactgaatttccaagaagggtttagaatgtgcagcagtttccaaatctacttgacctgggaacccttttgttcacag

SEQ ID NO: 47191 - DNA, 201 bp, Homo sapiens
ttttaacttgattacctctgtaaagaccctatctccaaataaagtcactgagagttagaactcccacatcttttttttttttttttttggtggtggttggyggggacagtgaaacccacagcagtgagagagttgtatgcacatggacacaaaagagcatctgatcataaagagaaggaaaccaaacctgtctgggcactg

SEQ ID NO: 47192 - DNA, 201 bp, Homo sapiens
agttgtatgcacatggacacaaaagagcatctgatcataaagagaaggaaaccaaacctgtctgggcactgcaatgtgtgaatctagaactctccaactgmtatgcttcagcttagatgttgcgcatcaccatatttctgtgtcctgaatttcacatcttcgagaagaattttattggtccagttgagcccagataccttc

SEQ ID NO: 47193 - DNA, 201 bp, Homo sapiens
tattaaatgtcccaaaggagtctttgcccaatgtttgataatttaaattcatgattaaactttctgtcgtgttcctgaaaggctgatgttctttgttgaargggattcatacactttggatagtaacactgctgggggtaatgtgattgagaagtaaggagggggcgctggagccggaattgggttcacatcccactgacc

SEQ ID NO: 47194 - DNA, 201 bp, Homo sapiens
tttaatttgctgtttaattaagcaagatgcctgccttacactgtttggcaaaggagaaaaatcagcatcaggcacttgcagacatagatttccagaattcstaaaacattcaagaaggatgttatcggtacatgatcagagttgagtaggttctggattttaatgcctgtacttgctttttacttataaatgattaatact

SEQ ID NO: 47195 - DNA, 201 bp, Homo sapiens
aaaggaaatcatctttgtattactagtctttttattgccaaaaaaattttatttgcaaaacaaatataggctcatggtaaaaattttagcaactgagatargcaaaactaagaaagatgtaaatcccactagccagataccactactcctaagacccaggtcagacagcgaggcatcactgttaagagcatgggcgctatg

SEQ ID NO: 47196 - DNA, 201 bp, Homo sapiens
tccccctttctccctgtggtgtcttgggcactcaggattccaacctcaaaacagcaaagtccacgggagcttgatttgctccattctctgacttcccatgrcagggttcctctagctgctaatacagactgctcactcttgccatggttccaaactggcatttcaagaacaccagttctaattagttccaaacaattctaa

SEQ ID NO: 47197 - DNA, 201 bp, Homo sapiens
taagcaagatgcctgccttacactgtttggcaaaggagaaaaatcagcatcaggcacttgcagacatagatttccagaattcgtaaaacattcaagaaggrtgttatcggtacatgatcagagttgagtaggttctggattttaatgcctgtacttgctttttacttataaatgattaatactttagcttcataattatcc

SEQ ID NO: 47198 - DNA, 201 bp, Homo sapiens
attgtcttagctcaggctgccataaccaaataccacggactgggcagcttgaatacagacatgtattactcacagttctggaggctggaagtccaagatcrtggttctagctggttcagtctctggggagggctctctttctggcttgcagacagccaccttcttgctgtgtcctcatgtagcctcatttccttggggcat

SEQ ID NO: 47199 - DNA, 201 bp, Homo sapiens
tgatgcccttcttactgaccaagtgaagaatatggaataggtacgatggcccctgacttttgcagagtctttactgtatctaccatggtgtctccccctgrgatctgttgcctgatttgactgtgtgagcctggctttaccattttacaaatgagcttactgtgatgctcagagaatccagagaacaagctccaaggtcat

SEQ ID NO: 47200 - DNA, 201 bp, Homo sapiens
taatccttctggagagccatttgttgtggtgatattcacatgactgtctttaacaccatgacaccaggagggtcttacttcgccagccaccaagctggggrcatcatgctgggtaattgtctgcaggtgcatttaactgaaaacctttctctaagattctggagttcacagcacacaaagaaaataggcatagcatcattc

SEQ ID NO: 47201 - DNA, 201 bp, Homo sapiens
aagtgcattcacctgggtgagtactcagcctgaggtctgaatggaaccttccacctgggaagatgttaaagtggttatgaacgaatgaaatctacccccamggttttcctggtgcagaaagagaagactgaagatcaaatttacaacgtgcttagacttctacagtgttgctgaaatctacatcagacagtattttggcga

SEQ ID NO: 47202 - DNA, 201 bp, Homo sapiens
ctgatgtgacgggttttgacgagagaaatggcaactgtgtggttcaacctaatatttagatagtattgtcttagctcaggctgccataaccaaataccacrgactgggcagcttgaatacagacatgtattactcacagttctggaggctggaagtccaagatcgtggttctagctggttcagtctctggggagggctctc

SEQ ID NO: 47203 - DNA, 201 bp, Homo sapiens
gcactcatatgtgaatatgactgtcctcaacgctaaactttgacctctttggagaaagagacttgttttttgatcactgtatctctagtatccaacacgayatttagacaagaagttcattaactgccaattaaatagatgcataaactagttaaagaaagaattagaccaggtgcagtggctcatgcctataatcacagc

SEQ ID NO: 47204 - DNA, 201 bp, Homo sapiens
tatgtccatagtggtctttgtttcttacctaggttggttctgggtaggttctggactggattggcaggggagatcctggtctctttcatctcaggcacctraagtcaaatctttcagaaataacatttaaccggtacctccatatgtgtttttttgtttgtttgtttgtttgtttgttttagcgttgaacacttcttgttg

SEQ ID NO: 47205 - DNA, 201 bp, Homo sapiens
cccagcagtgttcatgatctgacagctgtaaccaatacctgacatttcccttttggatataaataattatctttcacagttatggcacatacacaacaagwaaatttccccttttatttggaaagcctctactttacaattcatgtttaccttcctgaatcttttctacatttcaaattcatgttttgtttaaaaagatga

SEQ ID NO: 47206 - DNA, 201 bp, Homo sapiens
atgacatggcttgattcttttttcaagatgagatgtttgcttttcaaatcagtgtgatcagtgaacctggcctgtgtctgtggagattcactcgaggcttyttcttgcagacataccatcttgcttttgtttctagaatatatattagctggtagctagtcgacacccaggaggagacagcaaatgcaatagaaatgcatg

SEQ ID NO: 47207 - DNA, 201 bp, Homo sapiens
gagagatagccccctgcaacacacacgcacatgcacacacacacacacacacacacacacacacataggttttgtgctctcttgggagcatttaagatacwctgcaaactacaattgcttccttaaaatgtacagtggacgtttgacatagtaaagatattttgaagatttgcaggccagaaacctgtttaagccaacata

SEQ ID NO: 47208 - DNA, 201 bp, Homo sapiens
agttatggcacatacacaacaagtaaatttccccttttatttggaaagcctctactttacaattcatgtttaccttcctgaatcttttctacatttcaaaytcatgttttgtttaaaaagatgacagacacaggaaagcgttggttatggcaatataattaaaggacattcatttcactcaaacctgcatggtgatttttg

SEQ ID NO: 47209 - DNA, 201 bp, Homo sapiens
ttttccacatcacatctatttgttgattttccccccacagctaccactatgcttgttattagtgataaatgttctgttaaatgcatacctgtgtggaagtsattgtagctgtgcaaaacgtcgagggtctggtgatggattaagtgccagatttaatgacatggcttgattcttttttcaagatgagatgtttgcttttca

SEQ ID NO: 47210 - DNA, 201 bp, Homo sapiens
ctttggtgtcctgaacagaaccagaatcagccttcccttcttattcaatgactacttttaatagagtttagggattaaaggtctcccaccttcttccatakaatttgactttcagtccaagaccccatctctaatcctatggtagggtatgcccttctgcaggaatcactgcttaatctcttccggcctccacctctccac

SEQ ID NO: 47211 - DNA, 201 bp, Homo sapiens
cttgaaggtagggcaggacgagaaggcctcgaaggtacttttgagaacttgtgtctcttcacctcacaaaccttgactccaggcacgctggtggccctgtygcagcctgatgtctccactcttattcccaggcccttcttccttctctgaattctctcccctcacacccatccttcaaagctcagctgcagtcttacatta

SEQ ID NO: 47212 - DNA, 201 bp, Homo sapiens
aactcagacattatcctgtagccactgaagggttttaaggagagtccttggtcagatggtagctggacagttcgctctggctggctttggggtggagaggrgcatagaagaaggcagggggaccaacctggaagctgttgcataagtcaaggaagaagagatggggacttgacatcatgtgcacacagaggtggtggagaa

SEQ ID NO: 47213 - DNA, 201 bp, Homo sapiens
tccacctttggagacagacatatcagtcactttctcacttcccctgactcagctggattctcatcttctctggctcagaggggagtatcatcaagtacagstaacatctttgagcatataccatgtgtcaaaaactattcagcttttcttactctttataagaactcggtgaagtaggcactattattattttcatttgaa

SEQ ID NO: 47214 - DNA, 201 bp, Homo sapiens
caccataaccgtttcttgatttactcattcattgaacatttactgagagtgactgagagtgaactagtttgtgtgatttttcccccaggagatttagaatragttcaacttgttttcaaagactataacccgatgaccacatacaggcagtgtcttgggacctcagtgtctcaaggggcaaggcactggggctatggcagg

SEQ ID NO: 47215 - DNA, 201 bp, Homo sapiens
tgtgggagctacatttcaagatgagatttgggtggggacacagccaaatcatatcaatggctaagactccatctctgtacagggggctgggagattcactkggcaatttttgttcctcttggcttcaaaggactcaatctaggatcatcacaaaatgtatttattgtccaaaactggagtgcttttgagagcaaaaaggac

SEQ ID NO: 47216 - DNA, 201 bp, Homo sapiens
tctagcttaagataaggggttgtggagactgaggttcttactatgtagacgaagcctccaggtagcaggcttcagagagactagatggtaaatgtttcttstcagactttaaaaggtatcagactcttagttaattctctcttggatcaagaaaaaggcatgagaaggggaaaagggattttctacaaaatatagtttttt

SEQ ID NO: 47217 - DNA, 201 bp, Homo sapiens
taaaattatcataaaagacacaggagttagcatgctggcacaaaaacgccttttaaatcatttgtcttgcatttcaagagggtgaatggagacaaagtacrtaactggttcttgatttttttggtcatattttattacaacctgaattcctgtaaagaaaggagactcatatcctgaagaatgaagacatcaaaagcaagg

SEQ ID NO: 47218 - DNA, 201 bp, Homo sapiens
cttcttcattaactatgaagccctttcccatatgggtttatcagcattgtaggaagggctttcatggaaccatataaattcatctctctagaaacgaagarttctaacgtccatcctcacttctgccaccaaaattagaaacatacatatgtgtcgagctttctgcttggtgaaggtgcagtgacccctctttttttcagc

SEQ ID NO: 47219 - DNA, 201 bp, Homo sapiens
cctctctgaactttcttcattgattaaggagggataagatttactttggaggtctgttggaaatatttgagggggctcatgccaagtgcccagcacattgrccagcatacgcttgctgtatcattattatagtagtttagagtagtgatggtgagggcattggagtgatgatgatagtggtcggaacatggtcttcacagt

SEQ ID NO: 47220 - DNA, 201 bp, Homo sapiens
tatcagcattgtaggaagggctttcatggaaccatataaattcatctctctagaaacgaagaattctaacgtccatcctcacttctgccaccaaaattagmaacatacatatgtgtcgagctttctgcttggtgaaggtgcagtgacccctctttttttcagcatccatttatttctgcttgctgagctttctgtctgcat

SEQ ID NO: 47221 - DNA, 201 bp, Homo sapiens
aggtaaattggagcagtttgcatgcaacctctctgaactttcttcattgattaaggagggataagatttactttggaggtctgttggaaatatttgagggkgctcatgccaagtgcccagcacattggccagcatacgcttgctgtatcattattatagtagtttagagtagtgatggtgagggcattggagtgatgatga

SEQ ID NO: 47222 - DNA, 201 bp, Homo sapiens
aggaagggctttcatggaaccatataaattcatctctctagaaacgaagaattctaacgtccatcctcacttctgccaccaaaattagaaacatacatatrtgtcgagctttctgcttggtgaaggtgcagtgacccctctttttttcagcatccatttatttctgcttgctgagctttctgtctgcattttcatctacag

SEQ ID NO: 47223 - DNA, 201 bp, Homo sapiens
agtaaatacaacttctcaaagtagaagataactggtgttaaaacaagactacatttatgagaactcacttccataagggcaaatactaccttaacagaatmtcagcaacattccagaagatggaagtcagaatagatatttatagggcttgtagggagggtatagcctcaagcaatttaagataggaagatgattggtatt

SEQ ID NO: 47224 - DNA, 201 bp, Homo sapiens
tagcatttcataggtaaaaactaaggatgtggctaaatatcctacaatgcaaagggcagcccctcccccaacagcaaagctttatctggccccagtgtccrtagcgcagtggttgagaaacctggcttcagatgtagaaacatcagagatgcagtgtcagaggtgatctttgggtcttgtcttgctaacaaggtgaaaggt

SEQ ID NO: 47225 - DNA, 201 bp, Homo sapiens
acttctgccaccaaaattagaaacatacatatgtgtcgagctttctgcttggtgaaggtgcagtgacccctctttttttcagcatccatttatttctgctygctgagctttctgtctgcattttcatctacagctctgttctttattgatagtgtttgttttagacttgtgagctccaagagggctgagactgcacacttt

SEQ ID NO: 47226 - DNA, 201 bp, Homo sapiens
cccattatctttccatatggaatggtgtagctggtgttggagtcttctttcacagtaaagtgctcctgtcattgcctctgagaacagactggggtgtcctkgatagtttcacaggacagtggtgtgggctcctaggttatattgcctgtctctgtcactcacaatgggtggtgtttttaagctacccaaacttccagctcc

SEQ ID NO: 47227 - DNA, 201 bp, Homo sapiens
aggagtgaggagggtgttgtagtgggaagctgtggcctgcagaagctatcctggggcatcaggagctgctgggggagggaaatggtataagacagcagacsaggcagaccaagactgggttctgtaagctctgctaggaatcttccttggtatctgcagagcacaggaaagcttttgagagatttcagtggggagatgata

SEQ ID NO: 47228 - DNA, 201 bp, Homo sapiens
cagaaggaaaaacggtgttcagcataagccatatctatttgtacggtttaggcacgttgagccactcttatcagagaatggtaggaaccttccccaaatcrtcattcccaaataccagccaagagccaaccttgcaggctggcctttctagggatagcagtcccacacttgctatgttggctcttttctggatagtatgca

SEQ ID NO: 47229 - DNA, 201 bp, Homo sapiens
tgtactggacagcacagattccaaatatacagagcagagaaaactaaaaagagaagtagacaaatctacaatcattgtgggagtcttaaaacatctctcayatcagcttcaagaaaaaacaacaaggagtaaagctgtaaaagatttgaacaaaataattaacaaatttcatcaactaacatatatagaactctgaactca

SEQ ID NO: 47230 - DNA, 201 bp, Homo sapiens
gctagctagccaggtggtactcggagttggcatttctgttgctcaggccgggctgcatttggtgagttgcgggaaggggatgatgacatcttctccagttracaaaagacaatggcttgttctgaggagagggcctggaactcttggtccatcagtctggctttgtcctgtctattatacacagtctaatcacccccaaca

SEQ ID NO: 47231 - DNA, 201 bp, Homo sapiens
cacttttctgatacttttctgaagttttaatatgtcgttgtttctgaagaggcaggggtatttcttaggagacattttcatgaagggactcctgtccatgytgacaaaagagagtgagtgtttctagataatgtgacaatcatatgcatgttaggaggtgtattagcctattttcatacttctataaagaactacctgaga

SEQ ID NO: 47232 - DNA, 201 bp, Homo sapiens
taggttctccataaatatttgctgaatgaataaatggctgcttgtctcctcaagtagcctatcagctccacattcgccatgtcagtttcttcctctgcaayctctgcagtggcttgcaccatgcctggtgccttgtaagttctttgcaagcaatcattggccatctgcctgagtagtcacgctggtccggacttgagcgat

SEQ ID NO: 47233 - DNA, 201 bp, Homo sapiens
ggaaaggacagtttaaaaatttatgaattatcttttcctttacacttcagcattgacagataagtgttaaattgaaatactgtctcatactttgatcacasaagctaaggaaagcaagtgctgaagccgcactggcctcctttggaaagtaaaacccgagaactccatctaggcttcgagttaatagatgtggtggtcttt

SEQ ID NO: 47234 - DNA, 201 bp, Homo sapiens
ctatacccccatccctgaaaaatgggggtttccttttagggcttttaacagcataatgcagttgaatacaacttattttactgacatctctcctccaagcrctctcccccagcactttccaggactaaataatgcatgaagggagagaataacagggattgcataaacgacggaaaacagcacggtaaggattctgtgttg

SEQ ID NO: 47235 - DNA, 201 bp, Homo sapiens
ctggggacacatgggatgcatggcctgtggacatctagaaatgaggcctgtccatcaggaggtcaaccttaccatccacggagtgttgccctgtttgactscaagctcaaagctgtcccaaatccagatgctcggtgaaaatccctgatatttgaatggcagcctctgcaagctaaaggccatctagcagatacagtggcc

SEQ ID NO: 47236 - DNA, 201 bp, Homo sapiens
tcattgtaacacaaatgacttctctgcagctgttcaaggaagactcttttcctatgagtgttggtagatgaagagtggaaactcaggtgcttggcaaggtyagaaagttagtgtcaatgagtgaggaggcttgggtagaagaaaagtctgtatgaagacataagtacaaaccaaaaatcacttttagttgactatgaggca

SEQ ID NO: 47237 - DNA, 201 bp, Homo sapiens
aatccacccccttgatccagtcacctcccaccaggttcctcctcccacattggggattacaattcagcatgagatttgggcggtgacccaaatccaaaccrtatcaatcatttatttcattcacaagtgcgtattcagcacctgtcatccctgcagctgtactgatgtgaatggagtcacagcccttgataggctcacagg

SEQ ID NO: 47238 - DNA, 201 bp, Homo sapiens
ttgtgaactcatgaagggagggtcttctgagagatataaagaggctgatatatgctctttatatctcacctttgatgatacacagctcacctttgatggtmactctgaatcacatcaaggcgatgacaagaacaactgtctagacttagtggtgtggctttgaaacgacacttcgccattcagggattcaattgttttcca

SEQ ID NO: 47239 - DNA, 201 bp, Homo sapiens
tacccattacatctgcctgtacctccagcaggtgcccaggagatggctgagtcccaagagccatgcaggcctcctggacgaccgccctgatgtggtccacktgactcttaacaggtatcatggccttggcacatgttgggcattttccagcgtcactctcagaagaccctccctccatgagttcaccactgctggtcttta

SEQ ID NO: 47240 - DNA, 201 bp, Homo sapiens
ctgagctggcgccagcacggagcagctgaatccgactcaggcttcatcccagctcacattccaccttcccgacaaggacactgaggcccagagatgaagtsggacttcccaccacaagtcaatgaggagatggggtagccaggcctaaaaccccggcctttggcttacagccgcccgtcattttcccaggtgcccacctca

SEQ ID NO: 47241 - DNA, 201 bp, Homo sapiens
tagttctgaaaacataagaactgagagatagccccctgcaacacacacgcacatgcacacacacacacacacacacacacacacacataggttttgtgctstcttgggagcatttaagatacactgcaaactacaattgcttccttaaaatgtacagtggacgtttgacatagtaaagatattttgaagatttgcaggcca

SEQ ID NO: 47242 - DNA, 201 bp, Homo sapiens
gacactgaggcccagagatgaagtgggacttcccaccacaagtcaatgaggagatggggtagccaggcctaaaaccccggcctttggcttacagccgcccktcattttcccaggtgcccacctcagaggccatccttggaaaaggaaacgtcactaacctatggttctggggaaatggagacgagagaggaagtaatatgt

SEQ ID NO: 47243 - DNA, 201 bp, Homo sapiens
cagaaataatttgcatttaaatgcgtttaagatatttaacttatgattccaaatgtgcctattttaagcctggtagaagtactttagtctccaaagtatgyggacgctctacttctccctagtttgtggacctgaaaaggatttagatattaatatagaataacttttccaaactagttctgaaaacataagaactgagag

SEQ ID NO: 47244 - DNA, 201 bp, Homo sapiens
agtgggacttcccaccacaagtcaatgaggagatggggtagccaggcctaaaaccccggcctttggcttacagccgcccgtcattttcccaggtgcccacytcagaggccatccttggaaaaggaaacgtcactaacctatggttctggggaaatggagacgagagaggaagtaatatgttgttcttcttttctttaggct

SEQ ID NO: 47245 - DNA, 201 bp, Homo sapiens
cctgagggaaaactaattccagcaaaggccatttgtctttggtaccttaagatctagataatttactgcaagtttatttttattgaaaattatgtagataytattcagaaacacaattttcaactatacggcacacttaagcacgttatattttaagtgttaatacatagactgaggatatatgctagaatgtgcatttct

SEQ ID NO: 47246 - DNA, 201 bp, Homo sapiens
tcttttctttaggcttctttccactgggtaaatcttctccatacataataaaatgaaggccccagatgatttgtgaaagagttgaaatgaacttcctgcarttgaacaaactattatgaagcccctactgtctttatcagcaattcacagtcttttgtccataagaataagcaggggacttaaaaaaaaaaaaaaaaaaaa

SEQ ID NO: 47247 - DNA, 201 bp, Homo sapiens
tagttttagaaacatccaccgacccctcggtgagctcctgtgcttctgtcactgggagtcagtaattgaattttctggacattttgaccagtatgtaactktgtggagccgattacacagcagaacgcaatttttagcctgaccttaaaagcattaccttctgctgcgtgattagaaaacatacagagagtgccgcccttc

SEQ ID NO: 47248 - DNA, 201 bp, Homo sapiens
ggtgaaaacactacaatataacagcagcagagagaaaggcacatcagtcaaagtcaaggaaggaagggacagctgggctcagacttgcaggtagaccaggrcaaggatgttcaggcagaggaaatgggataaacaaaggcatggtggccaagagagctagatccgttcactcaacacacaggcaggactgcaacgggtctt

SEQ ID NO: 47249 - DNA, 201 bp, Homo sapiens
tgtggtgctgattaaacgtctgaaattagtgggcagggaccattaacatgcaaaggactgatattaggcaaaggttgtaaagctggaatggctgcaagtcrtagacatttaaaacctagttttagaaacatccaccgacccctcggtgagctcctgtgcttctgtcactgggagtcagtaattgaattttctggacatttt

SEQ ID NO: 47250 - DNA, 201 bp, Homo sapiens
ctggagacttttggttgtcaccgttgggatgggggctgccgttggcttctagtgggtagaggtcagtgatgctttttaacctcctacaatgcactagacarcctccaccacaaagaattatctggccccaaacatcgatagtgccaaggtggagaaaccctaggcttatggatgccatgggaaacaccagttacctggatg

SEQ ID NO: 47251 - DNA, 201 bp, Homo sapiens
aactctatatggcttcccagcctttcttccagctgcaggatcatcctacccctgggactcccttattggtgtcctcattaggccaatcaatgcaaattaasccctgattcacagatagtggggatatacagtcaccacgacacatatggcctctgtcatccagtttcactcagtctagagaaagaaagagatgaataaaca

SEQ ID NO: 47252 - DNA, 201 bp, Homo sapiens
tcacggggggagccttccagaataatctgtggccgggttattctcactgctttttctccctggtccacgaattagcttttggacaacagctgtggtgtaaytggaatccatcttgtgtgattttttttccctcagatgatttagaattagttcaatttattttcaaaaagtataacccaatgacagcagaaaggccatgtc

SEQ ID NO: 47253 - DNA, 201 bp, Homo sapiens
gaggtcagtgatgctttttaacctcctacaatgcactagacagcctccaccacaaagaattatctggccccaaacatcgatagtgccaaggtggagaaacmctaggcttatggatgccatgggaaacaccagttacctggatgtaaatccatggtaaaataacatagatgctatgacatgtggcccactggaagacaccca

SEQ ID NO: 47254 - DNA, 201 bp, Homo sapiens
tggcctttgggtacaactctatatggcttcccagcctttcttccagctgcaggatcatcctacccctgggactcccttattggtgtcctcattaggccaaycaatgcaaattaagccctgattcacagatagtggggatatacagtcaccacgacacatatggcctctgtcatccagtttcactcagtctagagaaagaaa

SEQ ID NO: 47255 - DNA, 201 bp, Homo sapiens
aataaaatgaaaaggagccctccaagggcttgtttatgggttttattattggcgaagaagagcacacttgtctttatcaacatcctgtctgtctgggagtmtgagccgagaagggcaagaccaaatgttaagtcgtaacatctgacttgttgttccttgctctgctaacgatccaggctgttaagaggcttagcccttgtc

SEQ ID NO: 47256 - DNA, 201 bp, Homo sapiens; identical to SEQ ID NO: 10486

SEQ ID NO: 47257 - DNA, 201 bp, Homo sapiens
gacagtgagttctgtctctgggtctttgaagccagagtgacacacatcagatagatgcagttttcacccaagaagacctgggtagtgaatgggattagtcyaaactcatagtgaagatattaaatataccttgggatgaaaagagtagcaggaatgcggacttgtgggaggagggcaggccataccgggcctcacagggca

SEQ ID NO: 47258 - DNA, 201 bp, Homo sapiens
tgcactagacagcctccaccacaaagaattatctggccccaaacatcgatagtgccaaggtggagaaaccctaggcttatggatgccatgggaaacaccasttacctggatgtaaatccatggtaaaataacatagatgctatgacatgtggcccactggaagacacccatgtcaaatcccaggagccagtgaatgtgagc

SEQ ID NO: 47259 - DNA, 201 bp, Homo sapiens
cctcagtgacatcagctcactgtggctccctctgcctggaatgttctcccttgcccaggccttcatgtgactgtctccttttcacttcagtctcactatcrtctcctttgcaaggctttccctgatcaccttcgctaaagaagccctcctcaactctgcccacctgtcactggtcactccctgtactgttgcccaatggga

SEQ ID NO: 47260 - DNA, 201 bp, Homo sapiens
ggaaggtccgcagcttggggctagaaccacaagggagcgtgatgcacacaggtgtgcttgcacccacggctgaggtttttcttcccaccggcacagggcgmtgaggcagggatttcctcccagagagagggcggttgagttcagttcccctccactttgaaaatggctctggaggaggggcggaggaaaggcagagactcc

SEQ ID NO: 47261 - DNA, 201 bp, Homo sapiens
tgtcttcatctctggggcaccagagatgaaggaagggacactatcactgttcttgtaaagtccacacgctagctggggcaatgatttgcaacaatcgactrtattatcttgtgaggagggtcatgttacaggttcagccttcggaaggacatgaggtcaaagcaaattctcaagaatgaggaatgacaggagacagagacg

SEQ ID NO: 47262 - DNA, 201 bp, Homo sapiens
atcccaggagccagtgaatgtgagcttatttggcaaaagagtctttgcagaggtaattaagttgggggtcttgagatcaaataatcctgaattatctgagygtatcctaaattgaatttcaagtggccttgtaagagtcatagaggaaaacagatacacaggggagagggtgatataaccatagaggcagaaattacagca

SEQ ID NO: 47263 - DNA, 201 bp, Homo sapiens
gctgatgtgagaagcacgatgactttcacttggcagaaggatttggaagtatctgggcttgataagctacctcatgccaaggaccatgctctgtatacgayttcatcttttcacccaccctatgagtgaggttttagtgtctccatttcacatatagagaagtaaaagcttggaaggttagcacctctctccatgtcccac

SEQ ID NO: 47264 - DNA, 201 bp, Homo sapiens
gggtggcaccaatgaaagctctgccccaagatccaaacacctcccaccaggccccacctccaacactgggggttacaattcaacatgagatttggtggggmcacatatccaaaccgtatcagatgctcctgagccatgacttagatttgaattgctgcagacacgtgtctctggtggcttcctgtgtgccataccctaagc

SEQ ID NO: 47265 - DNA, 201 bp, Homo sapiens
ccaccaaatccctgcttcatggagctctgtcaatctacaggcattagtgagtatgtgacgatcaggtggccctaagtgctgggaatagacacggagccgayaaaagatatagggtggtgggagacactgcttggtccaggaaggccctcctgggaggggccgtgagaagggaggccagatggaaagtctcctgagggcagg

SEQ ID NO: 47266 - DNA, 201 bp, Homo sapiens
tttgtccagcagagtcaccacgtcttattcaggttacagtgctgagctatttggaaaccaggctgggggggtggatttcaatgtcatcttactaaaaaagytcactaatgaaaagtgtattgctaagacagcagcttcatatttctcccagtctttatcagcagccatggattgaatcgttgacttgattttactacactg

SEQ ID NO: 47267 - DNA, 201 bp, Homo sapiens
gcaggttgtacaggaagcatggtgccaggcatctgcattgcttctgatgaggcctcagaaagcttacaatcacggcagagggcaaagcgggagtgggcacstcacatggcaaaaacagaagcaagagatagggggaggtgccaaatttaaacaaccaggtcttaggagaactcactcactactgtgggggtggcaccaatg

SEQ ID NO: 47268 - DNA, 201 bp, Homo sapiens
cctagagccaattcatagcagtttgcaggagccagttgttaccatctctttgtagctgtgcattcagtgacatcgtgggagtaactcgaaactggccacaktggaaatacttctatcatggaattagacaaacactattaattcaagctttccccacctccagagaatcagatgttaaacatttgccagtgttcctctggc

SEQ ID NO: 47269 - DNA, 201 bp, Homo sapiens
agaattgcttgaacccaggggttggaggttgcagtgagccaagattgtgccactgagctttagcctggagaacagagagagactccaaaaaaaaaaaaaaagaaaaagaaaagcactaggaaggcatctcattcaatacatagttttatagatgaggggtcctgctcaaggtagaaaacagatcccagaccaacctcactg

SEQ ID NO: 47270 - DNA, 201 bp, Homo sapiens
tagagaaagcaaagcaggcttcccatggagggataaatggatccttcccagcccacccactgttctgaggctgctgcccataagggttgttaggacacacrggagcctgagtggccaggtctctcaggagtggagacattcacttcccagccgtgggacatttacccaaaccactgcaaagagccacaaatagcataagac

SEQ ID NO: 47271 - DNA, 201 bp, Homo sapiens
aatttaaatttgttttcagcatgttaaagacttagtcaatttttttccttttattttagtttatttttatttttttcctgaggcagggtctcaccctgtcwcccaggctggagtgcaatggtgtgatcatggctcactgcagccaagacctccctggctcaaatgattctcccacctcagtcttctgagtagcccggacta

SEQ ID NO: 47272 - DNA, 201 bp, Homo sapiens
ttagagaggagaggtttgctgtttaaaaatattttttaaaacagcttgagtttattcttgtaaggctgccattgggtctgagaccccagaggagcagtgcrctgccttgcagttactccgcagtgggcaagacaggcatgttttgctctgggaagagttgctgaacacctgtctgagcaagggactctttgtggctgtctg

SEQ ID NO: 47273 - DNA, 201 bp, Homo sapiens
gctacttagggggctgaggcaggagaattgcttgaacccaggggttggaggttgcagtgagccaagattgtgccactgagctttagcctggagaacagagmgagactccaaaaaaaaaaaaaaagaaaaagaaaagcactaggaaggcatctcattcaatacatagttttatagatgaggggtcctgctcaaggtagaaaa

SEQ ID NO: 47274 - DNA, 201 bp, Homo sapiens
attttaggctgatcagactacttctgcagggcaatgctgggctggagttggtcttgctttacgcagatgtttctgggttacacaacacttggcttaatccwtttttttttccatcaggcccataagacaatttaaaggaatgaaaaaatatgtatgttttaagggtctagacctaatgctagcagcatccctttggagagg

SEQ ID NO: 47275 - DNA, 201 bp, Homo sapiens
tcagtcttctgagtagcccggactacaggcacgcaccaccatacccagcttgtattttttgtagagactaggtctttccatacagcccaggctggtcttamacttttgaactcaagctatccacctgccttggcctcccaaagagctgggattgcaggtgtgaaccactgcgcctggcccaaattcctatttcttgtttga

SEQ ID NO: 47276 - DNA, 201 bp, Homo sapiens
gcattcctcggtgtgggagccatcaggccctcaggaacgagtcttcctgccaccaggaggtttcatgtatgcacctgtatcatcagtagtgtggtgtttcygtatcgtcagaactcagcacaccatttctggccagcatggttgtttgatgtagactgagaagtgggttcagtaatgagcacctggcacactcaaactctg

SEQ ID NO: 47277 - DNA, 201 bp, Homo sapiens
ctactttaaaatgcgtaagtgttttgtgtgtggggacacatgtttttatttctcttggctatttgtctaggagtggaactgctgcatcatatcatatgctmactctaggctgaactatttgaggaactgccagactattttccagttttaatgctgttacgttgcccttaggaaagagatcaaaatgcttaacattgttta

SEQ ID NO: 47278 - DNA, 201 bp, Homo sapiens
gcattttaggctgatcagactacttctgcagggcaatgctgggctggagttggtcttgctttacgcagatgtttctgggttacacaacacttggcttaatmcttttttttttccatcaggcccataagacaatttaaaggaatgaaaaaatatgtatgttttaagggtctagacctaatgctagcagcatccctttggaga

SEQ ID NO: 47279 - DNA, 201 bp, Homo sapiens
agggttttattaattatatatttggactagaatttctttattctgcaagtgcattagttttggaatcactgataaaaaccaaaagttgatttccactaacwtttccaagagggagctttaaaaattcacctgtgggaaattttatgcaaaaacttgaacaagacatagtatttttctgttagcaaattataattttccccc

SEQ ID NO: 47280 - DNA, 201 bp, Homo sapiens
tgtgaagtctattacctcattcagtcatcccagcaaccctgtgagggatcccccactgtctccaatttctgcactaggagagggcgacatggggaggttaygccacactccacgtcactcacccacggccctctcagtaaacggtggacacaggatccgtagcctgaatgtctgtgtcatggtcaagctccaggtcttttc

SEQ ID NO: 47281 - DNA, 201 bp, Homo sapiens
ataataaattttcagacattgcaggccatccagtctctgggcagctacactactctactctgccattgtagcatgaaagcagacatacacaataggtaaascaatgagcatggttgtgttccaataaaactttatttacaaaaactgacaataggctaagatgtggcccgtgggctttggtttgccaatcaatggtttagc

SEQ ID NO: 47282 - DNA, 201 bp, Homo sapiens
caaattataattttccccctgattcagggggggtctgtgattgttttcttccttggctgctccttccatttgcatttgcaaagatcacattcctaatcttyacctcatcagaagcctcattttgattttctgctttgctgacttctgtactccgagagattcactagctcttaatcctatcattggcctggcattcttcct

SEQ ID NO: 47283 - DNA, 201 bp, Homo sapiens
catttttaggacagagttattcagtcggtgaatatgcagtccctttaaagggatatttatcacccttgaagaatcttattgccaaatcttaatagtctttsttataacaaaggctcaaattcactatcaagattaagaggtggagcttgaatgagctttgctggagcatctcatgataaaatagattaaagtcttaaaatg

SEQ ID NO: 47284 - DNA, 201 bp, Homo sapiens
agatcacattcctaatctttacctcatcagaagcctcattttgattttctgctttgctgacttctgtactccgagagattcactagctcttaatcctatcrttggcctggcattcttcctcttctctatacttttccatggttcattcatctccattttattccttctagaatgtatttttttagaagcaattaccaattc

SEQ ID NO: 47285 - DNA, 201 bp, Homo sapiens
ggcattgtgctgctcttgaaagatacaaaggaaaacaaggtgtagtccctactttcaaggcgctcacggtaaagctagaaatgtaaacaaaccaacacaaracagtgtgcaagaatcctgttaaagacctgccctcactgaactgtgcccctccacctggaggctgcagcgggtcaaggatggcttcactgaagggatgat

SEQ ID NO: 47286 - DNA, 201 bp, Homo sapiens
ttcatctccattttattccttctagaatgtatttttttagaagcaattaccaattcttattggtttgagctatgaaatatttcttctttggttgcatcttyagtgtggttttcttctgactgtcattgtcaatcacttgaacgggtgaaattaacctctgcctttgaggcccctatgtttactcttcgccggtgttgctgc

SEQ ID NO: 47287 - DNA, 201 bp, Homo sapiens
attaatccaggggcttctttgcagtcagtgatggtgatttgccaatcattagcatttcagaaaccccaggccgaaaccatacatttatccttagctaggtyggtatcaagtttctctgctttcagccagaatcctaacaattcagcttggttgattatctaagaagcttctatttgataattatatatctttcattttttt

SEQ ID NO: 47288 - DNA, 201 bp, Homo sapiens
tagaatgtatttttttagaagcaattaccaattcttattggtttgagctatgaaatatttcttctttggttgcatcttcagtgtggttttcttctgactgkcattgtcaatcacttgaacgggtgaaattaacctctgcctttgaggcccctatgtttactcttcgccggtgttgctgccagaagcttaaagctggatcta

SEQ ID NO: 47289 - DNA, 201 bp, Homo sapiens
agccaaaaaaattaacaggggcaacgaactttcttctttttccaagggctttttatcgatgattttaagaaaatggtcagacagcgcaggcgtgttttacyttagtccttccaaagcagtaaggtgcacccacttctcagccaccctccctgactttgttttcacaacccgaattcaccaggaaaataccaggagtctgct

SEQ ID NO: 47290 - DNA, 201 bp, Homo sapiens
tctcccttccttccatttattcattcaacaattatttataagggacttaatatgtgcccagcactgttctaggcactacagatacagcattgaaccacccyaattaagcttgcattctactggggagaatgaaaataaaattaaaattaaaatgagatatatagtaaattaaattagaaatgcagtagggtttctttttaa

SEQ ID NO: 47291 - DNA, 201 bp, Homo sapiens
tttttttagaagcaattaccaattcttattggtttgagctatgaaatatttcttctttggttgcatcttcagtgtggttttcttctgactgtcattgtcawtcacttgaacgggtgaaattaacctctgcctttgaggcccctatgtttactcttcgccggtgttgctgccagaagcttaaagctggatctaatcacttcc

SEQ ID NO: 47292 - DNA, 201 bp, Homo sapiens
aacttttgagtttacaactgcctgaggctgcctccatctacaggacctttactaactgtgccattttggcgaaaagatagattttgaagttcaatcagtcytggtttcaagtattagctattcctcagatgattgtgggaccttgaacaagtctcttgccctctctgagtcagttttatcatccatgcaatagggataata

SEQ ID NO: 47293 - DNA, 201 bp, Homo sapiens
tttagaagcaattaccaattcttattggtttgagctatgaaatatttcttctttggttgcatcttcagtgtggttttcttctgactgtcattgtcaatcamttgaacgggtgaaattaacctctgcctttgaggcccctatgtttactcttcgccggtgttgctgccagaagcttaaagctggatctaatcacttccttgc

SEQ ID NO: 47294 - DNA, 201 bp, Homo sapiens
aagataaaaggcttcaaaaaggtagtgtcttcccggaggctgcttgtggccactcgctgtgtgtctgtggctatacagaccccagattgctggggctggaytttgcatgtctctctctattaccttctagagcctgtgaggcccaggcttttaaagattcggcactgaaagaaactaaaaccaaacttttgagtttacaac

SEQ ID NO: 47295 - DNA, 201 bp, Homo sapiens
ttaaagctggatctaatcacttccttgctgaaaccattgatgcttctctgtcgacttcaagatgtgttcagttgggacattgccgtctgtttccttcttcmgttctcctttcccttctactccagtccttacaagtgacatcttctgttcctgcatgctaaaatgcccgtgacttctctaatgcagctctctgccttggtg

SEQ ID NO: 47296 - DNA, 201 bp, Homo sapiens
tgcagctgctgcaccttgtttttaacccctgcatccaagagctgagtgttgcatgactctcaagatgcagatattaaaaccttattgactgatgtagactyttctgtgcatcaaagggctcagaagtggtattagctggctgtctccttttaagtgcagagagtgcttttctgtagatagtgctatgagctacctggggtt

SEQ ID NO: 47297 - DNA, 201 bp, Homo sapiens
gatgggaaggattttgctttcatcctaagaagagtgagaagccattaataggattcggggtgattgtgagtcagggggaaatggggggaggtatcaggacrtggaggtctttgcaattattagttggagaacagcaatggttcttagctgcttcgtgtgccctggacccttctctcagtctgctgaagcctgggcagtcca

SEQ ID NO: 47298 - DNA, 201 bp, Homo sapiens
taacaaaaataattctttctggacagcagtaaaagaagtggattagaacaatttacagccttctcaagatacatataaggtgcctgttaagaaaaaaaaarggacagatttttgattaactgatacgtagacttgcttttaaaacatgtcagttcattctctgtatgcccatctattaagggcaatgtccctcatggagga

SEQ ID NO: 47299 - DNA, 201 bp, Homo sapiens
caggcctgcaccaccacacccagcctgttcatttctagtaagtccattattttacttcttttatttgttcttattaaagtttccatgctgttggagttaaytgtaagtagaaagttgagaacggccaaatgtttggttggttgctgagcagaagagcaatacttagcatctttgttacataacagatctctatttgtggga

SEQ ID NO: 47300 - DNA, 201 bp, Homo sapiens
caagttcacacattcagggaatgggtagaagtggaattcacacccaggtcagtgtaagaccaaagaggctgtcagaatggtttgctgttccactcatggcraacaggatttgaagttgttccagtccaagggagaccatcaggccatgcaggaataaaaaggccaaggggaggaaagaagatgctgtcttcattaaggcct

SEQ ID NO: 47301 - DNA, 201 bp, Homo sapiens
ccacagtagaaacccagatctgcacactaagaccatgggcagggtgggagaagggacccggtgagagagagggctgtcctgcgaccctttgtcccacattytttggacaacttaatcctagtctcctgtatctgaggcctttgcctgcactgccataattggctcagaacccaggacagagttggataatgcaaggcttcc

SEQ ID NO: 47302 - DNA, 201 bp, Homo sapiens
cctctcagggggtggccttccattggccctcacaagggcacagcggagctcgttggttatgcttcagttacataaatccagccttacaaaggctacacagrgagaggggctccttgcctcctagatctgtaccttgtaggtgctcaatacacattggtaagaatgttcacatcatcaggtaagcaaggggtataaagtgag

SEQ ID NO: 47303 - DNA, 201 bp, Homo sapiens
tgggtgaagacaaacacggggcttaagaccgagttcacctgttccctaacaatccattaaaataaaaaccattttctgtgtatgcttgggaatattccagsataattttgtgttacatcatgttatccaacctgtaaacaaaaagatatcctcagtgaatttcctgatgaaaactaaagactcatcaacctgaaaggtctt

SEQ ID NO: 47304 - DNA, 201 bp, Homo sapiens
gcaaagaagctaggtggataggaagtgcaccttgaagcatgtggccggatggcaccattggtgaaaatagctgagactgcctaacaaatcaatccaacctygagggtggccagatcttcgttgtttatctgatcaatcaggcctaatgactgatactctgattccagtggtgggggaaaaaaaactggctttgatgattag

SEQ ID NO: 47305 - DNA, 201 bp, Homo sapiens
cgtagccacataagctcattactacccattacatctgcctgtacctccagcaggtgcccaggagatggctgagtcccaagagccatgcaggcctcctggaygaccgccctgatgtggtccacgtgactcttaacaggtatcatggccttggcacatgttgggcattttccagcgtcactctcagaagaccctccctccatg

SEQ ID NO: 47306 - DNA, 201 bp, Homo sapiens
aaaaaaaaataggtctgtatttaaaagttttagtgtcagctccatccagcccaagttaagtactaattcagcaagttagttaagtaataaatggctgtcaytcaactacaacatatttgaattcagttttgaggccccagtagttgctaaaaatcaatgcccactttctccaggtatagtaattatttctcatattgttat

SEQ ID NO: 47307 - DNA, 201 bp, Homo sapiens
ggaggcgaaggcattgtttttactctttgctgcccaatggtccttgacaatggatataccagtttccctttatatcagctgcatgggagggagacccattwtctgacacccttatcaatcattgacataatccaacactccacatgcttgttatagaatcaggtcctatttgtatgactcttgcttgtttgtgagtgaacc

SEQ ID NO: 47308 - DNA, 201 bp, Homo sapiens
tctgcacaggcgttgtatattttgttctcaaatccagcagccttgacttgacatgggatggttgggatggttctccacgtagccacataagctcattactrcccattacatctgcctgtacctccagcaggtgcccaggagatggctgagtcccaagagccatgcaggcctcctggacgaccgccctgatgtggtccacgt

SEQ ID NO: 47309 - DNA, 201 bp, Homo sapiens
cttcaactttacttggtggcttttctctatacattgtacctttatttttactttggaaagttgtatgcagtgccccgaatgctgacttgtaaactgatttsaacaccatcctcattccttttggctctctgagaaatgttcttttttaatgaatatgatagcaagacttacttattaccaggttatttcaggcaagagtga

SEQ ID NO: 47310 - DNA, 201 bp, Homo sapiens
ctctgaggtccctttgacttgttcctgcctactctcttcttacgggtcctcatcagacacctttgtgcaaaccccagactagataaggttgttcatctctrtattcataatgccctctctcagtgtgcctgataagtcttattgtttgttatatatttatctcttctactgatttctgagctcctgcacacccaggagcat

SEQ ID NO: 47311 - DNA, 201 bp, Homo sapiens
gccctgttggaataataagtcagtgctctctggaggctataaccaaatataatttgccacataaacatgaaatgtgtgtccaagaaactagtaggaatgcmtctaggaaccaaagtgtctccttcctagagagagaggaaaaaaacaaagtgaggatggtcctctgcacaggcgttgtatattttgttctcaaatccagca

SEQ ID NO: 47312 - DNA, 201 bp, Homo sapiens
gggtgtttttcttgtcccctaatacagggccaagatgtctaaagttgaccttcagtctagtccaacatctggaaatgagtactaaagccaccagcacagayaaaaatggagaacaggtggacctggggaacagtctggggaaggaggggttccacatgagaagttacctgcagggagcagttgggtggcttgagttccagc

SEQ ID NO: 47313 - DNA, 201 bp, Homo sapiens
gtttctgttttaaaaatgccaatttccagtttttctggacatcagaaatcctggagacatcaggtccactttccacatgtgcactatcggtggtgtgaggygtgatgctccagtggatccagggtctgctgtcccctttagatgggacatgtgctcccacctcgattacgtttccacgtgcatgggcccctctggtcctgc

SEQ ID NO: 47314 - DNA, 201 bp, Homo sapiens
caaaattcaacaaagcacattaggagagatggggtccatgagaagggataggatgcatgcaactcataaggctgaagacagacgggagtgggagtaggaargtctagaagagaatctgacaaagatgcgggtgaaactctgaacccctggccagggcagggaagtcatgaaggccaagcaacacatccagtgatgattctt

SEQ ID NO: 47315 - DNA, 201 bp, Homo sapiens
cctagactgtatgtttcctgacaacagagactgtggtcatatgcatgtttatatttctactgcctagcatggttgaagtacttctaaaaatcctaattatrtgtttgttggcatagagggaaaaaaaggaaaaagagttggaaataaaactaagatcttacataagctgtgagaaacagaagctagaaataggtaattatt

SEQ ID NO: 47316 - DNA, 201 bp, Homo sapiens
attatattcatttcatctcccattctctttccaaccctccctatttttttatttttttattttttttattttattttatgagacagagtcttgctctgtcrcccaggttggagtgcagtggcacgatctcagctcactgcaacctccacttcccaggttgaagcaattctcctgtctcagcctcctgagtagctgggaata

SEQ ID NO: 47317 - DNA, 201 bp, Homo sapiens
aagtatcccatttgggaccctgtggactttgagatgattcaagttgattttaaggtttgttaccttgtctcctgtcttcattcgcagtatctcaaattgcktgttggaacaatgaatatagtgattccagttctgtcacaaactccttcaagagcaggagctgcagaaaccacacacacacacacacacacacacacacac

SEQ ID NO: 47318 - DNA, 201 bp, Homo sapiens
gtgtatgctccctggggactgagctcatacctggttcgtatttgcgcccgctgaatcctcaacacctagtacaattctcagtaagcagtccctaaagctargtgattactctgtatgtgttagtgaaatgcattaagtgcccatttccccttggcgtgggaagcccacaggaacagcattttcctgccttacttctgaagt

SEQ ID NO: 47319 - DNA, 201 bp, Homo sapiens
tatttgcgcccgctgaatcctcaacacctagtacaattctcagtaagcagtccctaaagctaagtgattactctgtatgtgttagtgaaatgcattaagtrcccatttccccttggcgtgggaagcccacaggaacagcattttcctgccttacttctgaagtccttgaactcacgctcctactggagtgatggcaaggcc

SEQ ID NO: 47320 - DNA, 201 bp, Homo sapiens
ggatccttggctctgtgagggctgctcccagcattttaggctgatcagactacttctgcagggcaatgctgggctggagttggtcttgctttacgcagatrtttctgggttacacaacacttggcttaatccttttttttttccatcaggcccataagacaatttaaaggaatgaaaaaatatgtatgttttaagggtcta

SEQ ID NO: 47321 - DNA, 201 bp, Homo sapiens
tttctctcctgaacacagggttgtcaggggggtggttagtagggtgtaagggaaaaagagtagcagggtcccaggatccttggctctgtgagggctgctcmcagcattttaggctgatcagactacttctgcagggcaatgctgggctggagttggtcttgctttacgcagatgtttctgggttacacaacacttggctta

SEQ ID NO: 47322 - DNA, 201 bp, Homo sapiens
aggtcggagaacagagacccccccagcctgctttcacagttggttccggcagttgttgcatttgtggcaagaacctcatggcagtattgtgtccttcacaktgctttgtatcaggcagcatgtagcaggcttttgtgtccttactggtgacattaacttggaccacttacagagggtggtgtctgccaggtttctcctata

SEQ ID NO: 47323 - DNA, 201 bp, Homo sapiens
attaacatgactgtgactgtcttactttggacagtcttactttggattgcccccgaagcagatgctgagacaagggttagggtgaaaatagtttagttggsagaaaatcccataaaataccagcgggagagcaggaagtgggacaggagaggaacacagcccacacactctgcattgtccatccagccaccactatgcgta

SEQ ID NO: 47324 - DNA, 201 bp, Homo sapiens
ctgttaatatcttgctgtatataattctcctgctctatttatatattgtaatacataaatacctttttcacaaaaatgagagttcactattcatacagttkcataacctgcctttgcttctcaacaatataatagaaacattttccatgtcattaaatattcccctactaagcatttatttttaatgtgggtgcctctggc

SEQ ID NO: 47325 - DNA, 201 bp, Homo sapiens
acagttggaaagagaggccccctctgacacctgtagcactgtggcatgggaagtgctggtcttcaggggtgggtcaccgtggtgacatctcccgcagtggycctgataagggaggaggcagcagcagttggcacatggtatggaagctgacattgatcagggggcccttgtgaagccagccttgggcctcccaggaaatac

SEQ ID NO: 47326 - DNA, 201 bp, Homo sapiens
ggacaacatggaaaaaccccatctctacaaaatatacaaaaattagttgggcatggtaatcccagctgctcaggaggctgaggcaggagaatcgcttgaamcctggaggcagaagttgcagtaagccaagatcgcatcactgcactccagcctgggcaacagaatgagactctctctcaaacgaaaaagaaataataaaca

SEQ ID NO: 47327 - DNA, 201 bp, Homo sapiens
acattgcataactacatcacccagagataattgctgttaatatcttgctgtatataattctcctgctctatttatatattgtaatacataaataccttttycacaaaaatgagagttcactattcatacagtttcataacctgcctttgcttctcaacaatataatagaaacattttccatgtcattaaatattcccctac

SEQ ID NO: 47328 - DNA, 201 bp, Homo sapiens
agacccttgggttcgagaacagaaaatgattgaagtcatgttttacgaaagactgcaagattgaaagtgaaggccagaagctaattaaattgatcacaaaygattgggtcagaacccggatgcaagcaccacagctatgggaacaggtggccaaggattacacagttggaaagagaggccccctctgacacctgtagcact

SEQ ID NO: 47329 - DNA, 201 bp, Homo sapiens
ctagctatgctgccccagtgagctcaagtgtgttttcattagggcatttggtaagcctgggggaaactgtttctgccccacaaaggaatgttctgcaaacrttcagtaactaaccatgtgatgctttctacctctgtaactaaagctaaagacttttacctattgacttggattctcagctatcagtaggagggacagttt

SEQ ID NO: 47330 - DNA, 201 bp, Homo sapiens
tgccgcagaagccacaacaatcccatccactgcaaatcacacgatagtaaatggcactttagaccccttctatagtttccagaaatgtagagaggatcacrttgctttagtgtcttgccccaagtgctattaatatccctgtccctaaaagattgatttttattatcggtagaaatacttaatagaaatgaaatctacgct

SEQ ID NO: 47331 - DNA, 201 bp, Homo sapiens
caaccggggaggtgttatcagcatccatacctcacggggagggaggtcagggggatggggcggggaaggaggctgatggaggagttgctgactgcaggtasctggaggcctcagccttcctgggcagcagggatacgggcagggatgtcccctgagcatggtcccacctggaagccagggggctgaccttgacacactcct

SEQ ID NO: 47332 - DNA, 201 bp, Homo sapiens
cattgatgcttctctgtcgacttcaagatgtgttcagttgggacattgccgtctgtttccttcttccgttctcctttcccttctactccagtccttacaartgacatcttctgttcctgcatgctaaaatgcccgtgacttctctaatgcagctctctgccttggtgcctttgcgtatccatctctactgaggaactggga

SEQ ID NO: 47333 - DNA, 201 bp, Homo sapiens
aggaaacctaactcaaaccagaatgggggtggggaaagtgaattgatgtatctcacataactgggagatccaagggtggatgtggttttaaccagaactcsatctgagggtttgtgggaaatattcaaattagaacagttaagagcagacaccagccaatcaaaacagtccatgccagtgacgtcagccctgcatgtgccg

SEQ ID NO: 47334 - DNA, 201 bp, Homo sapiens
cataatttacttggaggcttggggagaataagcttccaggtgaggaactcagtggctgagttgcaaagagctggaaatgagagaagcaaacttaatgactwtgtacgtgcttcagtttagtgcatatcccactcttgtgtcctaatccagttatttttatttctgctgaactctgtacatcctgaggatgaagcccatgct

SEQ ID NO: 47335 - DNA, 201 bp, Homo sapiens
tcacctcatcttctgccattggcctcccaccccacatttttccaatgaggttctttgagtccgacttatttttgacaaagccacactggtttgtaatgagmattgcattcttttatacagagttggggagggagggagattttgaagggggaaaacacgaaccaagtaggtagatatttgcatctctcaacttttctcgtc

SEQ ID NO: 47336 - DNA, 201 bp, Homo sapiens
tttccactagaatacttctggatttttcatgaagcctgagggaaaatgagaagttattatctacatcatttttcactgttttaatgttaatcattgatacrggaattggctttcaccatcttggagtccaccccacctataattaattataaatcctttcagtggacaaaccaataacacttctatattgaaccaggaacc

SEQ ID NO: 47337 - DNA, 201 bp, Homo sapiens
taagaaaaaaatgcaagcaaaataaaaattcccacatattgccttaattgtctttagagaaggaaatatcccagggcaagaatcatcagggcatgctctgygccctgcatttgatttcatgttttcaggagcacccctcaaggtctggagaagcacaggtgctgtacctgtacaagccagcaaggcaaagaggcctggttg

SEQ ID NO: 47338 - DNA, 201 bp, Homo sapiens
tacatcatttttcactgttttaatgttaatcattgatacgggaattggctttcaccatcttggagtccaccccacctataattaattataaatcctttcaktggacaaaccaataacacttctatattgaaccaggaaccagagagcctaaatgcatcccctggatatcatctagtgagtcagaggcacagaacaaaatgt

SEQ ID NO: 47339 - DNA, 201 bp, Homo sapiens
gagtagaaaggcgagagtgagaaggcaagatgaatctggaggggaagattcatgttttctgatttctgagggtccctcctgatcagcggggtgctaatgaratcagagacaggggatgtgaacaccacgggaacctgctggctttcttccactcacagcgccagaatgttcccaccagctgggacaaagcacagggagagc

SEQ ID NO: 47340 - DNA, 201 bp, Homo sapiens
tgatttctgagggtccctcctgatcagcggggtgctaatgagatcagagacaggggatgtgaacaccacgggaacctgctggctttcttccactcacagcrccagaatgttcccaccagctgggacaaagcacagggagagcatcaaggaggggatgaaaaaagagatcaggaaggaagagaatagtgtgcatgagctcac

SEQ ID NO: 47341 - DNA, 201 bp, Homo sapiens
gcttctgtgatactaagtttcctggttccgtttctgtctctcagaatacttttcccctaaaggtgtaaagttctctccttcatgtacttctctttcatgarcttctctccttctaatcttaactgagccttctccaagttccttccctatctcattatcttccatttctcattatgttccctcacaatcttaaccacaccc

SEQ ID NO: 47342 - DNA, 201 bp, Homo sapiens
tgatgtgatcttccccttggtgcatatccaaactgaactcaacacttaactcgtgccctgaattttggcaaggaagttatcaccagctttcactctttgartgcataacctttcactctgtttcttgtactcagggactgtagtgtgtgttgcagtctcttatctgactctcagaaataactttgagtagagcagtactac

SEQ ID NO: 47343 - DNA, 201 bp, Homo sapiens
gtgatatgggagtgacttaaattctttgttgcaaaaccagtgacactgttatgcaaacatgaagtattgaactatatggaagtatttatctgtttaaacaytgggggaagagacttttaaaatatggtttatattctcggtggttcggtaaaggtttttctcctgctcctcatcccccagccaaccttctccaatatattc

SEQ ID NO: 47344 - DNA, 201 bp, Homo sapiens
ttattgaggctcatttttacattagcccgctctcgctacataacaatttttaaatctttttacatttatgatagtcgttactgcagtttcagaatcattartgagataatgtgcttcttcaagttcaccagtctctgtgaatttgatatacttgttctgagttagcagggttgcagcggcctcagctttttggttcatgca

SEQ ID NO: 47345 - DNA, 201 bp, Homo sapiens
ggaacttcctgatggagatggaactgtttcacatcttgattgtatcctagttgggaagtcatttcatagatttgtaagatattgccattgggggaaaatgrgtaaagggtatataggatctctgggcactatttcttacaactgtgtgtgaatcaacaatgatctcaaaatagaaagtgtaatgagagaaaaagctctatt

SEQ ID NO: 47346 - DNA, 201 bp, Homo sapiens
aaagctcatatctctgtccaggatttattgcacatctattctgtagttttaactgtaatagcttccacttgctgattttgttctgtgcaccaggtcacatsgtcaacgatgtatagggattatcccattttatcctcataatagtgatggagggaaggtaagattgctttattttgcagaaccaggatgtgtgggcatcaa

SEQ ID NO: 47347 - DNA, 201 bp, Homo sapiens
tgtgtgataagcttgcagaataaatagattttgaactttctttttaacacagaaaagcaaaatacagtgaagttttggtggaactttcattctcatcaggscataggcttcagtgccgcattatcatatgggccaggtgggctttttccaggttactgagcccagtggcttctatagctcggttttaggaggctatggaga

SEQ ID NO: 47348 - DNA, 201 bp, Homo sapiens
caataaacattgacaaagacaccctggaagccctatagaaaacagatggtggcaggcagtcatggctgtgcaggaagacccacagggcgccttgcacagtwgccctggtgagaagtgacagaagctaatctcaaggagtgttgagggggatggagagaaaaggggacattcaggaagtgaaacaatggatgtgggcaggat

SEQ ID NO: 47349 - DNA, 201 bp, Homo sapiens
tgaacctgggaatacagttcccaaattccacaagacccttggatttccatctccaacccctgtgtctcagtacaacatcactcaaacagtaatgtgcaccygaattctctagaaacaatgttaaaatgggtttcctctgtaggatctagacaggaccgaggagcctgcatttctaaccagctcctgggggatgccaatgct

SEQ ID NO: 47350 - DNA, 201 bp, Homo sapiens
agagccttcagaaaggacatgacttttctgacactttgatttcagactttttgcctccagaactgtgagcgatcacatttctcttgttttacaccagccartgtgtgatactttgttccagcatccgtaggaaactaatacaaagtcccaaactctttccactatgtctagatccaaagtcaccaagaggcctggcttggg

SEQ ID NO: 47351 - DNA, 201 bp, Homo sapiens
tgggtggataaggctgtatttactaacaacttcctcatgcatatgcatgtgcttaattttcatccacatcattaataagatgattttaaaactggatgaayctctgcataaaacacaaacatttcctattatatattttattcagtctactatgttttcctctgtggggatcaagcatgatatacttctttctcatctctg

SEQ ID NO: 47352 - DNA, 201 bp, Homo sapiens
tgcccccagcactgttgggtgtcccttctctgtgcttcctctgccaacactctgtgcggtgtttccgggagtcagaatggcagggtggtcaagagtacggwctcagaggttgcagaaagataaaaagatgattgcattcatgattgttatgatgtcttgtacatagaatattgtcttatttgctctaagactccattaaaa

SEQ ID NO: 47353 - DNA, 201 bp, Homo sapiens
ttcactttgtaacaaggcttgtaactgaggatagtcacacagggcagtgtagaaatgatccttactatgttgtcactttggttgttatcctttcttcttcscaccctcctcccttcccaggatgtctcacatggagccatctgaggcaggtgcactcatctaatctgctcctctcctgctccaaggattggcagccactat

SEQ ID NO: 47354 - DNA, 201 bp, Homo sapiens
aaatgtcattaaacatttataatttcggggaaacccttatttcaaatcaattcttcataaccatttcctcagtaaattcattcaacaagtatttatcgggsagtttctatgagtcagataatattataggggctggggatatagcagtgaccaagaccatttagaactctattcttaagacattgccaccttcctgggagg

SEQ ID NO: 47355 - DNA, 201 bp, Homo sapiens
acatggagccatctgaggcaggtgcactcatctaatctgctcctctcctgctccaaggattggcagccactattcttgaaagagtctatggcctatctgcytgcactcaccatagtcaatgctcaaacatgcaatttgtgggatgatgtttggcttgcccatgacctattgccagtacctagcacatgagagatgctcaaa

SEQ ID NO: 47356 - DNA, 201 bp, Homo sapiens
taaagttttattagaatacacatgtgccccttcattcatgtattgactatggctgctttcgcaccatattggtagaattgggtagcggggacacagactgwatattccacagaggcaaaagtatgtaatacctgatcctctgcaaataaaaagtttgcagacccctggcttagaactccatacattttgattacattttaa

SEQ ID NO: 47357 - DNA, 201 bp, Homo sapiens
ttggaaaccacgtttgatgtggtttaactggaaatattgacccacgcaactaaaactcaggtaacccaagagactactactgctggcagagtcgtgtttgstgatttcagacaccatggagcagtggtccaagtttgaatgattttgttcccaggagacactttgggttccacactggggaagaagagggtacaactggca

SEQ ID NO: 47358 - DNA, 201 bp, Homo sapiens
aacatataattcacctataaaatactattttatctcataagacaaaatgagtccatggtcttattatgtaagactgttttccattggggctggtctcaggstaggcaaggtgagtatctgtaggtggaattctcctgagaacagatgctctaaactttttaaataattgatttgacttcttcaccatgtccatgtatatag

SEQ ID NO: 47359 - DNA, 201 bp, Homo sapiens
agactggaggatgtaatctaccccatagatgagctccttgaggatatggctgcatgttaatgttccagcgcagtgattggcacataggggctataaagaartatctgttgaatggatgaatgaatgaatgaatgaatgagtggagactcatggaatttaacttggacaggcaggttctaactgttgctgtaggcctaggaa

SEQ ID NO: 47360 - DNA, 201 bp, Homo sapiens
ttgattctcgacatttctagcctgatggagagaagagctgaggagctaccacttgaatctaaattctgagcttgttaaatagattaataaacctcagtccrtaggtattttctttcttctgttcttgggcttcttaaagtatcagacaatcagtagttactgggcacatgttgaatcaagagacacttaactttatcatga

SEQ ID NO: 47361 - DNA, 201 bp, Homo sapiens
acctccttcagttctattgccaaagatagggcttccttttaaaataaatttgctctcgccataggaaatatcgctttagcttgtgcagatgaatatgcacyattcttcgtcaagattagtcttgagttatgcaaattctgaattatctgagatattcgacaatgtaccacgtacggaaaatacatctgtgttctgtgtacc

SEQ ID NO: 47362 - DNA, 201 bp, Homo sapiens
gtcttggctctacttatttgaaatggatagcttcctaaagtaacatataattcacctataaaatactattttatctcataagacaaaatgagtccatggtsttattatgtaagactgttttccattggggctggtctcaggctaggcaaggtgagtatctgtaggtggaattctcctgagaacagatgctctaaacttttt

SEQ ID NO: 47363 - DNA, 201 bp, Homo sapiens
aatcaaccataacccatttaaagcagccttgcagataaatgtctcaaatctactagcctgccaaatgtattccttatctacacacatttatcaatttttcyacaacactaagcctttctaatgtttctctgacagttactttctctcccaagcctgaaattcgggtgacatctactttctgtaaactagatgtgcttgacc

SEQ ID NO: 47364 - DNA, 201 bp, Homo sapiens
tttatcagccaaaaagtatgattactatgttaatgcaggttttgcttcatcaagagattttccagttattgaacttaaataacattgttctaaaccccaartcctctaaattcctgttgtcagtgaaagaggtaccttctaatttggaaagaatatctagttcagttctgatttcaaaccagcagagaaaaataagaaaaa

SEQ ID NO: 47365 - DNA, 201 bp, Homo sapiens
gagcaaagtcttagtccaaccccttagcctgcaaactctggaattttagaaaagtcaatagtgtgccccagacatatttcaatatacctccattttactcmaggtaaaaggtttcttgcatccatttaactattgtaaatgaataaccatgtgaccctcaagaagattccaagccaaattccattggtttctaaggtctta

SEQ ID NO: 47366 - DNA, 201 bp, Homo sapiens
tacccttgtttgcagcgattactctgctcagaggaggatgacctgtgtggggagcctcttcagctacttgaggcactaaccctctagcccaggaagtcccwttattgctgggccctgccataagcttatttgtatttcacagcgacttgcacagatgtgccagatatgtacagatggatttttatcagaagagagtctacc

SEQ ID NO: 47367 - DNA, 201 bp, Homo sapiens
gcttagcaaggaagcatcctctacttgtgcatggcttcaaacgcttctaaattaacaggagtatgaaccatctgaggattcacaatttccagtgagtcttsgctctacttatttgaaatggatagcttcctaaagtaacatataattcacctataaaatactattttatctcataagacaaaatgagtccatggtcttatt

SEQ ID NO: 47368 - DNA, 201 bp, Homo sapiens
acataatggtgcatgtgtgtggggagggtggagacaggaggcagtggaggagctaagtatcccaaggtggaggaggcagcgtgggcaaagtcctgtcggcyggaggaagggcatgttcttggtaccagaagcagctcagtggaaaggatcctgaagcggaggctggtgggccgagtccagaccctgggggccttgtcaacc

SEQ ID NO: 47369 - DNA, 201 bp, Homo sapiens
gtttgcagagaggcaatcaaaagctgcaacacttagattaaggcaaactaatgatagaccatttcaagacatgatgacatctcaaaatgcctgggatccasatttctttcacttttgttttaagaggtatctcatttgctgtgccttttcataggataaaagcttgttgatcgtattatttagttgaacactttggggttc

SEQ ID NO: 47370 - DNA, 201 bp, Homo sapiens
gtaggagagaggaacatctaactcggtgagatgctagcatgatgacaagggcttggtctcaggtggttgtggtagagatggtgagcatgagacatgcatartctagagagagttaggaggtacaaaagatggacttgggggtttctgatacattacaaagggccagaaatctttgagcatcttgtcccctccccttgattc

SEQ ID NO: 47371 - DNA, 201 bp, Homo sapiens
caggttataggtggattcaaatattttgtttggcaattggttgaaagagtttaaagacctggaatcaatagaaaggaaatgtctagcttaagataaggggwtgtggagactgaggttcttactatgtagacgaagcctccaggtagcaggcttcagagagactagatggtaaatgtttcttctcagactttaaaaggtatc

SEQ ID NO: 47372 - DNA, 201 bp, Homo sapiens
gaagcaaagaaggatcctgagtgaaagcatgatgtgtctgaggatttgcaagtcgatcatgaggttgcagcatacatcacatgggagagagttgctgactsttcaggagagcagatcatggtatgctaggacaatcagagtctccactagagcatatgaagggcttaacataagggagtgtcataattacatttatgtttg

SEQ ID NO: 47373 - DNA, 201 bp, Homo sapiens
atatgcctaagatgattcaaaatggacattggtattcttgcgtgaggatgagagtggttgtcattggtaaaaaggttgaaagtcatagaacaggatatgayggatcaaagatcttaagctttatctgtaatattttatttcttttaataaaataaagacaaagcaaatgtgacaaagtgttaccagttggcaattccagat

SEQ ID NO: 47374 - DNA, 201 bp, Homo sapiens
tacttttggacaggcacccagagagacatagcacccagatcattgcttcaggtgtaagagtcatgcagagaagtgacacgctgcagctctgagtcagtacragccctggcacaccagtgtgttggtacaaaatgtcatcacgcaccagcagccaagggactctgaaaccctgggatcatatagaggcctgcataccctctc

SEQ ID NO: 47375 - DNA, 201 bp, Homo sapiens
gatgtcttagataggaatttgggcaagtgaagaaaaaaggtcagagtttagtcctcattatgcaggtacttatataaccattaacagacaaacagagagcsaaatcatgagtgaactcccattcacaattgcttcaaagagaataaaatacctaggaatccaactgacaagggatgtgaaggacctcttcaaggagaacta

SEQ ID NO: 47376 - DNA, 201 bp, Homo sapiens
aatgcagccctcatagcactaaggcatttcaggggcgactaaacaagtggcccatgaaatggaggcaccagaagcctctggaagcggcatcagtgcatcayccagtgaagccattgtgtcgcctgttagtaatgagcatttgcaagggcagcatggggaatttcaatcaacctgtgagaagacaaggtgtgcagacattgt

SEQ ID NO: 47377 - DNA, 201 bp, Homo sapiens
tagaaatggaactgcattaataatgattgttgaaaaaatgaataaatgattgttgaatgaataaccgaatgaatgccaccagggaaaattattgtctccawttcattttagggcctgaactttaggagaataaagttatcctaaagagagctgttggaacctgcctttctaaccagcttcctattttctagaaaaggggtc

SEQ ID NO: 47378 - DNA, 201 bp, Homo sapiens
aaggctgtgatgtgtctgactgagaaaatgcatgtgttagataagctttgttccagcatgagttacagtgctgctggctgtgataaattttaagtaaggcrtctttaaaccgaggcgcacgtaaaacaaggttatatattgactagttgactgaactgtgaccagaggctcacaggaacctaaccctgcatttctactagg

SEQ ID NO: 47379 - DNA, 201 bp, Homo sapiens
catagtttttagtttttccagctccctggtacaggaaagtccgcttgccagaggactggagtggtggttgtcatctaccacattgtgatgacatgagtgcwatttttttaattccatgggtttttggggaacaggtggtgtttggttgcatgagtaagttctttagtggtggtttgtaagattttgctgcacccatcacac

SEQ ID NO: 47380 - DNA, 201 bp, Homo sapiens
gccaagctcagaacctctgatctgcaaagcacagctgtggcctcccgccactcacttccatccagtctcacgctggtgcatctgcaggaagaacctagacygtaagcaggactctaggtgcaagagagctgggtcaacatagtttttagtttttccagctccctggtacaggaaagtccgcttgccagaggactggagtgg

SEQ ID NO: 47381 - DNA, 201 bp, Homo sapiens
actttctcatgctgctaatgggtacctggagttgagaatttatgcataggtgtgtacatgccatcacagctctgtgtgcatgagtgcctgtggggtctgcrtagcatgcacacatcacagaaaccctctgccctcccttctcattcctctatttgaagccaagtttccataatccctctactcaacccccttcttccccag

SEQ ID NO: 47382 - DNA, 201 bp, Homo sapiens
gggaggcagaagttgcagtgagccaagattgcgccagctgcactccagcctgggcaacagcaggactctgtctcaaaaaacgacaacaacaacaacaaacaaacaaaaaaaaaaaaaagtgtggcacctcccttcccccacacactttgctcttgcctttgccatgttatacgcctgcatcccctttgccttccaccatga

SEQ ID NO: 47383 - DNA, 201 bp, Homo sapiens
aggcagaagttgcagtgagccaagattgcgccagctgcactccagcctgggcaacagcaggactctgtctcaaaaaacgacaacaacaacaacaaacaaamaaaaaaaaaaaaaagtgtggcacctcccttcccccacacactttgctcttgcctttgccatgttatacgcctgcatcccctttgccttccaccatgattg

SEQ ID NO: 47384 - DNA, 201 bp, Homo sapiens
agaagttgcagtgagccaagattgcgccagctgcactccagcctgggcaacagcaggactctgtctcaaaaaacgacaacaacaacaacaaacaaacaaamaaaaaaaaaagtgtggcacctcccttcccccacacactttgctcttgcctttgccatgttatacgcctgcatcccctttgccttccaccatgattgtaag

SEQ ID NO: 47385 - DNA, 201 bp, Homo sapiens
ccagaagctgagcagatgccagcatcatgcttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagacta

SEQ ID NO: 47386 - DNA, 201 bp, Homo sapiens
gccttcctcttaacattcatctagtaaggggggagatgtagaattttgatataaattggccagccttatgttgatttatctttaacacagatttcaactcyttcacttcagttgccatgaactgcaaggcccttgttcagtctggcttttcatctctttcctgcccaagtccaatttagctcttataaaacaaccagacta

SEQ ID NO: 47387 - DNA, 201 bp, Homo sapiens
tcaggaaagggaaaatgtgcaaatatacgagacaaaattgcttttctttcccagcagttttctcccttaggaccatttcacaggcctgagctaccctaggrgtctgttttgcccacaggctatgcgtgaagccgacccttaccctctcacccagtgacgaccacgacaatgttgatgatcataagcagtgcttgcaggctt

SEQ ID NO: 47388 - DNA, 201 bp, Homo sapiens
tcactcagattgcttttcattttttaattaaagaaacataatttacaaaaatcacattattgtaagaattttaaaaagtcagatatgcaaaatataaaacyataaaattgccatagttgttattttagcgtatcttaacgttttagtgtataagcatttttttaggtgtttgtgtgtgtatattttttaccaaaatgagat

SEQ ID NO: 47389 - DNA, 201 bp, Homo sapiens
acctgaaaaggatttagatattaatatagaataacttttccaaactagttctgaaaacataagaactgagagatagccccctgcaacacacacgcacatgmacacacacacacacacacacacacacacacataggttttgtgctctcttgggagcatttaagatacactgcaaactacaattgcttccttaaaatgtaca

SEQ ID NO: 47390 - DNA, 201 bp, Homo sapiens
aatgctgccttattgatggactggaccatttattctgcagatagtcccaccttttagacttatctggtcacttccttatggtgtcacatagcttgttgctstgtcctggggtgcctttgtttattctctttaatgcattttccaagactcccctcaaactccaatgaattaaagttttcagagtttggggcctgggaatct

SEQ ID NO: 47391 - DNA, 201 bp, Homo sapiens
cctgaaaaggatttagatattaatatagaataacttttccaaactagttctgaaaacataagaactgagagatagccccctgcaacacacacgcacatgcacacacacacacacacacacacacacacacataggttttgtgctctcttgggagcatttaagatacactgcaaactacaattgcttccttaaaatgtacag

SEQ ID NO: 47392 - DNA, 201 bp, Homo sapiens
gaataaaatacctaggaatccaactgacaagggatgtgaaggacctcttcaaggagaactacaaaccactgctcaaggaaataaaagaggatacaaacaamtggaagaacattccatgctcatgggtaggaagaatcaatatcgtgaaaatggccatactgcccaaggtaatttacagattcagtgccatccccatcaagc

SEQ ID NO: 47393 - DNA, 201 bp, Homo sapiens
cctggggtgcctttgtttattctctttaatgcattttccaagactcccctcaaactccaatgaattaaagttttcagagtttggggcctgggaatctgaastggttccactttgccaggtgagtctgagtttgagaggaaaggtgtcctagatcattcagcagcagcagaagagttggcccttaaatctacgaagaacatt

SEQ ID NO: 47394 - DNA, 201 bp, Homo sapiens
ccctgacttagagcccatctcttctattaattagctgcacacagaagctggattcccctccaagcgtgctctacctgtggcaaagtgctattgtgggactmcttgggaacataggaaaagtgtgcattgtctggtactcagtaattgctcaataaataccagctacatcctaacaaatattttatggaggtccttaaactg

SEQ ID NO: 47395 - DNA, 201 bp, Homo sapiens
gtaaacaattacggcgttttttcatccaggcattacattaggtccataacactcacaggagctctgtaaggctgaaattgccacatccattctactaggasggttatggagttcccaagggctgacctgcctttcctgagtcacccactggagagccagggcattggatttgacctcatagccgctgctctatccactccc

SEQ ID NO: 47396 - DNA, 201 bp, Homo sapiens
gattgaacagagttatttgagctacttttgataaaatgtgacaggcagactttggtatttcaccaccccaacatttttttatggactgctcactatcactrcaacattcagcacttttttctgtgtcaatgtgatagacaatattcatattcttcttgggtaattgcctttttagctgaatcaatggcttgcaggcatgag

SEQ ID NO: 47397 - DNA, 201 bp, Homo sapiens
tctattaattagctgcacacagaagctggattcccctccaagcgtgctctacctgtggcaaagtgctattgtgggactacttgggaacataggaaaagtgygcattgtctggtactcagtaattgctcaataaataccagctacatcctaacaaatattttatggaggtccttaaactgagcaagagcaattttacctgat

SEQ ID NO: 47398 - DNA, 201 bp, Homo sapiens
agggatttctgtattcattgctcctggacttttcacatatttggggagcttgattgagttcccctcagctcttccattagaaagcccatgtggtacagtgrctcagagcttgggcttaggaattcacaaatgtgaatctgtgaatctgagctctgcatcttattacttgtgtggccttgggcaagtcacctcacctacctg

SEQ ID NO: 47399 - DNA, 201 bp, Homo sapiens
aagaaacatggtagatatccttatgcatgtgtgcacatgcagcacacctggcctggcacaacctgctcacacctctgggagtcacctgggtgttggctgaygcagcctggcctcggctgagctgactgtcaaccccgcaactgcctgtcccatcatggaccagaagcagagccagggatgaggatgaacgctctagttgcc

SEQ ID NO: 47400 - DNA, 201 bp, Homo sapiens
caagaaatattctttgtcatcctagtggttgctttagaatttgtagtatacatctttaacttatcacagttcgcgttaaataatattatagcatttcatayatggtataagaaccttacagtaaaacactttcattttctcctttcccagcctttgcactactgctcctctggtttttagttgctcataggttgtaaactc

SEQ ID NO: 47401 - DNA, 201 bp, Homo sapiens
cagcagcagaagagttggcccttaaatctacgaagaacattgccctgtgcatctgcatgcagacagggtctgataacatcaaagctgggagtctctccaaygctttaactaatgggatctgagctcggctgtttatttatagtcattcagtgataagaaagtcaacttggttggaaggagcttctgtcctaggcttgcagc

SEQ ID NO: 47402 - DNA, 201 bp, Homo sapiens
cagtatgtgatgaaagagaggagggttgagggtagtgggaagattttttaaatatttcaacttttttaaattgtaaaaaaaaaaaaaacatgactttaaawttactgtcttaatccttttttttttttttttttttttttttgagaaacaaggtttcactgtgttgtccaagctggcttctaactcctgtgctcaagtgat

SEQ ID NO: 47403 - DNA, 201 bp, Homo sapiens
acgaggccagtcgctcactgactatggaagatgagtccattatttaatcactctggccttcggcttttcagctctaaaaatgagaatattcctttcctcartgattattgttatgattcccggagataacgtgcatgaaagattttagtgcaggcctttcttccttccgttgacaacccagaatgttgcttgatgcacagg

SEQ ID NO: 47404 - DNA, 201 bp, Homo sapiens
tcgtaagtacagagaaaggcaatattaatgccaatttcaggggatctgttcaagttcaccggaaggcagagtttttagcaattttttaaaggttgaacatrtctttaggaggtagcaacaagacaaaggtccaggaagagggtgtgatgcagtggggaagcatgcagtcaccttgtgccgaacttaacaggtcaagaactc

SEQ ID NO: 47405 - DNA, 201 bp, Homo sapiens
gatctgagctcggctgtttatttatagtcattcagtgataagaaagtcaacttggttggaaggagcttctgtcctaggcttgcagctggggccttagctayccttgtaattttcccagaaaaaaaaatgcacatctctttgagtcctgggccatgtgtaaatcagtggtaatacaagaaacatggagcaccccagaaaatc

SEQ ID NO: 47406 - DNA, 201 bp, Homo sapiens
ggggtaccaaataattcatttccccttttcccaacagatgcattcttgtgacctcactgatgacaggggcgtcgtttattctaacaaatgctcttgtccamattccaaccatgttgccaagagatggcatagctggtgagggctggactttaggggccaatctccactcctgagctcccctgaccacacaggaagaaaaca

SEQ ID NO: 47407 - DNA, 201 bp, Homo sapiens
gtggtagaatatagatgtaggtcagtagtgatagcaggctacagccagccggtggtcaccacagggtagatatcacatagtggttgaaactgaaggcggcygaaacctgaattctaattaatttctttgtgaccatgggaagttatttcacctttccgttcttttttttaacttttaagttgaggagtacatgcacaggat

SEQ ID NO: 47408 - DNA, 201 bp, Homo sapiens
taataaaataatggtgagacttgagatgacacaggagtgttctaacagaggcacagtccacttgaccagatctttctcaggcatctccatcgacagtgggrtctccctagaaggctgggtggctgccatcccacccaaccagcctgcctgagttggtaaaagtgcatgaaagtgttcctctcagggggtggccttccattg

SEQ ID NO: 47409 - DNA, 201 bp, Homo sapiens
tttcttgctacaggcaaagccaaatgccgtgttgtagggaagctcaagtagcttcatggagaaatccacatggcaaggaactgaggccacctactaatagscagcatcaattctttagccgtatgtgtgagccaccttggaagtagaccttctagcccccatcaagcttttagataactgtagcctcaccaacatcctgac

SEQ ID NO: 47410 - DNA, 201 bp, Homo sapiens
tttaaacaatcaattttccttctaaacatagaaaaaggcatatttttccacatatacaccactttctgtgctcttcattcctttgtgtagattcatatatscatccaacattatttttggtttggatgaaggactattgaacatttcttacaatgaggttctgctggtgatgaattccttcgccttttgtatgtgcatctg

SEQ ID NO: 47411 - DNA, 201 bp, Homo sapiens
gatgggcacttaggttgattccgtgcctttgctattgtgtttcaccttgttgaacatcagttttgtgagctataaaatgggggtaatccattctctacctsgtaggattgttcagagtatgataaaacactgtgtctggcacaggaatgtcaatgatcagctattgagtaagcaaagtgaattaatgatctttatatgcca

SEQ ID NO: 47412 - DNA, 201 bp, Homo sapiens
atgggcacttaggttgattccgtgcctttgctattgtgtttcaccttgttgaacatcagttttgtgagctataaaatgggggtaatccattctctacctcstaggattgttcagagtatgataaaacactgtgtctggcacaggaatgtcaatgatcagctattgagtaagcaaagtgaattaatgatctttatatgccat

SEQ ID NO: 47413 - DNA, 201 bp, Homo sapiens
ccctcacaagggcacagcggagctcgttggttatgcttcagttacataaatccagccttacaaaggctacacagggagaggggctccttgcctcctagatstgtaccttgtaggtgctcaatacacattggtaagaatgttcacatcatcaggtaagcaaggggtataaagtgaggccttgaatcgctcacgtagattcaa

SEQ ID NO: 47414 - DNA, 201 bp, Homo sapiens
gaaagggctggagggagaaggttattgttatatataaagtcgcggtaccgcaaaagaaatagcagtcgaatataaaattttatttttaattctcagcaagkcaagttacttctatatagaagggtgcacccttacagatggaactatggtgagcccacatttggacaagagaggggaaggggttcttatccctgatgcacg

SEQ ID NO: 47415 - DNA, 201 bp, Homo sapiens
gacattatgcctatgtgaaagtaaagatggagttgtttatctctgtatctccttgtcctgtttctcccaggacttggcagaactcttgatggcaagaatcwaatctttgtcctacttgtaactgcagtgcctggcagtttgccctgtccatattcatagagctaaagaaacatttgttataaatgaagaaatcccccagag

SEQ ID NO: 47416 - DNA, 201 bp, Homo sapiens
tgtcaatcgtgtcttgaggttattctagcaccttacgaaaagccaccatccacctaattttagagcttttaagataaagcccgggagcactaggaaggtgrgtgagttaccgttatcaatctggaatgtgaggtttccagtgcagtagcaccacctcttctaggtcaccatggccagcccttctcagaatacagaatgatg

SEQ ID NO: 47417 - DNA, 201 bp, Homo sapiens
acctctaaagggccccacctcccagcaccattacattggctattacattacaacaagagttttggaggtgacaggcatttcaaccatagcaaagagtcaakgtcgctgctggctcttcctgccactttgctctgatgctcacaactggatgtggcagccctgcttgggttacctaaaagagccaggtgactttgccaagct

SEQ ID NO: 47418 - DNA, 201 bp, Homo sapiens
cctatgaagctgattaggaaagccttgagtttgtacccaaataaatttgctaatacttttacctaaattagagagattcggatggggtgggataacaacasgccacatctacctgggtggagcccatctcaggatgcctctgcccaggaggaggggcagtgagaaggaggccggaaggggaagagaaacaggagagggaaa

SEQ ID NO: 47419 - DNA, 201 bp, Homo sapiens
agtgcgatgcatgggtcacagaatatgccagagaacaacgaggccagtcgctcactgactatggaagatgagtccattatttaatcactctggccttcggyttttcagctctaaaaatgagaatattcctttcctcaatgattattgttatgattcccggagataacgtgcatgaaagattttagtgcaggcctttcttcc

SEQ ID NO: 47420 - DNA, 201 bp, Homo sapiens
ttttacttttcggcctagaaactgttcctcaagaactcttccctagtaagtgatcccatagaacgccatgtttccccatcatattcctcatcacactgtaytgtcattgccagcttatgactttggtcgtgagtgataacaggtaaggaaccatgcctgtgttactcaccgctcagtcctcagcccaggcaccctgcctaa

SEQ ID NO: 47421 - DNA, 201 bp, Homo sapiens
catttgacccaaaatcatttttaaaaattattgttctcctaaattgaagccctttccagcattgcgcattagaagtcttaaaactcatctgttttcttttygtaattgacttacaaatgcgtaatcgactcacaaatgtataactgagtatgcatggcattttaaaagggcagagtttccatttgcttcttgatttctttg

SEQ ID NO: 47422 - DNA, 201 bp, Homo sapiens
ttgtgcaataggaaaagatgcttgaccagtgacgatgagcttttttccaaatgttttttggccacagaagtgtcttgagaagtgtctgttcatatccttcrcctgctttttaatggggttgtttgttttttttcttgtaaatttgtttaagttccttgtaaattctagatataagacctttgccagatgggtagattgcaa

SEQ ID NO: 47423 - DNA, 201 bp, Homo sapiens
atggaatctagtggggcatcagacaaaccatagtttcatttactatcttgtaacttcaaggaagccactttactttcctgagtctgtttccttggatccaraaacctacttagtaggatagccatgaaaattcagtgagataaatcatatgaaaccagaacacagctgatacatgcagtgaagcggctcttaaatatgtgc

SEQ ID NO: 47424 - DNA, 201 bp, Homo sapiens
ctccacatgagaacgtccctaccatgatgtccagtaaagaatgggctacgtgtcccgcagacttgattacctccctgctccagcttggctctttctacaarggctgtgctggcccaaacatcaatgtctcatttaacttttgaaaatcgtcctcttggcatctagacctgttgttttcctggcctgctaggataaatacgg

SEQ ID NO: 47425 - DNA, 201 bp, Homo sapiens
aaagactattaagtctcttaaatgctggaaaatgtcttcatgagcatattcagtgatttggcacttactccacatgagaacgtccctaccatgatgtccastaaagaatgggctacgtgtcccgcagacttgattacctccctgctccagcttggctctttctacaagggctgtgctggcccaaacatcaatgtctcattt

SEQ ID NO: 47426 - DNA, 201 bp, Homo sapiens
gagatgccccaaactgccgggcctcctgctccatcctccaggtttgaactacggctggttgcaaggagtgtatttgtgcttgcattagaaaattaggaacrcctgcagaaaatggctttcccacagataaaagactattaagtctcttaaatgctggaaaatgtcttcatgagcatattcagtgatttggcacttactcca

SEQ ID NO: 47427 - DNA, 201 bp, Homo sapiens
tgggcacattataacttctccagcatggactatgtggccatgatggtaggcttggcaattaaaaagacaagtggagagatgccccaaactgccgggcctcstgctccatcctccaggtttgaactacggctggttgcaaggagtgtatttgtgcttgcattagaaaattaggaacgcctgcagaaaatggctttcccacag

SEQ ID NO: 47428 - DNA, 201 bp, Homo sapiens
ccccttgcccattttttaatcagtttatttggatttttgttggattaagttggggaagttctttatatttttctggattttaaccccttatccgatatatrtcttgcaaagattttctcctatttagtaagttgcgttttcattctgttgattgtttcctttgatgagcgtaagtttttaagtttgatgtagtttcatttg

SEQ ID NO: 47429 - DNA, 201 bp, Homo sapiens
tcagtccttgaaactaattgtgccaagtatgggcacattataacttctccagcatggactatgtggccatgatggtaggcttggcaattaaaaagacaagkggagagatgccccaaactgccgggcctcctgctccatcctccaggtttgaactacggctggttgcaaggagtgtatttgtgcttgcattagaaaattagg

SEQ ID NO: 47430 - DNA, 201 bp, Homo sapiens
gcaatgactgagagacacaggtactctgaagaatataaggaattttcttgtgccatatgaaagtgccgttagaaaaataggttggtcattttctgacatcaaaagattttttccccaaattgtctgagttgcagccaatataaacataggccaagtttttctaaatcacatgtgtttggagagggtggaatggctgtcaga

SEQ ID NO: 47431 - DNA, 201 bp, Homo sapiens
gcagccaatataaacataggccaagtttttctaaatcacatgtgtttggagagggtggaatggctgtcagaatgggctgggcttatagggtgacatacagrtccaggcagagtgagccaaccaacatcacttgcaagattgaagaaggctcatggagttagatcagtggaagagaagatcctcatagaagaggcaaaattc

SEQ ID NO: 47432 - DNA, 201 bp, Homo sapiens
atcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatc

SEQ ID NO: 47433 - DNA, 201 bp, Homo sapiens
tgctgtgatcaaaaggattgtgtttaagaatgtatagtctaaatgcttattgtgatcactaacatttgtatagttctttggggtttaccaagtactttacytgtattttctcatttaatcttcacttaggactaaaaaagttagtaacactaatgggaatgagcgaaaaccaaattcagacagtattaaatacacaaaatt

SEQ ID NO: 47434 - DNA, 201 bp, Homo sapiens
taatcagtaaaaccacccatggattcctaattgaggacaatttctttcctttcttttagaaaacttaggaatcaaagtgtattccagtaactgcatggaargggctggagggagaaggttattgttatatataaagtcgcggtaccgcaaaagaaatagcagtcgaatataaaattttatttttaattctcagcaagtcaa

SEQ ID NO: 47435 - DNA, 201 bp, Homo sapiens
taagaaattctgcatgttccattgacaaaactgggaacactgcacacacatacacatattcacacaaaccatatacagtcacgtgtcactcaacaatgggkataccttctgagaaggtatcattagatgatttgtcattgtgcaaacatcatatagtgcacttacgcaaatctagatggtatattctgctacatgcctatc

SEQ ID NO: 47436 - DNA, 201 bp, Homo sapiens
agacagtattaaatacacaaaattataaagtaaaatgagactgatttcccacgtcatgaggaaaaatgtctctttactttgtgattctttttatcacatayttaaaggcatttgcatttttccttttctgaattttctgcttttagtttttcctcttgtattagatgttcagtgtaactcaccaattgtggcagttttctg

SEQ ID NO: 47437 - DNA, 201 bp, Homo sapiens
ccctcaatgtgcacttctgcggactttgattagtatgcataatagagcagcacacctgatgtccgcagcaggcagttctaatgccggtggagagaggtacragataaatcactccaagtaaatgactaattaatcatgcacttgattttaataacatataccatctggctcaagatttgtctgtctacaatcttgtattcc

SEQ ID NO: 47438 - DNA, 201 bp, Homo sapiens
ggaactaaagaatgcaggctcggcttttcccagaggcagcagtgcgatgcatgggtcacagaatatgccagagaacaacgaggccagtcgctcactgactrtggaagatgagtccattatttaatcactctggccttcggcttttcagctctaaaaatgagaatattcctttcctcaatgattattgttatgattcccgga

SEQ ID NO: 47439 - DNA, 201 bp, Homo sapiens
ttagctatcagccataattttaaaaatagtgtttttaaaatcagtaatattattgacaaccttttctgaatattgtccaagtgctttacagggattatttmacttatcatgggaatgatcctatgagatagccactgttattattcctactttacagatgaggaaaagagaggttaattagcccaaggacacacagtttcc

SEQ ID NO: 47440 - DNA, 201 bp, Homo sapiens
ggaaaaatgtctctttactttgtgattctttttatcacatacttaaaggcatttgcatttttccttttctgaattttctgcttttagtttttcctcttgtwttagatgttcagtgtaactcaccaattgtggcagttttctgtttgattcacagtaaaaaagaataaaaaataaaaattaaaaaaaaactgtgacctgcat

SEQ ID NO: 47441 - DNA, 201 bp, Homo sapiens
tggggaaaatggtccaatgatggggaaagggcccaggttttgacacctgaagacatccctggatttcaggaatttgaggcagatccctagagctcagatcyaggattcagaacgaaacggtgactgtgagagtaaaccatggtgtctgacataagggtttccttgattaccctttaagggcccctatgaatgtctctgggt

SEQ ID NO: 47442 - DNA, 201 bp, Homo sapiens
gacagccccatccagtaatgcctcctttctccttcaagggcatcttattgtctcattactcacatttagagactgattatgtcatttagtaagccttcgaytgaatatttaaaagccacttggatgaagttaaaagtcagcaaagaatgtatttgaaaagcatgcatagctcatagctcctagaactgacagtgaaatgga

SEQ ID NO: 47443 - DNA, 201 bp, Homo sapiens
ttagatccccatagtcaattttggcttttgttgcaattgcttttggtgttttagttggggggtggggggcaagggaagggacagcattaggacagatgccsaatgcatgtggggcttaaaacctaaaatatgggttgatgggtgcagcaaaccaccatggcacatgtatacctatgtaacaaacctgcacagtctgcatat

SEQ ID NO: 47444 - DNA, 201 bp, Homo sapiens
ggacagcgcctcattccttacctgattcacacggtgctgatacgcttgttcagggctgcctcaagcttcagactcagagtcagaagggacctcagagtctrtgtggtgctgatggtctttgtaacgccttaacaggatgagggtgtgagcctgggcgctgggtggcagccttgtccatcaccagatgagcttagcaccgtc

SEQ ID NO: 47445 - DNA, 201 bp, Homo sapiens
ccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacac

SEQ ID NO: 47446 - DNA, 201 bp, Homo sapiens
cacagggcactagagaagagtgttcacaacctccagcccctccacaaagaagcctgattctggaaagacagaggttccaacctcacccttacttctcttcygaagatctgctgtgcatgaagcattttggaggtatttcttcagctcagaacacagcaactttcctatgaaagagagcacaaagggttaatgccaccagaa

SEQ ID NO: 47447 - DNA, 201 bp, Homo sapiens
agttctcattttgttcacttcttcagaaaattcaaagaagaaaaaaagcctaaagccactcactcgttgctctttcaatggcatcaccattgtgtgatctrtcttcttctgctagaaggaaattccaggaatccttgatctcgcatcttttaaactgatttcacagagggtatccctgacagcatttaaaaaaaaaaagca

SEQ ID NO: 47448 - DNA, 201 bp, Homo sapiens
gaacatattttacacattaaaagacctggattttgctggagaccctagagaatgttctcattggagtccccctcatttaccttggaaaggactgtctgaakttgaaaagaaatctgaagcaggaaaaacatataaagaaatatgaaaaaatggtataactttcaagggaaagggtttccttaaaaattcatgagatgggtt

SEQ ID NO: 47449 - DNA, 201 bp, Homo sapiens
ccacaaagaagcctgattctggaaagacagaggttccaacctcacccttacttctcttctgaagatctgctgtgcatgaagcattttggaggtatttcttsagctcagaacacagcaactttcctatgaaagagagcacaaagggttaatgccaccagaagacactcagcctgtccagtgtcgctaccactgggacgggca

SEQ ID NO: 47450 - DNA, 201 bp, Homo sapiens
tggcttttctgaaagttaagactaaaccagtctccttttctgctggtctttagatgatacccaaaactgtacctcgtgttccatgtctctaagcattcaaycacttactgggttgggctgtgctcatcttacacagaacagatctcctcacttttctctcaaatgttttcctccttagtcccctgtctacacgtagcctct

SEQ ID NO: 47451 - DNA, 201 bp, Homo sapiens
cttcccctcccattgtacccagaagaaacaagaattgtttctcagttctaactgtcataatgcctagcgggcgttagcctacaacgaaggataattcaatstatcctcaccttagtgtacgctggacaacactaggactcagaagtgctttgctcttgatcttgaaaggccagtggaaatccatgcagattcctcccccag

SEQ ID NO: 47452 - DNA, 201 bp, Homo sapiens
aagtctagaagagggaaatctaacacgtactgaacagtctagaagggggaaatccaatgtggactgaacagtctagaagaggaaaatccaacatggactgracagtctagaagaggaaaatccaacatggactggacagtctagaagagggaaatccaacatggactgctgtgcaccagcctacatcatagtcacgtggtt

SEQ ID NO: 47453 - DNA, 201 bp, Homo sapiens
taaaatgagatatatagtaaattaaattagaaatgcagtagggtttctttttaagtggaggtggtcctttctcctatcctcccaacttcttaactccaatrtttcaaagctaggaggagaaatcagtattcccagggaccctttggaagaacctttcttctttcaccctctttcatccattccttctctgaagctcatgcc

SEQ ID NO: 47454 - DNA, 201 bp, Homo sapiens
aacccagtttaaagagatccaggaagcagattgtgagctgcagatatgatgtgattattaaaagcagcctccattgccaacattgcaaacgcatcagcatrttccttccttcaacattccataacgtggtggtggtattcccaccttaccccgggagaagctgagagtcacagggagcatttactttccaagttcacacat

SEQ ID NO: 47455 - DNA, 201 bp, Homo sapiens
ggtagagtgttgggaccagaaaggggttgccctgagttctcgtcctggctcttgtgtgaattagtccatgactatttgcttacccaacatctcatagcttsagtttcctcaactgtaaaatgagggaaataagagtgcctctgccttccccttgaggcttgttgagtagttccaatgagtcagcaaaaaatgagaaacacg

SEQ ID NO: 47456 - DNA, 201 bp, Homo sapiens
agaatgtgttcatctgttacctgtgtaactgaacataataatactatgtttgaacagatttcaaaaatgggtttggatctgattttaaaacatttgaaacrgatgtggaacaagtttttaaagaaggaaccctatctcataagattgtcaggatcattaaacatcacgagtatgagcccacaggaaaccttcagtatatcg

SEQ ID NO: 47457 - DNA, 201 bp, Homo sapiens
ccagcctcctgcgactggcctgcatacatacaaatacccattctaggtggtttccaaaaggactccatttctatgggaatattttccattgagctgtttawgaactttcacttagtgattaaaaaattattcaaaaggagggcaatagtaataaacttccactttccgtttcaccagcatatctcaaaactaaattaatta

SEQ ID NO: 47458 - DNA, 201 bp, Homo sapiens
tcactccaagatggccagttatcgcccaactctcttccttctgcttcctcaagatctcttccatctgcttccctccatccatcctcctggccactcccatktgcatgcttctatcctctctgcttcagccacccacccctcaccggtctccctactctcccctgtgctagagtggactctaaagcacacacctgatgatgc

SEQ ID NO: 47459 - DNA, 201 bp, Homo sapiens
ttacctatggactttcaaaggtttgcaaagatttacctcctactaaaatggcttgtgagcatggaaggcttaaacattagcagagcaggtagaaaaataasgcctggtaagatgccaaatggtggaaaccgaggcagaagatagtcctctggacaaggtcagcataatctagtacatatgaactcactcacgctcctgcat

SEQ ID NO: 47460 - DNA, 201 bp, Homo sapiens
tgagaatatgcctcccagagcctccaccacagggaacacgactgacatgtgaccccagatgctgtactctgaagcccatgacagtatttgggctgacgctrtggtttttattatctttcctcaccaaagacttcagcaagggagggatactaaggcaaatctgtttctgggaatcttcaaactcattcaacagctgatctt

SEQ ID NO: 47461 - DNA, 201 bp, Homo sapiens
ctccaagatggccagttatcgcccaactctcttccttctgcttcctcaagatctcttccatctgcttccctccatccatcctcctggccactcccatgtgyatgcttctatcctctctgcttcagccacccacccctcaccggtctccctactctcccctgtgctagagtggactctaaagcacacacctgatgatgccac

SEQ ID NO: 47462 - DNA, 201 bp, Homo sapiens
agaaacaacagaggaatctgtgagacagggctgctgtgagatgatgtcacacttgacataaattgacagttaattgcctggagatttgggaacagttcagsggtgtgtgtatgagagagattgtgcataccatgaacaatggacacaaatatatatgcctgcttctgtgttgtgtgtctctctgaattagtgttccctggt

SEQ ID NO: 47463 - DNA, 201 bp, Homo sapiens
gtattttgttgccacaacttctttggttcaaattaaagaatataggtcatttgtcccagagagtcagtccagctgaaaaattgtggatgttgataaatgcrtaggtctccattcttaaaaatccagcatttttgtataggaacaaaactttacttggattataaattgcaggccttctttgaaaagacaaagtgtgaaagg

SEQ ID NO: 47464 - DNA, 201 bp, Homo sapiens
acaacttctttggttcaaattaaagaatataggtcatttgtcccagagagtcagtccagctgaaaaattgtggatgttgataaatgcgtaggtctccattyttaaaaatccagcatttttgtataggaacaaaactttacttggattataaattgcaggccttctttgaaaagacaaagtgtgaaagggaagagaactgta

SEQ ID NO: 47465 - DNA, 201 bp, Homo sapiens
acatcgtatatatgtatatatagtatttgtgtgtgtacatattatacacatgtatgtgtgtgtatatgtatatatgtatatgtgtgtgtatatatatgtakgtgtgtgtgtgtgtatacatatgtgtatatatatatatgccctttaagactaatgcaataacttttaaggttctttttgattgaagaaatatatgtaatt

SEQ ID NO: 47466 - DNA, 201 bp, Homo sapiens
ggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaat

SEQ ID NO: 47467 - DNA, 201 bp, Homo sapiens
gcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaata

SEQ ID NO: 47468 - DNA, 201 bp, Homo sapiens
caggaaatgggtggcatatggcatttggcattatgaggcattgagaaatcctttccgtaatatccactgagtatatactgtgagccaaaactatgatagckgctatgggggaaaaatgagtaaaaaccaacagtcattgtcttcatagagcttacaatgtagttggggggaccaatattagtcaaataagcatagtaagaa

SEQ ID NO: 47469 - DNA, 201 bp, Homo sapiens
ctaaaaatacaaaaattacctgggcatggtggtgcacgcctgtagtcccagctactcaggaggctaaggcaggagaatcgtctgaacccaggaggcagacrttgcagtgagctgagatcatgccattgcactccagcctgagcaacagagcgagactccatctcaaaaaagcaaagatgtgagtccagggtgggtgttgat

SEQ ID NO: 47470 - DNA, 201 bp, Homo sapiens
aggatggctgaggctttagaaccagatggagtgctgtggcctctcttggatggatgctgtttctgagctttgcatctggaaagacagagcctgctctaggrataatgatgtcaaagatctttctcattttactgtctggttaaatatcacctcttcagagaagccttcccttatcaacttacttaaattgagtaccccctg

SEQ ID NO: 47471 - DNA, 201 bp, Homo sapiens
cctttgcactctttccttccctcgtccacctgggagactcctgctgatcttttcagactcagcttaaatgtccccaccaaacctcccctccctctccccaytggaaccagctccacactgcactccaccatgttggcatgtacagtacatgtggctaccagttgattgacagattgtccctgtaagccagtctgctcaggg

SEQ ID NO: 47472 - DNA, 201 bp, Homo sapiens
gggggttgcaatgagcccagattgcatcactgcactccagcctgggtgacagagcaagaatccagctagagaaaaaaaaaaaaaaaaaaaaaagtccttgygcattaatctgttctataggtgtttttagtggaacatttagtgggggtccagttcatccccaattataaatataattccactgagcatcctcaactttgt

SEQ ID NO: 47473 - DNA, 201 bp, Homo sapiens
ctgtctggcctcctctcctttccctccttctgaacaccctagattcctgccaaatataatgttattccacaaacctatgaggaccttgcctgccctctgtsctttgcacatgctcttcctccagcctttgcactctttccttccctcgtccacctgggagactcctgctgatcttttcagactcagcttaaatgtccccac

SEQ ID NO: 47474 - DNA, 201 bp, Homo sapiens
gatggccagttatcgcccaactctcttccttctgcttcctcaagatctcttccatctgcttccctccatccatcctcctggccactcccatgtgcatgctyctatcctctctgcttcagccacccacccctcaccggtctccctactctcccctgtgctagagtggactctaaagcacacacctgatgatgccactgtcct

SEQ ID NO: 47475 - DNA, 201 bp, Homo sapiens
gattcagcactcaataactctccctcacgcttagaggaggcttcatatttttcaagacacgttcctatctgtcatcttctatcctcccagacgtgttttcycatgataagaattatttacacatcatttacatttacagatttgctttttttgttgttagtgtcaaagacatttttgcagatgctgtgttgctcttctctt

SEQ ID NO: 47476 - DNA, 201 bp, Homo sapiens
aagctgtctgatcacatacctgggaacctggttgttatatccatggctggggagcagggtagcagggagcaagaactgtccaacataatctagtttacctrtggactttcaaaggtttgcaaagatttacctcctactaaaatggcttgtgagcatggaaggcttaaacattagcagagcaggtagaaaaataacgcctgg

SEQ ID NO: 47477 - DNA, 201 bp, Homo sapiens
cctttcatgacttaagaagcagtgtgcatcgaaatcgcagaccctagattcctttatcaaactgcctacaggagagcctgagggacttgtctgcaaagctmttctggagtcagatgaaactggaatatttggtctttggtattcaccatgctccatcaccccaactgcaggaatcatttgcagctcatggacattttggat

SEQ ID NO: 47478 - DNA, 201 bp, Homo sapiens
cacagacaatagcacctagggcagggcccggtcacagttgtctcttcataacattctaagtcgaggtatgtttattcattgaccaactccctggagtcttyatttctagtacagctgctaaattcagtcattcattagtcatgttttaaggacaatggataggagacattatttaaaaagcaataatacaaaataccaaga

SEQ ID NO: 47479 - DNA, 201 bp, Homo sapiens
ctttcaagctggtaagacttcaaaggtcctcagtctctccctgtcccaatcccaggcttccgaaagaaatgatcttgccaggctcagctttggataggacrctctgggtcacaaagggcagcccgggactgacatagtgctaggcccaagcatggcgcttttggggaaaacggctgcaaaataggatgaggggatgtggac

SEQ ID NO: 47480 - DNA, 201 bp, Homo sapiens
aagaatgcagaaatacggggtatagctgaggccaggtgctgtctgatcatatacctgggaagctgttgttgatcacgtacctgggaagctgtctgatcacmtacctgggaacctggttgttatatccatggctggggagcagggtagcagggagcaagaactgtccaacataatctagtttacctatggactttcaaaggt

SEQ ID NO: 47481 - DNA, 201 bp, Homo sapiens
cggatagaaacggtgtctgggaagagagagagtacctggtggagccctatgagtaaatgtgatgatgattcagctctggaccctatactctactccaaaargaaatgtttcagggcatcagagggcatgaattcatgaatgtgtatacgaggctttgttcaggatatttttaaatatagaagttcattgatacaacatccc

SEQ ID NO: 47482 - DNA, 201 bp, Homo sapiens
ggcagctgaggcacactcctcccaagacagctatagaaagtgcctcagaaatgtctgtctctaggacacggttcccattatccatgggtcaaagcttgccygaggaacgccagctcctttgcattcccaaactttgcaagcatgtgtcatcctgcaggttctcttgggtattccattgtaaggagtctgagaagctccaag

SEQ ID NO: 47483 - DNA, 201 bp, Homo sapiens
tgaggggatgtggacaaactcagcaaaagttgatgctgaagacagaggcagggatatggctataaagagccttgctttcctgaggggacttgaatttttcytgaaatcaatggggtggggggccctggaaagattttaatcagggcatgatccaattggaagagacagtagcggcttcacagagtgagaaacctcaaagct

SEQ ID NO: 47484 - DNA, 201 bp, Homo sapiens
ctcatctcactatactaacacaaatgttttcagttctacaatctacatttccccctccaatttttctcctcttttttgactgccttgatggtttcagtggstcctggttaagcctgtctttaagtttctaatcaaactaatccaagtgaatttggcttctgaccttgctctcacatatttgccatctctaaatgattgatg

SEQ ID NO: 47485 - DNA, 201 bp, Homo sapiens
agtgaagtttggcaagttagcaagagagtaagcatgtatagttcaacagcatccgagggcatgattaatttattgtccttttagatggcagaatgcacacraaacccttcaaattacaccattattatgacaaagctcagggggtgtgagaagttaaagatgttcctgccaagagtttgatgtacagaggaaacgggcaac

SEQ ID NO: 47486 - DNA, 201 bp, Homo sapiens
tcatcatcaccatcattttaaactgttgagcatatttatgtacctaagcatttcctatgtctcaggtcattcactcaccatgagcctttccattattttcyattgtgcagaagacaggagtgaggctcagagaggccacacagctttctataagtccacgttgtccgtgagccctgaactgggatgcagatgcgtttttat

SEQ ID NO: 47487 - DNA, 201 bp, Homo sapiens
gaggaaatcagagctcattctaacttaagggtttagaagtatcagaggcaggactctgacccgggtctccagactcacaaaacacaatacactataaggtstacaatagcactgacagatattttttaaaggttcctctcatctcactatactaacacaaatgttttcagttctacaatctacatttccccctccaatttt

SEQ ID NO: 47488 - DNA, 201 bp, Homo sapiens
ccaagatcagcatgccagccattctcacatgcacccgacagttttgtccttttaggaaaatgtcgagatacattcattcactagatgacaaatgtttgagkaatcactgtgtgccagaaactgggtttggctctgtgggataccagcgaatacaatcagacgtggccactgctcctaggaccacagagtctaatcagagag

SEQ ID NO: 47489 - DNA, 201 bp, Homo sapiens
gatagaattcagaactttagagataatctaacattctcagagactagaattctgcagtgttctggaacaataccccaaggtcaaaaagctttaactaaatrtttgtatgatcaataaattggtctgatttaaaattagcctataaagacattttttaaaagcaaatgcttaacttcaatactacatgacaagagggtgata

SEQ ID NO: 47490 - DNA, 201 bp, Homo sapiens
atttatttatggggaatatgtgattattgtattttccctactgagattcaaagctatacaaaggaaaggactcttctgccttttttttttttttttttggkttttaactcattatgaaatccccactgctgagcacaatgctgaacacctttgaagtaattaataaataacgactaaattactgctgtgtagataaggcag

SEQ ID NO: 47491 - DNA, 201 bp, Homo sapiens
tgggtgagctagaaaatttcaaaattatatactggaggaatttgacttggggggacccattattttctccaatcaagagaccaaggacactgaccagagtrtttttctttacagagcctcctagtgcctacaattcacaaaagggccttgaccttctctgtgcattcaaacacagtaggttaaacaaacaaacacattaag

SEQ ID NO: 47492 - DNA, 201 bp, Homo sapiens
atatatgatcttggtaaatcctcatgccagcctttcgtgggtattagatggcgaggggaaagtcatcaagccagagactgactactttgaaaattgaatayaagtctgtccagtgctacagctaacattctttaagtactaaaataaattgcttgtaaataaagtaaatgaaaaaagaacacaactgtgtaagtcacaaat

SEQ ID NO: 47493 - DNA, 201 bp, Homo sapiens
ggccctaatatgtagtaacagctgtttagtacctgagatataaacaaaacatttttcccatggctgtcactgttcctcctcctggaggtgcagtatcaccraggcttctctgtatttcctatcatgggtaatagtaacaatatcaataacacaatgatgattatcatgtattgtttaactatgtgtcatacactatgtcaa

SEQ ID NO: 47494 - DNA, 201 bp, Homo sapiens
gacagggaagaaaggagggagaaaagattgattaagcccccagtctgtgcctggcaacattctaggtgctttgtatctgaaaatctattttattttcacartgatctcatccatgtccatggattcaactttatctacctgaccaccaataattcatatatttggtctttcggtttagtcatcttggtgctccagagctgt

SEQ ID NO: 47495 - DNA, 201 bp, Homo sapiens
agtaggttaaacaaacaaacacattaagggaggactggataaaatcacctgtactcagactaaaatacttcggaatgtgacagatctggaaagcaacatawaagcaaggacatagaggatctgaatagtttaatcagttaatactagaaaagatagataaatatggaactatgtggcctacaaagagaaaatactattttt

SEQ ID NO: 47496 - DNA, 201 bp, Homo sapiens
ttcattttcttatttccaaaattatactacctaatatagaaggtgatgatgaattttgagagataatgtacctgaatttcttattgttcatggtatatgcrgaataaattgtgcctgctgattgctgtagtggtatcatcaactacaacattgttccacagctgagtggcatcactgttttgtagttccttaaaagagacc

SEQ ID NO: 47497 - DNA, 201 bp, Homo sapiens
atgcagtttttattcctgacctgcctcaaggagcagatacggactggaaagcagcccctgttggataattgctgcttgtctcagagtttgagattctgcckgggtttcttgagtcaccgagcatatggggcttcaggttggactgcccactccagtgcctgagaatttactgggaagttttaataaagtagagcagaaatt

SEQ ID NO: 47498 - DNA, 201 bp, Homo sapiens
atactagaaaagatagataaatatggaactatgtggcctacaaagagaaaatactattttttttaattgtggtaaaatgtacatggcagtggcattaagtmcatccacattattgtgcaaccatcatccccatccatctccagaacgttttcatcttcctcaccttaaactctatacccattaaatgctaactccccattc

SEQ ID NO: 47499 - DNA, 201 bp, Homo sapiens
ccccattggcagagatgtagtctgttttcccagtacagagaatttcttgcagcctgtacattttccctttaaaagataaagagaaaccattatgcagtttwtattcctgacctgcctcaaggagcagatacggactggaaagcagcccctgttggataattgctgcttgtctcagagtttgagattctgccggggtttctt

SEQ ID NO: 47500 - DNA, 201 bp, Homo sapiens
agtttatgaagcattttataatcatataaaaacaggcaaataaagttgtacttcttcactcagagtgttaatcaagtgtcttctatgttccaagccctggraatgtgaaagagaataagaaagcaacagcctgagggacagttaccaccacccaccaagaggcaaggtgctcccctagctttaacagaccttgcaggcgag

SEQ ID NO: 47501 - DNA, 201 bp, Homo sapiens
gagctgtcttggagccaaagtaagttcttcacggaactaaatggagttgcttgttcaatgagattctaatttcagtgagaggacttctcggctacatatgyattgctttgggaagtcctcccttccgaggcaagggcttctccacacctaggatttgatgtagaattactagggcagtatgtaaggacagagaaagaacag

SEQ ID NO: 47502 - DNA, 201 bp, Homo sapiens
caaatggatctctataaggcagcttatgtgctaaatatttctcctggccccattggcagagatgtagtctgttttcccagtacagagaatttcttgcagcytgtacattttccctttaaaagataaagagaaaccattatgcagtttttattcctgacctgcctcaaggagcagatacggactggaaagcagcccctgttg

SEQ ID NO: 47503 - DNA, 201 bp, Homo sapiens
gcagcagaagggaaagtcaccctgggataatttctgggtctagaattcagctttctgtgccgagtggcaggcagagaaacgggagggtggtgatgtttgtyccaagaggcccattcccccaccccctccttgtttcttctagaaggtctgggtgctgtgttcccaactttttctgagcagagaagggtcaagaaaagataa

SEQ ID NO: 47504 - DNA, 201 bp, Homo sapiens
cttactcctttgaaaaatgtgtgcagtgattcttttcctccctgagctgtcttggagccaaagtaagttcttcacggaactaaatggagttgcttgttcartgagattctaatttcagtgagaggacttctcggctacatatgtattgctttgggaagtcctcccttccgaggcaagggcttctccacacctaggatttga

SEQ ID NO: 47505 - DNA, 201 bp, Homo sapiens
cattcccccaccccctccttgtttcttctagaaggtctgggtgctgtgttcccaactttttctgagcagagaagggtcaagaaaagataactaacagcccrgaaggcttttcctggcaggtcttcaccagcggggcctgtgtctggcagatagatgggtcagagaagcccattcttgggaagcatgattgcttcatagctc

SEQ ID NO: 47506 - DNA, 201 bp, Homo sapiens
gagaagaatgcagcctgacaggaaggatctgggtaggtgacatgtggggagaggattaaaagaaaggagggccagtggctcacgcctgtaatcccagcgcyttgggaggccaaggtgggcagatcacctgaggtcaggagttcgagacgagtctggccaacgtggtgaaacctcatctctattaaaaatacaaaaattagc

SEQ ID NO: 47507 - DNA, 201 bp, Homo sapiens
aatgacataatagaagattagagaaataaagccacttatccaaggtcacacagggtccaaactcagattattgtgaaatgaactggctagatagaaggatrgatgatggatggaaggatgaatgcatagatggaggatggatggatggatgatggatggatacattgataactatatgaaggggaaggaatctggtgaatt

SEQ ID NO: 47508 - DNA, 201 bp, Homo sapiens
gtgctccatcttgcctgtaaccttagcgccttccctgggatgatgggagctccatttgaccttggtgatgaacacagacagccctagctggcgtgagcacygctgattgataaggtgggtgtggagcttctgtccttctcagtggattgcgagaactttggctccatgtttcttcaccagggtatggggactcttggccat

SEQ ID NO: 47509 - DNA, 201 bp, Homo sapiens
cagcggggcctgtgtctggcagatagatgggtcagagaagcccattcttgggaagcatgattgcttcatagctcttgtagaattcccatgttcgttgctcrtcagaatgcattgtatgttaatagaatcttcaaaaaggacctgctcatctcaggtgtgcttaggagaacaagaggaaggagttttaatccatatttgggc

SEQ ID NO: 47510 - DNA, 201 bp, Homo sapiens
gggagtatggaaaagaaagagccaattttagatggttgatcatgaatgagatgatggggaagaaagagaaaagtgccagaaatgattccaacattttaaascattttgaatggaagaaaataagcaatggaactaatataaatatagttagagagtgagcgcgcaccggctttctttacatttgttgcttgtttaaaccta

SEQ ID NO: 47511 - DNA, 201 bp, Homo sapiens
acctggagccagcgatgagacgaggggttttattggatgcttccatacaggggaatccagtggtggcaggctgaacaggagaaccacaaccacctgtaaarggcatgcagtttatatagcattttcagttagcaccctttccctaacatccttcacctggcaactttcattccacctatgagtcagggcctggatctgccg

SEQ ID NO: 47512 - DNA, 201 bp, Homo sapiens
gtatgtgtcaacaggtgcctgttcgtttgtaatttggtgacagctagatctgtatcagctttcttttatctgtgtgtcctgaatgattattgtgttcatgrcctttcaattgttttgttataatcaaattaacgtttgaaggttctgatgataaagtgacataaatatagatgaatacttgagggtaaactctagattcca

SEQ ID NO: 47513 - DNA, 201 bp, Homo sapiens
acccaaggtgagaagtccagcttgaaagcttgtatgagttactgggagtatggaaaagaaagagccaattttagatggttgatcatgaatgagatgatggrgaagaaagagaaaagtgccagaaatgattccaacattttaaagcattttgaatggaagaaaataagcaatggaactaatataaatatagttagagagtga

SEQ ID NO: 47514 - DNA, 201 bp, Homo sapiens
ttgcaaggcagttttctctagccatttaaaatgcttctgaagaagttgtgttatatgggagagattcaagatattgaatgaaaacaacatacagacacatrtggtatcctcattaccaatggagtatttgcacatatcatgaggtgtatatgtttaacaaaaatgataaagaaaaatcagtgggttaatggttgtatttgg

SEQ ID NO: 47515 - DNA, 201 bp, Homo sapiens
gttttcttcccactgagctcattatttctgtgcctcatcaaacccgggactacatggctttagggtgtttctgtgggagctgaagtggatggaattgaacmctgacagggcaacagtggggggtctttatctcatcagtagagccctccaggcctgcatcagactttgggtaccagagaccaagaagggagaccctggggg

SEQ ID NO: 47516 - DNA, 201 bp, Homo sapiens
agggcgttggaggcataaagtgctggacagacatagagcagtagcatgatggtaggtagtaaagtccccaccctccagcagaacccttactgggcaatgcrctcaagggtctcaggccctgggaggatgcgggtgctttccagatgtccatctcggaagccttgccaaagccttttctgagcatttgctgggggagtcacc

SEQ ID NO: 47517 - DNA, 201 bp, Homo sapiens
ttttgttgtctgtgctttttgtgtcatatataagaaatcattgtaaaatccaatgtcctgaagctttcccattatgttttccactagcagttgtatagttktaggtctcacatttaggtctttaatccattttgagctgatttttgtatatggcatgaggtaagggtctaacttcagttttgcttgtggatattcagtttt

SEQ ID NO: 47518 - DNA, 201 bp, Homo sapiens
gtctccaagaaagttctggcacaaaaaactaaggaaagatacaataaatttcataatttcttaacagagtgatcaagagctgtgggatctgatatggtttrgctgtctccccaatctcatcttgaattgtagctctgagaattcacacgtgtcatgggagggacccagtgggaggtaattgagtcatgggggtgagtcttt

SEQ ID NO: 47519 - DNA, 201 bp, Homo sapiens
atgtctttccctccctcctccacacttaacagggacagtgaatggaagccagtgttaaatttgcacgatgtgcagtggtctaaactttcactgaatcctartcaacttaatatcctgttgcctttttgaaatccagtgatgaaatgtaaccctgagacagcttaaacagaactcaagcctggatgctctctgcaaaatggt

SEQ ID NO: 47520 - DNA, 201 bp, Homo sapiens
gggcctcctggaatgctctaagttgtgtcacagcccagctgagtacctgggacagaacagggaaaagcaaggagtgacgatgtcagagaggggctgtgagmccctggctttggagccagacctgtaccttcctggacttcagcaagttccagaatttctgtgcatgtgagtttacccctgtgtaaagtgaagatgacaaca

SEQ ID NO: 47521 - DNA, 201 bp, Homo sapiens
acgtgagtgaggaaggcgaagcagtgcacccatgatgtttggtgcagtcttgaaagcgcagtcactatggagccgccccccgcctctccccttctgagccsccacagctcacgcttgctttctatgtcctgagcttttctgtacctctgtcttgctatgtcaggcattcatggctgtgctgttagggagccttttcaatct

SEQ ID NO: 47522 - DNA, 201 bp, Homo sapiens
aagttggacagagcccaggcagagctgagatgtgacgtgagtgaggaaggcgaagcagtgcacccatgatgtttggtgcagtcttgaaagcgcagtcactrtggagccgccccccgcctctccccttctgagccgccacagctcacgcttgctttctatgtcctgagcttttctgtacctctgtcttgctatgtcaggcat

SEQ ID NO: 47523 - DNA, 201 bp, Homo sapiens
ttggcaagggcggagaggctctcagttcagagaggagttgtctgatgtcacgttgcccctatctgaagttggacagagcccaggcagagctgagatgtgaygtgagtgaggaaggcgaagcagtgcacccatgatgtttggtgcagtcttgaaagcgcagtcactatggagccgccccccgcctctccccttctgagccgc

SEQ ID NO: 47524 - DNA, 201 bp, Homo sapiens
tctagagggggaatactttgacttgggtctttagaagttatctgatgccagcttattcacatcgcctcacctcctagcagctggagcaggaatgcagcagyagggtattgaaatttaagaggttggccttgagtcactgacttagctgggtatcccataaagcagagagcttatacatttctatcgtattagggagacaat

SEQ ID NO: 47525 - DNA, 201 bp, Homo sapiens
atccctctctgcctataacgatctcacgtctgtttttttgccaaaaaatatagctgctggggaacctgttcagggaagttgggatgtgtttatccttaggygtttattcatctttccaagctcctgcaatcaaccagaaacacaggggaatggaaggcttagtgtttgttgtaccaattatgccacaggcagtatcttgtg

SEQ ID NO: 47526 - DNA, 201 bp, Homo sapiens
tcagggaatatctgtgtataaatcgtgtaaaatcctcccagaacctttatgagagggtgtggactgtgattcttaagttaatggcatccctctctgcctayaacgatctcacgtctgtttttttgccaaaaaatatagctgctggggaacctgttcagggaagttgggatgtgtttatccttaggtgtttattcatctttc

SEQ ID NO: 47527 - DNA, 201 bp, Homo sapiens
ctcatataagagtattgtaccacatatttctggaccaggaaaagatcaaaattcaaaatctgaaaaatggtttcaatggagtaagtatttcttttgtaccmttgtaaagttgaaaaactgttgtctagtcattctaagtcagggaatatctgtgtataaatcgtgtaaaatcctcccagaacctttatgagagggtgtgga

SEQ ID NO: 47528 - DNA, 201 bp, Homo sapiens
ccagacagggacaatgtgacagtagccagctcctctctgaactgacaccctgtaaattggacctactgaacagcaatagtttagcctaacctactttataygtgcttagagcacttgcgttagcctacaggagggcaaaatcattgaatacaaagcccattttataatgaagtgttgactgtctcatataagagtattgta

SEQ ID NO: 47529 - DNA, 201 bp, Homo sapiens
ttgctaactagtaattgctaaacagctaataaaacagagcttcggttgcagcttggagcttcccatacttttaaaaactgaggccatataatattacggtmgttaaaagcatggattctgcacacagccagattggctgcattcaaatcatggctatcatgtactaggtgtggaaacttgacaaattgtctgcctcaactt

SEQ ID NO: 47530 - DNA, 201 bp, Homo sapiens
agggtaagggacacgcttcaaggtgttcggaggatacagtagcaacaagacacactgggttccttgctttcatgtatcttttattctagttctttgtttcrgaataaactggcttgaattcctctcttctgtgtgtaggtgacatggcaggaagttgtgcctggtttgtaacatggcttgttgataacaccagcacagggt

SEQ ID NO: 47531 - DNA, 201 bp, Homo sapiens
gtgtgtaggtgacatggcaggaagttgtgcctggtttgtaacatggcttgttgataacaccagcacagggtcatataccctcattggaaagggtactggtrtttagtgggaatgcagtttcttacacaagtacttgggttacttacgactggcagactggggcccagcccttggcagcgcactcttcaatgggctcatgag

SEQ ID NO: 47532 - DNA, 201 bp, Homo sapiens
gctggtaagcttcctcagctgccagctgcaaagacgtggatattaggatgaaaggcgttaggcagtgatgctatttctggtgctgttactttagtcaaatmtgtgttcaccaggtacccatgtgctggcacctgtgattagtgaattgctcatgggagtatgtttgcaatgtgctttctctgtgttttccaggcagtttta

SEQ ID NO: 47533 - DNA, 201 bp, Homo sapiens
gcccttggcagcgcactcttcaatgggctcatgagggcctactttctgatgccgtttccctccgtgcttcatgcacttcagttcggtcattgtcctgtttwcatcatacccgcactgaagcttcttacagttgctgaagcttcttccttgaagaagcaagtttgaggaagagccccgatcattctgcggttctttattttt

SEQ ID NO: 47534 - DNA, 201 bp, Homo sapiens
agagaaaaacttcttactcctttgaaaaatgtgtgcagtgattcttttcctccctgagctgtcttggagccaaagtaagttcttcacggaactaaatggarttgcttgttcaatgagattctaatttcagtgagaggacttctcggctacatatgtattgctttgggaagtcctcccttccgaggcaagggcttctccaca

SEQ ID NO: 47535 - DNA, 201 bp, Homo sapiens
tgaatttgtggtcaagaatgttgtcataaaattgaaatacaactggcattcagaggtatccttgctcatatattttcttttgttaatgtggctctaccccwattctaacccatctgtagctccatgacaatttggcagaatacacattaaagtgaaagctgctgccgtcatgcggaaataggtgtatcataatgtcagtgc

SEQ ID NO: 47536 - DNA, 201 bp, Homo sapiens
aggggaggggtccctggccacaaagctccaaccagccaactgatcaggctttctgcgatgatggaagtggctgcatcatcattaactcagctagattaacytgttcagcagaagcttgcagagctgcgtgagcctgccttccactcagcttgaattaaagagattgggctgcaaggacacagagaggtgagccccaggagg

SEQ ID NO: 47537 - DNA, 201 bp, Homo sapiens
gaagatggattgaatcaggaaacacccaaggtgagaagtccagcttgaaagcttgtatgagttactgggagtatggaaaagaaagagccaattttagatgsttgatcatgaatgagatgatggggaagaaagagaaaagtgccagaaatgattccaacattttaaagcattttgaatggaagaaaataagcaatggaacta

SEQ ID NO: 47538 - DNA, 201 bp, Homo sapiens
agatgtaaattgttaggtgctttcccaggcctgctggatcagaaactctcggggtgggtctctccatctgggttttagccagcccaccaggtcatcctgasgctcactgtagttggaggaacacaggtctaaataatcacactcttgggtattaacatcatggcagctgacctgatcactaattggccttgatgaagatga

SEQ ID NO: 47539 - DNA, 201 bp, Homo sapiens
tactcccgctgctggtgaagctgcaggaatcctgacaggagcaggctgcctttcagctccaagttcctggcactaagttctgcgcaggggcctgggcgagktctttatgactttccagaggcttccaggtctctattgaaatgcaacagctgttactaggggcaactctacttcccaaacaagaacatagactttgtggag

SEQ ID NO: 47540 - DNA, 201 bp, Homo sapiens
aaaataggtggtaagacccagtgaaagttttaaagaagggaataacataatggaaaatgtatttcagaaaaattaatctgggggcagtgtggaagatggaytgaatcaggaaacacccaaggtgagaagtccagcttgaaagcttgtatgagttactgggagtatggaaaagaaagagccaattttagatggttgatcatg

SEQ ID NO: 47541 - DNA, 201 bp, Homo sapiens
gctatcagcataaagatatttatttttatttggtaaaaatgagaagggagaggaagaagaagtgcattagtggtgtggactggaagacagaggagcgaaasaggggatacggacaggttgtcctcctacgctgggaccctgaagtgtgttgaagacccttgggttcgagaacagaaaatgattgaagtcatgttttacgaa

SEQ ID NO: 47542 - DNA, 201 bp, Homo sapiens
tacaagaaacttgaaaaagtacaagaagaaaaaaccttctaaaaaataggtggtaagacccagtgaaagttttaaagaagggaataacataatggaaaatrtatttcagaaaaattaatctgggggcagtgtggaagatggattgaatcaggaaacacccaaggtgagaagtccagcttgaaagcttgtatgagttactgg

SEQ ID NO: 47543 - DNA, 201 bp, Homo sapiens
ggtttggatagtcaagaagtctgtcttcatctctggggcaccagagatgaaggaagggacactatcactgttcttgtaaagtccacacgctagctggggcratgatttgcaacaatcgactatattatcttgtgaggagggtcatgttacaggttcagccttcggaaggacatgaggtcaaagcaaattctcaagaatgag

SEQ ID NO: 47544 - DNA, 201 bp, Homo sapiens
gggcaatgatttgcaacaatcgactatattatcttgtgaggagggtcatgttacaggttcagccttcggaaggacatgaggtcaaagcaaattctcaagartgaggaatgacaggagacagagacgcggacggggcaggaagggttttgtgagaacagctgatggaagaaagcatttaatggcacctccagcggagtgcgt

SEQ ID NO: 47545 - DNA, 201 bp, Homo sapiens
tgaaatagaaattaattcaaaaatgcattcatttattgaggccccactaccaggcactggggaaaagagatcaaagagaaaactttgctttccctggagckctgccttcaagtttccctctacacatagcaaaccagaaaacctttattttttaattcacaagtagagggttggggagcattttatgcactgactcgttct

SEQ ID NO: 47546 - DNA, 201 bp, Homo sapiens
aattttaagtaaggcatctttaaaccgaggcgcacgtaaaacaaggttatatattgactagttgactgaactgtgaccagaggctcacaggaacctaaccstgcatttctactaggagcaatggttcaatatatgttaagtattcatggtgacttcatagaacataagtaccataaataagagaatcaattgtatgcagac

SEQ ID NO: 47547 - DNA, 201 bp, Homo sapiens
tggccccaagtggactgcagagtgctctctagtgtctctaagtgcaagaaggctgtgatgtgtctgactgagaaaatgcatgtgttagataagctttgttycagcatgagttacagtgctgctggctgtgataaattttaagtaaggcatctttaaaccgaggcgcacgtaaaacaaggttatatattgactagttgactg

SEQ ID NO: 47548 - DNA, 201 bp, Homo sapiens
aatttgcctactcagtaaaatgtatctgtagctcccaaatcagtggtcatggtagtgttgtggtcacttgcagacatatacagagctgtgacaaatttgartcatatgatgtatatgcttccaggtgcattcaaactaggtgagactgccttcttgttttagctttcatactacaaacaaatatccttttcatgaaccatt

SEQ ID NO: 47549 - DNA, 201 bp, Homo sapiens
catggctgtgtctctcctcctcagatggatggagtaggagggttgttggaagacaaaagcatcctgcttcactcttgtctctccaggctcctgacagtgayttgcactagctgattagtaaattcatggcagtgcctggtgcctgagagagcgagggttgggtgcagcttggctacagctctgaacacagcagtgggggct

SEQ ID NO: 47550 - DNA, 201 bp, Homo sapiens
cggaaatattacttactcgtccctacctcatagggtggtttttcgaagtcagtgagacaaggacagtgaagggttgaggcagtgctcagcacatagtaagygctaaataaatgttagcttttgttgaaattaatcttacttttcactaaattgtgctgcaaagcaacgtgccattgcctgttcttcacatggctgtgtctc

SEQ ID NO: 47551 - DNA, 201 bp, Homo sapiens
aggtgtgagccatgtgggctctcaggactcttctggctccacttctgcctttgtagctgtggaccacgaggcagtgactttgaaattcagtcttattctgyggaaatattacttactcgtccctacctcatagggtggtttttcgaagtcagtgagacaaggacagtgaagggttgaggcagtgctcagcacatagtaagc

SEQ ID NO: 47552 - DNA, 201 bp, Homo sapiens
gagatagtctgagtcttctgagaactaggattaggattttttttttttttttttgaaacaaggtcttcctctgtctcccaggctggagtgcagtggcgctrtcacagcttattgcagtcttggcctcctggactcaagtaatcctcccacctctcatcctcctgagaagctgggactacaggggttccccactatgcctgg

SEQ ID NO: 47553 - DNA, 201 bp, Homo sapiens
ttttcctgttgatctggttgtctgattcgtgtccatttggtttctaggtccagccaaagagcccacataagaaccaaggtggggttgggggtgatctctgrtcccctttgtgatcctcttctaggagatttacctctctgctagcttacatactatgtgaatatagcgtgggctttcttcttgctcttcagaaagtcttct

SEQ ID NO: 47554 - DNA, 201 bp, Homo sapiens
ctaaaaagttcaaaagcatcttgctttggccgcttcttcagacatcactctcttgtgaagatcccttgtacctggaaaactattaagatccgtatgctttyttcctgttgatctggttgtctgattcgtgtccatttggtttctaggtccagccaaagagcccacataagaaccaaggtggggttgggggtgatctctggt

SEQ ID NO: 47555 - DNA, 201 bp, Homo sapiens
ctagccagatcccatttgtcctgtctttgtcagatttatcattctttgtctaaaaagttcaaaagcatcttgctttggccgcttcttcagacatcactctyttgtgaagatcccttgtacctggaaaactattaagatccgtatgcttttttcctgttgatctggttgtctgattcgtgtccatttggtttctaggtccag

SEQ ID NO: 47556 - DNA, 201 bp, Homo sapiens
acgcctcggcctcccaaaatgctgggattacaggcatgagccaccatgcccagccaccgccactcattttacacagtcccctgtatgtctcctagtgactsccctagaaattcactgaccctagccagatcccatttgtcctgtctttgtcagatttatcattctttgtctaaaaagttcaaaagcatcttgctttggccg

SEQ ID NO: 47557 - DNA, 201 bp, Homo sapiens
attttttaattcacaagtagagggttggggagcattttatgcactgactcgttctccccatttagtctggcataatttccatgccaagtaaatattctctyttaaaattttaaattttgagggttttttttttcttctacgggggtttatcagtgggctctctcaaaatttattaaacacagttggccagagctgttagct

SEQ ID NO: 47558 - DNA, 201 bp, Homo sapiens
aggaccatttcacaggcctgagctaccctaggagtctgttttgcccacaggctatgcgtgaagccgacccttaccctctcacccagtgacgaccacgacamtgttgatgatcataagcagtgcttgcaggcttggctagtccttcacagatgctacgtcaccagtccttgtgctgactcaacgagtaggtggctgtattag

SEQ ID NO: 47559 - DNA, 201 bp, Homo sapiens
gtcagaagtccgacatggttctcactgggctaaaaccaagctgtgggcagagctggcttcttctggaagggagcatcattctccgaccttttccaactttygggggccacctgcattcttcagctcatgactgcttcctccatcctcaaagccagcaatggaagcagctcctttcacactgacatctttcctattctccca

SEQ ID NO: 47560 - DNA, 201 bp, Homo sapiens
taaatgtcatatgtggtaaaagaggaagtaaccagccaggggtgaggaacacaacagcaggaaattaagtagctgatgaatattcagacttgaagttcctsctaaagtgcccatttgttgtttggtagaaatatggatatgtaggagggggcctctaccagggtgcagaacatatggtggtattattagggcaccaggcag

SEQ ID NO: 47561 - DNA, 201 bp, Homo sapiens
ctgttttgagctgagggcacctgctcctactggcttcctggagccttagacgcacccagtgctctggacctcccacaccttgttgaaccacccggcacttsctgactcctctcctgaacctcatgtgcttgtgacccacgattcagccactgtctaaccagctcttccgtgtgcagccctcagagccccagctcccacggc

SEQ ID NO: 47562 - DNA, 201 bp, Homo sapiens
ctcaaaaaagtacatacacacatatataaacaaacacttaggtttgcagggaagcaccctccaatgcacaggtcagcccctgccccagagaatgacgcagstccgagtgccaatagtgtcactgcggagaagccccggtgtaaaatgaaaataataaaatccaccatagagcgttgctatgagttttgaaagccctatcat

SEQ ID NO: 47563 - DNA, 201 bp, Homo sapiens
tcaaagaaggaggcacacatgtgaacctaaatgtcatatgtggtaaaagaggaagtaaccagccaggggtgaggaacacaacagcaggaaattaagtagcygatgaatattcagacttgaagttcctcctaaagtgcccatttgttgtttggtagaaatatggatatgtaggagggggcctctaccagggtgcagaacata

SEQ ID NO: 47564 - DNA, 201 bp, Homo sapiens
gtgacccacgattcagccactgtctaaccagctcttccgtgtgcagccctcagagccccagctcccacggctctaattccacggccgcccctgccgtctcytcagccatcccatcccgccatcaccatggaaacctgtgggaacagcagcttttcctcatcctcttctccccttaatctccagcccactcctcctccctct

SEQ ID NO: 47565 - DNA, 201 bp, Homo sapiens
agctccgagtgccaatagtgtcactgcggagaagccccggtgtaaaatgaaaataataaaatccaccatagagcgttgctatgagttttgaaagccctatyatgtgagccttcatctaaccgaatcatgttttcactgactggattttcagctggaatcgtggcatgtcagggctctgcctagccgggccccactcctacc

SEQ ID NO: 47566 - DNA, 201 bp, Homo sapiens
gtaggattcctacaaagcaaaacaagcctctaaataaagaaaaagaagggtggaatctgaaaggaatttatcaaaatcctaactgcaattttgttcatgcrttgggattcagagttgttttttcccctctggtttacaagtctccattgatacacttgcgttacatctataatgaaaaatacaagaaacttgaaaaagtac

SEQ ID NO: 47567 - DNA, 201 bp, Homo sapiens
caagttagatgagtggcaggggtgggaaggagggcctacttataggtctgggtttccctttgaagtcatggaaatgttttggaactagacagaggtggtgkttctacaacatcatgagtacactaaacatgactttaaaaatgtttcatatgtgagtttcacctcattttaaaaatcacagtgcacaaaaagaggtaaggg

SEQ ID NO: 47568 - DNA, 201 bp, Homo sapiens
ttgtatatgttttatgcattgtatgtgaaatagtaataatagccaacgcttaggaagtagttgccacatgcctgactctcctaaatgctctgcaaataggytagatttccagcaaatgaaaacaggttaggcagctcaatagaatattacataaccattaaagaggatggttataaagatgatgataatggcatggaaaaa

SEQ ID NO: 47569 - DNA, 201 bp, Homo sapiens
tgttactggcatctcagttacattctccatgggcgcttaagaagctaacactcactgttggtcaggggactgatgctctacttcctactctaaatatagcscctgtcttgtcacacttgctgtttaacagccttaccatgccattcttgagagaaataaagtgaggtttcattaatgtgagagatcaatagtagttcagtt

SEQ ID NO: 47570 - DNA, 201 bp, Homo sapiens
caaaatacattatattaaatgatatatgaatattgtatatgttttatgcattgtatgtgaaatagtaataatagccaacgcttaggaagtagttgccacaygcctgactctcctaaatgctctgcaaataggttagatttccagcaaatgaaaacaggttaggcagctcaatagaatattacataaccattaaagaggatg

SEQ ID NO: 47571 - DNA, 201 bp, Homo sapiens
cagtgaaagtgaaattttactggaatgggcaacctattgaacacacactttatccagatggcttagatttggatcttttaaaagagtaacatcaccatttkaagtgttttcttcttcattaactatgaagccctttcccatatgggtttatcagcattgtaggaagggctttcatggaaccatataaattcatctctctag

SEQ ID NO: 47572 - DNA, 201 bp, Homo sapiens
taggaagggctttcatggaaccatataaattcatctctctagaaacgaagaattctaacgtccatcctcacttctgccaccaaaattagaaacatacatakgtgtcgagctttctgcttggtgaaggtgcagtgacccctctttttttcagcatccatttatttctgcttgctgagctttctgtctgcattttcatctaca

SEQ ID NO: 47573 - DNA, 201 bp, Homo sapiens
ggaaattttatgcaaaaacttgaacaagacatagtatttttctgttagcaaattataattttccccctgattcagggggggtctgtgattgttttcttccytggctgctccttccatttgcatttgcaaagatcacattcctaatctttacctcatcagaagcctcattttgattttctgctttgctgacttctgtactcc

SEQ ID NO: 47574 - DNA, 201 bp, Homo sapiens
ccttttctttcccagatctaggtctgatacctgcccctcctccttaccctggactgtaattaaagggaatatgtggaaatccaggccacaactattttacyttctgtgaataaggccatcaagttgatggcttgttactgtgggtcgatgggtcaaacatgaggcaatttggggaaacagcctaaggtggctataccacag

SEQ ID NO: 47575 - DNA, 201 bp, Homo sapiens
aggtctgaagtgagagagggaaacgttcgatgctgcgttgttctgggagatgtgagccgccggctcattcagaatgtgcagggatgtccattcccacaggrgcatgtgtcgttcagccaggtgcatgttttaccttgatctactgtgcttggagccttttctttcccagatctaggtctgatacctgcccctcctccttac

SEQ ID NO: 47576 - DNA, 201 bp, Homo sapiens
tcagtagaaatggaactcagattttaaaatggactttaaaatggtctaaaaagtgtttctaggtacaaaatgaattggagtttacctattttttccaaagsgcaggtagcaggtctgaagtgagagagggaaacgttcgatgctgcgttgttctgggagatgtgagccgccggctcattcagaatgtgcagggatgtccat

SEQ ID NO: 47577 - DNA, 201 bp, Homo sapiens
taaatttttttcttaaaaaactcagtagaaatggaactcagattttaaaatggactttaaaatggtctaaaaagtgtttctaggtacaaaatgaattggastttacctattttttccaaagggcaggtagcaggtctgaagtgagagagggaaacgttcgatgctgcgttgttctgggagatgtgagccgccggctcattc

SEQ ID NO: 47578 - DNA, 201 bp, Homo sapiens
gcctcctaggttcaagcgattctcttgcctcagcctctggagtagctgggattacaggcatgcagcaccacgcccggctaattttgtatttttagtatagwtgggtttctccatgttgttcaggctggtcttgaactcccgacctcagataatccacacgcctcggcctcccaaaatgctgggattacaggcatgagccac

SEQ ID NO: 47579 - DNA, 201 bp, Homo sapiens
ttgagtcgataacagcttctgctatagaagggggcagatcactgggcttaaatgtcaaatagcgcctgagaggcttaaacaaccaccagtatgtgtccctytgggagggcttctctgccatttagaagatcaatgagaagatgtcctccaggccagtgtgaggtggtagaggtgtgtgcttgcgtgggcatgcctgtgtgt

SEQ ID NO: 47580 - DNA, 201 bp, Homo sapiens
tatcaggtcttgcccaggcataccctgcttttcctgaatgtcctgaatgttgttgtaggacaacaaatgcactttataattattcataggacctctcactrctaatctttgagtcgataacagcttctgctatagaagggggcagatcactgggcttaaatgtcaaatagcgcctgagaggcttaaacaaccaccagtatg

SEQ ID NO: 47581 - DNA, 201 bp, Homo sapiens
tctctttgcctctttagagactggttaatggtgctacctgagtgagattgaccagatggcttgttgggagaagaagggagctggtttggagtaaatccatscccaccactatcaggtcttgcccaggcataccctgcttttcctgaatgtcctgaatgttgttgtaggacaacaaatgcactttataattattcataggac

SEQ ID NO: 47582 - DNA, 201 bp, Homo sapiens
aaaactgatgaaaatgattgagaaacatgaacagagggttttctctttgcctctttagagactggttaatggtgctacctgagtgagattgaccagatggmttgttgggagaagaagggagctggtttggagtaaatccatccccaccactatcaggtcttgcccaggcataccctgcttttcctgaatgtcctgaatgtt

SEQ ID NO: 47583 - DNA, 201 bp, Homo sapiens
cagaaaagaatatatactcaaacatgtataatccatatgcatgaacataactcccctattgggaatttctcataaagaatccccccaaaatataataccaygtccacaagaacccacccacaggccaggtactgtgcgaggcactggaatacaatgggggtaacatggactaggagactcatgaaaacgtcatgacaaaca

SEQ ID NO: 47584 - DNA, 201 bp, Homo sapiens
aacgagttcacacctatgaaactagatgaattatttctcacagaagacacggagaaaatggtgattagaatctctgcaccagtttctgtgatttttttgasacatcctgaagatgagaggtgagtagacagcagatgggcagggccagcatggtttttgtctggttatttatttctgtggaataagttcctagaaatagga

SEQ ID NO: 47585 - DNA, 201 bp, Homo sapiens
tattcctctctcccttcattcaacactgggtttagaatgcttgccagcagcattgtggaaattacctcaaaggtagaaacacgtaactcataagcacacaygaataggtataggtcataatcctggaaagacggccttgccattgagaggggaatagcaggagcaaggctacggaagcacgggactctggttgagtctagg

SEQ ID NO: 47586 - DNA, 201 bp, Homo sapiens
tgggtataaattgcacctccgttgcttattagctgtatgaacttgggcaagatatttaatctctctgtgcctcagttttcacatctgtaaaattatgtcamatagtactgatctccaagggtggttgcgtgggttaaattatacctaaagaacttagcaccccactcagcacatggtggctgccatgatggtttgccgtga

SEQ ID NO: 47587 - DNA, 201 bp, Homo sapiens
atgcttcccattttacagaaagtaatgccagaagaaaacagtgcacagttactgctggttcccaatagttgatttgactcctttaaagatttagctgtccsatttatgtgctggataacatcaattgattcttaaatgttcaacaagccttgcatacctgtgataaatcccatcatggttacattttaatatacttacttt

SEQ ID NO: 47588 - DNA, 201 bp, Homo sapiens
tccaaactgaactcaacacttaactcgtgccctgaattttggcaaggaagttatcaccagctttcactctttgagtgcataacctttcactctgtttcttrtactcagggactgtagtgtgtgttgcagtctcttatctgactctcagaaataactttgagtagagcagtactactaaaacacaaattcaccaacttttct

SEQ ID NO: 47589 - DNA, 201 bp, Homo sapiens
aaatggactaatacagtatccaaaggcataaaaatagtcatgcactttggggaagtaatacacatctgagaagttaaacagaggtaaatacaggaaaataygtacaaaatacattatattaaatgatatatgaatattgtatatgttttatgcattgtatgtgaaatagtaataatagccaacgcttaggaagtagttgcc

SEQ ID NO: 47590 - DNA, 201 bp, Homo sapiens
cacacagagcctgtttctcatatttattgaccagactaaggagagaacatcgtaccctctaacccagtggttggcgcgcttgagccagctcataccagctytcgtgagaccgttgttaatgtctctttctcactctgtcttcactgtagcttgatatcagccatggcaggattgtcttcaccatggcaatgggcaacacca

SEQ ID NO: 47591 - DNA, 201 bp, Homo sapiens
cttcttctgctagaaggaaattccaggaatccttgatctcgcatcttttaaactgatttcacagagggtatccctgacagcatttaaaaaaaaaaagcaarcaagaaaaacctcaaatgggtagaatttttctaaaagtctgaaataaaagtttataactgattttcaggtttcctattattacctaggcacacctaaatg

SEQ ID NO: 47592 - DNA, 201 bp, Homo sapiens
taaattacccagtcttgggtatttcatcatagcagtttgaaaatggactaatacagtatccaaaggcataaaaatagtcatgcactttggggaagtaatayacatctgagaagttaaacagaggtaaatacaggaaaatatgtacaaaatacattatattaaatgatatatgaatattgtatatgttttatgcattgtatg

SEQ ID NO: 47593 - DNA, 201 bp, Homo sapiens
ttcacacctatgaaactagatgaattatttctcacagaagacacggagaaaatggtgattagaatctctgcaccagtttctgtgatttttttgagacatcmtgaagatgagaggtgagtagacagcagatgggcagggccagcatggtttttgtctggttatttatttctgtggaataagttcctagaaataggatgtctc

SEQ ID NO: 47594 - DNA, 201 bp, Homo sapiens
cactctgataaaacttcactgatttatctcatttaatcccaatagctacttcatgagaaaggtgccatcattctatctgttttacaggtaaggcaaatggrcactcagagaggtaagatctgacaccgtgtgtctgagagcaggtccatgccatcgaagtagatttgtagcagaaacctggctgggggtatttttccccat

SEQ ID NO: 47595 - DNA, 201 bp, Homo sapiens
atatagaaagaactctctaaactcaacagcagaaaaccccaatcaaccaaattaggaaattgacaaaagacataaacagacatttcagcaaaggggatatraggatagcaaataagctcatgaacaaatgttccaactcattagccatgagggaaatgcaaattaaaaccacaacagactaccggtacacacctattagaa

SEQ ID NO: 47596 - DNA, 201 bp, Homo sapiens
atagggagattgaatcggtaaccacaaattctcaacaaagtaaagcttaagaccagatgtttggcccaccaaacatttaaagaattgatgagaatccttcycaaactcttccgaacagctggagagggagtgacacttccaaactcattttataaagctagtattaccctgacaccaaagccagacaaacaccacaagaaa

SEQ ID NO: 47597 - DNA, 201 bp, Homo sapiens
agtcaggacttgaactggctctggctgggacccaggctcccaggtagccagctcccaggtgacaggagtccgctgggctccctctgattcttaaagccttyccaggtagcaacaggagatcacgcaaagccacgtaagtgtctgattcagtcctccctggtcagttttccagcatagcgttttgcaaaatgtgttctgaag

SEQ ID NO: 47598 - DNA, 201 bp, Homo sapiens
aggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagt

SEQ ID NO: 47599 - DNA, 201 bp, Homo sapiens
gaaagcaggacccagatgatacagagtctcagaggttatgagttgggatttattctaagtgcacataggaagcactgtagaattccaggcaggatacagaytttcccatctgtgcttaggagtctaagctgcactctttctttcttcaagtgatatgggagtgacttaaattctttgttgcaaaaccagtgacactgttat

SEQ ID NO: 47600 - DNA, 201 bp, Homo sapiens
tacacacacacacacacacacacacacacacaatcatgaccagctcaagaataaatatgtggggactaagcatccaaagctcgacaccaacaatttgcagstgaagacataatgaacttttgttagtggatggaccagctgggaagactgtaaagttggatgtcttgttgtgctttctatttattattcagatctccagtc

SEQ ID NO: 47601 - DNA, 201 bp, Homo sapiens
attgtatcctagttgggaagtcatttcatagatttgtaagatattgccattgggggaaaatgggtaaagggtatataggatctctgggcactatttcttayaactgtgtgtgaatcaacaatgatctcaaaatagaaagtgtaatgagagaaaaagctctatttaagtgttttattaggtaccagacatcatgttaagtat

SEQ ID NO: 47602 - DNA, 201 bp, Homo sapiens
cacacaatcatgaccagctcaagaataaatatgtggggactaagcatccaaagctcgacaccaacaatttgcagctgaagacataatgaacttttgttagyggatggaccagctgggaagactgtaaagttggatgtcttgttgtgctttctatttattattcagatctccagtccagtgtacagacagaaggtgcatctt

SEQ ID NO: 47603 - DNA, 201 bp, Homo sapiens
gctattgtctgaagagctcttgtctgttgacttgcagacctgtgacctctagataaagtttcaaaatgcagaaaatatttatcttcttgctatgaccttcyacgcacacgacgtgaagccatggatttgtttcctagggaactagtgagtgaggaagatctataattaaatctgtgagttatatgctacacatgggaattg

SEQ ID NO: 47604 - DNA, 201 bp, Homo sapiens
gcagctgaagacataatgaacttttgttagtggatggaccagctgggaagactgtaaagttggatgtcttgttgtgctttctatttattattcagatctcmagtccagtgtacagacagaaggtgcatcttgatggatagttcaaaagggtaaagacttagacaaaataatgagaaagggactatttggcgacatatttca

SEQ ID NO: 47605 - DNA, 201 bp, Homo sapiens
gcctggttgccctccaggtgtcattttgctaggggttgacagagcaggctactgcccttctgcaaatactcttaagatcatgtgagttaatacacaggacrtgcttagacaggggctggcactgttctcagtgttctgttagcaattattaccattattttcacttagatttgtcattatgtacacacagctgcctgtgga

SEQ ID NO: 47606 - DNA, 201 bp, Homo sapiens
ctgattgagctgctgagtaactcttctgcctcctgatttgcaaaataaggatactggcttttaattcctaaggtggttctgaagatgacatgagacaatgkcagtaaaatacctagcactaagcttggcacatagttggcatagaaaaggaggagttggcagcttgattatggtcaaatctaagaagatttgatgcagacc

SEQ ID NO: 47607 - DNA, 201 bp, Homo sapiens
tttgcaaaataaggatactggcttttaattcctaaggtggttctgaagatgacatgagacaatgtcagtaaaatacctagcactaagcttggcacatagtwggcatagaaaaggaggagttggcagcttgattatggtcaaatctaagaagatttgatgcagacccaacttcctagggccactgaggattaaataggtata

SEQ ID NO: 47608 - DNA, 201 bp, Homo sapiens
cagcctagagctggtccccagaccaggcccagtgcacgagtttgggtgctggaaggggaggctttatggaggcaaagctgaggggctgtacgtgtcttcayaggtctccagtctgtaaaagcaaccacgctttgggctggggcagaagtcaggacttgaactggctctggctgggacccaggctcccaggtagccagctcc

SEQ ID NO: 47609 - DNA, 201 bp, Homo sapiens
gggatccaaggcagtgtttggcaaaagttttttgatgttcaaaatgtgtccttcaaataaaatctaatttaaaaattcactgagtgaagcagacattaggygaattggttttgactagaagtaagggagaaagaaccttttcatcaccaccccaatcccaaaattccagagcaagaagtctctaaggcacccccgtttctc

SEQ ID NO: 47610 - DNA, 201 bp, Homo sapiens
tcaattcacctttccccaggtctccagctcacacactgcagtccaatttcaaattcttccgtctcaccatgaatctccagtcttgaagccctctccttgamcccctccttggagggtgatgtggtaaatcaagtcagctctctgtgaatgtctcatcattctccacctgccacagcaattttgccccctctgctctcctcc

SEQ ID NO: 47611 - DNA, 201 bp, Homo sapiens
tcatcacccacacattaagcctaatattcagtagttatttttcctgatcctctccctcctcccatcctccaccctcctggtgtgtgttgttcccctctatrtgtccacgtgttctcatcatttagctcccactatgagtgggaacatgtggtatttggttttctgttcctgtgttagtttgctaaggataatggcctccag

SEQ ID NO: 47612 - DNA, 201 bp, Homo sapiens
aggacgatgttgaaaaacaatggtaagagggcacatccttgccttgctactgatcttatcaggaaagctagtttcctaccatgaagtgtgatgttagttgyaggctttttgtagttgttctttattaagttgaagaagtttctgtctgttactagtttgttgagagttattatgagtattgattttgccaagtgctttttc

SEQ ID NO: 47613 - DNA, 201 bp, Homo sapiens
ctgcaaactaagttttgtttcttactttccaatcactatacctttgttttcttttcttatcttactgcattagctaggacttccaggacgatgttgaaaarcaatggtaagagggcacatccttgccttgctactgatcttatcaggaaagctagtttcctaccatgaagtgtgatgttagttgtaggctttttgtagttg

SEQ ID NO: 47614 - DNA, 201 bp, Homo sapiens
cttgggagaaaagacgaggcaggctgggaggaggggtgttatggcagcttacaaatgggcccgggtacatttgcctggcttcaagtcagaaggtgctggarctgggcttggattcatttccattgtgtggcacacatatctcatgcatgggccagggacgtgccttgtgacagttagcacccacggtgccatgtgggcttg

SEQ ID NO: 47615 - DNA, 201 bp, Homo sapiens
ggatttttttttttttcatattcagaagaggtgggtacagaaaggatgagggcagcttctcaggttatagtattaaccacgtgaagcagctaacaaaggtrtgtgcctggccttgtgctaaaggctttcctcgtatcagttctttcatccctcccaacactactgaggtagatggagtgactagatccattatacaggcaa

SEQ ID NO: 47616 - DNA, 201 bp, Homo sapiens
tagtcattgcaaaaacatctatttccggcctacactgcaccagccagtgggggaggtcctgagagatagagaaaggatgaattcttgcccttagagagtcrcctagagattctggggagacagcaggtccgagtctctctgcctgaaacctctggacagtgtctttggctgacacttacatggtggtcttggtttcttatt

SEQ ID NO: 47617 - DNA, 201 bp, Homo sapiens
acagggagaaatcaggtttcttccagcccagcttctggttggaatcactcaggcagagacacatgggcctgagagaggattccccttatgacataaagcckcaaaaattctcattagtcattgcaaaaacatctatttccggcctacactgcaccagccagtgggggaggtcctgagagatagagaaaggatgaattcttg

SEQ ID NO: 47618 - DNA, 201 bp, Homo sapiens
aacggacccataactcatagggagattgaatcggtaaccacaaattctcaacaaagtaaagcttaagaccagatgtttggcccaccaaacatttaaagaawtgatgagaatccttctcaaactcttccgaacagctggagagggagtgacacttccaaactcattttataaagctagtattaccctgacaccaaagccaga

SEQ ID NO: 47619 - DNA, 201 bp, Homo sapiens
cattcaaggccctgagagagaagagaaggggacagataccacagagatcatgagatatagcacaacagataagacttgctaattaactgtacggggttacrgggagggacagggagaaatcaggtttcttccagcccagcttctggttggaatcactcaggcagagacacatgggcctgagagaggattccccttatgaca

SEQ ID NO: 47620 - DNA, 201 bp, Homo sapiens
  misc_feature (1)...(201): n = A,T,C or G, or insertion/deletion polymorphism (see Tables 1-2)
aaataaataaatatggtagttttgcgtagtgatagtgctatagaaaaacgttcaaatggggtagagtgatagacagtgttgttctgagcttgtccaccacnccctcttgggacagaggattctttgttctgatggaatggcctttctatagcatagagatgaaatgtgctaccgtttgtgaaaggaagttagtaatacata

SEQ ID NO: 47621 - DNA, 201 bp, Homo sapiens
aactctgtgcatcggaatcacccgggatcccagcaggtctgggagggactgagattctgctcccaggtgatgctgatactgctgctccccaaagtgcgttrggccatacactgaacagcaaaggaagagaaaaatgcaaagttggaaccttgtgtttcctggcctccaccgacagccccatccagtaatgcctcctttctc

SEQ ID NO: 47622 - DNA, 201 bp, Homo sapiens
caacttgacttcagggagattcacctgagaccaaatggttccaataaatatctatgatctctatggaggatctactatgttccaagcaccacttgtgtgtkcaggatacagttgctcataaggcagactgagtctctgctctcctggggctcacagcttggcaggaaggatcaatagcaattaatgaataatttaagatgg

SEQ ID NO: 47623 - DNA, 201 bp, Homo sapiens
atataagagggtaacagcaggcacccctggagacctgggcatgaggtttagcttcatgcaatcccctgtaagtataatttccccagaccacatggggtaaygggcctccatgtctctgatttgcccatggggggaggacattaagtctgcacagctgtggtgtaatcagatgtgtagggagactctgagagccagaggaat

SEQ ID NO: 47624 - DNA, 201 bp, Homo sapiens
cctcacagatatacataaacattcacaatcaggtttccaaagctgtttccttacttccctttgttgctattttacttttcattggaggttgggcgaggcartctttaaatgaagctattttttctttgtctctctgtccctctgtgtctctctctgtgtctcacacacatacacatgcacacacacacacacacagacaca

SEQ ID NO: 47625 - DNA, 201 bp, Homo sapiens
acttataaacatttatttctcctattaaaactaaagatatggctgtcaaactatgcacacatttattatccctttatattctaggtttatgttattgtggytataagaatctgctgtaaataattatatgaaatacgactctgatagaattttctttgtcacctatcattttgtttttccaggtgttaataattatttctt

SEQ ID NO: 47626 - DNA, 201 bp, Homo sapiens
actcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaa

SEQ ID NO: 47627 - DNA, 201 bp, Homo sapiens
caagtcgtctgtttgtttgttcttattttcttggaatttgtttttcttggaattctctgtatttctgctctagtttcttcctctaagcctgcttctcagcsatcaccctgactggccatcaaactgggaactctgtttgcctttgtcctgtactgagtctcctctttcccaaatcctttctctttttccttcctggttaac

SEQ ID NO: 47628 - DNA, 201 bp, Homo sapiens
ttatctttctttgcaaagtcttttactagaattatttatttaggataattagagaaaaattctgtaatttcaagtaaatattaactacaaatcaattccartaaaaatgctgctgtccaatcatctgtgtcactgcacttgggagaaaacaatttatgttcaagcctctttagctggattaatctcttcaaacctaagtga

SEQ ID NO: 47629 - DNA, 201 bp, Homo sapiens
tattcgcacgttttcacgctgctgataaagacatgccctcgactgggtaataaggaaaaagaggtttgatggactcacagccctcacaatcatggtggaargtgaagaggagcaaaatcgtgtctcatgtggcagcagacaggagagaatgagaaccaaatgaaaggggtttccccttataaaaccatcagatttcatgag

SEQ ID NO: 47630 - DNA, 201 bp, Homo sapiens
tagacgtggattgtactctgagagctaatgatgagtttgctggaaataatttttccatttccatttctaattgttaatatagtacagtgagctcggtaagyacaatctgctcagataacccaatctgcagtgtgactggtgcctgtggctggtgcctacacaacaggcttttgtttcgtaacttcagcacttgttgtgggg

SEQ ID NO: 47631 - DNA, 201 bp, Homo sapiens
agctagaacctgagggaggaggtgccttcttttggaattaaaattccagaatgttctggaaagtgccagatgcaagaccaagtaggaccagctagtaatgraaattcctcccatattgacaaggttgatgaacacatggtgggtgcagctcatggaacactgggaggtcaaaagcggtctcagttacctttgtacaatgga

SEQ ID NO: 47632 - DNA, 201 bp, Homo sapiens
cccatgaatacaaaaggtgatgggtagctagaacctgagggaggaggtgccttcttttggaattaaaattccagaatgttctggaaagtgccagatgcaakaccaagtaggaccagctagtaatggaaattcctcccatattgacaaggttgatgaacacatggtgggtgcagctcatggaacactgggaggtcaaaagcg

SEQ ID NO: 47633 - DNA, 201 bp, Homo sapiens
ggacaaaacatgctgctgcttttttctcatcccctaaattttgccatttcagcacaaagggagctcaggtgcatcaggagccccagcctcctgcgactggmctgcatacatacaaatacccattctaggtggtttccaaaaggactccatttctatgggaatattttccattgagctgtttatgaactttcacttagtgat

SEQ ID NO: 47634 - DNA, 201 bp, Homo sapiens
tggagtctagttaatagtcaagtatcagtgttaatttatcagttatgaccaatgttccatttttacgtaagatgtcaacattaggggaaattggatgaagrgtacatgggaactctgtagtatctttgtaatagttctgtaaatctaaaattaccacccgaagtttataaatgaatacacacatatacacatacaaacctc

SEQ ID NO: 47635 - DNA, 201 bp, Homo sapiens
cacattcaaggccctgagagagaagagaaggggacagataccacagagatcatgagatatagcacaacagataagacttgctaattaactgtacggggttrcagggagggacagggagaaatcaggtttcttccagcccagcttctggttggaatcactcaggcagagacacatgggcctgagagaggattccccttatga

SEQ ID NO: 47636 - DNA, 201 bp, Homo sapiens
gttaagaaacacgatgtgcatgtcatgttgagaaacttggatttcaccctggaggcgcaggaactaggggggatttttcagcagcagtgacagacgctctyaaatctgggttttccaatgatcagcatgcttgtgcctgcaccggggcgcaggatgggagacagatgccttttgcagtagttccggagaagaagactgaag

SEQ ID NO: 47637 - DNA, 201 bp, Homo sapiens
cacatttaacaaagaccagaagaaaatcaaaactgttgctcaaactgacagtgtatgttcttcatcccactccttcattagctcattcattcattgattcrttcattcatgtgctggctctttgtagaagttgggggtaaacaggcgaccaaaaggtagtccgtgaccccaggatgttgtaattcagaagggtaaacagac

SEQ ID NO: 47638 - DNA, 201 bp, Homo sapiens
gcctgcattacctagaattgtttttttttttttttttctggttaaaaccaatgacctttaaagcctttttatttttcctctgacaatctctagtggacctmtggtcttttgtgagttctgatgggaatcccagaatctttctgtaactgtgggttccaatgagagaggcacatttaacaaagaccagaagaaaatcaaaac

SEQ ID NO: 47639 - DNA, 201 bp, Homo sapiens
atcttctatcctgattgattgcatcagaaaagccattcatctggtttgaagatagacaggtggttgctgtcactgcaccagcagcttttgaagtttgctcrgtgatatgattacagcccatacttaagcttctgctccaggaagtgagattgacctttgatcctactcctcatttaaaaattacagatcttggaaaatgaa

SEQ ID NO: 47640 - DNA, 201 bp, Homo sapiens
tcattatctgtgctccaataattattaatttaatgacattttaacaaataagaaataacttttattgagcactgtctacatatcaggcacccagctaagtrctttcacatgtgatgtctaattaaagcttctgaatatgattaacttcattttatagctgaggagtctacagcctatagggcacacacacatataccatct

SEQ ID NO: 47641 - DNA, 201 bp, Homo sapiens
gaatgggttttctctttctgtgttaatcttatctggcagctaatctttacctgtcatgtggtttttgggggagaaaacggtaccctctttagactgcttcyttttctgggaggagaaccctgagaaagactatcagtttgaagttgtccctcctgggatagaaatttatctaattttagtgggtggcaagactatgaacaa

SEQ ID NO: 47642 - DNA, 201 bp, Homo sapiens
ccaggattgattttgcatagtgtagaaatcaatccggtgaacctggcagcataggtatcctctaagtttggttgtaagcccagtggggcagggcagtaaayagtttaaattggaaagttaaaacaataaacaggagagacaggtgaagttggggtttgaaatttgctgggctagaatgggttttctctttctgtgttaatc

SEQ ID NO: 47643 - DNA, 201 bp, Homo sapiens
ctgagccactggagaagttgcacatccaggattgattttgcatagtgtagaaatcaatccggtgaacctggcagcataggtatcctctaagtttggttgtmagcccagtggggcagggcagtaaacagtttaaattggaaagttaaaacaataaacaggagagacaggtgaagttggggtttgaaatttgctgggctagaa

SEQ ID NO: 47644 - DNA, 201 bp, Homo sapiens
ctgtcatgcattctttttgagtcctcttggtggttttgtaaagaagccagcctcgctgcccatctcccagaggggggaaactgaagctcagagacattcarggatttgcttaaagccccatgccaggcgttggccatggtcctggctcccaaacctgtcctttttctactgtaacaggctgcctcccctccaaagtctgca

SEQ ID NO: 47645 - DNA, 201 bp, Homo sapiens
tggtgatcatgaaacctgccaaagaagcattctctctgaggctgagccactggagaagttgcacatccaggattgattttgcatagtgtagaaatcaatcyggtgaacctggcagcataggtatcctctaagtttggttgtaagcccagtggggcagggcagtaaacagtttaaattggaaagttaaaacaataaacagga

SEQ ID NO: 47646 - DNA, 201 bp, Homo sapiens
gaagttcactgacatctactcatcctgcattagtaatatgggcatggtgcattttctgtatttattagctatgtttaacagaatctttagaaaggaactcratgccctgtttcaacaaagtacattgattttttgctttgtgatagataaggcaaaagcggtcactttgttcggtgtgtgctctcatcctaatttagggcc

SEQ ID NO: 47647 - DNA, 201 bp, Homo sapiens
gggacttgctgcagatttatttcaaagttgtaaatcctctgtggattacctcctcatgctattctcaacctctggttctttctttttctgattgcccccartattaacaaagtggagcaaaaataactacagttgctggaaagtggtactgtgttagtcagaacacagaggttgtatgtgacagatacacgttcacatggc

SEQ ID NO: 47648 - DNA, 201 bp, Homo sapiens
aaaaataactacagttgctggaaagtggtactgtgttagtcagaacacagaggttgtatgtgacagatacacgttcacatggctaaggctaaagggtattyattgactcccatagtcaggaaatccaaaggtgcatctggctttaggacagctggatccaggcctcacacagttgcactttgtactctccctttgcgtggt

SEQ ID NO: 47649 - DNA, 201 bp, Homo sapiens
accaaagtcaaattgcatttatagcactggagtttcacttaaagggaatgcagcactggggacagaccctagtattttttccaattgtcctttattttcarttgccaccatgtcttgagcgcctgccctatgcccccatactgttctaggtacatatgatggcaaaatgatgaataacacattgactctgccctcacaaat

SEQ ID NO: 47650 - DNA, 201 bp, Homo sapiens
gatcagagcatccaggagaaactgtatggggatgggggcaccactgactgaatcagagcctccagtttgctgtgggtgaccacagagggactgaacaaacmcctgtgttgtcagtccttagttttgagaatagccttgaccagcacacttgttcactgaggaaggatacgaaaatgcagataagttaaaacaaacaaacac

SEQ ID NO: 47651 - DNA, 201 bp, Homo sapiens
tgctgttcattaggatgggtcttcctaaattatagagactgatcaatttacatgccaccctttgatgctaactaagacaatggagaaatagccccaagtgytaatactctgtctcttgaattgagttatttttccaaggcagtaaaatgtgaagattgcaattagttaaccattatgaagacaaatcttcaaatatttttc

SEQ ID NO: 47652 - DNA, 201 bp, Homo sapiens
ctggggaagaggaagggattgtttggaaagatcagagcatccaggagaaactgtatggggatgggggcaccactgactgaatcagagcctccagtttgctktgggtgaccacagagggactgaacaaacacctgtgttgtcagtccttagttttgagaatagccttgaccagcacacttgttcactgaggaaggatacgaa

SEQ ID NO: 47653 - DNA, 201 bp, Homo sapiens
aactaagacaatggagaaatagccccaagtgctaatactctgtctcttgaattgagttatttttccaaggcagtaaaatgtgaagattgcaattagttaamcattatgaagacaaatcttcaaatatttttctcactgtggtgacatttaaaatgcttcctgctcaaccaaacagccaattgatttctttcccatcttctt

SEQ ID NO: 47654 - DNA, 201 bp, Homo sapiens
gttatcaatagtttattaatatattgattaaaagatgacaagttctcaacccccacgatagcccactggtgaagacagaaccatgcagacactattaattyggctctgtttctttttctaatgagccagtgtggagactggggaagaggaagggattgtttggaaagatcagagcatccaggagaaactgtatggggatgg

SEQ ID NO: 47655 - DNA, 201 bp, Homo sapiens
aaggcagtaaaatgtgaagattgcaattagttaaccattatgaagacaaatcttcaaatatttttctcactgtggtgacatttaaaatgcttcctgctcarccaaacagccaattgatttctttcccatcttcttataatggctaattgctaagcaattgattgaatcctcttttgttactatgtaattactaagctggcc

SEQ ID NO: 47656 - DNA, 201 bp, Homo sapiens
gatttctttcccatcttcttataatggctaattgctaagcaattgattgaatcctcttttgttactatgtaattactaagctggccaaaacgactctccckaccatttctcagttggctcattttggtcacctataggacaggtttggggtgggaatgttcttatttggttaaactttttgcaaataatcaatcaaattgc

SEQ ID NO: 47657 - DNA, 201 bp, Homo sapiens
gtgagcactctgttcccattctatttctcactagtattttgagtatgttccccccaaagtagagatagtatgtctttgaatgcaaaccatgggctgagccytccaaattacttttaaaaaattagcttcttcaaaaaatttttttccacttccctactgtcttaaatatactggtgcttctgccctaagacctttcaggaa

SEQ ID NO: 47658 - DNA, 201 bp, Homo sapiens
ggactgctgtagatgattcctgcatagccagcgctgtgcagggcctccacttgagtgagcactctgttcccattctatttctcactagtattttgagtatkttccccccaaagtagagatagtatgtctttgaatgcaaaccatgggctgagccctccaaattacttttaaaaaattagcttcttcaaaaaatttttttcc

SEQ ID NO: 47659 - DNA, 201 bp, Homo sapiens
ttttgagtcaagtgtgtgaggaaggagtctctcttgccaaggactgctgtagatgattcctgcatagccagcgctgtgcagggcctccacttgagtgagcrctctgttcccattctatttctcactagtattttgagtatgttccccccaaagtagagatagtatgtctttgaatgcaaaccatgggctgagccctccaaa

SEQ ID NO: 47660 - DNA, 201 bp, Homo sapiens
cttttgagtcaagtgtgtgaggaaggagtctctcttgccaaggactgctgtagatgattcctgcatagccagcgctgtgcagggcctccacttgagtgagyactctgttcccattctatttctcactagtattttgagtatgttccccccaaagtagagatagtatgtctttgaatgcaaaccatgggctgagccctccaa

SEQ ID NO: 47661 - DNA, 201 bp, Homo sapiens
gcaacacttgcccttccatgagtagcttcgttcacttagcaagatgttttccaggttcccccatgttgtagctgatgtcagagcttcatcccattttatarctgagtaatattccactgcgtgaatatatcacgttttgttcattcattcactgatggacagttgggttgtttctaccttttgactgttatgaataatact

SEQ ID NO: 47662 - DNA, 201 bp, Homo sapiens
aagatacatataagtgaggatgtgactgtgttccaacaaaactttattgtggacattgcagctggaatttcatataattttcatggaccacaaactgttaytttcttttgacatttttctactgtttacaagataaaaaccattcttttctcatgagctgttcaaaaacaggtggtaggtgggatcttgctggtgggctgt

SEQ ID NO: 47663 - DNA, 201 bp, Homo sapiens
attgtgccatgtgctaggttctcagtgttgagcaaagcaggtgctgctctggccttgatggagttttcagtcttacctgttattttttctattcccactcygtcttccactccttgcaggcaataacagatgatgttgggggcaatagtcttgaaataactctggtaagtgcccagcagagccagatgctgggctgagttt

SEQ ID NO: 47664 - DNA, 201 bp, Homo sapiens
cgctgccctgtaaccttgagcaaaccccataactgtctctgcttccgacccctcatctgttgaatgggaaaagagtaataagccctatatcctggggttcytgagaggaggaattgaagcatgtaacatgcttaagacagtgcccggtgtgctgtaagttgaaactgtgtagggatcctgttgccttagtcatcacaacaa

SEQ ID NO: 47665 - DNA, 201 bp, Homo sapiens
agtgaggcaaggaaggaaaaggaaacagacgaggggtctgttactcaggcaggtactgctctgggtgtctggagcttaactcccctgggaacctttgagartcagtgtggaatacctgcttccaagccatcccacctgaggggcatgggagctccagattttatgccacaaatctggttggcattgattcaaagctgcccc

SEQ ID NO: 47666 - DNA, 201 bp, Homo sapiens
aacctagctgatatgactgggatggggattccagagaaccttgtaaacacttggtccagcaaataatatggcctcagaaaatagaagctggatgtgtttaygtacatgaggaaatggacagataggacttaacagaccatggttgtgagtgacttggctgtaagtgtcacagtctcagtttgagtttcctcaaaagcggat

SEQ ID NO: 47667 - DNA, 201 bp, Homo sapiens
agagtgtggcaagaaatgtactttgacagagagaacttgtgccaggtcattctggtctttgtaggccatgatagagagttcagattttgttctaaatacartcaaagccattaggaattgtaggcactgtacttccagtgagctaagttttggggtcagtctggtcactgtgatggagcagagagggcagggaggagagtc

SEQ ID NO: 47668 - DNA, 201 bp, Homo sapiens
aaaccagttgggaaagttatatttaggatgagtgagggacacggaggttcagaggtcctcaggcagttaaagagggagtagggtagaaggtgcaggatagrtatgggcacatggaaggtcatggaactggccagtcacccagtgaggctagagtggaacactgctcacgtaggcaggaagaaaggtactccaggtagaagt

SEQ ID NO: 47669 - DNA, 201 bp, Homo sapiens
tattgttagtattttgagacggagtctcgctctttcacccaggctgaagtgcagtggcgtgatctcggctcactgcaacctccatctccagagttcaagcrattctcgtgcctcagcctcccaagtagccaggattgcaggtgcctgccatcaggcccagctaatttttttttgtatttttcattgagatggggtttgacc

SEQ ID NO: 47670 - DNA, 201 bp, Homo sapiens
caaacaccctgaaagttgcagtggagtaaagctctcttcacattaatttacccttgagatgcacattcagaaggagacttttacacataattgctataaastttaaaaactaagggccttgtcagagacgtgtgccagtcatgaaaataccaagaagggatctctgtaaatccgagatttggtgattctcaaacttgctga

SEQ ID NO: 47671 - DNA, 201 bp, Homo sapiens
ctgataaccaaaggatgtgccatcaaccatttgggccttgtttgcaagctttgaataatttttctggtgctttaaacacattattgttagtattttgagayggagtctcgctctttcacccaggctgaagtgcagtggcgtgatctcggctcactgcaacctccatctccagagttcaagcgattctcgtgcctcagcctc

SEQ ID NO: 47672 - DNA, 201 bp, Homo sapiens
tgacttcacaaagtctgggatcttcaagagcaaacaatgagatgaactaagagcatgctcctaaacaacttcaggttgtccctgactgataaccaaaggaygtgccatcaaccatttgggccttgtttgcaagctttgaataatttttctggtgctttaaacacattattgttagtattttgagacggagtctcgctcttt

SEQ ID NO: 47673 - DNA, 201 bp, Homo sapiens
gggggttatctgttctattagataaaaagtatttgcatctctactggacaaaagttgaccacttaagtggtgacttcacaaagtctgggatcttcaagagyaaacaatgagatgaactaagagcatgctcctaaacaacttcaggttgtccctgactgataaccaaaggatgtgccatcaaccatttgggccttgtttgca

SEQ ID NO: 47674 - DNA, 201 bp, Homo sapiens
tagcaccactgggacagaataagcctgtaacaaatcacaagtgttaatagtttgtctaggccacctctactgcatgcttatgggaacatggtcaacattgwtaacttttgtgcctcagtttcccaatctgtaaagggaggataatagagccactcatcatcaaataaattagagtttatttgatgattgtattagtcgggg

SEQ ID NO: 47675 - DNA, 201 bp, Homo sapiens
aatagtaagctttcaatgagtgttggctagcattcatgcccgtaagttatcctcttgcctagagcagtgatggctctaatgtgagttcagatccctacaayaggagaaacagtgcttgttgcttttcaaaaagcagagaataaccataacttttctacagatccttgaatataataacagtagctaatatctgtttactta

SEQ ID NO: 47676 - DNA, 201 bp, Homo sapiens
attcgtaaaacattcaagaaggatgttatcggtacatgatcagagttgagtaggttctggattttaatgcctgtacttgctttttacttataaatgattawtactttagcttcataattatccatttagtttatgattatgggttgcctggttaaccctactgggtgtagtgatgcatgctttcatcagaaacatttttgg

SEQ ID NO: 47677 - DNA, 201 bp, Homo sapiens
agctaaggtattcgtaaggaatttagcaaagaaatgtgaagacgagattgctgagttagataaaaagtggttaatgttcatcatgcctaaacttttggggsttatctgttctattagataaaaagtatttgcatctctactggacaaaagttgaccacttaagtggtgacttcacaaagtctgggatcttcaagagcaaac

SEQ ID NO: 47678 - DNA, 201 bp, Homo sapiens
cgagttttcaatgagcaatcattgcacctctgataaacctcattggctatggtatttctatatgcaaagctgagacaacacttggaaagtaattaccatartccctggttaatagtaagctttcaatgagtgttggctagcattcatgcccgtaagttatcctcttgcctagagcagtgatggctctaatgtgagttcaga

SEQ ID NO: 47679 - DNA, 201 bp, Homo sapiens
ctggggctgaattaaatgtgcaattactgcacattttctcgaaaggagttttgacaatgataaatgcatagacatttttccacactcagacaacgtgactvcttgctcatcaagtggctcaggattcactttgaagaactggtctcttgttaacaggagaacgtgggtgctgcccgagaagcgcatgggcctgagttcaag

SEQ ID NO: 47680 - DNA, 201 bp, Homo sapiens
ccaaagccatgacaacacctgtgttgcctcacattgattttctgtttccaactggaggaagaggttcccggaacagccacttttgagtcaagtgtgtgagkaaggagtctctcttgccaaggactgctgtagatgattcctgcatagccagcgctgtgcagggcctccacttgagtgagcactctgttcccattctatttc

SEQ ID NO: 47681 - DNA, 201 bp, Homo sapiens
gaaaacagcattatatgatgtctggatgtatttattgttcatgatggccaggtcttcctgcattgttgtttgagtcagtcacagtgagttggcattgctasaagtcactgagcaaaaggccctcgcctggctcattcgccaatgagtctcctgtgcctgaaacaaagcttggtaaatagtagatgctcagtaaatactaac

SEQ ID NO: 47682 - DNA, 201 bp, Homo sapiens
agtgctgggattacaagcgtgagccaccatgcccggccagtaaaccttttcttaatgggtagaaggaggagtacactctaaaaaaaaaaaaaaaaaaacartaaaaacgatagtatattaaatatataaaccagtagcatagttgtttattatcattaccaaatattacatatggcacataattttatgtgcttgactttt

SEQ ID NO: 47683 - DNA, 201 bp, Homo sapiens
caagactcttgggtaaatacgcacttcaactcattaatttatgaagaaaccagtaagatgccatggttattccaaagggcatttaagaagctaaggtattygtaaggaatttagcaaagaaatgtgaagacgagattgctgagttagataaaaagtggttaatgttcatcatgcctaaacttttgggggttatctgttcta

SEQ ID NO: 47684 - DNA, 201 bp, Homo sapiens
gaccaactgggagcctgttaggactgcaaatcctgtcctctggacctagagaatgaaagcctctgggggcaggctcagaaatctgtgtttccagattccaytgggttttcaactccatccagaataattcttctggtgtcactgtgaatatttgctgatccttctgacgtctatccgtggtgcttgtttctgaagtgtagt

SEQ ID NO: 47685 - DNA, 201 bp, Homo sapiens
tacacagtgggtctcgggcactaactcacagatcacacttctgaaaacaagctcctaggatgccatatctcagagtacgggcttcgacggggcccttcacmcagctccaggaccaactgggagcctgttaggactgcaaatcctgtcctctggacctagagaatgaaagcctctgggggcaggctcagaaatctgtgtttc

SEQ ID NO: 47686 - DNA, 201 bp, Homo sapiens
cattttagcattcacatgggaatgagactatgtggtatttgccttgctgtgcttgagttacttaacataatgtcctccaggttcatccatgttgtcactartgataagatttcctgtctcatataatatatacatatatatgtgtatgtgtgtgtgtgtgtatatatatatatatgtgatattcatgtattgatggacatt

SEQ ID NO: 47687 - DNA, 201 bp, Homo sapiens
agtttcagagggctcttcccaaacccctgaggttaaggaaactcttgtacacagtgggtctcgggcactaactcacagatcacacttctgaaaacaagctsctaggatgccatatctcagagtacgggcttcgacggggcccttcacccagctccaggaccaactgggagcctgttaggactgcaaatcctgtcctctgga

SEQ ID NO: 47688 - DNA, 201 bp, Homo sapiens
gtgacaaagccattagccatgcacagtgaaacaaggaaagcagcctagagctggtccccagaccaggcccagtgcacgagtttgggtgctggaaggggagsctttatggaggcaaagctgaggggctgtacgtgtcttcataggtctccagtctgtaaaagcaaccacgctttgggctggggcagaagtcaggacttgaac

SEQ ID NO: 47689 - DNA, 201 bp, Homo sapiens
taaggtctaaggctgggaaaggagctcccacttcttacattcagtgctcatcactctgcaaatcaaggccccccgaactcctcccacccctgccttctgcrtctccctctgtgccctccatcacccccctacggagttcctttgattctcaggtcccttaaccatggaacgtactcctgtctgccctcactcgtgggttga

SEQ ID NO: 47690 - DNA, 201 bp, Homo sapiens
tggcaccctttggctggtgcggctgaagaattcaatagcctagtaatgagaagtcaatctaaggtctaaggctgggaaaggagctcccacttcttacattsagtgctcatcactctgcaaatcaaggccccccgaactcctcccacccctgccttctgcgtctccctctgtgccctccatcacccccctacggagttcctt

SEQ ID NO: 47691 - DNA, 201 bp, Homo sapiens
aatagggaacaatgtataatgcacgcagtaatgtacagggcataataaagaatatatgcaagatataattttatagcatttaattgcagtatttacattgktctttttctctctctctttggtgggagagctggctttccattagttaaatgtgcatatgatgagacttgactatattcatttaagccacattcctaatca

SEQ ID NO: 47692 - DNA, 201 bp, Homo sapiens
aatacaaaattagctgggtgtgatggcacatgcctgtcatcccagctactcaggaaggctgaggcaggaaaatcgcttgaacccgggaggcggaggttgcsataagccaagatcgtgccgttgcgctccagcctgggcaacaagagtgaaactccacctcaaaaaataaaaaagagttaagggcaggctgtcttggacaca

SEQ ID NO: 47693 - DNA, 201 bp, Homo sapiens
gcttatacctggaatcccagccctttgggaggccgaggcgggcagatcacctgaggttgggagttcaaagaccagcctgacccacatgaagaaaccccgtmtgtactgaaaatacaaaattagctgggtgtgatggcacatgcctgtcatcccagctactcaggaaggctgaggcaggaaaatcgcttgaacccgggaggc

SEQ ID NO: 47694 - DNA, 201 bp, Homo sapiens
agccacacaccacgtctctgtctcagagtctatcctcgaccacagggtttaagtccttgatgtgcacactgggccctggagagaaggtgcctgttctcacsggctgaccccacaagcctgtgagccgtaagcggtgtgattcgctaacagttgaatggcactggctatgtgtgtatgtgtatgtgtgtgcgtgtgtgtgtg

SEQ ID NO: 47695 - DNA, 201 bp, Homo sapiens
tctctactttttgtttgtgttgaaattttactgttgggaatttacgaatatggcaactaatgatttaaaccaggggtaggtatcctttttctgtaatgagscatctagtaaatagctggtttctcttgaaactgttcaattctatccgtgtagcattaaagcagccacagccgatatgtaaatgaatgggcagggtaataa

SEQ ID NO: 47696 - DNA, 201 bp, Homo sapiens
actgggggaagacaatatctcaagcacaattctcagcattgagggaggcagcagtgattaagaaagacaagattgcctgcccccgtggagtttgtgttctsatagcagagaaagacaggaaacaagaaaaataaataaatatggtagttttgcgtagtgatagtgctatagaaaaacgttcaaatggggtagagtgataga

SEQ ID NO: 47697 - DNA, 201 bp, Homo sapiens
  misc_feature (1)...(201): n = A,T,C or G, or insertion/deletion polymorphism (see Tables 1-2)
tttcctgttaatttaagtgctttagtgagggttgccattgattgagcaaacatgtgttgagtgcttattatgtacccagctccattttccgtactagccanagagcagcgagagcatggcctttgccctccaatcctgttctggtggacagacactctctcccttgacagggtcctcaccactgtgtgcaccgtcccgcca

SEQ ID NO: 47698 - DNA, 201 bp, Homo sapiens
taagcagcctctgtagggcacaggtgagtgatgatgggattcaccgctgacagctctgctgtagatttccccgggcaggtgacctctgaactgccacctgwagtagaagtaggaagtaaccagcaactggggtggggatggtgaagaagaaggagaaagtgttaaggaaggaaacagaaagtgccaagccctgaggtaggt

SEQ ID NO: 47699 - DNA, 201 bp, Homo sapiens
tggttcccccagcaagaacatcccagtgagaatggcccacagatgcctgggcgtgactcacctgcagcttcaaccatgcaggtaaatttgcctgctgctgkgtcgtgtggctggatggaattcttccctagggatgctaagaaaccctgttgcctaagtcagtgcttcctgcaagctactctttgtaattctttccccaaa

SEQ ID NO: 47700 - DNA, 201 bp, Homo sapiens
ttgttcttatgggcagctggagctgaatcccactggggactctgggagacaatgaaaaccacatctcatagttatccccactgaggaatgagggacctggkgtatttatctaccaactccccttctattattggttgagtccctcttctgacgagtcacaggtattcccagtaagcagcctctgtagggcacaggtgagtg

SEQ ID NO: 47701 - DNA, 201 bp, Homo sapiens
ggatgactacttttttgagttcctagtctctcaaagtgggtctgggccctggacttcctgtctgggctactgattgcaaccttcagaacagggtcagcccrgggtcatttgtgttctttgtctccatgtccttgcttttgaccagggccaaacaacccacctgcactgcatggttcccccagcaagaacatcccagtgaga

SEQ ID NO: 47702 - DNA, 201 bp, Homo sapiens
gtttaaggaactgacccaagatcacagaataataagtggtgagctgggatttgcacctgggtctgtgcgtgggcgagtccacctggggcccgtgtcttcastcagcgagtatttattgagcatttagggaattcagaggtaaacgagatgaactgaatccctgtctcatggagcttacagttttgtgggaacagcagataa

SEQ ID NO: 47703 - DNA, 201 bp, Homo sapiens
ctgattcagcctgtctaacattgcccatgcctgcctttggacctgtaacatctgcagaccatgagagcaacctgaggccaaatttgctgtgtggtgatcamcataaccgtttcttgatttactcattcattgaacatttactgagagtgactgagagtgaactagtttgtgtgatttttcccccaggagatttagaataag

SEQ ID NO: 47704 - DNA, 201 bp, Homo sapiens
accctgcatggcaaaatttgattaggagatcacatctgaatgggaacaggttcgagggaacggaggatgaatcaggctcagcaaagccaactttgattgcrcttttctaaggggaggatgtggtgctgattaaacgtctgaaattagtgggcagggaccattaacatgcaaaggactgatattaggcaaaggttgtaaagc

SEQ ID NO: 47705 - DNA, 201 bp, Homo sapiens
aaaagtataacccaatgacagcagaaaggccatgtctcaaattgctttcctgtccatggctagagtgggtgggtgtcatttgctgatttattactctctcmgtgggctcctttcgtttctaaagccacctggaattatggccagcaatagaactctaaaccaaagtcagctttgcacgaaaatgcatttgacttaagagac

SEQ ID NO: 47706 - DNA, 201 bp, Homo sapiens
caccacagcactccagcctggatgacagagcaagactctgtctcaaagaaataaataaataaacaaaaatttaaaaaagcagagctgagatttgtatcctkattttggcttaaagtccttgctgttttcactatgccataagtgagcaaaagcagagagttaaagcatggtttctggctgggcgcggtggctcacgcctgt

SEQ ID NO: 47707 - DNA, 201 bp, Homo sapiens
gtttggaaaatagggaatttttctaccaaagcataggaactccaggccccagcccctcctcactctttctccctgttcattctcatctctttccagttccytacctcctgtaacctgtgggcatactaaagtaccaaggtaggcttagctgcaggcacggtacttccatgattcagtgccccgcccccaccactgagatag

SEQ ID NO: 47708 - DNA, 201 bp, Homo sapiens
attctatttagtggctacccagataatccaaaataatctcttcatttggaaatcattaatttggccacatctgcaatgtctttaccacaaaagttaatatwgatgagttctagggattaggatttggtacctttggggatcattattcagcctactgtagtaggggttcatcagttagtggggggaagtagccagtttatt

SEQ ID NO: 47709 - DNA, 201 bp, Homo sapiens
aaaccagaaagcaaaacccaaaccaagacacaaccaagtaatttgtagctcttgccaatttctgtgatgtaaatactcccgtcatgggcaatttgaatctrccaacctgagagtttcctaaaaacttaacaaggggctcttgctacctgatactaactggctccagcacaccatggacctggatcctgtttctagctcacc

SEQ ID NO: 47710 - DNA, 201 bp, Homo sapiens
actaaagtaccaaggtaggcttagctgcaggcacggtacttccatgattcagtgccccgcccccaccactgagataggccactcccaccaacaacctcagrccttcagatgcccaatttctgtgtagagctttgagcagtgttttccagttgtgaagggcaaaggaaattctccaattatttgtgtgttcatcttctctac

SEQ ID NO: 47711 - DNA, 201 bp, Homo sapiens
ccaatattcctctgcccccctcttatgaaggaatttgggattctatttagtggctacccagataatccaaaataatctcttcatttggaaatcattaattwggccacatctgcaatgtctttaccacaaaagttaatatagatgagttctagggattaggatttggtacctttggggatcattattcagcctactgtagta

SEQ ID NO: 47712 - DNA, 201 bp, Homo sapiens
atattcaactgggtgccaggcagtggtatattggtaaatgtttaacaactgggccactctaaagaaacacccaaaccagaaagcaaaacccaaaccaagayacaaccaagtaatttgtagctcttgccaatttctgtgatgtaaatactcccgtcatgggcaatttgaatctgccaacctgagagtttcctaaaaacttaa

SEQ ID NO: 47713 - DNA, 201 bp, Homo sapiens
aaagtatttactatttagtccctaaaagaaaaagtttcctgactctttatctaacttaaagttacagccaaagaggcttctgggcgtcttctcaaataagrggggcctgagaagttcagccgttggggacttttcctcctaggccccaagcacttgagcaacttgacttcagggagattcacctgagaccaaatggttcca

SEQ ID NO: 47714 - DNA, 201 bp, Homo sapiens
gctgggcatcatcattccatgagtgttgctccctcacggtatagacataaccagaacgtcacaataacttactctacttagacttgccaaggcctccgggwacactgctctaatattcagcacctttgtaacttcaggataaagctgaatctgcagctctgtcacctactttttttctttgagacggagtcttgctttgtc

SEQ ID NO: 47715 - DNA, 201 bp, Homo sapiens
actggtactggcctgtggcctggaggttgggaacccctgctctacgtagtgttctaccaagagcatggctgtccttggagaacagtgacagctgggcatcrtcattccatgagtgttgctccctcacggtatagacataaccagaacgtcacaataacttactctacttagacttgccaaggcctccgggaacactgctct

SEQ ID NO: 47716 - DNA, 201 bp, Homo sapiens
caggccatggactggtactggcctgtggcctggaggttgggaacccctgctctacgtagtgttctaccaagagcatggctgtccttggagaacagtgacasctgggcatcatcattccatgagtgttgctccctcacggtatagacataaccagaacgtcacaataacttactctacttagacttgccaaggcctccggga

SEQ ID NO: 47717 - DNA, 201 bp, Homo sapiens
cacgcacacagttcacacaggattccaactcctatgaaaatccagtgccacggctgatctgacaggaggcagagcccaggcggtaatgcgagtgctggggrgccattataaatacagatgaagcttttgcttgctcacgggccactcacctcctgctgtgtggcctgatttctaacaggccatggactggtactggcctgt

SEQ ID NO: 47718 - DNA, 201 bp, Homo sapiens
tccatgcacggaccccccatgcggaagatatggcagaactcgtgattgtcggggggaaagacatccagggctccttgcaggtaacacatctgtttgagatmacttgggttcaaggaggacattaggttctgtctgtcttatgtggaaaatgggtctttaatttattatgttggctaagattccttttgttattgttgttgc

SEQ ID NO: 47719 - DNA, 201 bp, Homo sapiens
cgtgcctccgtagcttgccataatcgtcaccactctctactacccagccttctgtgctcactaattttgcctgcttgcccctagggctttttgagtttggracctctgctttcacaaatgttgaggtttgatcaaattgatgcagtttatttctcagtgatggactatttggaaagggagggactggccttttctccttcc

SEQ ID NO: 47720 - DNA, 201 bp, Homo sapiens
ttcgtccatgcacggaccccccatgcggaagatatggcagaactcgtgattgtcggggggaaagacatccagggctccttgcaggtaacacatctgtttgwgataacttgggttcaaggaggacattaggttctgtctgtcttatgtggaaaatgggtctttaatttattatgttggctaagattccttttgttattgttg

SEQ ID NO: 47721 - DNA, 201 bp, Homo sapiens
gtttggtgtgactttcatcaccaaaacctcactcttttattggaaaaagtctcatccgctctcaccagaaccctccttgcctttacagatacacacgccckggtaagccttcttcaaaatctgaacaaagcaaactacaacctgcccatcatggtgacagattcagggaaaccacccatgacgaatatcacagatctcagg

SEQ ID NO: 47722 - DNA, 201 bp, Homo sapiens
ctccctagtagctgggattacaggtacctgccaccatgcctggctaatttttgtgtttttagttgagacctggtttcaccatgttggccaggctggtctcraactcctgacctcaggagatcggcctgccctggcctcccaaagtgctgggattataggtgtgagccaccgcacccggcctacccacttttaattgggtca

SEQ ID NO: 47723 - DNA, 201 bp, Homo sapiens
attccccacagcccgcttcttctgcagccacctgggatcccaggcctggctcctcaggtatgaacaggctgcacagacaatgaatggctgggctgtaggakctcttgctcctgcagtaggcactcagcagtggccttattctagagttagggtggaaagtcatctttctctgctgagagaggcagcttgggggaaggcagg

SEQ ID NO: 47724 - DNA, 201 bp, Homo sapiens
gaatgttggaagatcattcatatgcaaaagaggaaattggaaaaaaccaatagcagctttgaatattacgggatcaacatggtagatgatgttgaaattamgcaggaagatgtcaatggttaagaaacaaggctcattgcttttatagattatattcaggtgatcaccagatagggccccctaggatggtagtatgttgac

SEQ ID NO: 47725 - DNA, 201 bp, Homo sapiens
tcaaatttgaaatccacaaacaagctgttcctgataaagtctggaagatctccaagatcaacagtaagtctggctaaagcatttctgcctattcttccagstttcagtttattttctctttcccaaaatgctgtttctctactgttctctcaagtattctcatttggttcattttaagttattggcatattataaatactg

SEQ ID NO: 47726 - DNA, 201 bp, Homo sapiens
gttgttagaaacaagtgctcagtgccgcaaaggagaaccagcactcaggaaaagagttttctcagcaaggcaatttacttctgcggaagggtgctgcttgyacttctggccactgggagagcacaccaaacaaaagagggaaggggtttttatccctcacgtggttagtccctgcttctgtgtcctgtccccattggctgg

SEQ ID NO: 47727 - DNA, 201 bp, Homo sapiens
tactaaaaatacaaaaaagaaaaaaaaaagccgggcatggtggcatgagcctctagacctagctactccagaggctgaggcagaagaatcacttgagcccrcgagggagaggttgcagtgagctgagatcgcaccacagcactccagcctggatgacagagcaagactctgtctcaaagaaataaataaataaacaaaaat

SEQ ID NO: 47728 - DNA, 201 bp, Homo sapiens
cctcgtcaacatggtgaaactccatctctactaaaaatacaaaaaagaaaaaaaaaagccgggcatggtggcatgagcctctagacctagctactccagargctgaggcagaagaatcacttgagcccacgagggagaggttgcagtgagctgagatcgcaccacagcactccagcctggatgacagagcaagactctgtc

SEQ ID NO: 47729 - DNA, 201 bp, Homo sapiens
agaccagcctagtcaacgtggtgaaatcccgtctctacaacaaaatgcaaaaattatccaggcgtaggggtatgcccttgtagtcccagctgctagggagrctgaggtgggaggatcacttgagcccaggagttcaaggctgcaatgagccaaaatcatgctattgcactccagcctgggtaacagagcaagaccctgtct

SEQ ID NO: 47730 - DNA, 201 bp, Homo sapiens
caggccaccctatttaaaacagagccttggccaggcacagtggctcacacctgtaatcccagcactttgggaggccaaggcagtgggttgtttgagtccasgagtttgagaccagcctagtcaacgtggtgaaatcccgtctctacaacaaaatgcaaaaattatccaggcgtaggggtatgcccttgtagtcccagctgc

SEQ ID NO: 47731 - DNA, 201 bp, Homo sapiens
caggaagcaaaaggggaggagaagcctttgctgacccttcaagggcaggtccagtttggagaggttctaagggcagtaaatattcattcaggcattggctscactgatgtttaatgagcatctattaatactgcatgcccagcagtgcccttgctgtcaaggatatgacaatgaacatacatagatggtctccaacttcaa

SEQ ID NO: 47732 - DNA, 201 bp, Homo sapiens
ccacaggaagcaaaaggggaggagaagcctttgctgacccttcaagggcaggtccagtttggagaggttctaagggcagtaaatattcattcaggcattgrctgcactgatgtttaatgagcatctattaatactgcatgcccagcagtgcccttgctgtcaaggatatgacaatgaacatacatagatggtctccaactt

SEQ ID NO: 47733 - DNA, 201 bp, Homo sapiens
catgagtgttcaaaagcagaagaggtcacattccacaggaagcaaaaggggaggagaagcctttgctgacccttcaagggcaggtccagtttggagaggtwctaagggcagtaaatattcattcaggcattggctgcactgatgtttaatgagcatctattaatactgcatgcccagcagtgcccttgctgtcaaggatat

SEQ ID NO: 47734 - DNA, 201 bp, Homo sapiens
acctcttacatgtttttattttcccataagttctcccctcataatgcaaaggtagttgccagcagctccaggctcacatccatccttcagagaaactccartggaaagagtctaacacagttcaaaccaaagcacaggatgaagttcacttaaatgaatatgggtcctgtgctcgtccatgaatcagtgatgtggccaaca

SEQ ID NO: 47735 - DNA, 201 bp, Homo sapiens
ctacagggagacacaaataagagagacgcacaaatgtcatgagtgttcaaaagcagaagaggtcacattccacaggaagcaaaaggggaggagaagccttwgctgacccttcaagggcaggtccagtttggagaggttctaagggcagtaaatattcattcaggcattggctgcactgatgtttaatgagcatctattaat

SEQ ID NO: 47736 - DNA, 201 bp, Homo sapiens
caataccaagagcaggaagttcatgtgggcacaatactattaaccagacctcacgaagtctccacccatttttgtgtgttttctgtgtgtgtgtgtgtgtrtgtgtgtgtgtgtgtgtgtgtgtgtggtcctacgcatttgatcacacgtacagatttgtatgaccaccaccaccatcatgatacaggacagctgcatggt

SEQ ID NO: 47737 - DNA, 201 bp, Homo sapiens
gctacagggagacacaaataagagagacgcacaaatgtcatgagtgttcaaaagcagaagaggtcacattccacaggaagcaaaaggggaggagaagcctktgctgacccttcaagggcaggtccagtttggagaggttctaagggcagtaaatattcattcaggcattggctgcactgatgtttaatgagcatctattaa

SEQ ID NO: 47738 - DNA, 201 bp, Homo sapiens
ctaaagtaccaaggtaggcttagctgcaggcacggtacttccatgattcagtgccccgcccccaccactgagataggccactcccaccaacaacctcaggmcttcagatgcccaatttctgtgtagagctttgagcagtgttttccagttgtgaagggcaaaggaaattctccaattatttgtgtgttcatcttctctacc

SEQ ID NO: 47739 - DNA, 201 bp, Homo sapiens
acttaatttccttatttttccattgttccatgatcacaggctcacagaagttgcaaaaatagtgccagaagcaccttgaacccttctctcagcttcctccrtagtaacatcgcctataactgtagtgcaacaataccaagagcaggaagttcatgtgggcacaatactattaaccagacctcacgaagtctccacccattt

SEQ ID NO: 47740 - DNA, 201 bp, Homo sapiens
attttgtcatcttctgagaggggctacttctggagacagtgacacagaaaaccagtgctcttgatttaagcagagtggatcagtaagaggtgtctctttcmtttgtttagattatgatatttattcaaagagaggagcagtgaactgtggttgagtttgttattttaatgaaattacacttgcaactattgtaggtgtctt

SEQ ID NO: 47741 - DNA, 201 bp, Homo sapiens
cctgtgtgatcttctaccacctttccggccctttcctttcttcccttcttcttctactcccagttaagctttcattttccaatgctcttcagcaatcgctrttttactctcccaaacttctacagccaaacccagcaagtgttcagttcagcagaacaaagggtcttgctctttgctggatctacctttctttcttagagg

SEQ ID NO: 47742 - DNA, 201 bp, Homo sapiens
agggctgctggttgcccatgtttatagttttttcttgatgatatgctaaacaaagggtgaattattcatgcctcccctttttagaccatatagggtaactkcctgatgttgccatggcatttgtaaactgtcatggtgctggttggagtgtagcaatgaggatgaccagaggtcactctcatcgccatcttggtcttggtg

SEQ ID NO: 47743 - DNA, 201 bp, Homo sapiens
atcttctaccacctttccggccctttcctttcttcccttcttcttctactcccagttaagctttcattttccaatgctcttcagcaatcgctattttactytcccaaacttctacagccaaacccagcaagtgttcagttcagcagaacaaagggtcttgctctttgctggatctacctttctttcttagaggggagttgg

SEQ ID NO: 47744 - DNA, 201 bp, Homo sapiens
ccccaagggctgctggttgcccatgtttatagttttttcttgatgatatgctaaacaaagggtgaattattcatgcctcccctttttagaccatatagggyaacttcctgatgttgccatggcatttgtaaactgtcatggtgctggttggagtgtagcaatgaggatgaccagaggtcactctcatcgccatcttggtct

SEQ ID NO: 47745 - DNA, 201 bp, Homo sapiens
gccccaagggctgctggttgcccatgtttatagttttttcttgatgatatgctaaacaaagggtgaattattcatgcctcccctttttagaccatataggrtaacttcctgatgttgccatggcatttgtaaactgtcatggtgctggttggagtgtagcaatgaggatgaccagaggtcactctcatcgccatcttggtc

SEQ ID NO: 47746 - DNA, 201 bp, Homo sapiens
cttatgtggattattcattgttattatatttaatcaattgattcttgtatactgatcttgtgtcctttaaacttgctgggagctctcttttaacatagacrttattatgcttattttatgtcttcatttatttgctcaaatctcgtagtagagctactggagcccaacattcatattctgtttgttatacactcataatta

SEQ ID NO: 47747 - DNA, 201 bp, Homo sapiens
aaagaatggctacgacatcgagcagccccaagggctgctggttgcccatgtttatagttttttcttgatgatatgctaaacaaagggtgaattattcatgyctcccctttttagaccatatagggtaacttcctgatgttgccatggcatttgtaaactgtcatggtgctggttggagtgtagcaatgaggatgaccagag

SEQ ID NO: 47748 - DNA, 201 bp, Homo sapiens
cttctccttcagtcctctgtaagatagatgttccaataatgccagctgattcaaaattgaaatattgttcaaaatatgcttagattgatttttttaaaaaattgttattcagccccagagtgaaatgactactgaactactgaatttatagcccccaaactgagggtgggaggggctctgaactgaacttcagaaagatac

SEQ ID NO: 47749 - DNA, 201 bp, Homo sapiens
cctgtcttctccttcagtcctctgtaagatagatgttccaataatgccagctgattcaaaattgaaatattgttcaaaatatgcttagattgatttttttwaaaaattgttattcagccccagagtgaaatgactactgaactactgaatttatagcccccaaactgagggtgggaggggctctgaactgaacttcagaaa

SEQ ID NO: 47750 - DNA, 201 bp, Homo sapiens
tgtcccagcctgtcttctccttcagtcctctgtaagatagatgttccaataatgccagctgattcaaaattgaaatattgttcaaaatatgcttagattgwtttttttaaaaaattgttattcagccccagagtgaaatgactactgaactactgaatttatagcccccaaactgagggtgggaggggctctgaactgaac

SEQ ID NO: 47751 - DNA, 201 bp, Homo sapiens
tttctgaaaggtcaaaatagtgccttcagagtacaggcactcttttatggaagacttcaatgaacacagaattgctgccctctcttaagaaaggataaaataaaaaaaactgttaaggaaaaacccaagcggtagagagaacattcgggaatgcaataaaatggaatccctttggggatgtgctggcagtggagcaaggca

SEQ ID NO: 47752 - DNA, 201 bp, Homo sapiens
aggctgaggcaggtgggtcacttaaggtcagtagttcgataccagcctggccaacatggtgaaaccccttctctactaaaaatacaaaaattagccaggcrtggttgtgcatgcctgtagtcccagctactcaggaggctgaggcaggagaatcgcttgaccctgggaggcagaggttgcagtgagctaacgccactgcac

SEQ ID NO: 47753 - DNA, 201 bp, Homo sapiens
agaggagtggaagcaaagagacccactaagaggggagtttggtggtgatctgaacaaaggtgacttggactattgaaaattgatcttggacgggcatggtrgttcacgcctgtaatcccagcactgtgggacgctgaggcgggaggatcacccgaggtcaggagttcaagaccatcctggccaacgtggcgaaaccccgtc

SEQ ID NO: 47754 - DNA, 201 bp, Homo sapiens
gtggctcacgcttgtaatcccagcactttgggaggctgaggcaggtgggtcacttaaggtcagtagttcgataccagcctggccaacatggtgaaaccccktctctactaaaaatacaaaaattagccaggcgtggttgtgcatgcctgtagtcccagctactcaggaggctgaggcaggagaatcgcttgaccctgggag

SEQ ID NO: 47755 - DNA, 201 bp, Homo sapiens
ggtggttcacgcctgtaatcccagcactgtgggacgctgaggcgggaggatcacccgaggtcaggagttcaagaccatcctggccaacgtggcgaaacccygtctcaactaaaaatacaaaaattagccagtgtcatggcacgcctgtaatcccagctacttgggaagctgaggcaagagaaccacttgaacccaggaggt

SEQ ID NO: 47756 - DNA, 201 bp, Homo sapiens
cagccgaggtggaggactgccggtcttaagcagtcctccaagagtggttgtggaccagctacattagcatcgcctgggagcttgctagaaatgcatatttycatgtcccaccccaaaaccactgagccaaaaactctggggttaaagccaggaatctgcgtttttacacagcttctaggtgattgtgatgcacactcaaat

SEQ ID NO: 47757 - DNA, 201 bp, Homo sapiens
cccggctaattttgtatttttagtagagacgaggtttctccatgttggtcaggctggtctcaaactcccaacctcaagttatccaccctcctcagcctccsaaagggctgggattacaggcgtgagccactgcatctggccccacatttttttttatcctgtcttctgttgatggacacttaggttcattccatgtctttg

SEQ ID NO: 47758 - DNA, 201 bp, Homo sapiens
agatggaatgaaactatcatttatcacatgattttgataggaagctgttgttaggattgagatgcttgcttctgatgatgcagaagacagttttaattagyatgtggcattaaataagatcagtttgcatattggaaatgatattctttttcaattatctttcagtcctctgatcagatcaaagaggaagtctcagcttgg

SEQ ID NO: 47759 - DNA, 201 bp, Homo sapiens
tgacttgctcaaatcctgtaaaattaaccatttctcacagccgcgggctacttttctggatgggaaaatttgctgggacttaaggttccagggcacagacygggcggtcaatccctggcagatctgtagctctgttaaaggagacagggctggttaaaatttaaataaccctggaaggtcccaggctgaaatatgctacag

SEQ ID NO: 47760 - DNA, 201 bp, Homo sapiens
ctcctgctctatttatatattgtaatacataaatacctttttcacaaaaatgagagttcactattcatacagtttcataacctgcctttgcttctcaacartataatagaaacattttccatgtcattaaatattcccctactaagcatttatttttaatgtgggtgcctctggcttaaacagcagcaatcttcagtgctg

SEQ ID NO: 47761 - DNA, 201 bp, Homo sapiens
atcccccctccaaattaacagtaaaataggccatgtgatcccagaatgcatcatttcaggcttataaagaaaagcaacttaatttccttatttttccattkttccatgatcacaggctcacagaagttgcaaaaatagtgccagaagcaccttgaacccttctctcagcttcctccatagtaacatcgcctataactgtag

SEQ ID NO: 47762 - DNA, 201 bp, Homo sapiens
attccatcataaacaaggtatcccccctccaaattaacagtaaaataggccatgtgatcccagaatgcatcatttcaggcttataaagaaaagcaacttartttccttatttttccattgttccatgatcacaggctcacagaagttgcaaaaatagtgccagaagcaccttgaacccttctctcagcttcctccatagta

SEQ ID NO: 47763 - DNA, 201 bp, Homo sapiens
gcgttcattggccatttgtatatcttctttggagaaatgttgattcaagtattttgcctacattttaactatgttgtggagttataaatgttgcctacatsttctggatagtagacccttatcagatgtatgatttgctgaatatttttattccattctgtaagttgtcttttcactttctttataatgtccacttcattg

SEQ ID NO: 47764 - DNA, 201 bp, Homo sapiens
agtgatactgaacattttttcatgcgttcattggccatttgtatatcttctttggagaaatgttgattcaagtattttgcctacattttaactatgttgtrgagttataaatgttgcctacatgttctggatagtagacccttatcagatgtatgatttgctgaatatttttattccattctgtaagttgtcttttcactt

SEQ ID NO: 47765 - DNA, 201 bp, Homo sapiens
tcggagcggtgtgcacagagggagcacaaagaatgtccgttgcattaaatcaaatctaacaaacagcactttttcccggcagctctacaaataggaacagrtgtctttgctaatcgcccctgaatgcacggttcaattcagggctgtaaatccatatatcagagccagaaccagttagctgtctggtctataataaccacg

SEQ ID NO: 47766 - DNA, 201 bp, Homo sapiens
aatgttcactgggggatttttgtttatctttataatttcttttcaacctatttcaaaataaaaactcagagcacattgtaatattcaatataaacttaacratgggaacaaaaataggataaccccaacccaaaatatgaagatggatctgtgttaccagctgtgtgagattaattagttacttcaatgccactgtgaatt

SEQ ID NO: 47767 - DNA, 201 bp, Homo sapiens
gctgttttttatgctagccattctagtgtctatgaggtgccatctcatagttttgacttacatttatctcatgattagtgatactgaacattttttcatgygttcattggccatttgtatatcttctttggagaaatgttgattcaagtattttgcctacattttaactatgttgtggagttataaatgttgcctacatgt

SEQ ID NO: 47768 - DNA, 201 bp, Homo sapiens
cagtggatggcgctgcagccccttctgtttagtcttcacatcagcaatgaaagagggtgaagttcatggaaatattgtggggacatatcgcatggtttctkttcatgaaatgtccagaaaagacaaacatatacagccagtggctgtggtaaagtgggaatgactgctaatgggcatgaggtttcatttaagggtgatgga

SEQ ID NO: 47769 - DNA, 201 bp, Homo sapiens
catggaatgttcactgggggatttttgtttatctttataatttcttttcaacctatttcaaaataaaaactcagagcacattgtaatattcaatataaacktaacgatgggaacaaaaataggataaccccaacccaaaatatgaagatggatctgtgttaccagctgtgtgagattaattagttacttcaatgccactgt

SEQ ID NO: 47770 - DNA, 201 bp, Homo sapiens
catccctcccagcccttgctattttctgttgttgctgttttttatgctagccattctagtgtctatgaggtgccatctcatagttttgacttacatttatstcatgattagtgatactgaacattttttcatgcgttcattggccatttgtatatcttctttggagaaatgttgattcaagtattttgcctacattttaac

SEQ ID NO: 47771 - DNA, 201 bp, Homo sapiens
tattttcttgtatgggtagagcacattttgtttatccattcgtctgtttatggacatttggcactgtttctaccttctggctaatgtgctgttctatgaasgtgtgcatacatgtatttctttgagtgcctgtttctaattctttggggtatatatctagaagtagtagctctatgtttaactttttgaggaaccatcata

SEQ ID NO: 47772 - DNA, 201 bp, Homo sapiens
gtttttcacttagcataatgttttcaaggttcttccatgttgtagcatgcatcagtatttcatccctttttatggctgaataatattttcttgtatgggtrgagcacattttgtttatccattcgtctgtttatggacatttggcactgtttctaccttctggctaatgtgctgttctatgaaggtgtgcatacatgtatt

SEQ ID NO: 47773 - DNA, 201 bp, Homo sapiens
tatcatcccaaaaggaaactccagagccattaagtagcctctcccacttcttcctccctgaccccagtccctggcaaaaaacaacctcctttctgtctctrtggatttatccattctggaccttccatataaatgaactcattcaatctgtgacattttcgtgtctggagtttttcacttagcataatgttttcaaggttc

SEQ ID NO: 47774 - DNA, 201 bp, Homo sapiens
taatgcactataaccagcaaagtggctcacgcttgtaatcccagcactttgggaggctgaggcaggtgggtcacttaaggtcagtagttcgataccagccwggccaacatggtgaaaccccttctctactaaaaatacaaaaattagccaggcgtggttgtgcatgcctgtagtcccagctactcaggaggctgaggcagg

SEQ ID NO: 47775 - DNA, 201 bp, Homo sapiens
cttgagcccaggagttcaaggctgcagtgagccatgatcacaccactgcactccagcatggaggacagagtgagatcctgtctcaaaaccaataaaaaaamaaaaaaaagaaagaaatcctataatctgtaagcaaaagacacaacccaaagaagaatagataagagacttaaacaaatacttcacagcagaaaatacaca

SEQ ID NO: 47776 - DNA, 201 bp, Homo sapiens
agagcgagactctgtctctaaaaaatttttaaaaattgaaaatcaacaaatccaaaagtttgtcctataaaaagattgaataaaattgtaaactcatatcraaactgttgggcaaaaaaagaaaaaaacacaaattaccaacactgggaataaaaaagggaaaatgactatagccatcaaaaagatacaaagatattatga

SEQ ID NO: 47777 - DNA, 201 bp, Homo sapiens
acaagacaaaatcaacaaatccaggctgggcacggtggctcactcctgtaatcccagaattttgggaggctgaggcgggtgaatcacctgaggtcaggagwtcgagaccagcctggccaacatggcaaaaccctgtctctaccaaacgtacaaagattagctggatacagtggcatgtgcctgtaatctcagttacttggg

SEQ ID NO: 47778 - DNA, 201 bp, Homo sapiens
aaacaacattatgaaattttttggcgctttttttatagctcttcagctactgttagtgttagtgtattgtatgtgtggcccaagacaattcttcttccaaygtggcccagggaagccaaaagattggacacccctgtttaaaacaagaaacatgacaagaggtaaagaggccatttcataatgatgaagggaggtatcaaa

SEQ ID NO: 47779 - DNA, 201 bp, Homo sapiens
ctgtgggccatatgtggcccagaatggctttgaatgcggcccaacacaaatttttaaactttctttaaacaacattatgaaattttttggcgctttttttwtagctcttcagctactgttagtgttagtgtattgtatgtgtggcccaagacaattcttcttccaatgtggcccagggaagccaaaagattggacacccct

SEQ ID NO: 47780 - DNA, 201 bp, Homo sapiens
gtccaggaattttccaaaactgatgaaagacattctccctattaaatcaaaaagtttagcaaaccacaagctggataaatttgaagaaaaacacacctcaracactgaaatcaaactgatgaaaaacaatatcaaagagaaaatgttaaaaatagcctgagaataaaagaggcatttacctgcaaatgagctacaatatga

SEQ ID NO: 47781 - DNA, 201 bp, Homo sapiens
agtgagtgcagttctggggttctctcctggcatctctacacagagagatgcaggtgcacagttttacagaatgggagctctatgtgcttttccgtaaatcyctctcttcactcctcagggtcctatggacatttttgtaaatcaataaacatcaagcaacatcattgtttcaaacagctagagtctggatctaccatcgtc

SEQ ID NO: 47782 - DNA, 201 bp, Homo sapiens
tggctctgtgtccccacccaaatctcatcttgaattgtactcccataattcccatgtgctgtgggagggacccagtgggagataattgaatcatgggggcrgtttcccccatactgttctcatggtagtgaataagtctcacgagatctgatggttttatcaggggtttccacttttgcgtcttcctcattctctctttgc

SEQ ID NO: 47783 - DNA, 201 bp, Homo sapiens
aaataaattgatttctccaaacaaagagtaactcaggaatttatgccaaaacatgttgataaaatatatggcttcgggaacttccatgtaggatacagtayggaagtgtccccactgtgaaactagaaaaatctagttaaattataaaaatcagataatataaaaaaatcttaattgtaaaggaatcagggagctgcagaa

SEQ ID NO: 47784 - DNA, 201 bp, Homo sapiens
gttggcagcttctgattggttagccttaagtttcgtttttctttaacatagtcatttataagaaatagctcatgttggccgggcacggtggctcatgcctrtagtcccagaacgttgggaggctgaggtgggtggattacaaggccaggagtttgagaccagcctggccaatatggtgaaaccccatctctactaaagata

SEQ ID NO: 47785 - DNA, 201 bp, Homo sapiens
aggagctctgggatgcctgggaaggggatccagggaagggactggagatgtcaagagctcctgccctgttctcagctgttatggagtcacagaaggtcatrcctacatgaaaggcaaggcaagaagtatcccatcctcccaaccccaagaggccctgcccaggccactcactggacaactcttcttgtccacatctgctgg

SEQ ID NO: 47786 - DNA, 201 bp, Homo sapiens
ctccactccccaaagctgtccacatcctagtccttaccttatacagtaaaaaggactctgcagctatgattagatgaaaggtctttagacgaccttagatsatcaggatagacccattttcaccataaaagtccttataagaaggaggcagggccaagcgcggtggctcacgcctgtaattccagcactttgggaggctga

SEQ ID NO: 47787 - DNA, 201 bp, Homo sapiens
ggccccatgctgttaagtaaacatcccccagccagtgtgaatatctgaaagcacctgctttgtacgcagcagggtcagagacctttatatgcacgccctcragccctcctcctgccagcactgagacaggtaccatgatcgtaatacccctttcgtgggtatggagatgaaggctccgacagctgaagaacttacccaggc

SEQ ID NO: 47788 - DNA, 201 bp, Homo sapiens
tggtggagtttgcacttaaccatgtttgttaacttcctagggatcctgaaacaaatcaccaccaactagagggcaaacaacaactgaaatttattcagttyattgacaatcctagagccctgaagtccaaaatcaaagtgttggtaggccttgctgtctctcgtggtcccagggaggatcccatctgcttctgccagcatc

SEQ ID NO: 47789 - DNA, 201 bp, Homo sapiens
ttgtgaataatggatgtcttcatataggaagggttaaacagcccctgtcctactgtgtccactgaccaagtccccttcatgatttatggatgatcacattraaggaagaagagaggaataggagaagatgaggtttcccagcacgtccttttcaggacctccatgtcacgcctcactgccaattaacatttacttgaattc

SEQ ID NO: 47790 - DNA, 201 bp, Homo sapiens
aagggaaatgtggttaattcaactccagcttgctttgacctgaatttatgccaactgggacttttgcctgaattattcgggaaaatgccctgagctgcccmttaattcatcttgtacgtttggtctcttacatattgaaaaagtgtgttctatgattcttttccatatagctaatgtcatcttgaccaggtcagagttcct

SEQ ID NO: 47791 - DNA, 201 bp, Homo sapiens
aatttcccttgatacaagctagaaaaagatactggtttagattcactggggtgattgactagaaaattgccccagctgtcaaagtttccagtgttaaaaascagtgtaaaatttctcaaatgcttagaatttctagatgtcacaacagagatgttaccaaaatatgagaatcaagttttttataagcaggacaaaaataca

SEQ ID NO: 47792 - DNA, 201 bp, Homo sapiens
tctgattaactttaaaatgctttgtgtttctctaacagggttaggtatggtctgtggggtttctcattcttctttggcctgggggcttttttttctaggcyaccttatatggcttatggagctggtgtttcatggaatgttcactgggggatttttgtttatctttataatttcttttcaacctatttcaaaataaaaact

SEQ ID NO: 47793 - DNA, 201 bp, Homo sapiens
cctattggaaataaagcaagggttcttcacgtttgttttgctgatttgtaaagtgaattaagaaccatcttttgcctcactggttattattctcatagtascctaccctggtgtagagttctggctgcaaagctctcagagactgaagaaaaggagatggtttagtgttactgactttttttaagacagggtctttctctg

SEQ ID NO: 47794 - DNA, 201 bp, Homo sapiens
tttatgttgcttacaataattggatattacttcagtactaaaaatatttttaaggtcagccttaagtttgccagaaaatttagacttttgaaacctcatcrcaaactttgcaatttatctacataacagtctaattgattctctactaggttaatcagtctatttctcattataggtgcaaagttttatttacttcaggag

SEQ ID NO: 47795 - DNA, 201 bp, Homo sapiens
cacgttccactgaccgcaatcagccacacaagtccatttgactgcaaggacgcctgagctgtacagtctagccctatgcccctggaacccaaggaaatagratccagtgaacatacaacattgttttcaccacaagttcctttgcttgcaagtaactgaaactcattcaggctggttttggtacctaaaaggagctcttga

SEQ ID NO: 47796 - DNA, 201 bp, Homo sapiens
acatccaggtcacattgatgcaggaagtgtgttcccatggccttgggcagctttgtccctgtggctttgcagggtacagccctcctcctggctgctttcawgggctggcagtgtctatgacttttccaggtgctctgtgcaagctgtccatggatctaccatcctggggtctggaggacagtggcccttttctcacagctc

SEQ ID NO: 47797 - DNA, 201 bp, Homo sapiens
tcattatcaataatgaaagtaaatcgcccaccttgtgtgctgactactggctaggtgttgcagccaaaggcatggtccttgcccttgaaaactttgtcatscacttagggagatagtaaatgggcattcaaaataaagcaaaatgggacacatagccttcatattaaacaaggtaagctaagcacagtcataagcagccct

SEQ ID NO: 47798 - DNA, 201 bp, Homo sapiens
gctagttctggtgttgagttagttggcagcttctgattggttagccttaagtttcgtttttctttaacatagtcatttataagaaatagctcatgttggcygggcacggtggctcatgcctgtagtcccagaacgttgggaggctgaggtgggtggattacaaggccaggagtttgagaccagcctggccaatatggtgaa

SEQ ID NO: 47799 - DNA, 201 bp, Homo sapiens
taggaactggtggtgtttggatggcagaagttacaaggaacgcaaaagcagggagcgtgagccaacaccagattgacctcaggcagctgatgctatcgaakgaaaaagggaggacttccatgcaactccagaaaacaaaaccaagacacctgcggtagattctggtttaacaaaagggagaattttctaaaaattttctat

SEQ ID NO: 47800 - DNA, 201 bp, Homo sapiens
actcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctcca

SEQ ID NO: 47801 - DNA, 201 bp, Homo sapiens
tatctgtacctttttctttagcatcgaggtatctatttaccagaccttcgtgagcaccgtgcagtttattttttaaaaatatttctcaactttatagtcartatatttggctattaggataatttcaggatatttgaggaggaactttaagaccggcttataaattacagcacttataaaggaggaaaacatgtggaactc

SEQ ID NO: 47802 - DNA, 201 bp, Homo sapiens
cactcagtcttgagtatgtctttatcaacagtgtgaagatggactaatacaatttgttaactcatattctctcttcctggtttgtctgtcctctcactctctgatgacatcctatctattcctcctgtcttggtttggatgctgcattctctgtgaggtgcccaatattgccctggatcagaggtagtgagttcttcctcc

SEQ ID NO: 47803 - DNA, 201 bp, Homo sapiens
atttcttgccctcgcgtaacctacatcctaatgaatgtttctgttccatctgtaatagtttggctgtgtcctcacccaagtctcatcttgaattcccacawattatgggagggaccctgtgggaggtaatcgaatcataggggcgggtctttcccatgctgttctcgtgatagtgaataagtcccatgagatatgatggtt

SEQ ID NO: 47804 - DNA, 201 bp, Homo sapiens
gatatttgggaggctgaggcaggagaattatttgaacccaggaggcagaggttgcagtgggctgagatcgctgccactgcactccagcctgggcgacagarcaagactccgtctcaaaaaataaaataaaataagcaaacagaggggagcagaaagagtcctgtgaaaactcagttaaatagcacagctctggatacttga

SEQ ID NO: 47805 - DNA, 201 bp, Homo sapiens
attccagatatttgggaggctgaggcaggagaattatttgaacccaggaggcagaggttgcagtgggctgagatcgctgccactgcactccagcctgggcracagagcaagactccgtctcaaaaaataaaataaaataagcaaacagaggggagcagaaagagtcctgtgaaaactcagttaaatagcacagctctggat

SEQ ID NO: 47806 - DNA, 201 bp, Homo sapiens
agtggctcatgcctgtaatcccagcactttgggaggccaaagcaggtggatcgcttgaggtcaggagttcgagaccagcctggccaacatggtgaaacccygctctactaaaaatagaaaatttagccaggcatggtggcaggtgcctataattccagatatttgggaggctgaggcaggagaattatttgaacccaggag

SEQ ID NO: 47807 - DNA, 201 bp, Homo sapiens
caaaataagcaaactggccaggtgcagtggctcatgcctgtaatcccagcactttgggaggccaaagcaggtggatcgcttgaggtcaggagttcgagacyagcctggccaacatggtgaaaccctgctctactaaaaatagaaaatttagccaggcatggtggcaggtgcctataattccagatatttgggaggctgagg

SEQ ID NO: 47808 - DNA, 201 bp, Homo sapiens
agtctatttccatgacttgtgtcatttataaaggcagggacagatggaatcacttcagtgagctagaatttgtattaagttctacttgctttattttcctycatttacatatgcttattagtaatacacgtgtgagaacaaaatcatatactatcagtcactgccacacaatgaataatcccatgtaaaatatttttgcac

SEQ ID NO: 47809 - DNA, 201 bp, Homo sapiens
cagcaagctgtccttccagggcatctgtggggcaggcatacctccttgaggtctcccatgggaggaggcaccaaacaaaataagcaaactggccaggtgcrgtggctcatgcctgtaatcccagcactttgggaggccaaagcaggtggatcgcttgaggtcaggagttcgagaccagcctggccaacatggtgaaaccct

SEQ ID NO: 47810 - DNA, 201 bp, Homo sapiens
cacctgagctcaagcaaccctcttgcctcagttctggaaatagctaagtgggactacaggtgtggaccaccaggcccagttaattaaaaaaaaaaaaaaaytttaagacaaggtcttgttatgttgcccatgctggtctcgaactcctggcttcaagtgatcctccaggagtagctggcattacaggcttggctgactttt

SEQ ID NO: 47811 - DNA, 201 bp, Homo sapiens
ctcctttcgtagtttttattttctacgtttctcatagtctttcctatcctactatatatatgtgtgtgtgtatatatatatatatatgtgtgtgtgtgtgkatatatatgtgtgtatatatatgccatatatagagatagatccatcttccatctattactatatctataatctccctatatataaatttgatacgtatat

SEQ ID NO: 47812 - DNA, 201 bp, Homo sapiens
tcaaaagttttcttgaatgaaacaaagccttctccggatgaggaagcttgtcagaagcttgagtgactggtaaggagggtgaatctctgctgctgatttaytaagaaatatttggatctttccttgaagctaagggtatatacctacttctgtgcaaaacaggtggcatggctggcccttgaagagtacacagtttaagga

SEQ ID NO: 47813 - DNA, 201 bp, Homo sapiens
tttaaaggctatcaaacatagttacattgtttttcagtaaaatatctgtacctttttctttagcatcgaggtatctatttaccagaccttcgtgagcaccrtgcagtttattttttaaaaatatttctcaactttatagtcagtatatttggctattaggataatttcaggatatttgaggaggaactttaagaccggctt

SEQ ID NO: 47814 - DNA, 201 bp, Homo sapiens
gaaatctatataatggggaacagctgctcatagctgccagcacttcattcagtgaagtcacattggcagcttgaagctggccatgccgggagtatttataygacaggaactggcaaacacctcagggctagatgtcttgtttttgaactagaatggcagtcagcaaacttttttctgtaaaaagctagaggagtatcctag

SEQ ID NO: 47815 - DNA, 201 bp, Homo sapiens
tttgattatttctctgcactgtgttcctagtagttaaattacttagtcaaaaagcatgaacactttaaaggctatcaaacatagttacattgtttttcagkaaaatatctgtacctttttctttagcatcgaggtatctatttaccagaccttcgtgagcaccgtgcagtttattttttaaaaatatttctcaactttata

SEQ ID NO: 47816 - DNA, 201 bp, Homo sapiens
gcagtgagaatctagagagaaaataagtgattacacttaaagtagagagtcagggaagacttcctgggagaggtgacatttagactaaagcataaataatrttgatttgtttgccaaatggaggaagcaaagaaggatcctgagtgaaagcatgatgtgtctgaggatttgcaagtcgatcatgaggttgcagcatacatc

SEQ ID NO: 47817 - DNA, 201 bp, Homo sapiens
aaaaaaatccctaatttctattgatataatatcattggatagtgccatgatagaagaatgtcccatgtgcagtgagaatctagagagaaaataagtgattrcacttaaagtagagagtcagggaagacttcctgggagaggtgacatttagactaaagcataaataatattgatttgtttgccaaatggaggaagcaaaga

SEQ ID NO: 47818 - DNA, 201 bp, Homo sapiens
aatggcaaggaataaaatttgccttcaatgtgcttatggtcttgggaggagtagagtaaaaaaaatccctaatttctattgatataatatcattggatagwgccatgatagaagaatgtcccatgtgcagtgagaatctagagagaaaataagtgattacacttaaagtagagagtcagggaagacttcctgggagaggtg

SEQ ID NO: 47819 - DNA, 201 bp, Homo sapiens
ctgggcgacagagcgggactccgtctcaaaaaaaaaagaaaaaaatagaaatggcaaggaataaaatttgccttcaatgtgcttatggtcttgggaggagyagagtaaaaaaaatccctaatttctattgatataatatcattggatagtgccatgatagaagaatgtcccatgtgcagtgagaatctagagagaaaataa

SEQ ID NO: 47820 - DNA, 201 bp, Homo sapiens
acatagtgaaaccccatcactactaaacatacaaaaattagccgggcatggttgcacatgcctgtaatctcagctacttgggagcctaaggcaggagaatygcttgaacccaggaggcggaggttgcggtgagcccagattgcaccactgcactccagccttggcaacaaagggagactccgtctgaaaacaaaaaggggg

SEQ ID NO: 47821 - DNA, 201 bp, Homo sapiens
tttcttgttactcagcaaccaccacaatgcctggtccgtggaaaatggtcaataaatatctgttggctggataaattaatccctaaatgtatgtattaggktgttgcaaaaaaaaaaaaaaaaaaaaaaaattagccgggcgtggtgtcgggtgcctgtagtcccagctactcgggaggctgaggcaggagaatggcgtga

SEQ ID NO: 47822 - DNA, 201 bp, Homo sapiens
ttggcttcttgagaaaggaactcagataagacaattgtaactttctcaagttttaaagtctggaaggaacaatttctgtggttattcaaaaaaaaaaaaaacataagcgtcagttctgtgggacaatttgatcactttattttggagaaaaaaatgatgaacagaagtttgtttataagtttaaccccaataataggctag

SEQ ID NO: 47823 - DNA, 201 bp, Homo sapiens
gttttggtcacttggtaggtgacaatccagtgaccacaaccaaggaggatttaacaagggattttatgccttgcaatgcggaagagcactggggaaagttyccgaaggggtgcctcccagaacacaaatgaaaacagggcttttactgggctggcgagctgagtcactgtatgtagaggtgtagtgaaggcagcacatgct

SEQ ID NO: 47824 - DNA, 201 bp, Homo sapiens
aactatggattatatgggaatgttttaactttttcttgaagtaactttatggtttgtatacggatgccaaatatagatacatatctaatttatctattttmtttttttagaaataatttcttagaattaggaacctcttcagagccataattgcaaaaagagctccccgtcagctctctttgcagtcgaggtttgtaatta

SEQ ID NO: 47825 - DNA, 201 bp, Homo sapiens
acaggaaagggaacatcacactctggggactgttgtggggtgggggaaggggggagggatagcattaggagatatacctaatgctaaatgacgagttaatkggtgcagcacaccagcatggcacatgtatacatatgtaactaacctgcacattgtgcacatgtaccttaaaacttaaagtataataataataataataat

SEQ ID NO: 47826 - DNA, 201 bp, Homo sapiens
ttaacagagatgcaccaggtacttttctaagcactttatatatgttatattaaacataggtgtcttaactatggattatatgggaatgttttaactttttyttgaagtaactttatggtttgtatacggatgccaaatatagatacatatctaatttatctattttatttttttagaaataatttcttagaattaggaacc

SEQ ID NO: 47827 - DNA, 201 bp, Homo sapiens
actcatagatgggaattgaacaatgagaacacatggacacaggaaagggaacatcacactctggggactgttgtggggtgggggaaggggggagggatagmattaggagatatacctaatgctaaatgacgagttaattggtgcagcacaccagcatggcacatgtatacatatgtaactaacctgcacattgtgcacatg

SEQ ID NO: 47828 - DNA, 201 bp, Homo sapiens
tctgtttattctgttgatagtttctttgccaatttttgtttttggtgcaattgcttttggggactttgtcataaattctttgccaaggtcaatgtgcagawtgctatttcctaggttttttccagctggattcttttctcgtcttctggcaagtcagtttagaagaggttgatttattcagaaagtatccattttcttttt

SEQ ID NO: 47829 - DNA, 201 bp, Homo sapiens
ggcggggtggatcacaaggtcaggagatcgagaccatcctggctagatggtctagccaggtgaaaccccgtctctactaaaaatacaaaaaaattagctgsgcatggtagtgggcgcctgtagtcccagcgactcgggaggctgaagcaggagaatggcatgaactcgggaggcggagcttgcagtgagcaaacgtcacgc

SEQ ID NO: 47830 - DNA, 201 bp, Homo sapiens
aaacaatttatcttcttttggataaacacccagtagtaggattgctgagtcaaatggtagttctgttctaagttctttgagaaatctccaaactgctttgracaggggctgaactgatttacattcgcaccaacagtgtataagagttcccttttctctgtaacctgggcagcatctgttatttttttgactttttaataa

SEQ ID NO: 47831 - DNA, 201 bp, Homo sapiens
ctaattcacttaggttaatggcctccagctgcatccatgttgctgcaaagaacacaatttcatcctttttcacagctgcatagtattccatggtatacacrcactgcattttctttatccattccaccattgatgagcacctggattggttccttgtgcttgccattgtgcattgtgctgtgataaacatacaagtgcatg

SEQ ID NO: 47832 - DNA, 201 bp, Homo sapiens
tgctaattcacttaggttaatggcctccagctgcatccatgttgctgcaaagaacacaatttcatcctttttcacagctgcatagtattccatggtatacrcgcactgcattttctttatccattccaccattgatgagcacctggattggttccttgtgcttgccattgtgcattgtgctgtgataaacatacaagtgca

SEQ ID NO: 47833 - DNA, 201 bp, Homo sapiens
gtgctgggattacagatgtgagtcacaatgcccagcatggattgtccttttcagacccagaccaaagaacaggacttattgtcccaagaccaatctaggaraagtataagctgtgttgtcacccaggcattgctagaaagtggtaggctggacacaggatgaaacagttgcctgattttaaagtaagagaaatagatcaaa

SEQ ID NO: 47834 - DNA, 201 bp, Homo sapiens
ttagattcagggggtccatgggcaggtttattacctgggtctattgcgtgttgctgaagtttggggtatgagtgatcccatcacccagacagtgtgcatartacccgatagttttcaacccttacaccccttccatgctcccccttctagtagtccccaatgtctattgctcccatctttgtgtctgtgtgtactcaatgt

SEQ ID NO: 47835 - DNA, 201 bp, Homo sapiens
ggtggtattcttttaaaaaattcatacaattgaaccgggtacaaagaatcacctgggttttttgtttgtttgtttttgttttgttttcgttttttggtttktggtttttttgagcttttagattcagggggtccatgggcaggtttattacctgggtctattgcgtgttgctgaagtttggggtatgagtgatcccatcac

SEQ ID NO: 47836 - DNA, 201 bp, Homo sapiens
tcatttcattctcataacctagaggacgggcacattatcctcctttacagatgagaaaatttccttcaacccctctgtgtcctgtctcgaggggagcagtrttgggcctcttctctgaggctgatgtaactgctgattcctctcacacctcctgtgggcatctcctctgctctcttgcatcttcattcattctgtgtttct

SEQ ID NO: 47837 - DNA, 201 bp, Homo sapiens
cacagccgaattactcactcctgatacagactgagtggctcaccctcattttctcacttcctccgtcctggtgttaataagactcatccttcatttttctrccgtttctgcagttctttagagagtgcagaccactttcacatgcagcttctcatttcattctcataacctagaggacgggcacattatcctcctttacag

SEQ ID NO: 47838 - DNA, 201 bp, Homo sapiens
aacactgcccctgtgatggaagcaaggctggatgaggctgcagcaggcctcggatgacctaggctaaagatgctgcggatcactgtccggagactgctgtsgggggaatcccacaagacacacatggtctggtgttggtggcggccccagaacctcactctcctctgcacacctctgcgtgcctacgtctgttcctgtgac

SEQ ID NO: 47839 - DNA, 201 bp, Homo sapiens
aatagaatccagcatgcgtgaggctccctgaagacacaacactgcccctgtgatggaagcaaggctggatgaggctgcagcaggcctcggatgacctaggstaaagatgctgcggatcactgtccggagactgctgtcgggggaatcccacaagacacacatggtctggtgttggtggcggccccagaacctcactctcct

SEQ ID NO: 47840 - DNA, 201 bp, Homo sapiens
ctgggtctgatcccatctgaagctactttgggtggttatcacaatgtagtttatcatagtgctgtggaatatgaactatgaccatagccagccctatattytagaaccagcatctccatttgtagctatgggtgcttggacaaacacttcaatgttctccatctcagtttcctcatctgaaaatagagtaaacaacagtac

SEQ ID NO: 47841 - DNA, 201 bp, Homo sapiens
acctactaaaatagaaagatacctttcaggttcctgacctcatgccagtatctaccatttccttttcctagaattctctctttctccttatttaaatcctrtgcattctctagtgcatttgggggaaaatgtcatctctttctgtaggcattaactctctatgccctaaaatttcatataaccttggtggttccttttatc

SEQ ID NO: 47842 - DNA, 201 bp, Homo sapiens
ctaaaatagaaagatacctttcaggttcctgacctcatgccagtatctaccatttccttttcctagaattctctctttctccttatttaaatcctatgcawtctctagtgcatttgggggaaaatgtcatctctttctgtaggcattaactctctatgccctaaaatttcatataaccttggtggttccttttatctcaca

SEQ ID NO: 47843 - DNA, 201 bp, Homo sapiens
caagtttaattacactgtcttcatcattagtcataacgttttaaaaacataattgccagcataagagggaatctatctatgtctttctatttctctctctmtatatatacatacattttatatacatataagcacacatcaaacatactatatactatatacatactatatattatatgcatggtgtgtgtgtgtttatat

SEQ ID NO: 47844 - DNA, 201 bp, Homo sapiens
cactagtagcagaaaacaaagtctgtttaagtaaatgtgttttcaggatggcccaactgtacagaaacttgcagatctcacgttctgatcactccatcaastgctgcttctttaaaatactcaagagtcacttacgatgtttaattggcatgtctgtctttcaaaatgaaaagctacagggtagcttgtgttaaccacaca

SEQ ID NO: 47845 - DNA, 201 bp, Homo sapiens
ggtcacaagtagctattgaacatgaatattttatcagtgccagagcagatagagggaaactgtatccattatattctcatcaccatcacatgtggttgaaygggcttccgactaaagaatctaaacatgtttaaaacatttttcacctccagtaaaactagcaagtcttgatttgtgttgttattgctcctgctagattcg

SEQ ID NO: 47846 - DNA, 201 bp, Homo sapiens
aattgaaaataattctttttccaagtgcgggttttctaacaggggccagccagacatttatgagctcaggcagatgaggaaagcatgatacctggatcacrtgtgctcacatctggaatacatgcgcaaattaacacagctgtggaggcaggagtacatatgtgtattagaaaaacaagccccacctgtagagcgctgcaa

SEQ ID NO: 47847 - DNA, 201 bp, Homo sapiens
attctactgttgttttcatttgcatttctcttaagaccttatctggagaattatgttttttcaacataaataaataagaattgtccaaggtaagagttgtrtaggctctgtaaaaactccccaagtttcagtaatttacagatttgaatggataaacatccttattgttcttaaatactaaagtaagagcagatgtaagaa

SEQ ID NO: 47848 - DNA, 201 bp, Homo sapiens
cagataccactactcctaagacccaggtcagacagcgaggcatcactgttaagagcatgggcgctatggttggacaactctatcacttactagctgtgtgwcctggagccagctacttagtccctcaccacctctgtttcttcatctatataatgggtcagtaatcccacccacatgaagttattgttagacttaaataag

SEQ ID NO: 47849 - DNA, 201 bp, Homo sapiens
ggcccaattaaaattttgacacagaccattaactgtcacacagatttatattgccaccaggagcatttgaaagtgttctattcaattccacacaccagggrtactatcatccttactcaatatctgccaatcctttgggcaacatagaatattctactgttgttttcatttgcatttctcttaagaccttatctggagaat

SEQ ID NO: 47850 - DNA, 201 bp, Homo sapiens
gtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaacagacacattcatcattttattgtatttt

SEQ ID NO: 47851 - DNA, 201 bp, Homo sapiens
cgtgcttccttctccccactgctctagtgaccactaaccagcttcctgtctctgtgggtttgcctagtacggacatttcatcggaatgaaatcagctaacatgtgatatccttaatggttttgtagcagaaagacatctacgtgggaagggacgctgctgagtgtttagagaacagacacattcatcattttattgtattt

SEQ ID NO: 47852 - DNA, 201 bp, Homo sapiens
gagcgtggaggcgggcccctgtagtcccagctactcgcgaggctgaggcaggggaatggcgtgaacccgggaggcggagcttgtagtgagcggagatggcrccactgcgctccagcctggggcgacagagcaagactctgtctcaaaaaaaaaaaaatcaccgtccttttttggcgttctgtcagtcaagagtattctgaa

SEQ ID NO: 47853 - DNA, 201 bp, Homo sapiens
aatcccggccctttgggaggccgaggcgggcagatcacgaggtgaggagatcaagaccatcctggctaacacggtgaaaccccgtctctactaaaaatacmaaaaaaaattagccgagcgtggaggcgggcccctgtagtcccagctactcgcgaggctgaggcaggggaatggcgtgaacccgggaggcggagcttgtag

SEQ ID NO: 47854 - DNA, 201 bp, Homo sapiens
ggtcacaggccaagtttgtgacaagaccggggtgtctgttcgggttttggagaaacaaggaccctagatagggtccattcattcattcatttatttatttwtttgttcattctccagacaaatcgttatcttggccccttctgctgcagccattgccactaagaaggcaggccctgcaggggagactctgcacgtcttttg

SEQ ID NO: 47855 - DNA, 201 bp, Homo sapiens
aactatgatcataccatttgtactatttggtcatttttctccattcaataatataaagtaggcagtcgtgtatgtgtgtgtgtgtgtgtgtgtgtgtgtgkatgcgtgtgtaatccacataaggctttttgatgactgcatattatttctcatcattgctgtcttctaattcatttgaccagtcctgtaattgatgggcat

SEQ ID NO: 47856 - DNA, 201 bp, Homo sapiens
ctgaccttgacacactcctgaccagtcagtggatggcgctgcagccccttctgtttagtcttcacatcagcaatgaaagagggtgaagttcatggaaataytgtggggacatatcgcatggtttcttttcatgaaatgtccagaaaagacaaacatatacagccagtggctgtggtaaagtgggaatgactgctaatgggc

SEQ ID NO: 47857 - DNA, 201 bp, Homo sapiens
atgggtggatgatgaatgcatgggtggatgatgaatgcatggatgagtgtggaatgcatgggtgagtgataaatgcatgagtcggtggatgaatgcatggrtgaatgatgaatgcatgaatggatggatacatggatggatgaagttgtacaagctcaaaccagctcagattggaggaagcgtcttacttgaagccccctg

SEQ ID NO: 47858 - DNA, 201 bp, Homo sapiens
caggtagctggaggcctcagccttcctgggcagcagggatacgggcagggatgtcccctgagcatggtcccacctggaagccagggggctgaccttgacasactcctgaccagtcagtggatggcgctgcagccccttctgtttagtcttcacatcagcaatgaaagagggtgaagttcatggaaatattgtggggacata

SEQ ID NO: 47859 - DNA, 201 bp, Homo sapiens
gaatgcatggatgaatgtggaatgcatgggtggatgatgaatgcatgggtgggtgattaatgcatgggtaggtgatgaatgcatgggtgagtgatgaatgmatggatgagtgtggaatgcatggctgagtgatgaatgcatgggtgggggatgaatgcatgggtgggtgatgaatgcatgggtgagtgatgaatgcatagg

SEQ ID NO: 47860 - DNA, 201 bp, Homo sapiens
ccccatttggtcttgacattgagcaccatgctttggcaggtgtcagaggttggctcccgggaaatagaccacgcaaccggggaggtgttatcagcatccayacctcacggggagggaggtcagggggatggggcggggaaggaggctgatggaggagttgctgactgcaggtagctggaggcctcagccttcctgggcagc

SEQ ID NO: 47861 - DNA, 201 bp, Homo sapiens
atataatagctacacaataaatattgaaagaatgaggggatgggtggacagatgcatagatccatggaagaatggatggatggatggatggatggatagadggatggatacatgaattgatggatgcatggatagacacatggatgagtgatgaatgcctgggtgggtgatgaatgcatggatgaatgtggaatgcatgga

SEQ ID NO: 47862 - DNA, 201 bp, Homo sapiens
cctgtcttgtgctaggcaccagggggcgtagcagcagaccaggaaaatgtagagtctgcccttacggagctgggagccttgcatgaaagactggcactgaygacacagtggcactgaatgaacgtgtgatcagaagctgagacagggctctaggggaaaaaggcaaagtgcagccaatcctcatagcaaaagagaccgagg

SEQ ID NO: 47863 - DNA, 201 bp, Homo sapiens
acatataatagctacacaataaatattgaaagaatgaggggatgggtggacagatgcatagatccatggaagaatggatggatggatggatggatggatagatggatggatacatgaattgatggatgcatggatagacacatggatgagtgatgaatgcctgggtgggtgatgaatgcatggatgaatgtggaatgcatg

SEQ ID NO: 47864 - DNA, 201 bp, Homo sapiens
tcagagcactcaggcattggattggagaatggagttgagatgagaagcagtgaagcacttgctgtagccatcataaaaacctggatcatatcaatagatcrtcataacttggcttcaacaagaattcataaaaccaactcctctctatttcatagtttcatcattttatggaatatcaaaaacctaaagagaaagagaaat

SEQ ID NO: 47865 - DNA, 201 bp, Homo sapiens
agttacaaacagccatccccttagggtatacacttgcagcacccatgggtgtgtggttgcagaacacagggtaaatttcagccctcagccacttcctgcarggacttttgtacagcgtacaacctttaccaccataaatggaggctttttgtatttcacacatcatttaactagtgaaagttgcataatagatactcagtg

SEQ ID NO: 47866 - DNA, 201 bp, Homo sapiens
ttgccatgttggccaggctggtctcgaagtcctaacctcatgtgatctacctaactcagcctcccaaagtgctgggattataggtgtgagccaccgtgccrggcctctacatattacttctaatccttaacataacagcccatgattccactctttcaatctcgtttcttttaactttgaaccattctttgccaattactt

SEQ ID NO: 47867 - DNA, 201 bp, Homo sapiens
tgtctggagaagtttgaagcagagcagatgctcagacggtctgcatccctcctctttgccgtccttctcctttgctcacctgcaagaatcaggctttacgwttcaactttctgttccaaacatagctttaaagcctgtttgggtgtccttagaaatttttctaagtgtcagctcatatgagacacccgctccagatgtctt

SEQ ID NO: 47868 - DNA, 201 bp, Homo sapiens
agtgcttaaatggatatcttatttaataataacaggaacccttggaagtgagcacaggtttgattctcactttgcagataaagaaactgaggcccagaaasgtgcccaaggaagcagagttatttaggacctgacagaggtaggattccaacctgggcagtctatcaccagagtccttgtttaatcactaaattttgtacc

SEQ ID NO: 47869 - DNA, 201 bp, Homo sapiens
ttcatgtcaggttcctgtgcctctcctggagaagcaggtgataaggtctctgtgttaaaggaggaaaccaaggttctaggcagcctcgtgggtaatacagycagtaaattgcaaagctgggtgaactcaattgacaggactctagccagaaactggttctttgccattagtctctactgacccctatggatgtatggaggg

SEQ ID NO: 47870 - DNA, 201 bp, Homo sapiens
ggaatcatctcttggtagtgtcatcagcagaaagaaaattcttttctgaattgagctttggttgtatgggatagatatctgttctgttggtggtggtggtkgtggtggttttgtgttttaatttttggattgtgacctcagtttgagtgagcaatgtgatgaagctgctaacaaaaaaatcaaagagaaaactctaaactc

SEQ ID NO: 47871 - DNA, 201 bp, Homo sapiens
aaatagtcagactaatagaagcagagtagaatggtgatttgggggagcagaaaggggaaatttattgctcagtgggtataaagcagcaattatatgggaaraaaaagttctagagatgttttgtacaacttagtgcttttaggtaacaaaactgtaatgtgcacttaaaaatgtgttcagaggctgggcgccatggctgat

SEQ ID NO: 47872 - DNA, 201 bp, Homo sapiens
gatatgagtcttcttttaccagctgtgtgatcttaggtgttctgggtcccatttgggaaatgaggggtttaattgcctccaagcttgatctgtgcatggakcaatgtcgttatgagaattccccacattttgctcccttttggacctccctaaaattcccctaagaacacccctcactagtagaaatgtagaatcccagac

SEQ ID NO: 47873 - DNA, 201 bp, Homo sapiens
tccccacctccagagaatcagatgttaaacatttgccagtgttcctctggcaaagaaaaggaaaatagccagaggtaagtgaaatcaaatgagagaagtcyaaccttgcaaaactgagccaactgcactgatgtatcctgttgtctgtcccacaccctcgcaaggcttttggtctttgtccagcagagtcaccacgtctta

SEQ ID NO: 47874 - DNA, 201 bp, Homo sapiens
ttagcagggctagcaggactagcaggacaagacagagtttgaatgagatcgttgcatctaagtggaataaggagaagctgataatgcaagaaggtcaaccrtctcacacacatctagggaccgtggggaaacccattttgctagagtagagagattggatgaggaagtacaggctgcaccctggagccaagctaagtaaac

SEQ ID NO: 47875 - DNA, 201 bp, Homo sapiens
agctccagggaggaagagactccaggggctcaagtggtttagcagggctagcaggactagcaggacaagacagagtttgaatgagatcgttgcatctaagtggaataaggagaagctgataatgcaagaaggtcaaccatctcacacacatctagggaccgtggggaaacccattttgctagagtagagagattggatgag

SEQ ID NO: 47876 - DNA, 201 bp, Homo sapiens
accatcgaggtgccggtgggtgtgtgatatagtatgttaacgagcatatattgaggtcctagggaaaacctaagtgaaatccaccaccacgatgggtccarttggtcttagccagcttggcccacactcttgttttttcagggtcttatcagcccctagcttctgcagctatttcaacattttccttttgctaatcatgtg

SEQ ID NO: 47877 - DNA, 201 bp, Homo sapiens
tacctgtaatcccagcactttgggaggccgaagcaggtggattagttgaggtcaggagttcaagacccgtctggccaacatgtctggccaacatggtgaarccccgtctctactaaaaatacaaaaattagccaggggtagtggtgcacacctgtagtcccagctacttgggaggctgaggcaggagaattgcttgaaccc

SEQ ID NO: 47878 - DNA, 201 bp, Homo sapiens
tagagatggggtttcactatgttggccgggctggtctcaaatccctgacctcatgatccgccctcctcagccttccaaagtgctgggattataggcatgarccaccgcacccgccctggcctctttaatgattgtttacttgggtaggtaaagtcttccagtccttttcattctctctaaaatcagaaactctttggaaat

SEQ ID NO: 47879 - DNA, 201 bp, Homo sapiens
tggcacttactggttcatgtcaggttcctgtgcctctcctggagaagcaggtgataaggtctctgtgttaaaggaggaaaccaaggttctaggcagcctcktgggtaatacagccagtaaattgcaaagctgggtgaactcaattgacaggactctagccagaaactggttctttgccattagtctctactgacccctatg

SEQ ID NO: 47880 - DNA, 201 bp, Homo sapiens
cagtcttgctctgtcacccaggctggagtgcagtggtgcagtctcagctcactgcaacctccacctcctggactcaagcaatcctcctgcctcagcctccrgagtagctgggactacaggcacgtgccaccacacccggttaatttttgtatttttagtagagatggggtttcactatgttggccgggctggtctcaaatc

SEQ ID NO: 47881 - DNA, 201 bp, Homo sapiens
ttgtttcttgttataccataaagataaggagcttgagttactttccagctgataaggcaattttcacctttttccatttgtcttggaatttcacaccccaycccatcctacccttaaggtgccctggaggggttgaagggccattcttggtcatccagtctctgtgtggttgggttgatcacagaaactagagaagtcacg

SEQ ID NO: 47882 - DNA, 201 bp, Homo sapiens
gtaccatagactgagcagcttaagtagcagaaatttaatttcttacaattctgtaggttagaagtctgagatcaaggtgttggcagagttggttccttctgaggcctctcttcttggcttgtagatggctgtcttctccctgtgtcctcacagagtcttccctctctgtctgtctgtgccctaatctcttctcatgaggac

SEQ ID NO: 47883 - DNA, 201 bp, Homo sapiens
attgtatcatatctactctcctgtttgtctcttgctgcagactcctctaaggcagggaccacttttcaccacctttccatgcccctggatccttgttcagrtttggcttgatgtacgcactttgaagatacttgaatgagtgaccacaaatatcttcatttgcatctgaacaattttcttgatatttgaacttcttaccca

SEQ ID NO: 47884 - DNA, 201 bp, Homo sapiens
gggcagatcacgaggtcaggagatggagaccatcctggctaacacggtgaaatcctgtctctactaaaaatacaaaaaattagccgggcatgatggtgggygcctgtagtcccagctactcgggaggctgaggcaggagaatggcgtgaacccgggaggcggagcttgcagtgagccgagatcacgccactgcactccagc

SEQ ID NO: 47885 - DNA, 201 bp, Homo sapiens
tatagcctcatttaattgcaaagggatcaggaaagtgtcattctgaacattctcagaaaagcagagacctgattatacatgagtgttagaagcctctacarcacagcaattgtggactgaatgcttcattcaggcaataagcaaaagcctccttcagcagcgtattatttaatcctcacataaccctgcaaggtgtgggct

SEQ ID NO: 47886 - DNA, 201 bp, Homo sapiens
tctggactgctatagtaatgataataatagtaagaataataatagccaccatttgtggatcacttactgcaaaccaggaactgtgttaaatccttctcatrtgcaagctgctcctttaacctgcgtggcaacccggggtgactagctgttagtatagcagttccttgcccaagtttctcagtatctttcagcctcagtttc

SEQ ID NO: 47887 - DNA, 201 bp, Homo sapiens
gcccgggcccggtggctcacgcctgtaatcctagcactttgggaggctgaggcgggcagatcacgaggtcaggagatggagaccatcctggctaacacggwgaaatcctgtctctactaaaaatacaaaaaattagccgggcatgatggtgggcgcctgtagtcccagctactcgggaggctgaggcaggagaatggcgtg

SEQ ID NO: 47888 - DNA, 201 bp, Homo sapiens
ggagtgaaatacttgagtaggggctgggaagcaataaagcaagtggtattttcaagtttatgcatccacaagatcagtgttcaatatttaaaatgttcaaygtgtaaactctatcatggaaagatttttgaggaagtagcttgtaaaaagttgcatatttctatttgttgctagggttacctaaccaacaggttcttggct

SEQ ID NO: 47889 - DNA, 201 bp, Homo sapiens
tggtcactgtgatggagcagagagggcagggaggagagtcatcaggaggctgtaggtgcagaccaggggaaatgccagttagactacactatgctgtggcrgtgggaatggaaggacctgatgtgctttcctgaaatgtagttggggcgtgtcacatgcttgagttctgtgtccctaccctctctcactgacccatagtcg

SEQ ID NO: 47890 - DNA, 201 bp, Homo sapiens
gcgtctgtttgttgagaggcaaaggcggccccgccccatgctctggtttctgcttgcaccttattaacgggtaatgaagagtaggttctgctttattgatsttgagaccagagctacgtgcgatgctgcctaagaaaagccgcaaaggattttatttgatttttgcacacagcaataatctccctcaccagattagctggt

SEQ ID NO: 47891 - DNA, 201 bp, Homo sapiens
agggagccttttcaatcttctcatgctccagtttcaaagctgtctcaaaatgagataagttaaagcctaatacagttttttagaaacacctgtatttgtcrcgctgacctaatattaacacaggttctcgtctctacttgaatgttacgcatctatcgcgacaccattaccaggactgcgctctgaatctttagagattat

SEQ ID NO: 47892 - DNA, 201 bp, Homo sapiens
tggttttttttaatactgtaaaggcagaaatgaggtgtttaccatgttttggtggggaaaatctataaagggaaatgggatattatgtgacccaagaaaasacgtgctctaaaaggctaaagcgcctggaactgtttgtattcactcaacctgatgcctatttcctcaacagccacttattctctaggccctggtgattct

SEQ ID NO: 47893 - DNA, 201 bp, Homo sapiens
gtccttgcttttgaccagggccaaacaacccacctgcactgcatggttcccccagcaagaacatcccagtgagaatggcccacagatgcctgggcgtgacycacctgcagcttcaaccatgcaggtaaatttgcctgctgctgtgtcgtgtggctggatggaattcttccctagggatgctaagaaaccctgttgcctaag

SEQ ID NO: 47894 - DNA, 201 bp, Homo sapiens
cctatgttaaatcaacgtacatggcttgactcaggtgatatctgtaatcttgactttgtctgtttacatgtaactaggcctctggtctctgccatcctatmaatccattcagcctttcagcctcagtttctcctggtagagcctggcatggcctgaaggcagcacagtataatagaaataggaaggtgtgtgtgatagact

SEQ ID NO: 47895 - DNA, 201 bp, Homo sapiens
aggttcacaattcccaactggagtgggtgagtgggagagaactttacaaaagaaataagagcaaaaccatctgggtaaaaatgacaccatgtcttgatctstggtgctaaggacccctggaagtgcaaccatttacactcgctcttgaaaatgcctcattgtgggttcagggataataacccttaagctaaagcctttatg

SEQ ID NO: 47896 - DNA, 201 bp, Homo sapiens
atcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccac

SEQ ID NO: 47897 - DNA, 201 bp, Homo sapiens
cttttttaaaaaaagaaaaagaagcccgggcccggtggctcacgcctgtaatcctagcactttgggaggctgaggcgggcagatcacgaggtcaggagatkgagaccatcctggctaacacggtgaaatcctgtctctactaaaaatacaaaaaattagccgggcatgatggtgggcgcctgtagtcccagctactcggga

SEQ ID NO: 47898 - DNA, 201 bp, Homo sapiens
aaccaagctttttgagaattttgacttttttaaaaaaagaaaaagaagcccgggcccggtggctcacgcctgtaatcctagcactttgggaggctgaggcrggcagatcacgaggtcaggagatggagaccatcctggctaacacggtgaaatcctgtctctactaaaaatacaaaaaattagccgggcatgatggtgggc

SEQ ID NO: 47899 - DNA, 201 bp, Homo sapiens
ttagaattgaatttaagctctgatagaaaattgttgaaagccttcagtgctcatttttcaccaaactgaactctataatggtactacaatagaaaaaaaawttccaaagttcaattggaattttttcccagtaacttaataataaggctccaatttcaggaaaatagtttcagcatgagtgaaatcacactgtttgttatg

SEQ ID NO: 47900 - DNA, 201 bp, Homo sapiens
actgggccaggccctgaatgttttgaaggtactggtgacagggatttgctaaccaactgtgccgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctgga

SEQ ID NO: 47901 - DNA, 201 bp, Homo sapiens
cactgggccaggccctgaatgttttgaaggtactggtgacagggatttgctaaccaactgtgccgtgtgtgtgtgtgtgtgtgtgtgtgtgtgtgtgtgtgtcagagagagagagagaggaataaagattgactccaagatttttgtcccaaacaaatggaagcacagagggcacatctctgagctttgcaagctcgctgg

SEQ ID NO: 47902 - DNA, 201 bp, Homo sapiens
gccacgattttggctcactgctacctctgcctcccaggtgccagtgattctcgtgactcagcctctggagtagctgggattacaggcatgcaccaccacayccagctaatttttgtatttttaataaagatggggcttcaccatgttgtccaggctggtctggaactcctggcctcaagtgatccacctgcctcggcctcc

SEQ ID NO: 47903 - DNA, 201 bp, Homo sapiens
tgccacgattttggctcactgctacctctgcctcccaggtgccagtgattctcgtgactcagcctctggagtagctgggattacaggcatgcaccaccacrcccagctaatttttgtatttttaataaagatggggcttcaccatgttgtccaggctggtctggaactcctggcctcaagtgatccacctgcctcggcctc

SEQ ID NO: 47904 - DNA, 201 bp, Homo sapiens
gtggggttggtggagggaaataaatatgaagaagaatggtgagacaaccagtgggcatatactgtgtagactaccagaaagctttggaaatgtgtcaaccstaaagcattgctatttttaaatatttagttgtattttaatatttagctataaatgaagaacttggcttggacacaaaaataacaaaaaattaatatctaa

SEQ ID NO: 47905 - DNA, 201 bp, Homo sapiens
gtacagtgccacgattttggctcactgctacctctgcctcccaggtgccagtgattctcgtgactcagcctctggagtagctgggattacaggcatgcacyaccacacccagctaatttttgtatttttaataaagatggggcttcaccatgttgtccaggctggtctggaactcctggcctcaagtgatccacctgcctc

SEQ ID NO: 47906 - DNA, 201 bp, Homo sapiens
tttcttttttttttttttttttttttttttttttgagacagagtctcactctgtcactggggctggagtgcagtggcgtgatctcgactcactgcaacctytgcctccgggttcaagcaattcttctgcctcagcctcctgagtagctgggattacaggtgcccgccactatgcccagctaattttttgtgtttttagtag

SEQ ID NO: 47907 - DNA, 201 bp, Homo sapiens
gagtacagtgccacgattttggctcactgctacctctgcctcccaggtgccagtgattctcgtgactcagcctctggagtagctgggattacaggcatgcrccaccacacccagctaatttttgtatttttaataaagatggggcttcaccatgttgtccaggctggtctggaactcctggcctcaagtgatccacctgcc

SEQ ID NO: 47908 - DNA, 201 bp, Homo sapiens
atttcaacccagcccagactgagaggaggctgatttcaagggcaaagaaggtgaggcagccgattcccaggtcccatttcccttgctccacttcattaacrtggccacccttaatgcgtgtcataactctgccttccagcaagatttcctctccactaagaaccttttagaaatggtatttaagagaatgtgcataaaaca

SEQ ID NO: 47909 - DNA, 201 bp, Homo sapiens
ctgaccaacatggtgaaaccccatctgtactaaaaatacaaaaaaagttagccaggaatggtggtgcttgcctgtagtcccagctactagggaggctgagrcaggagaatcacttgaacctgggaggtggaggttgcagtgagccaagatcgtgccactgccctccaacctgggtgacagagtgagacttcgtctagaaaa

SEQ ID NO: 47910 - DNA, 201 bp, Homo sapiens
tctctcatttccttattcctatgttctcattctggtccatcatctgttcatttattcagtccattctttgtgtattcattcaattattctttcaagtgacrtttactgataattaaaactgttaaaatcactgacgtcaaggtctatgagcaaaactgaaccaaaccaaaacaagaactaaactagaatccgttgtggcgg

SEQ ID NO: 47911 - DNA, 201 bp, Homo sapiens
ctgccttccagcaagatttcctctccactaagaaccttttagaaatggtatttaagagaatgtgcataaaacaagtcttcatggtgattatgacatttctsctgaaccaaaatgtaatcagtacacacattttgcatccttacacttaatccacaaacatagcttttactgttttaccttctcccacccacaatccaaaca

SEQ ID NO: 47912 - DNA, 201 bp, Homo sapiens
tgtgagctattcatgtgcaagtaacaaacacctactcaaacaagcttaagaaaagcagggaattcctgggaggatgcaggagcaggaaattgagccagtcsttccaaagggccagaaccagaaggcagaccactgggtcccagacagatgggtcatctctttccactgtgattcaagccctgatttgtggcctttgcctat

SEQ ID NO: 47913 - DNA, 201 bp, Homo sapiens
agtgctggagaactcgtacccccaggatcagctctcaaccagggatgaatacagatggaggataaatttccccactcccttgcccctttggagatgtattygacaccatttctcagagtctccagggagaatgagctccagtagcccacagtggtacctggactgataatgctttactggctttcttttcatatcactgcc

SEQ ID NO: 47914 - DNA, 201 bp, Homo sapiens
aatctttccctggttcagcttgggtgcactgccttgtgctgactctgtcccctcccctacccaccacaccccatgtgtctagaacaatctcctctgcagtmcttcatttcctaaatgaattagtccagagccctgttttgaacagatgcctgtacagttcttgattggttgaggcaagtctaaactgacataagccctaac

SEQ ID NO: 47915 - DNA, 201 bp, Homo sapiens
ggaatctttccctggttcagcttgggtgcactgccttgtgctgactctgtcccctcccctacccaccacaccccatgtgtctagaacaatctcctctgcartacttcatttcctaaatgaattagtccagagccctgttttgaacagatgcctgtacagttcttgattggttgaggcaagtctaaactgacataagcccta

SEQ ID NO: 47916 - DNA, 201 bp, Homo sapiens
ggatttctccggactgttaacttctgttcaaagagcccgccaatgatggatagagagcggcgtgcagaaaggaatctttccctggttcagcttgggtgcaytgccttgtgctgactctgtcccctcccctacccaccacaccccatgtgtctagaacaatctcctctgcagtacttcatttcctaaatgaattagtccaga

SEQ ID NO: 47917 - DNA, 201 bp, Homo sapiens
atagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactgg

SEQ ID NO: 47918 - DNA, 201 bp, Homo sapiens
gaaaactctaaactctgttaataattgtacattgtaaggtagtaaggcatgttagcctcactgtgcttgtcacagatcagaatctacctagagagctgggrtacacgtagaagcccaagagtactagatgatctcctataaagagccaggatggtagaagacctgtggattggccttctgctatgtttctgtttcccagca

SEQ ID NO: 47919 - DNA, 201 bp, Homo sapiens
aagtcatactcaaatagagatgatagtactttgacatttctttaaaatctaggcaaacctgagatgcttttatcattgaaagtagaaggtgtccccattaytggcagggaaatagattccagaatttcatattctctccaggtcagccactacaaatgagaactgaagaattaatctaagacttttttcatttttaaaaat

SEQ ID NO: 47920 - DNA, 201 bp, Homo sapiens
tatatataaacacactgtttatatatatgtgtttatatataaacacactgtatgtatgatgcatgtatatatacatattttaaacaatttctaagtcataytcaaatagagatgatagtactttgacatttctttaaaatctaggcaaacctgagatgcttttatcattgaaagtagaaggtgtccccattactggcaggg

SEQ ID NO: 47921 - DNA, 201 bp, Homo sapiens
tttatatatatgtgtttatatataaacacactgtttatatatatgtgtttatatataaacacactgtatgtatgatgcatgtatatatacatattttaaayaatttctaagtcatactcaaatagagatgatagtactttgacatttctttaaaatctaggcaaacctgagatgcttttatcattgaaagtagaaggtgtc

SEQ ID NO: 47922 - DNA, 201 bp, Homo sapiens
acggtgacgctaggaggtatgcacggttacttccattataaggtgaggaggctgtggcataccatgttctgtgccatgtcctcagataccattataccagrtgccattccttaagcccctgagtaccaatcccactccctctccatcacacacagccactatggaatacactcacatcagcgtcagttggccccactcact

SEQ ID NO: 47923 - DNA, 201 bp, Homo sapiens
caggtgctgacaggtgcatttggcctgatatgcactgtagggggatggcttccagggcaccctcaatgcctcttaaaatcattctctccttaaaaccagcycattcatctcttgggggcttctgcctctctttcagacaaattattgcagagagtccagtagccaagtagaattgcattgagcaggcacatttgacaatga

SEQ ID NO: 47924 - DNA, 201 bp, Homo sapiens
aggcagatgttgaagaacgtggaagcttctagaagagctgaaaacgtccatagactgagtaatcggccaggcacagtggctcacacatgtaatcccagcastttgggaggctgaggcgggcagatcacctgaggtcaggagttcgagacctgcctggccaacatggtgaaaccccgtctctacaaaaatacaaaaattagc

SEQ ID NO: 47925 - DNA, 201 bp, Homo sapiens
cccattgctagctctcgcaccctctctgcccttgacctcaataatataccatatcttgattcactggctccaggtctcctaccaccgaggacttgccttamtttttttttgttgttttctccatggagtccatctgttggaacattctgtctacaaactccttttgttaggtaataatgagttttcccattttaaaaaatt

SEQ ID NO: 47926 - DNA, 201 bp, Homo sapiens
gcggtggctcatgcttgtaatcccagcgctctggaaggccgaggcaggcagatcatgggctcaggagttcgatgccagcctggccaacatggtaaaaccccgtctctactaaagatacaaaaattagcagtccgtggtggcgggcgcctgtaattccagctactcaggaggctgaagcaggagagtcgcttgaaaccggga

SEQ ID NO: 47927 - DNA, 201 bp, Homo sapiens
ccctgcgagtatatgtcaagcattttatctgtggggactaagtttggctgaacataacaggaaaattcaaaatgacagtggctcagagcagacggaagttsattttttttttctcacataaagtaggtctagagcaggcatgacagttcagggacagtggcagccccacacggccccacacagggttctacttgctcacta

SEQ ID NO: 47928 - DNA, 201 bp, Homo sapiens
gagggcaggtgcggtggctcatgcttgtaatcccagcgctctggaaggccgaggcaggcagatcatgggctcaggagttcgatgccagcctggccaacatrgtaaaaccccgtctctactaaagatacaaaaattagcagtccgtggtggcgggcgcctgtaattccagctactcaggaggctgaagcaggagagtcgctt

SEQ ID NO: 47929 - DNA, 201 bp, Homo sapiens
cactttttgatagatgtccatcttcttctctctctatcctcacatggtagatagagtgaggcagctctctggattctcttttttttttttttttttttttktttttttttttgagacagagtcttgctctctcaccaggctggagtgcagtggcctgatcttggctcactgcaacctccacctcctgggttcaagtgattc

SEQ ID NO: 47930 - DNA, 201 bp, Homo sapiens
agaatcacacgaatcagatcaaaataattgcaccctggagttgtttctgtgttacagcagcctcagtatcccttctcattcccactattttctagcctccatgcatgttctaagaattttccagctctccttttatggaagacaactcgcccaggtttgccgaggcgcaataaacaaattagttgcagtccccgccctgtc

SEQ ID NO: 47931 - DNA, 201 bp, Homo sapiens
cacacctggctaattttttacatttttttttagagagatgggaatctcactatgttgcccaggctcatcttgaattcctgggctcaagtgatcctcccacytcagcctcccaaagagctaggattacagtgttagaataccatgcccagcccccaaaataaattttttaaagcacattactctattatgataggaggggtt

SEQ ID NO: 47932 - DNA, 201 bp, Homo sapiens
tggtcatcccaacagatacctgcacctagttggccaatcagatcactaattgtccggtctcagcgattgatctagacacatttatgaccaatatatggcaratgagagttctttgggggaaattaatttgaatgttgcagagtgttggccttctcactcccctgaaatatgagttccaaagacaaggtgaatctggaattg

SEQ ID NO: 47933 - DNA, 201 bp, Homo sapiens
atgcaactagtcaagcatgcaagcttgcatatgtgcagtcctttaaacttgtcctctgtcacttctttcccatctgtgtctttccagccttctgatcattatttccatcttccatgttaatctaaaggtcaactttctgctcttggaggaagaacatgcattcttggtgtataataaaattcaagtccctcttcctacttg

SEQ ID NO: 47934 - DNA, 201 bp, Homo sapiens
tgagttccaaagacaaggtgaatctggaattgtggggtccaatttttttttcaaatggacacagtgagttggataaaaagcccgacagagccaagaaatgsagagagaaagagagagagagagacagagagagagaaggaggaaggtgggaagagagtgacagaccttacggtgttattcaaatccctggatccagctgta

SEQ ID NO: 47935 - DNA, 201 bp, Homo sapiens
gaaaggtacccatgagttagagcagcagtccacaacctttttttttttttttttttgagatggagtctcactctgtcgcccaggctggagtgcagtggcaygatcttggctcactgcaacctccacctcccgggttcaagcaattctcctgtctcagcctcccaagtagcggggactacaggcacccgccaccacacccag

SEQ ID NO: 47936 - DNA, 201 bp, Homo sapiens
aagacaaggtgaatctggaattgtggggtccaatttttttttcaaatggacacagtgagttggataaaaagcccgacagagccaagaaatgcagagagaargagagagagagagacagagagagagaaggaggaaggtgggaagagagtgacagaccttacggtgttattcaaatccctggatccagctgtacctaaagcc

SEQ ID NO: 47937 - DNA, 201 bp, Homo sapiens
atgtctaaagactataggggatgtcacccaaagggtcacctttttaggcagaacttgagctcttgttaaggtttgaaaaatcacaagctgtttttttttttcctccatagctcagaaatcaaaccagattgaggaaaatctttctagggaaaaaaaactcacaaaagctgagaaaattaaaatatatagagctcctagaat

SEQ ID NO: 47938 - DNA, 201 bp, Homo sapiens
aaaaaaaaaaaaaaaattacactagcatccactcttaccctacctgtaggaagtaccgtgttgctcacgggtgaccccaggaggcttacctttctgttttstttgtgaaagtttctcccccattttgcttgtgcttccagagcaatgatgctagatgttggctcactttggaaacactcccttcctacaacataaatgtgt

SEQ ID NO: 47939 - DNA, 201 bp, Homo sapiens
gatcgagaccatcctgtataacacggtgaaatcccgtctctactaaaaacacaaaaaattagccaggcgtggtggcaggcgcctgtagtcccagctactcrggaggctgaggcaggagaatggcatgaacccgggaggcggagcttgcagtgaaccgagatcatgccactactgcactccagcctgggtgacagagtgaga

SEQ ID NO: 47940 - DNA, 201 bp, Homo sapiens
atgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaa

SEQ ID NO: 47941 - DNA, 201 bp, Homo sapiens
tatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggca

SEQ ID NO: 47942 - DNA, 201 bp, Homo sapiens
atatgcatggtgtgtgtgtgtttatatataaacacactgtttatatatatgtgtttatatataaacacactgtttatatatatgtgtttatatataaacayactgtatgtatgatgcatgtatatatacatattttaaacaatttctaagtcatactcaaatagagatgatagtactttgacatttctttaaaatctaggc

SEQ ID NO: 47943 - DNA, 201 bp, Homo sapiens
tatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctagg

SEQ ID NO: 47944 - DNA, 201 bp, Homo sapiens
tatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagta

SEQ ID NO: 47945 - DNA, 201 bp, Homo sapiens
ctatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagt

SEQ ID NO: 47946 - DNA, 201 bp, Homo sapiens
actatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatag

SEQ ID NO: 47947 - DNA, 201 bp, Homo sapiens
tactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgata

SEQ ID NO: 47948 - DNA, 201 bp, Homo sapiens
catactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatga

SEQ ID NO: 47949 - DNA, 201 bp, Homo sapiens
acatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatg

SEQ ID NO: 47950 - DNA, 201 bp, Homo sapiens
gttttgctaactccgtttacagatacaggtattgtggattcgcagattcgtagaggttcggtacttgctcaagcagcccagcttggtggtagaggaatcasgatggaaacaggacactctgcaaagttcatgctccttctagctgctcaatgctcactgactctgagctgccagaaggggaaggagcaaagtcacttcctg

SEQ ID NO: 47951 - DNA, 201 bp, Homo sapiens
ggctctgctctcccctgggttgtctccatcctcagccatatttgcacatctgtagagggaagagggaagaggcaccagcaaacacctctccttgatcctascagaggaaagcaacatcttccttcctaatcaatagcccagcccaaggcccaggttgagtcacaagcacaactctctgaaccaagcagaagatgagcagga

SEQ ID NO: 47952 - DNA, 201 bp, Homo sapiens
gagactctgaggatgtatggccctgagctgggggattctagggacatttttcatgtcactacctagacagtcgtgtgagtgctccagcagtgagggatctyggctgcaggttacattccttgccgaagccagggctggatgataattcactttgtcattacttaattctgtgatggctgaaacgactgagccagaataaaa

SEQ ID NO: 47953 - DNA, 201 bp, Homo sapiens
gctgaatgacttgggatgagtcttttacatcttttaacttcaggaaaacagccatggtggttctgccagcaagtcgttgaatggattaagtgagataatcrtacaatgtgtttagcactgtgcctggcatgtaataaatactcaataaatggcagtattttctatggcagacttggtgaatccaggactaggatcccaggc

SEQ ID NO: 47954 - DNA, 201 bp, Homo sapiens
tcaggtttcaaaaggccagcagtagctctgggtctacagctccccagctctgcaccccagagaaatgcctgtccagtattctccaaaattcctgggctcaygctcacttgtccagagtagatctctagcccaccctatacccatcgctggccactggccccatccaaaactctggggcagtgagtggagggggggctgccc

SEQ ID NO: 47955 - DNA, 201 bp, Homo sapiens
ccatctgcagtgacacactgcctgtgtcctccaaaactcagtggattggagaattgagtcacgatgaatcttgtaacccatacccagagccctgaagaackcaggttgtttgcacgcccagccacaaagaagttgccttctcttgatctttgaagcaattaaatgtcatttagagaggagaggtttgctgtttaaaaatat

SEQ ID NO: 47956 - DNA, 201 bp, Homo sapiens
ggagggcggatcacgaggtcaggagatcgagaccatcctgtataacacggtgaaatcccgtctctactaaaaacacaaaaaattagccaggcgtggtggcrggcgcctgtagtcccagctactcgggaggctgaggcaggagaatggcatgaacccgggaggcggagcttgcagtgaaccgagatcatgccactactgcac

SEQ ID NO: 47957 - DNA, 201 bp, Homo sapiens
ccaggggcaccaaacccaactgcttcctgcagggattcagctgcacttgtcatcacagagccttgaaatccctggggatatcaactccttggaattccagkctgctcttccacttgcttctgacacattgacttttctgcccattcactcacccatctttaaccaaggcctgtatggccagacatgaggccactcactgcc

SEQ ID NO: 47958 - DNA, 201 bp, Homo sapiens
ggaggtctacaccaggcacctgggactgcaggctttctctctcccctgggtcttaaattacagtaacatcggccaggcgcggtggctcacgcctgtaatcscagcactttgggaggccgaggagggcggatcacgaggtcaggagatcgagaccatcctgtataacacggtgaaatcccgtctctactaaaaacacaaaaa

SEQ ID NO: 47959 - DNA, 201 bp, Homo sapiens
atcacgcgattgcactccagcctgggtgacaagagcaagactccgtctcaaaaaaaaaaaaaaaaaaaaaaaacacacacacacacacacacacacacacmgttgtgtttgcatcctgttatttgagttagctcaattctaccaaattcccatcctacagcctgttccagtaaccgcagagccatgagacctggtctgatg

SEQ ID NO: 47960 - DNA, 201 bp, Homo sapiens
ttcactatgttggccaggctggtctcaatctcctgacctcgtgatccacctgccttggcctcccaaagtgctgggactacaggagtaagacaccgtgcccrgccagtattgttcttctttatacctaattactcatcattggaattctctttaaaaaaaaaatgtgcttccctaattggttgccaacagagaggctacatc

SEQ ID NO: 47961 - DNA, 201 bp, Homo sapiens
tcattatttccatcttccatgttaatctaaaggtcaactttctgctcttggaggaagaacatgcattcttggtgtataataaaattcaagtccctcttccyacttgtgattgtctttgtggctcatccaggcagcctcatcctgaatgtctatgatgtaagtcaaagaaaagaaaataatcagtcctgaatttggagggaa

SEQ ID NO: 47962 - DNA, 201 bp, Homo sapiens
gcttgaacccgggaagcagtgagctgagatcacgcgattgcactccagcctgggtgacaagagcaagactccgtctcaaaaaaaaaaaaaaaaaaaaaaaacacacacacacacacacacacacacacagttgtgtttgcatcctgttatttgagttagctcaattctaccaaattcccatcctacagcctgttccagtaa

SEQ ID NO: 47963 - DNA, 201 bp, Homo sapiens
aaagctgaggccagcagatcacttgaggccaggagttcaagaccagtctggccaatgtggcaaaacactctctctcctaaaaatacaaaaattagctgagsacagtggtgcatgcctataatcccagctacttgggtgggtgaggcatgagaatcgcttgaacccaggaggcagaggttgcagtgagccgtgattgtgcca

SEQ ID NO: 47964 - DNA, 201 bp, Homo sapiens
ttttctctgatgcatttgtaccttttttgtgtacttcaaagaagccattggcaaattaaatatgactggacaacttttcacataagtaactaggaaaggtwaggaaagacacagaatataattcaagtccctgaaggcctgtattacagaagaagacataggcagattctttcacatgccagggagtagaactcagattag

SEQ ID NO: 47965 - DNA, 201 bp, Homo sapiens
gaaataaagtatccaagcctgaaattgaagaaaaaaaaatgtaggcatatttgctctttggtttttatttttctgtcaccatctaatgtaatatttatttmatcattcccctaaggcaatgattttcaaactctctttagcagcaaaacttttttttttttttcaaacaaaatcccaggcaggaattctaatatacaaaac

SEQ ID NO: 47966 - DNA, 201 bp, Homo sapiens
tcacaatagcaaggtcatggaaccaacctaagtgtacatcaacggttgactggttaaagaaaaggtggtgtatacacaggtgaaatactatgcagccataraaaagaatgaaatcctgtcctttgcagcaacatgggtggagctggaggctattatcctatgtgaattaactcagaagcagaaaatcaactactgcatgtt

SEQ ID NO: 47967 - DNA, 201 bp, Homo sapiens
caggacttgggcacaggtagaggtgagcttccgggctgaatcccctactaggccgttagtcaattgtatgtttcctttttggactcacctctgggttgcaraggaggttgctctgattgtttcttgttataccataaagataaggagcttgagttactttccagctgataaggcaattttcacctttttccatttgtcttg

SEQ ID NO: 47968 - DNA, 201 bp, Homo sapiens
acgctggtttctgtattgcatagattcctagcctgctccactgcaaatgggctgccatacagaggatgaggttcatggtccagaaacgcatctggtactcragcgcagagcagaggtggaattctaggcctgtgaatggttcacatcagcagtgggggtccccagtgaagtaggatcccaaaggccacagcaattggacgg

SEQ ID NO: 47969 - DNA, 201 bp, Homo sapiens
cttggttagtttaggtaagatttgtcaattttgttgacattttcaaagagcaaatttttggtcttattgattttctctgatgcatttgtaccttttttgtrtacttcaaagaagccattggcaaattaaatatgactggacaacttttcacataagtaactaggaaaggtaaggaaagacacagaatataattcaagtccc

SEQ ID NO: 47970 - DNA, 201 bp, Homo sapiens
aataaccaatacagagaagtgcttaaaggagctgatggagctgaaaaccaaggctcgagaactacgtgaagaatgcagaagcctcaggagccgatgcgatmaactggaagaaagggtatcagcaatggaagatgaaatgaatgaaatgaagcgagaagggaagtttagagaaaaaagaataaaaagaaatgagcaaagcct

SEQ ID NO: 47971 - DNA, 201 bp, Homo sapiens
aaaatgttaaattacctttctcatctcaggaatagagtcccaatcacttccagattgaagcacttacggggggaaaaggcgaagggctccagtaattttamattgcttcgtacaatgaagagtgcctgtaaattactgaatgtggtaatttgttccataagcttttttgatttgtaagtaacttagtggatttgctggtga

SEQ ID NO: 47972 - DNA, 201 bp, Homo sapiens
ctctccttctgccccagggttcttctccgtgtggatcacattaagggagcgtataacctttcataccgcctgactaggatgatggatatggaaatacacastttgggagccctgtctgcttgcctgttaagccattgactgttatatactcttgggcttgaaacaccttccaggctggaggggccagtattgcatttactt

SEQ ID NO: 47973 - DNA, 201 bp, Homo sapiens
gccgaagcagggcgaggcattgcctcacctgggaagcgcaaggggtcagggagttccctttccgagtcaaagaaaggggtgacggatgcacctggaaaatsgggtcactcccacccgaatattgcgcttttcagaccggcttaagaaacggcgcaccacgagactatatcccacacctggctcggagggtcctacgcccac

SEQ ID NO: 47974 - DNA, 201 bp, Homo sapiens
gaggaaataatttgatttggggctgcagggggtagggtggaaaagtgcagtcggaagacagagaaaatcagcaagaagattactgaaagggaaagaggggraaaccaaccagctatatatttcctgcaacatgagttaatgaaattccgttccttcttacacagctgtattcggtttgttttacattgtttggtatgtaaa

SEQ ID NO: 47975 - DNA, 201 bp, Homo sapiens
tctctttggtgaaatgtctaactatgtcttttgcctattttttgttttgttttgttttacaggccattttcaggactttaacttttgcccattttctttcytttttttttttttttttttttttttttgagacagagtctcactctgttgcccaggctggagtccagtggtgtgacctcggctcaccacaacctccgcttc

SEQ ID NO: 47976 - DNA, 201 bp, Homo sapiens
aaatgcagcacctaggcgccgcaccagacctgttgaataggaatctacattttcacaagattccaggtgatttgcatacacagtggcatttgagaagcatyaatccaggggcttctttgcagtcagtgatggtgatttgccaatcattagcatttcagaaaccccaggccgaaaccatacatttatccttagctaggtcgg

SEQ ID NO: 47977 - DNA, 201 bp, Homo sapiens
tcagacttcccgggcttaggcgatcctcccacctcagccttttaggtagtggggcctacaggcgcagaccacggcacctggctaatttttgcatttttttrtagtgacagggtctcaccgtattgcccaggatagtctcaaacgatccactcacccacttcagcctcccaaaatggtgagattacaggcattagccactgc

SEQ ID NO: 47978 - DNA, 201 bp, Homo sapiens
tagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggct

SEQ ID NO: 47979 - DNA, 201 bp, Homo sapiens
caccccgcagatcctggccccaaagccttaccttggtgctagcagctgcctctgttttgaaagctcttcccctgagttctccatgaccaagtcctcacccytttcattgcagatgcttgcgtgttcccatcactgagttctaatttctctaatggaagtatcattctaaagttatcctttgtccttcttttattcttgttc

SEQ ID NO: 47980 - DNA, 201 bp, Homo sapiens
ttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggc

SEQ ID NO: 47981 - DNA, 201 bp, Homo sapiens
gttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatgggg

SEQ ID NO: 47982 - DNA, 201 bp, Homo sapiens
agttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggg

SEQ ID NO: 47983 - DNA, 201 bp, Homo sapiens
tagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatgg

SEQ ID NO: 47984 - DNA, 201 bp, Homo sapiens
cttgcatttcatacttaagcaacatatttcaatgcagagaaggtttatagtgtggtggggatttgagggtagcttttcaattctgctctgtttgatttttsactgatgaccccagacacagagatttggcctggcagaacctgcccttagttctatagaggacaccttccccatacttttttctccttttcctcttcctct

SEQ ID NO: 47985 - DNA, 201 bp, Homo sapiens
gtgatattttggaaggaatttttttttttttctgagcagtaggtctcaacaatgggattaaaatattcagtaaagcatgctgtaaacagatgtgctgttakacaggctttttaaaagtagcactgcaagagtaatttaggatgattatttagggccctaggattttcagaatggtcaatgagcattggcttcaactaaaag

SEQ ID NO: 47986 - DNA, 201 bp, Homo sapiens
atttcagcaattcagtcacatcttcaggctctatttctaattatagttgtctttcagtttccaccacatctgccgttacttcctctactgaagtcataaasccctgaaagtcatctatgaaggctagaatcaacttcttccaaactccttttaatgttgacactttgacctccttccatgaatcatgaatatttttaatgg

SEQ ID NO: 47987 - DNA, 201 bp, Homo sapiens
atccatctcaagaaaccactttcttggctcatctataagaagcaactcctcatctgttcaagttttatcatgagatttcagcaattcagtcacatcttcargctctatttctaattatagttgtctttcagtttccaccacatctgccgttacttcctctactgaagtcataaacccctgaaagtcatctatgaaggctag

SEQ ID NO: 47988 - DNA, 201 bp, Homo sapiens
ctggtgagaaaacatgtaaaagatacataatataatgtctattaaaattataattataaatgcagtcataaatatacacatgtatatttcatttatgttaytgatatccatctgtttcatcagctcattttaaaggtttctttaatagctgaaaaatattctgtagtacaaatatttataatcaaactgttatagctattc

SEQ ID NO: 47989 - DNA, 201 bp, Homo sapiens
gccactctcactaaattagaatgtaagctcctcaaggaaagaaactatctgttttgtcatctgctgtggtcccgcacccagcctgccgtgtagtgcatgaycaaataactgatgaatgaatgaataaatggtcgatgcttgacaacaaagacaatcagaatctctgagtcatgttgttgcaaagcacttgcggccaggcat

SEQ ID NO: 47990 - DNA, 201 bp, Homo sapiens
tctttcttctcatttgatgattagaaattttttagctgtccaaatccagtccttgtcttatctcagctatgcagagtggcatggctggttcaagctttcartgaagaaacagatgtatgaggccaaatcttgcaaaatgccagaagagtgtatttgggcagaataccaaaatgagttcgggggcctatatggaactgcggg

SEQ ID NO: 47991 - DNA, 201 bp, Homo sapiens
cacagtatacattgcatacgattcttccatgactatgtacttgtcatgagttattcctcatcattctaaaatttgacctcaaagctgagcaaagtctagawgaaatgaggttctagtttttataataatgttcaatagtttttcctatacgtcactctttcagtgtggggaggaatggtgacttttcagttgcttctgaat

SEQ ID NO: 47992 - DNA, 201 bp, Homo sapiens
ggacattgacgctcctccatcactctcacctccagtcctctcttcccacacaactcttagttcatacagtggtcacagtacctccatgctgtattgtatcmtatctactctcctgtttgtctcttgctgcagactcctctaaggcagggaccacttttcaccacctttccatgcccctggatccttgttcagatttggctt

SEQ ID NO: 47993 - DNA, 201 bp, Homo sapiens
ctaaaaattcagccctattaagtttgttggtacatcacctggatttttattaaagtagtaaaaatgttccgcaaagtgactttgaagtaacagtacgattmtgagccacgttaaagaaatgttaaggtggagagctctgttgctttcaaatactagtataattctggccaaatatccctgtttaaaatgatctgagcactt

SEQ ID NO: 47994 - DNA, 201 bp, Homo sapiens
ggaactgcattaataatgattgttgaaaaaatgaataaatgattgttgaatgaataaccgaatgaatgccaccagggaaaattattgtctccatttcattktagggcctgaactttaggagaataaagttatcctaaagagagctgttggaacctgcctttctaaccagcttcctattttctagaaaaggggtcactgttt

SEQ ID NO: 47995 - DNA, 201 bp, Homo sapiens
gctatgccatgtgaaagttatttgcagtttgtgaagtcctgtggaaaggttgttgctgtttttctgctggggctgttttaagatgaaacatggtatggggraaagatgcaagctctgggtcccattctcaggagtttccacgagcaggaacctcacatcactgccattggcctgtaatataattttggcctgagtctatct

SEQ ID NO: 47996 - DNA, 201 bp, Homo sapiens
acagagctgattatgttggtcctgttgtttgtgtttttcttcccatttaagaacgtacatttgaaggtgcagtcttgaaattcttgatatggatggcagayacttgtaatgagagaggaattagcagaaaatcacacctcatttcaataaatcttcaccccttaaggcagcctggtgcccttcctgcattggcctatggaa

SEQ ID NO: 47997 - DNA, 201 bp, Homo sapiens
atctgtgtcttctctcttttatcttggttagtttaggtaagatttgtcaattttgttgacattttcaaagagcaaatttttggtcttattgattttctctratgcatttgtaccttttttgtgtacttcaaagaagccattggcaaattaaatatgactggacaacttttcacataagtaactaggaaaggtaaggaaaga

SEQ ID NO: 47998 - DNA, 201 bp, Homo sapiens
gtctaactgttggcataaaattattcatagcatttccttataatcatttaaatttctgtaagatcagtggtggtatgccctttgttatttattaatttggygatctgtgtcttctctcttttatcttggttagtttaggtaagatttgtcaattttgttgacattttcaaagagcaaatttttggtcttattgattttctc

SEQ ID NO: 47999 - DNA, 201 bp, Homo sapiens
gtgtgcgtgtgtgtgtgtgtgtgtgtgtgtgtgtgtgtgtgtgtgttgtgaagatacatttagtttgagtccctatgaagcgaggagaaaaggtcttgacraacaacagttcaatagctcctgccaatatgtgcaatgcaattctttttagtgagtgaattaggcttgataagaactacattaaagcttctgttggaagag

SEQ ID NO: 48000 - DNA, 201 bp, Homo sapiens
gctatgtgtgtatgtgtatgtgtgtgcgtgtgtgtgtgtgtgtgtgtgtgtgtgtgtgtgtgtgtgttgtgaagatacatttagtttgagtccctatgaarcgaggagaaaaggtcttgacgaacaacagttcaatagctcctgccaatatgtgcaatgcaattctttttagtgagtgaattaggcttgataagaactaca

SEQ ID NO: 48001 - DNA, 201 bp, Homo sapiens
gtgttctctttggtgaaatgtctaactatgtcttttgcctattttttgttttgttttgttttacaggccattttcaggactttaacttttgcccattttcyttcttttttttttttttttttttttttttttgagacagagtctcactctgttgcccaggctggagtccagtggtgtgacctcggctcaccacaacctccg

SEQ ID NO: 48002 - DNA, 201 bp, Homo sapiens
gggctgaccccacaagcctgtgagccgtaagcggtgtgattcgctaacagttgaatggcactggctatgtgtgtatgtgtatgtgtgtgcgtgtgtgtgtrtgtgtgtgtgtgtgtgtgtgtgtgtgtgttgtgaagatacatttagtttgagtccctatgaagcgaggagaaaaggtcttgacgaacaacagttcaatag

SEQ ID NO: 48003 - DNA, 201 bp, Homo sapiens
acatttttaagtctaaactgaaaggaaagctatgctcagtcatgtaatgctggcaaccatgctgcgcaaacatgggtcccctacatcaggggtccccaacycctgggccacggacggccccaacccctgggccacaacatcagattgttattggagcacaaatcctattgtgaactgcacacacaagggatctaggcggca

SEQ ID NO: 48004 - DNA, 201 bp, Homo sapiens
ggtgggaggcactctggcatccactgagatgttagtgaacccatctggtcttcatttgtttccttacaagctcaagggtgattgagtttgccagccttctstccactgttttagtcttttcccaaagcatataaggactcttctcttgcttccttgctgaactgggcttggagatgcagctcagagagaagacatgccctt

SEQ ID NO: 48005 - DNA, 201 bp, Homo sapiens
atgagtacacagcacatgtatactgattaatttctttcttttttccttcttttgatggagcaagactgtaacagaagcctgagagtgaggaagggctttgscaactattactgtagacacagtagtttactcaattttatgaactcttagtcctgggctggaattcacgcctctgctggaattgcacagacaaaacgtgct

SEQ ID NO: 48006 - DNA, 201 bp, Homo sapiens
attgcataagccaaactccagtgtctttagaaagcagactatgttattgtttcttgaaaagccattcttcctccagattcagatgttggtggtcaaatgartatctctacagaaaatctctctgcttctccgaattaaactattttcaattatcttgtcagatgaacaaatgtgttttgcattttctttcattttttaaag

SEQ ID NO: 48007 - DNA, 201 bp, Homo sapiens
cctataactgtagtgcaacaataccaagagcaggaagttcatgtgggcacaatactattaaccagacctcacgaagtctccacccatttttgtgtgttttstgtgtgtgtgtgtgtgtgtgtgtgtgtgtgtgtgtgtgtgtgtggtcctacgcatttgatcacacgtacagatttgtatgaccaccaccaccatcatgat

SEQ ID NO: 48008 - DNA, 201 bp, Homo sapiens
tttttttttttttttttttttgctttttccatccccatgattgttccaacagaaggagaaaagatgtaataaacctttaccgggcaccgtctgcgtccagrcactctactcggccctgggggtgcagagcacaccaccccagccttaggcatgaaaaacactgtgtaccgagaagcccagcccctggaatccagcatgctg

SEQ ID NO: 48009 - DNA, 201 bp, Homo sapiens
gttccatcttaaagacatggctttgccagtctgttgtgggtgtgctataccatatcagacagagaaataaggatgtgtgtgaaggtatgaatctccggttkacgaactctagtgtgcaaataagacaactgtctgtcttttaacatggtacgcacatttctgttttgatcaccctttctaccagttggtgaaaactttagc

SEQ ID NO: 48010 - DNA, 201 bp, Homo sapiens
caaaaatagttcatattttataactgtcttgcagcatggggtataagtgtaatcattgtaaaaatgaaacctaatcattgtaaaaatgaaacctaatcatkgtaaaaatgaaaagagtgcctcaaaacatctgaagttcttagcagagggcagcctgtcttcagtgggcacttttggatggaggcaggactagggtatcag

SEQ ID NO: 48011 - DNA, 201 bp, Homo sapiens
ccctgagctacattatattaaaagggctactcctcatatgttcaccacagcactattcacaatagcaaggtcatggaaccaacctaagtgtacatcaacgrttgactggttaaagaaaaggtggtgtatacacaggtgaaatactatgcagccatagaaaagaatgaaatcctgtcctttgcagcaacatgggtggagctg

SEQ ID NO: 48012 - DNA, 201 bp, Homo sapiens
gagtgttcttggatctcatgcaagaaagaattcagggcgagtccatagagtaaagtgaaagcaagtttattaagaaagtaaaggaggccgggcgcggtggytcacgcctgtaatcccagcactttgggaggccgaggcgggtggatcatgaggtcaggagatcgagaccatcctggctaacaaggtgaaaccccgtctcta

SEQ ID NO: 48013 - DNA, 201 bp, Homo sapiens
gttgctaagcctctctgattcttggttacctcaaccttaaaacaaggatgatacccacttcatcaggttgtcatgagtcacaaaaataaatgtagtgatgytcttaaagggtttagcaccaagctgggcccaaggaagcattctgtgtgtctattgaccaacttttacctatcctgacaccaaggagcttagagtttagtg

SEQ ID NO: 48014 - DNA, 201 bp, Homo sapiens
caccatctgtgttgcatgtgtgctttacctttgctgtcctccttactttgaaataaatcccacccactacggtgtcccatttcagaaactctaaaatactyacttgaatccctggaatggattcatccaaccctgttcggttttcttccttccagtgtgctattctatagtagaaacagtgccaggccatgggatttagac

SEQ ID NO: 48015 - DNA, 201 bp, Homo sapiens
ctggttcctgcgtccatctcttgtcacatagctcaatttgcgtgtgccatcaatttcctgctgggattaagatacctggcagtgcagggtttcctgggatrtgggacctctaaaaccgaaacctagacagtcccagtaaatcaggaggattaatctccctaactggaacccagccctgtctcctcccttggccctgctcca

SEQ ID NO: 48016 - DNA, 201 bp, Homo sapiens
gtcaggagaatgggttcttccatcactcagtccaggtttcctaccaaatagaatgaatgagacaggtagtactgcaaattcatagtttacttacgttaatsataatgtcaaacatgtcaacagcatcctggagagccccccaagtttcctgtccacttgtccactgtacagccacctacccacgctttacgtactacccag

SEQ ID NO: 48017 - DNA, 201 bp, Homo sapiens
ttttgtcaccattgatgctatattactgataatgatcaatagataggttactggaaaggggtccagatccagatcccaagagagtgttcttggatctcatrcaagaaagaattcagggcgagtccatagagtaaagtgaaagcaagtttattaagaaagtaaaggaggccgggcgcggtggctcacgcctgtaatcccagc

SEQ ID NO: 48018 - DNA, 201 bp, Homo sapiens
gcaacggctcccccgagggcgccccgcacaagaccaagccctttgtgtcagcttcagtttgccctcacagctaccccagaacaccactgggactgtccccragtcacagaggaggaagtagaaacacagagaagtagcttgccaggctcactgttagaacccaggtcctttcctctccagagtccatgactctaacactca

SEQ ID NO: 48019 - DNA, 201 bp, Homo sapiens
ctctctgccaccatctgtgttgcatgtgtgctttacctttgctgtcctccttactttgaaataaatcccacccactacggtgtcccatttcagaaactctraaatacttacttgaatccctggaatggattcatccaaccctgttcggttttcttccttccagtgtgctattctatagtagaaacagtgccaggccatggg

SEQ ID NO: 48020 - DNA, 201 bp, Homo sapiens
cagtaaatcaggaggattaatctccctaactggaacccagccctgtctcctcccttggccctgctccaattaccttcattctggccctcagtacccccaasttggataacggctttgctggccagtgactaaatacagtggccagatggggtctgtggccatcgccatgtgcacctctctgctagggcttatttgcccttg

SEQ ID NO: 48021 - DNA, 201 bp, Homo sapiens
cagatcaggtgaactatcttaacaaataccaaaagtaaatgtctctatatggagggtaagatgtagacaaactcagacacaataaagaaatttaaagaggkgagtgggcagggcacagtggctcatgcctgtaatcccagcactttgggagactgaggtgggtggattggataaggctgggagtttgagaccagcctaggc

SEQ ID NO: 48022 - DNA, 201 bp, Homo sapiens
tgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctc

SEQ ID NO: 48023 - DNA, 201 bp, Homo sapiens
ttgataccaacccagaccgcctctgtgtgaattaaatttacaacagcgctgtatcagagcatctgtcaatgctgactggaagcccaaagacctccagatgrttggttctgagactccaggagaggctgggaacactcggaggggctctggatggtggccaggcgagggtggtaggtgaattgctgtctgtcctgggtcgcc

SEQ ID NO: 48024 - DNA, 201 bp, Homo sapiens
ggatatctgtctcaaagttttcaaagaaaggacattcagtgatctgttgagagattcagaggttctccttttctctggtggtgctctatcagggacagatwggtccctaagacttagcagcaaaagggactctccctgcagaagcatgtacatgatgtgagtaggtgtgcccacagcccagggttcatactctggggcttc

SEQ ID NO: 48025 - DNA, 201 bp, Homo sapiens
actgaatctgtattcagatacaccgattttgtttgcttttagtggcaagcaggtttagcaggttagagaagagggtaatgttttgatactgtggtgaagcygaggagggcgatgtccttagtctgaggagaccagcatgaagccacctttattgccctaaaatgtctctgccttcaaacaagtgggctaaagagggagggc

SEQ ID NO: 48026 - DNA, 201 bp, Homo sapiens
gccattaagctgtttctgtggtttttctagcacgacttttatggtatggcaagtctcaaaaaaagaacttgtcgggaaaccatttctgaccattgctttcwgcttaattaaccagtattagcaagaatgtaaaaggacagatcaggtgaactatcttaacaaataccaaaagtaaatgtctctatatggagggtaagatgt

SEQ ID NO: 48027 - DNA, 201 bp, Homo sapiens
ttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcct

SEQ ID NO: 48028 - DNA, 201 bp, Homo sapiens
tgggttctgtgttgagtgcttaaatggatatcttatttaataataacaggaacccttggaagtgagcacaggtttgattctcactttgcagataaagaaamtgaggcccagaaaggtgcccaaggaagcagagttatttaggacctgacagaggtaggattccaacctgggcagtctatcaccagagtccttgtttaatca

SEQ ID NO: 48029 - DNA, 201 bp, Homo sapiens
ctgaatctgtattcagatacaccgattttgtttgcttttagtggcaagcaggtttagcaggttagagaagagggtaatgttttgatactgtggtgaagctraggagggcgatgtccttagtctgaggagaccagcatgaagccacctttattgccctaaaatgtctctgccttcaaacaagtgggctaaagagggagggcc

SEQ ID NO: 48030 - DNA, 201 bp, Homo sapiens
tttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcc

SEQ ID NO: 48031 - DNA, 201 bp, Homo sapiens
ttgtgatccgcctgcctcagtcccccaaagtgctgggattacaggcgtgaggcaccgcacctggccaataaagtatttttaagcctctcagattttagaastttgttacagcagcattatgaaattgatacacgggggcatgttttcctgaaatcagagcctgagaggagaaccaggtacaggtagttttctttgggaggt

SEQ ID NO: 48032 - DNA, 201 bp, Homo sapiens
gtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtc

SEQ ID NO: 48033 - DNA, 201 bp, Homo sapiens
atgatgtttgcttcccatactcatctccaactggctcacacattccttcaccagatagtgtgggaaggagtccatctttctgcagttggctaatccaggtrttggcatggaagttttagctctggtctgagagttctagtcatggacaattgtccatgtctattggaatgaataattttccaatggacatggacagttgtc

SEQ ID NO: 48034 - DNA, 201 bp, Homo sapiens
cagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtg

SEQ ID NO: 48035 - DNA, 201 bp, Homo sapiens
cccgcactggcacaaaagcaacttgtttccaagattcaggacttaaagaaatggctgtgggttggtctacgaaaaccattatgctgcatcctcccagtccygagagattctgaagagaagcaggccctggcttcagagttgaagaaatgataccttccctcctttgcctcatagtctcattcatgatgtttgcttcccata

SEQ ID NO: 48036 - DNA, 201 bp, Homo sapiens
tcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagt

SEQ ID NO: 48037 - DNA, 201 bp, Homo sapiens
gtagaataatttaaaccagtttttcctactttggttccttggaggctgattcttctgcctgaattcctctcacagaacatataaaccccttttacctccckcactggcacaaaagcaacttgtttccaagattcaggacttaaagaaatggctgtgggttggtctacgaaaaccattatgctgcatcctcccagtcctgag

SEQ ID NO: 48038 - DNA, 201 bp, Homo sapiens
tcttttgttgtcatttcaacaatgttcacagtatcttcccaaggaatagaatccatctcaagaaaccactttcttggctcatctataagaagcaactcctyatctgttcaagttttatcatgagatttcagcaattcagtcacatcttcaggctctatttctaattatagttgtctttcagtttccaccacatctgccgtt

SEQ ID NO: 48039 - DNA, 201 bp, Homo sapiens
gaaaagggagggaaaaaaaaaatcactccacccctcctgtccaaatgaaaaagcatttaattgaatgttctttatagaggtgaaaaaataccctgtggagktcccagtgtttcattatccgattgagttcggtacctcaagtttcaaagaccgttctcctgaatggttattctcatttccatgtcagtctgccgtgtgctt

SEQ ID NO: 48040 - DNA, 201 bp, Homo sapiens
gcatgtgatgctgtttgatagcattttacccacagtagaacttctttcaaaattggagtctaccctctcaagccctgctactgctttatcaactggtttargtactgttttaaatcttttgttgtcatttcaacaatgttcacagtatcttcccaaggaatagaatccatctcaagaaaccactttcttggctcatctata

SEQ ID NO: 48041 - DNA, 201 bp, Homo sapiens
aaggtgaattggcagtttctaaaaagaagaccacaatgaagttgtctgcatcaactgactgtttcttttacaaaaactttctgtaaaaattttgtatagcwtgtgatgctgtttgatagcattttacccacagtagaacttctttcaaaattggagtctaccctctcaagccctgctactgctttatcaactggtttaggt

SEQ ID NO: 48042 - DNA, 201 bp, Homo sapiens
ttgcttacttttagttgagtgtaaatcaaatctcttgacttatttagtcttgtccttcttgcaagaatacccattacggcatgggtctgatgggttagctrtttgttccagtaagcattaggaacttgatagaagcagtatgccctcatcttacctaaatgtctccccatgcaccgctgacagagacccactctgggaaat

SEQ ID NO: 48043 - DNA, 201 bp, Homo sapiens
agaataaactttttttcaaatgttgtttcaatttaattcagtaagcattggagatgtattttcatcagaaccctctcaattttaaggggttaatgtctaaytcaaatgggaaatgtatagttcacttaactgaaaaggtccagggagttgagttttaggcaaaactgaatacaggggcttgaatcttgttaaatggtttct

SEQ ID NO: 48044 - DNA, 201 bp, Homo sapiens
aacctgggaggcagaggttgcagtgagccaagatcacgccactgcactccagcctgggcaacagagagagactctgtctcaaaaaaaaaaaaaaaaaaaaaggtcttactgtaccatatgtcctcacttaacttcattgctaggttcttgaaaactgtgactttcagggaaatgaaatataatgaaagcaattttactgta

SEQ ID NO: 48045 - DNA, 201 bp, Homo sapiens
tatctaagactgggcaatttacaaaagaggtttaacagactcacagtgctggggaggcctggcaatcatggtggaaggtgaaaggcacatctcacatggcrgcagacaagagaagagaactcgtgcagggaaactcccctttataaacatcatcagatctcgtgagacgatcacaagaacagcatgggaaagacccagccc

SEQ ID NO: 48046 - DNA, 201 bp, Homo sapiens
cagaaagtgccaagccctgaggtaggtggggcacagtgtagtgttgtattagtccattttcacgctgctgataaagatatatctaagactgggcaatttayaaaagaggtttaacagactcacagtgctggggaggcctggcaatcatggtggaaggtgaaaggcacatctcacatggcggcagacaagagaagagaactc

SEQ ID NO: 48047 - DNA, 201 bp, Homo sapiens
tccccttctattattggttgagtccctcttctgacgagtcacaggtattcccagtaagcagcctctgtagggcacaggtgagtgatgatgggattcaccgstgacagctctgctgtagatttccccgggcaggtgacctctgaactgccacctgaagtagaagtaggaagtaaccagcaactggggtggggatggtgaaga

SEQ ID NO: 48048 - DNA, 201 bp, Homo sapiens
gaggcggaggttgcagtggattgagatcacaccactgcactccagcctgggcgacagagtgagactttgcctaaaaaaaaaaaaaaaaaaagagcccccccactcatccacacttactctcttacaatcctggaaggcaacttgtttcaatgggctagaggcaagttgttggctagaggagattccattgctggactcttt

SEQ ID NO: 48049 - DNA, 201 bp, Homo sapiens
ttgaaaccaggaggcggaggttgcagtggattgagatcacaccactgcactccagcctgggcgacagagtgagactttgcctaaaaaaaaaaaaaaaaaaagagcccccccactcatccacacttactctcttacaatcctggaaggcaacttgtttcaatgggctagaggcaagttgttggctagaggagattccattgc

SEQ ID NO: 48050 - DNA, 201 bp, Homo sapiens
atattttttaaaacagcttgagtttattcttgtaaggctgccattgggtctgagaccccagaggagcagtgcgctgccttgcagttactccgcagtgggcmagacaggcatgttttgctctgggaagagttgctgaacacctgtctgagcaagggactctttgtggctgtctggtcgttatgtacaccacttggtcctacc

SEQ ID NO: 48051 - DNA, 201 bp, Homo sapiens
gaagggttaagtaagatagatgaggtcactgccccttggagctcacattctaagttgtagagctggccagggaaggaggcagacttcagagagaccatccrgagtggcttctctagggaacacagaggccttggtgttggagctgagatcctacaaagcacaagacacacatgagaaaatctaagacttatccgatgaggc

SEQ ID NO: 48052 - DNA, 201 bp, Homo sapiens
tttgggaggctgaggcaggcagatcacgaggtcaggagttcaagaccagcctgaccagcatggtgataccctgtccctactaaaagtacaaatattagccrggcatggtgatgggcgcctgtaatcccagctactcaggaggctgaggcaggagaatcgctggaacccgggaggcggaggttgcagtgagccgagattgcg

SEQ ID NO: 48053 - DNA, 201 bp, Homo sapiens
cacatgtgtgaagatggatagtcaaaagagactgtcatgtaaacaagtaatgcaattggaaaggtgctgtgcaaagtagctgagagaatcacagggccctrtgagagactggaaggcacccagatgatccaaggtgatggccaaacctacaaacaggggagccagggacaagagcagggatgattgaatctagagtcagac

SEQ ID NO: 48054 - DNA, 201 bp, Homo sapiens
tcttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaa

SEQ ID NO: 48055 - DNA, 201 bp, Homo sapiens
aggatctttgcccaacaggaaggttggagaatgaggcatgcatctaagaaaaaaatgcaagcaaaataaaaattcccacatattgccttaattgtctttasagaaggaaatatcccagggcaagaatcatcagggcatgctctgcgccctgcatttgatttcatgttttcaggagcacccctcaaggtctggagaagcaca

SEQ ID NO: 48056 - DNA, 201 bp, Homo sapiens
atggatcagtgatcctcattctggccaccagcagaggtgccttgctacacgccaccaccttggggcaggtgccactggacagtagcctgcgtggacaactraagctgtcccttctccactctccccagttagaagtatctgtgacttcagatgcagggagattttgaagctatcccattagaaagtcaatagtctgcctac

SEQ ID NO: 48057 - DNA, 201 bp, Homo sapiens
gaataaatctgagttgttttaatccactaggtctgtggtcttttgcatagcagacacaggaacctgagatattaaccttcatctactttctcttccaatcyatgagggttcccccagcggactccctctataatcagtacggtccattcagcattcatccatgcacaccccaagttttccactctaggggtgccgtgtgtg

SEQ ID NO: 48058 - DNA, 201 bp, Homo sapiens
acccagatgatccaaggtgatggccaaacctacaaacaggggagccagggacaagagcagggatgattgaatctagagtcagactgatcgtacaccctcartcttccagttggatgtccttggctgggtcagccattctctctgtgactcagcttccccacctataaaatcaggataatttagctcatacttaaagggtag

SEQ ID NO: 48059 - DNA, 201 bp, Homo sapiens
gtgactgccacctctaagcactcaataaacagggctgtttatgcttgttattcggaacgggagagggctgcaactcgggcacctgaggcacaatgggaagwgctggagctggaaaaggaatgagtgatggacagactcgatcatcgttgtgtagcatttgaaggaggctgtctctggtgggctgaactacgatgaatgtta

SEQ ID NO: 48060 - DNA, 201 bp, Homo sapiens
taagaataaatctgagttgttttaatccactaggtctgtggtcttttgcatagcagacacaggaacctgagatattaaccttcatctactttctcttccartctatgagggttcccccagcggactccctctataatcagtacggtccattcagcattcatccatgcacaccccaagttttccactctaggggtgccgtgt

SEQ ID NO: 48061 - DNA, 201 bp, Homo sapiens
atggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccagg

SEQ ID NO: 48062 - DNA, 201 bp, Homo sapiens
gaaattgactcaccatctctaaaccagagtttccttgtcttgggaattaacaggaagattgtaatgagttaaagttcatgtgtgaagcgcttagcaccgtsactgccacctctaagcactcaataaacagggctgtttatgcttgttattcggaacgggagagggctgcaactcgggcacctgaggcacaatgggaagtgc

SEQ ID NO: 48063 - DNA, 201 bp, Homo sapiens
aaccccatctctactaaaaaaaaaatatacctcccctccacaaaaaagaaagatacatcctatagcagcatagaaaatggacgcggtgatggcaagatgtsaggagggaggcattaggcagctgccgcagaaatacaggtaagagaaaagagaggaccaagccaaggtagtgaagttagttggggaaaagtcagcctgcag

SEQ ID NO: 48064 - DNA, 201 bp, Homo sapiens
cctcattttgaaattaagaggtgccttcaactttacttggtggcttttctctatacattgtacctttatttttactttggaaagttgtatgcagtgccccraatgctgacttgtaaactgatttcaacaccatcctcattccttttggctctctgagaaatgttcttttttaatgaatatgatagcaagacttacttatta

SEQ ID NO: 48065 - DNA, 201 bp, Homo sapiens
ctttccctgactgcaagcttggtcttgggcaaaagtgccttatgactgctagaaaagctaagagcatctcaaagttcaagtgctggcatggaacttgggcyatagcattgcatgctggccttctgcattcctcttggtgcctctttttaagagggatgttggcaaattcaggtgtgttcaagggaggcaacctggaaaaaa

SEQ ID NO: 48066 - DNA, 201 bp, Homo sapiens
cccccagatgacatttgtcagtgtctagaacatttcagggggtgcgaggggaatgccactggcatctagggggcagaggcccgggttgctggtaaagttcycacaatgcactggacagcctctctgcaacaagaattatccaaccccagatgtcaggggggacaattgaagttgccgcttctccactctccccaattagaa

SEQ ID NO: 48067 - DNA, 201 bp, Homo sapiens
gactctgacttgtgggactataagaataaatctgagttgttttaatccactaggtctgtggtcttttgcatagcagacacaggaacctgagatattaaccytcatctactttctcttccaatctatgagggttcccccagcggactccctctataatcagtacggtccattcagcattcatccatgcacaccccaagtttt

SEQ ID NO: 48068 - DNA, 201 bp, Homo sapiens
cctgttctcacgggctgaccccacaagcctgtgagccgtaagcggtgtgattcgctaacagttgaatggcactggctatgtgtgtatgtgtatgtgtgtgygtgtgtgtgtgtgtgtgtgtgtgtgtgtgtgtgtgtgtgttgtgaagatacatttagtttgagtccctatgaagcgaggagaaaaggtcttgacgaacaa

SEQ ID NO: 48069 - DNA, 201 bp, Homo sapiens
tctcagttcctgaccttatgtctttctcagttcattatttccacctctctctagtcattggatttgtagaaagaacagagatatttaagaaacattattcrttccttcagagtcttggatttctccaaatagtccaaaaaatggcctatttttagatgattgaattatactagaaaggtggtgatcttgcccccagatgac

SEQ ID NO: 48070 - DNA, 201 bp, Homo sapiens
atcttaattttagactctgacttgtgggactataagaataaatctgagttgttttaatccactaggtctgtggtcttttgcatagcagacacaggaacctragatattaaccttcatctactttctcttccaatctatgagggttcccccagcggactccctctataatcagtacggtccattcagcattcatccatgcac

SEQ ID NO: 48071 - DNA, 201 bp, Homo sapiens
aatgatctcaaaatagaaagtgtaatgagagaaaaagctctatttaagtgttttattaggtaccagacatcatgttaagtattttacatgaattatcacgytatccttacaagaaaattgtgagttctagcattgccccattttaaagagaaggcacctgaggctcttagaaattaagggatttgcacagttacccagctg

SEQ ID NO: 48072 - DNA, 201 bp, Homo sapiens
ctgtctcagagtctatcctcgaccacagggtttaagtccttgatgtgcacactgggccctggagagaaggtgcctgttctcacgggctgaccccacaagcytgtgagccgtaagcggtgtgattcgctaacagttgaatggcactggctatgtgtgtatgtgtatgtgtgtgcgtgtgtgtgtgtgtgtgtgtgtgtgtgt

SEQ ID NO: 48073 - DNA, 201 bp, Homo sapiens
caaagaaacaaattctgccctgaagattctaaaaggaacacagccctgccaacatcttaattttagactctgacttgtgggactataagaataaatctgasttgttttaatccactaggtctgtggtcttttgcatagcagacacaggaacctgagatattaaccttcatctactttctcttccaatctatgagggttccc

SEQ ID NO: 48074 - DNA, 201 bp, Homo sapiens
cattataatggcattagccagaggaggtagcatggtggttcaggtttctggaagtggggttgaggcagtcctttcactttcttaactgaaattccccaacrcccttggcttactcacccctcagcatgctttgttctctttctgtctttttctgtctaggttctctatcatgagtgtcctcttctctgaattcatagcctt

SEQ ID NO: 48075 - DNA, 201 bp, Homo sapiens
cttcaaatgtgtttttcatttgcttgggttcaacctcattataatggcattagccagaggaggtagcatggtggttcaggtttctggaagtggggttgagscagtcctttcactttcttaactgaaattccccaacgcccttggcttactcacccctcagcatgctttgttctctttctgtctttttctgtctaggttctc

SEQ ID NO: 48076 - DNA, 201 bp, Homo sapiens
gtgacctatcaatccattaaagctaagaccgtggctagtctcttagtatgaccgcaatttagttgaaacctggcttcagagaaatgggccaagggcatagmctacctgtgttttttgttgttgttgttgttgtttttggttttttgtttgtttgtcagttgtgagacctctctaaacctcgatttcttcatccgccacagt

SEQ ID NO: 48077 - DNA, 201 bp, Homo sapiens
tggagttattcacagatggctaagttaaatgcagccctcatagcactaaggcatttcaggggcgactaaacaagtggcccatgaaatggaggcaccagaarcctctggaagcggcatcagtgcatcacccagtgaagccattgtgtcgcctgttagtaatgagcatttgcaagggcagcatggggaatttcaatcaacctg

SEQ ID NO: 48078 - DNA, 201 bp, Homo sapiens
gttcttcaaatgtgtttttcatttgcttgggttcaacctcattataatggcattagccagaggaggtagcatggtggttcaggtttctggaagtggggttraggcagtcctttcactttcttaactgaaattccccaacgcccttggcttactcacccctcagcatgctttgttctctttctgtctttttctgtctaggtt

SEQ ID NO: 48079 - DNA, 201 bp, Homo sapiens
tcattccagactacaaagtgccaagcgctaattgatttgtaagaaagtccacatgaaatgcctggcactctcccaaaggcacccatgggcttggagggacracagcattggactgttatgcgaggaaataattcttgcttgcccgcctgggatggggtgacgttctggccaggaagcagaagcagacttgactttgggcag

SEQ ID NO: 48080 - DNA, 201 bp, Homo sapiens
tgcaagtcccaattcacaattcagtacaattctgggggttctggactccctgaggaccatttataagttctctccaagtcattgaccccaggtttagttgsccctctagactataaggccccctagatagaaggcaagtgtcatatgccactgcatccccaactctgaggacaaagcctggtggcaggtggaccttcattc

SEQ ID NO: 48081 - DNA, 201 bp, Homo sapiens
gtgcttatggagaacattttaggagcacgcctattcttaaagtgaattccgttatctttcctcatgctaagaatggaagggggcttaggctgagccaagtsacatgttgcaagcagttgtatgatgtcaccaagtgctggccgttggtgtctcagccacagtgggaagctcagcacatggattaagggccaacctggggcg

SEQ ID NO: 48082 - DNA, 201 bp, Homo sapiens
acccagctgtgagggcctgcaggggcggctacccgaggaagtgcgggaggctagtcccagaggatgggaacaaatgctgtgtaatcaggaaccacagagarcccctggcccaaaggtgaaccttgtgaaccccacagaaaatagagctgcagtgtgtctctgcagctggtctaagagttctagcatttacagattggccta

SEQ ID NO: 48083 - DNA, 201 bp, Homo sapiens
tactcattcaatcatttagcaccctttctcgcttgcttggaaaatacaaggtaaaaaacacactagcctactatttgatatttgtgcgtgggtgtgtgtgkggggcgtcatatatccctcttagcatctgataaaaaaaagatcaattcattacccagaaatatgtatctgcatgtgtgcaagtcccaattcacaattcag

SEQ ID NO: 48084 - DNA, 201 bp, Homo sapiens
tactcaataaatagtggagattgtaactcttactaatctggtggtggtgtcctcctcaaagtaaaataacaaggcaaaggcttcaaatcaagctgcatttkaaaagttgcattttttggtatcaaagtcctccaagatggatttatttttctattttatgattccgtaaaaggcttcctataagacttgtttgttgggggt

SEQ ID NO: 48085 - DNA, 201 bp, Homo sapiens
tgcagcagggcctgcccatcctaatggccactgtcacctcctccctgagggggctccttccatggtcaacatgggaagccttctccccaaccccaaccccrctgaaacttaggaacgcacttccagctaagtccaactcctgggccacgtcctgcctcgcatgaggaaatgcacttctcaggcaccactgctcctcggctg

SEQ ID NO: 48086 - DNA, 201 bp, Homo sapiens
tccacagagcatctcctcactggacaggcattgtgggcacgctcctgcggaggaagaatcagggtggtgaggcaattagtaggtgttctacaatcctgacrtctttctcagaccagcccccatctctgtctattggcgagatttcttctttagcttctgctcactatgacatgaaggacttcttcttacctagatattctg

SEQ ID NO: 48087 - DNA, 201 bp, Homo sapiens
actgttctcagtgttctgttagcaattattaccattattttcacttagatttgtcattatgtacacacagctgcctgtggacatgtgcaggcacatccatrtaatatattaatataattaggaaagtgggggcattcagtactttctaggtatacacatgaacagacacacaaatatacataggacgtgcagatgtaatgg

SEQ ID NO: 48088 - DNA, 201 bp, Homo sapiens
aaatggcactttagaccccttctatagtttccagaaatgtagagaggatcacgttgctttagtgtcttgccccaagtgctattaatatccctgtccctaaragattgatttttattatcggtagaaatacttaatagaaatgaaatctacgctctcggtcatagatagctggcataaaaattaaacaaaacactgtgaagc

SEQ ID NO: 48089 - DNA, 201 bp, Homo sapiens
ggtatacacatgaacagacacacaaatatacataggacgtgcagatgtaatgggatttaatgttcccaaactcttgcagtcataaccgtctgcccagagtyaatcttagatagagagccagcaccgtgaggccaagagaatgtcttgctcctggatctggctggtgttcctgagagaaggacaagacgccgcagtgttcct

SEQ ID NO: 48090 - DNA, 201 bp, Homo sapiens
cctctgaggagtctgttatgcggcaacacatactcagatgtggacagcagtgagcacgctgcctggaaagggggaacagcaccgcgggcaggcttcagagycacacaccacgtctctgtctcagagtctatcctcgaccacagggtttaagtccttgatgtgcacactgggccctggagagaaggtgcctgttctcacggg

SEQ ID NO: 48091 - DNA, 201 bp, Homo sapiens
aagggagggtcttctgagagatataaagaggctgatatatgctctttatatctcacctttgatgatacacagctcacctttgatggtcactctgaatcacrtcaaggcgatgacaagaacaactgtctagacttagtggtgtggctttgaaacgacacttcgccattcagggattcaattgttttccagttttataatgag

SEQ ID NO: 48092 - DNA, 201 bp, Homo sapiens
tcaccaccatcaccatgagcaaaatggattattcactggccatatttctcctttttacctcagccaacaaggcacgcaggatcaaatgtgtggttctaccmtaatgactctatggacaggatcccctgtggctggcatgctgtcaccatctcctcctccttttcttttttctctgatccttgtttttatctgcttgtactt

SEQ ID NO: 48093 - DNA, 201 bp, Homo sapiens
accccatcctacccttaaggtgccctggaggggttgaagggccattcttggtcatccagtctctgtgtggttgggttgatcacagaaactagagaagtcamgaagagtaggtgttcctcaggttaattacacaaagaactaattcagtctgattccttaagctcggagttaaaaacagtgattgtgaactcatgaagggag

SEQ ID NO: 48094 - DNA, 201 bp, Homo sapiens
gattgtttcttgttataccataaagataaggagcttgagttactttccagctgataaggcaattttcacctttttccatttgtcttggaatttcacacccyaccccatcctacccttaaggtgccctggaggggttgaagggccattcttggtcatccagtctctgtgtggttgggttgatcacagaaactagagaagtca

SEQ ID NO: 48095 - DNA, 201 bp, Homo sapiens
gtgtagaggtctaaagagatttgtcctatgagaaagttcactaatttcaattatctgggttttattatcaccttctaagggttagagagacaggattttayagaatgccatcacctgaggctgtgacaatggggtttcacaccattaaattcagaaagcataagagaagagataagaaatgagagggcttgaagtgcatgc

SEQ ID NO: 48096 - DNA, 201 bp, Homo sapiens
gactcacctctgggttgcagaggaggttgctctgattgtttcttgttataccataaagataaggagcttgagttactttccagctgataaggcaattttcrcctttttccatttgtcttggaatttcacaccccaccccatcctacccttaaggtgccctggaggggttgaagggccattcttggtcatccagtctctgtg

SEQ ID NO: 48097 - DNA, 201 bp, Homo sapiens
cttgaaaccaggaggcggaggttgcagtggattgagatcacaccactgcactccagcctgggcgacagagtgagactttgcctaaaaaaaaaaaaaaaaaragagcccccccactcatccacacttactctcttacaatcctggaaggcaacttgtttcaatgggctagaggcaagttgttggctagaggagattccattg

SEQ ID NO: 48098 - DNA, 201 bp, Homo sapiens
aaagaaactgagcaggacttgggcacaggtagaggtgagcttccgggctgaatcccctactaggccgttagtcaattgtatgtttcctttttggactcacstctgggttgcagaggaggttgctctgattgtttcttgttataccataaagataaggagcttgagttactttccagctgataaggcaattttcaccttttt

SEQ ID NO: 48099 - DNA, 201 bp, Homo sapiens
aggtgctggttgcagtgagccgagatcaatccactgcactccagcctaggcgacagagcaagactccatctaaaaaaaaaaaaaaaaaaaaaaaaaagacwcaacgacacacagagaacttgtgtgatgatggaggcaaaaactggggtgacgcagctacaattcaagggacaccaaaactgccagcaatgaccagaagct

SEQ ID NO: 48100 - DNA, 201 bp, Homo sapiens
ggtggcctagtgcatgtttcacctaggtctctgactaattctatgagcttgggcaaattatttagcttctttagggcttctgtatttgtgaaaaaaaaaamaaaaaaaaaaaaaggaaaacaatagtttccctttaacagggctattgtaggaatccagtgagatcatatcttggaagtgctcagctgagggcctgggcgg

SEQ ID NO: 48101 - DNA, 201 bp, Homo sapiens
aacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgt

SEQ ID NO: 48102 - DNA, 201 bp, Homo sapiens
aattgaacaaactattatgaagcccctactgtctttatcagcaattcacagtcttttgtccataagaataagcaggggacttaaaaaaaaaaaaaaaaaamaaaaactactggtacttgggccttaccccagactaactaaattagaccctctagggtggactttgctctcagtatttttcaaagttacccatgctattcc

SEQ ID NO: 48103 - DNA, 201 bp, Homo sapiens
aggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgca

SEQ ID NO: 48104 - DNA, 201 bp, Homo sapiens
caggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgc

SEQ ID NO: 48105 - DNA, 201 bp, Homo sapiens
agtatatttatatatttgtatatttataaatgtattttatatattgtatgtttataaaatattagaaaaatatatttgtatatttataaaatatataaaartatatttatatacaaatataacctataagtatatatgtatgttttacatacacaaatacttttatacataaatgtgtacacatttcagaatcaaacagcc

SEQ ID NO: 48106 - DNA, 201 bp, Homo sapiens
gagccgagatcgcgccactgcactccagcctgggtgacagagtgagactctgtctcaaaaaaaaaaaaaaaaaaaaaatatatatatatatatatatatawaaatatatttctatatttataaaatatataaagtatatatgatatacaaatatatttacatataatataatcattttatttgatttaaaaatatacagta

SEQ ID NO: 48107 - DNA, 201 bp, Homo sapiens
acccaggagggcggagcttgcagtgagccgagatcgcgccactgcactccagcctgggtgacagagtgagactctgtctcaaaaaaaaaaaaaaaaaaaawatatatatatatatatatatatataaatatatttctatatttataaaatatataaagtatatatgatatacaaatatatttacatataatataatcattt

SEQ ID NO: 48108 - DNA, 201 bp, Homo sapiens
ggatgcaaagcaggaaacacacattctcacatgcggtggtcaatcagccaagtaaagccaaagttgttgttgttcccagttcaaagatgaggaaattgaasctcggaggggtcaaataactcatccccaatcacaaagccattaagtggttctgtcaggatttgaatccatagcctaagttcatcaccacattcttctcct

SEQ ID NO: 48109 - DNA, 201 bp, Homo sapiens
ataaaccctgacctaagcaaagacaaaatggacatgaagttgcctcaatgggcaagaccaagacttctgagccaccccatcagtgacacttgatgtagccsgtagcaggagtgccagggagaacacagctttgttgttccatatccagctgtttggatcagagggaaatgggatctttcaatcactactgcagtatgagaa

SEQ ID NO: 48110 - DNA, 201 bp, Homo sapiens
tccacccaaagccaccgggagaaccaacacatccctgcagacgacaaaagcgtccttttgctcatggccacatgccttgcagcacaagctcctctcaaatrcttcccaggacctcaccgtaagggacagtcaaccagacgtgtgcttccacatgttcttcaaatgtgtttttcatttgcttgggttcaacctcattataat

SEQ ID NO: 48111 - DNA, 201 bp, Homo sapiens
cataaagcctctaaacaagaaaaggcccctgatctcaagaagctcggattgtcatagccacgatagccactaaacaagtaatcagtaaacaagcacattayagactgtggtagtggtaggtgctggggaaaacggtactcattatctattgctgcatgaaaaattgtctcaaaacttagtgacttgagacaagaagcactg

SEQ ID NO: 48112 - DNA, 201 bp, Homo sapiens
caaagctgtccacatcctagtccttaccttatacagtaaaaaggactctgcagctatgattagatgaaaggtctttagacgaccttagatcatcaggatasacccattttcaccataaaagtccttataagaaggaggcagggccaagcgcggtggctcacgcctgtaattccagcactttgggaggctgaggttggtgga

SEQ ID NO: 48113 - DNA, 201 bp, Homo sapiens
ggatccacccaaagccaccgggagaaccaacacatccctgcagacgacaaaagcgtccttttgctcatggccacatgccttgcagcacaagctcctctcaratacttcccaggacctcaccgtaagggacagtcaaccagacgtgtgcttccacatgttcttcaaatgtgtttttcatttgcttgggttcaacctcattat

SEQ ID NO: 48114 - DNA, 201 bp, Homo sapiens
gtcctgtaataattgtaatcaatattatgcaataatatgtaatcatatttatgtaatagtgggctaattgtgttataatatgactaattgttacatagctmtgatgtcccaggcagtgaattttatctcccaggcagagacataaagcctctaaacaagaaaaggcccctgatctcaagaagctcggattgtcatagccac

SEQ ID NO: 48115 - DNA, 201 bp, Homo sapiens
ccatgtttcccagccaaggctcttccagccagcagtgctgatgggaagaacaggcaagccagagtgccttatcaagtgcaagactcaccacccatagaggmtccacccaaagccaccgggagaaccaacacatccctgcagacgacaaaagcgtccttttgctcatggccacatgccttgcagcacaagctcctctcaaat

SEQ ID NO: 48116 - DNA, 201 bp, Homo sapiens
tttaccattcactttaaaacaaatattattgaaatgtttaaaataattgctgatcccctgttctactactcttccctattctggctgagttcctataagayagagatcagctcttagattccccgtgtatcatatccctgacatgccgcactgtgctattgatctggtggccgttcaataaaaagtcattgagtgaacaaa

SEQ ID NO: 48117 - DNA, 201 bp, Homo sapiens
ccctttgcctacctaactcctccttctttgatctgcagcttaaatgtgacttcttcaaaaaagacttctttgatcccttcagtaccaaatgagttcttccytttatgcacatttttccttgtgacacttgacttaattatagttaaatgatgaattatgtgctggcttattacttcctttttaccaaaagactgcacgctt

SEQ ID NO: 48118 - DNA, 201 bp, Homo sapiens
gagttcatgtggcattttctctaattttcaagtgcaaactgggtgttgtacattccaaaggaggttactttcattatcggttttggggattttgttactgwtctccttgtgaaagcaataatgttcattacagaaaaatccccaaatcataacaggccaataaactttttatattagaattgcttttaaaagtgaaaactt

SEQ ID NO: 48119 - DNA, 201 bp, Homo sapiens
gaggaaacgaatgaatgaattccattacatctttgctatgtagctcatgttaatgtttctcattaacgataccttaaatgttagactagaaagggatttgytaacaaaaatgccttcttacagccttccttgactcctagagcagcatgtgtgtgctggagcccattctcactggctcacaatagccaactggtgtctctg

SEQ ID NO: 48120 - DNA, 201 bp, Homo sapiens
gcagagtaacaaatgcagagtggccagcgagggatacagaattaaaaatacatgtgtatatttcaagtaagagtgactccgagagctaggaaattaggggrtgactttctggaaaaggctctgaggatcgggaagtaggtcagaggcaagtggaaggtattctgatcatgtatgagcaagggagttcatgtggcattttct

SEQ ID NO: 48121 - DNA, 201 bp, Homo sapiens
tattgcaaggacgcttgtgatgcccagctgatcgggacaaagctaaagaggaaacgaatgaatgaattccattacatctttgctatgtagctcatgttaakgtttctcattaacgataccttaaatgttagactagaaagggatttgctaacaaaaatgccttcttacagccttccttgactcctagagcagcatgtgtgt

SEQ ID NO: 48122 - DNA, 201 bp, Homo sapiens
agcacttttctgtctttgtttgaatttgcctttaccttattatctattatcttccagataatctagggaaagtgatagcctgcccgtgaaaatgtacatayaatacaagatattagggctgtgaatgtaatttgttttgtattttcagctggtaacgcactttctgaaactttataatgcccaaatttttaggccagatgt

SEQ ID NO: 48123 - DNA, 201 bp, Homo sapiens
aggtgcagccagcccggggaagaatgtggtccctgtttaggcttcatattgcaaggacgcttgtgatgcccagctgatcgggacaaagctaaagaggaaaygaatgaatgaattccattacatctttgctatgtagctcatgttaatgtttctcattaacgataccttaaatgttagactagaaagggatttgctaacaaa

SEQ ID NO: 48124 - DNA, 201 bp, Homo sapiens
catttcttccccttccatatcttaagctccgcattaatagatatcaagtttccccaagacatgtgcgttttccattacacgctcatccatttacttgttckgaaaaccctaccagaacatacgcttctggaagaaagggaccttggatttctgttctctctctctattcccattgccaaatatagcaccagataaataata

SEQ ID NO: 48125 - DNA, 201 bp, Homo sapiens
agatcccttgcggacacgtgcagttgtttctgaaagtagatgccaaggaggcgaaggcattgtttttactctttgctgcccaatggtccttgacaatggayataccagtttccctttatatcagctgcatgggagggagacccattatctgacacccttatcaatcattgacataatccaacactccacatgcttgttata

SEQ ID NO: 48126 - DNA, 201 bp, Homo sapiens
ttccaagtagttgggactacaggcgtgtgccaccatgaccagctactgttgtactttttgtagagatgggattttgccatgttgcccaggctggtctgaakctcttgagctcaagtgatctgcccacctcagcctcccaaagtgctgggattacgagcatgtaccactacacttggcccataagtgattttttaaaaataa

SEQ ID NO: 48127 - DNA, 201 bp, Homo sapiens
aaaagaaactgagcaggacttgggcacaggtagaggtgagcttccgggctgaatcccctactaggccgttagtcaattgtatgtttcctttttggactcamctctgggttgcagaggaggttgctctgattgtttcttgttataccataaagataaggagcttgagttactttccagctgataaggcaattttcacctttt

SEQ ID NO: 48128 - DNA, 201 bp, Homo sapiens
gctggtctgaagctcttgagctcaagtgatctgcccacctcagcctcccaaagtgctgggattacgagcatgtaccactacacttggcccataagtgattytttaaaaataagtaaatatttacaagaaattaattccctgagatcgtcaggacccaaccttgtcttcattttaagtattgtcagctcagagttctaatga

SEQ ID NO: 48129 - DNA, 201 bp, Homo sapiens
tccaattaaagaagcaggaatgggtagcataattgacatgcatgactcttaatgccttttggttcattaagcctttggatcaacttttgtaggaagacatktaaaagaaactgagcaggacttgggcacaggtagaggtgagcttccgggctgaatcccctactaggccgttagtcaattgtatgtttcctttttggactc

SEQ ID NO: 48130 - DNA, 201 bp, Homo sapiens
ctattggaaatggcctgctttaacagtcctggttcctgcttattaagatgcaccttcttaatgtatgcaataaaaattagactcaaagatatctagtgatrtttagccagcttcagtgactggtctagaaataaaaagatatgccagtaaaacccgagtgttgcaaatactgttactgatgatgatcaagaagagaggaag

SEQ ID NO: 48131 - DNA, 201 bp, Homo sapiens
tggtcctctgcacaggcgttgtatattttgttctcaaatccagcagccttgacttgacatgggatggttgggatggttctccacgtagccacataagctcrttactacccattacatctgcctgtacctccagcaggtgcccaggagatggctgagtcccaagagccatgcaggcctcctggacgaccgccctgatgtggt

SEQ ID NO: 48132 - DNA, 201 bp, Homo sapiens
tgtcactgtgtcctcccttctgtcctgaagcattccatgctacacaccattcataagatttaaaatcatcttcaagaagtgccctgttggaataataagtsagtgctctctggaggctataaccaaatataatttgccacataaacatgaaatgtgtgtccaagaaactagtaggaatgcatctaggaaccaaagtgtctc

SEQ ID NO: 48133 - DNA, 201 bp, Homo sapiens
cagttgaaacggagagacataagatagattgttgaaataggaaggggaagacatgagactctcttatgtctaaatgtctaacatgggttggaaaggctgcscaccagtcccaggtatgcaggcttggcacttggctcatttgaaagagagacaactaagccataactggtttatccttttcctctgcagttttatggcctt

SEQ ID NO: 48134 - DNA, 201 bp, Homo sapiens
tgatgggcacactgctgcactgctattgcccaggtggggaaggggctctggccgttgttgacccattgataaccattccgtgcctttctgtcttgccccgrtaggcaccacagtgatgcggatgacagcctttgatgcagatgacccagccaccgataatgccctcctgcggtataatatccgtcagcagacgcctgacaa

SEQ ID NO: 48135 - DNA, 201 bp, Homo sapiens
tggaggtgtgtgtggctgggcaattatcctttttcactcttgcccagtgcttgttttgaatgcaaatgtattagttcagatgggccaagttgcagtaaaaraaatccacccccaaatttcggtggtttaacagaacagatgttcttatcctgcttacccaacagctctagtgggtgtttcttctatgaagctgctcagaaa

SEQ ID NO: 48136 - DNA, 201 bp, Homo sapiens
agcagaagcttgcagagctgcgtgagcctgccttccactcagcttgaattaaagagattgggctgcaaggacacagagaggtgagccccaggaggtggggwcccagtcctgagattagtgacagcagccctgaggatgtagagaaaaacttcttactcctttgaaaaatgtgtgcagtgattcttttcctccctgagctgt

SEQ ID NO: 48137 - DNA, 201 bp, Homo sapiens
ataagcttttttgttgtgtacattggcaacttgatggctaaggtcattctccatccatttgtctagctacccacacacctatacatccatctacccatctrtccacccactcacccatctattcacctatccatccacccagctatttatctatcatccatccatccacccacctacccacttattcaccaatccacctat

SEQ ID NO: 48138 - DNA, 201 bp, Homo sapiens
tgaatgctatcttaatgagaataagcttttttgttgtgtacattggcaacttgatggctaaggtcattctccatccatttgtctagctacccacacacctrtacatccatctacccatctgtccacccactcacccatctattcacctatccatccacccagctatttatctatcatccatccatccacccacctacccac

SEQ ID NO: 48139 - DNA, 201 bp, Homo sapiens
aacccaggagggcggagcttgcagtgagccgagatcgcgccactgcactccagcctgggtgacagagtgagactctgtctcaaaaaaaaaaaaaaaaaaawaatatatatatatatatatatatataaatatatttctatatttataaaatatataaagtatatatgatatacaaatatatttacatataatataatcatt

SEQ ID NO: 48140 - DNA, 201 bp, Homo sapiens
ctaccgttctgcttgctggtggttcaggttttgtgaacttatacaagggcttggtatttgaatgctatcttaatgagaataagcttttttgttgtgtacaytggcaacttgatggctaaggtcattctccatccatttgtctagctacccacacacctatacatccatctacccatctgtccacccactcacccatctatt

SEQ ID NO: 48141 - DNA, 201 bp, Homo sapiens
tcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcact

SEQ ID NO: 48142 - DNA, 201 bp, Homo sapiens
ctggagctgtggtcagcacacagccagtgagtgctctacaaacacttacagcatcagttcatgaatgcttgcaaacatgcagaggttaccattgcttatasttttttttgttttgttccacttatataaaccacttatatattcagatatttgtgtatatatgcatatatatgtatttatgcacacataaacatactacac

SEQ ID NO: 48143 - DNA, 201 bp, Homo sapiens
gtggacattagcttgtattttcaaataataaagtcaaactttattattaaggaagatacaagaattagggctagtaagtgtgtgtgtgtgtgtgtgtgtgtctgtgtgtctttctatgtgtaaatgtccatccccagggattaagaagtctggatttgggttaaacttaatcatttctaagaatctgaggttttcagtcct

SEQ ID NO: 48144 - DNA, 201 bp, Homo sapiens
agtggacattagcttgtattttcaaataataaagtcaaactttattattaaggaagatacaagaattagggctagtaagtgtgtgtgtgtgtgtgtgtgtgtctgtgtgtctttctatgtgtaaatgtccatccccagggattaagaagtctggatttgggttaaacttaatcatttctaagaatctgaggttttcagtcc

SEQ ID NO: 48145 - DNA, 201 bp, Homo sapiens
gtacagatttttcttttaatggaggttttcattctctgagatgaattcgcccaaaagtgcaatgtctgggttatataattgcatgtgttgttttatttttwaaaaaaacattgctaaactgttttccagagcggctataccattttacattctattgaagagttttgagcagtaaggtgatgcaatcctattcatgtttta

SEQ ID NO: 48146 - DNA, 201 bp, Homo sapiens
taacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaa

SEQ ID NO: 48147 - DNA, 201 bp, Homo sapiens
gaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagct

SEQ ID NO: 48148 - DNA, 201 bp, Homo sapiens
tctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggccttt

SEQ ID NO: 48149 - DNA, 201 bp, Homo sapiens
attctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcct

SEQ ID NO: 48150 - DNA, 201 bp, Homo sapiens
gatggaagaacatcgctcgacctctgcagtgggaataaggcacattttatgaggatgtgtaagcggttcctgctggatttatggactacctattcccagtrttatgtggccagagtggttaaatcaaactccagacagacaacaactcgttctgcttcagatagtgttttcaccaatcttttgcaatatttatagactagg

SEQ ID NO: 48151 - DNA, 201 bp, Homo sapiens
gagagaacagattgggaatcagaggtacttgagttcagattccagctccattgctcattagctctgtggcatggggaaatcagtgaaccctttactgctgwgttatttgtaaaatgactgtgattgctgactgattatgtcaggctatacaatcatttctttggttgcaagccatggaaaccaaaccttatgaagagaaga

SEQ ID NO: 48152 - DNA, 201 bp, Homo sapiens
tggccatttttggaaaatgctatagagccaaagtctgcatgaagagagaacagattgggaatcagaggtacttgagttcagattccagctccattgctcaytagctctgtggcatggggaaatcagtgaaccctttactgctgagttatttgtaaaatgactgtgattgctgactgattatgtcaggctatacaatcattt

SEQ ID NO: 48153 - DNA, 201 bp, Homo sapiens
aatattagcatggccatttttggaaaatgctatagagccaaagtctgcatgaagagagaacagattgggaatcagaggtacttgagttcagattccagctycattgctcattagctctgtggcatggggaaatcagtgaaccctttactgctgagttatttgtaaaatgactgtgattgctgactgattatgtcaggctat

SEQ ID NO: 48154 - DNA, 201 bp, Homo sapiens
ctagaaatttatttgcacagatcccttgcggacacgtgcagttgtttctgaaagtagatgccaaggaggcgaaggcattgtttttactctttgctgcccartggtccttgacaatggatataccagtttccctttatatcagctgcatgggagggagacccattatctgacacccttatcaatcattgacataatccaaca

SEQ ID NO: 48155 - DNA, 201 bp, Homo sapiens
gaacgagaggagcgtcagaaatattagcatggccatttttggaaaatgctatagagccaaagtctgcatgaagagagaacagattgggaatcagaggtacytgagttcagattccagctccattgctcattagctctgtggcatggggaaatcagtgaaccctttactgctgagttatttgtaaaatgactgtgattgctg

SEQ ID NO: 48156 - DNA, 201 bp, Homo sapiens
ctccttatagagttgttctatgcacttataaactgtacctgtaaaacatgtgaataaagtattgtggcatgttctgtgtgtaagcatgttcacaaaaatgrtatcactatccccctgtgggtaaggaaagttaaaacgtgccacatttcacatcagtttctgtatacttcaagttgctacctagaccactgtttgagaacg

SEQ ID NO: 48157 - DNA, 201 bp, Homo sapiens
atgaggccaacatctttcccgatgaccatgccaaatcccaatcccctctcttcttctccagatttaaccaccattaccagggagaagttctccttatagasttgttctatgcacttataaactgtacctgtaaaacatgtgaataaagtattgtggcatgttctgtgtgtaagcatgttcacaaaaatggtatcactatcc

SEQ ID NO: 48158 - DNA, 201 bp, Homo sapiens
gcagggagagtggcagagacagcaggctgctgccatggcctcaatcccagccacttaagttggcttcaccattttcctgcccatgtgtactacaggttgayggctagagacactgtgaacatcccactacttgccactgaggctgaattttttaaaaaaaataatgatagcagaaacacctcagacagtctttcatgcaga

SEQ ID NO: 48159 - DNA, 201 bp, Homo sapiens
atcatttagaaacttgtagatttttctggcaacatccaagaataagttatctcacttagaagagttttctgtgaaactgaagctcaccacttcaagtgctrtatctttctatatattgacttcacttctaaaacataggtttccccgattcttaaatagagtatgggaaaggaatttaaggtcatttgaggtaatcattct

SEQ ID NO: 48160 - DNA, 201 bp, Homo sapiens
gtcaacttttattgcttcacttaaaatctgccaccttccaccttcatgtcctgaatcctttatctagaaaatgtgtaattttccaagaaggcctcagaccyagtggtccagttactgtctgtttttgctgactaactcttgaaataagaatttttttaaaagctggtagtagggatgaagggggttaagtgacagttctcc

SEQ ID NO: 48161 - DNA, 201 bp, Homo sapiens
ataggtggattcattggtacctgtcttcttaaaagaagaaaggcaggataatcaatgagaggttttctcactcatggttatgaccttgcatttggatggamagtcatctacaaatatgttttcaccttctcagggcaggctgaacaaagcctgtctgaaggttgtcagataactatgttctccaaagtatggggagtttat

SEQ ID NO: 48162 - DNA, 201 bp, Homo sapiens
gagttgaactccaacaatcatttaaaaacttttgtttccaatcatttagaaacttgtagatttttctggcaacatccaagaataagttatctcacttagawgagttttctgtgaaactgaagctcaccacttcaagtgctatatctttctatatattgacttcacttctaaaacataggtttccccgattcttaaatagag

SEQ ID NO: 48163 - DNA, 201 bp, Homo sapiens
ttgccacagggaaacattataccaattggcctatagcttgaaattacagcattctctatattcgtccagctttagggaaatgcagaccacaagggtcctgsctaccgttctgcttgctggtggttcaggttttgtgaacttatacaagggcttggtatttgaatgctatcttaatgagaataagcttttttgttgtgtaca

SEQ ID NO: 48164 - DNA, 201 bp, Homo sapiens
ggcttcaccattttcctgcccatgtgtactacaggttgacggctagagacactgtgaacatcccactacttgccactgaggctgaattttttaaaaaaaawaatgatagcagaaacacctcagacagtctttcatgcagagactcaatttaacacttcagaaaatttttgttcttatgtcaagatcctaaagttcctagat

SEQ ID NO: 48165 - DNA, 201 bp, Homo sapiens
tatcaaaggttgatttcagaccaccacaatcaaaggaatatcacaatgaagtgagtcacatgatttttttttttgcttttccagtacatatagaagctccrtttatactatactgcaatgtagtaagtatgcaatagtttcatgtctgaaaaatgtacataccttaattaaaaatacgttataactaagaaagtgctaaca

SEQ ID NO: 48166 - DNA, 201 bp, Homo sapiens
atccattttgcccatgatttcaggtacacaggtgatttcgccaaacaaaacaagcacagctgaaatctgtgacttaaatcaagcaacggtgtctgcaatastctcattgcagagacttctgctcccttgttgcttgtaggaatgggggtggggaaaggtcaggactatatatttaagaaaaaaaccccacatatgtcgacc

SEQ ID NO: 48167 - DNA, 201 bp, Homo sapiens
ttagggatggtgacttccagaagctgactgtgataacctttcctcgggcttcagaagaggctaatggagagttgaagggagaaatcaggaaagatggtctsccctcaatattctgacatgggttaataaggaggcactggttcttaaattgggatctcgatgatgctggactagcagcagcaatatcacctgagaacttgc

SEQ ID NO: 48168 - DNA, 201 bp, Homo sapiens
tagtagagacggggtttttaccacattggccaggctggtctcaaactcctgacctcaagtgatcaacccacctcagcctcccaaagttctgggattacatrcagaagtcactctcacacacatactcatatttgccttaccatttgtgcaggaaatcaataccattactacccaagaccaaaggtttcactggatttaagc

SEQ ID NO: 48169 - DNA, 201 bp, Homo sapiens
tatttagaatctctgagcagctcagactcagttttttttgtaatgccagcatataggtcaaatgtgaattccttacaattttttctgaatgggaagtttarggaacgactccaatgttcctgtagtcgctgtaagtcgtttaggtgtgctataggatgaaaagaagaataatgaaactgtggtatatgcatgccgtgggat

SEQ ID NO: 48170 - DNA, 201 bp, Homo sapiens
ttcttgttcccttgggacaagagaaatctgaactcagttgtgcaaaaaagagggtctgggaatgaaccaagagggatggtcagtggctccaaggggcggaktgggagaaggcaaaggagaggggccaggagagaatgccaggaaaaaccagaagaaagatttaaacaaacctcataatttacctgtaaccgacagctctcc

SEQ ID NO: 48171 - DNA, 201 bp, Homo sapiens
tatttgccttaccatttgtgcaggaaatcaataccattactacccaagaccaaaggtttcactggatttaagcactgacatgaggccaagaccatagctcsttccatggatatatggtccactttaatttttatgaattctaccctaagaagggggaaatgttaattgaaattgtagccattgttaacattgaatttatca

SEQ ID NO: 48172 - DNA, 201 bp, Homo sapiens
gttttttttgtaatgccagcatataggtcaaatgtgaattccttacaattttttctgaatgggaagtttagggaacgactccaatgttcctgtagtcgctstaagtcgtttaggtgtgctataggatgaaaagaagaataatgaaactgtggtatatgcatgccgtgggatatcattcagtcatacaaaagaagaaagtcc

SEQ ID NO: 48173 - DNA, 201 bp, Homo sapiens
gatgggccttatatttgtagaagactatattgggataaaaagttatggttaggcaggatgccctaatccaaatgtgatagcaatacaattgctattgtcartcatcaaaaccagcaggcatgtttttgttggtgcttataattatgctctttgtaaattaaattttaattgccaaagcaatacattcaccttgtaaaaata

SEQ ID NO: 48174 - DNA, 201 bp, Homo sapiens
agcaaacctgggacatggggctgagccagcagaatcattagcagtcaggctgtgtgaatttttttgtggtaagagagataaatgtccctcttgttctttgyggtttcctttgccataagagccactgctttgtgaaagttcttctttcctttctctggcttgcccatccctggattgatgtagtagccagcagcaaggaca

SEQ ID NO: 48175 - DNA, 201 bp, Homo sapiens
gaggcttatgaagtacacttttcttctggaatcctctcttttccccacctctcagggcttcttggtgaggtccacactcttcactcaccattcctggtctsaagtcgggatgtcttgtcctaactatcaatgacccacagttacctctacctctcagctgagccctcagcctattttctttttttctactcatgttctgat

SEQ ID NO: 48176 - DNA, 201 bp, Homo sapiens
cgtgattataggcttaaccatctggttatcaggaaaaaaaaccatgtagagagcgcacgagagcccagaatcagtagctgggcctcctggtgtggaaaggwtagaactcaaatctcatcgagggatggaagtctggatacactcctttcatctctcagaatcagctccaggctggcccaaaacaaatgatacagaggctga

SEQ ID NO: 48177 - DNA, 201 bp, Homo sapiens
ctagggatatgaagatacaaagatgcagtctgttggcagaataaaattcttaaacagatcttagaatagtgtgagttgttcctggaaggtacagagtgccrtgggaactcagagaacagattcccaccccagtaagaattctgggatcactccaccccaaaagaatgagggttatgttgtccttagtgggaggtggtagtt

SEQ ID NO: 48178 - DNA, 201 bp, Homo sapiens
gttgcttcagtggccatcaggatgacctgggagtaacctaattttacgtgattataggcttaaccatctggttatcaggaaaaaaaaccatgtagagagcrcacgagagcccagaatcagtagctgggcctcctggtgtggaaaggatagaactcaaatctcatcgagggatggaagtctggatacactcctttcatctct

SEQ ID NO: 48179 - DNA, 201 bp, Homo sapiens
ctctggccaccttcccttctcctagccttgctcctcaccaggtaatcctagacatatggacagctcactatcaagaggaggattggtccactggagaaccrttaatcccttctgcactttggggatgatctcatctgatttgtctgtcctgcttcctcaaagcccctaaaatgcatttctatgctaagttaaacagaattg

SEQ ID NO: 48180 - DNA, 201 bp, Homo sapiens
gcagcactcatgtataccagctgcaatatggtaggaaacctgcccctgcccacacaggctaggcagaggtgtgtgagaaaaagggaactggtgagagggargggaacatgctggatttcagagcaaggtctctcaacctgaggtggcctgggtatgagacatgctacgcagaaaaaaacctagaaataactgagattaaaa

SEQ ID NO: 48181 - DNA, 201 bp, Homo sapiens
gaagtgttcagtaaatatttactggcatactaccggagctgctggcctttgggaatggaagcatactgggggtccgtgtgcactaaaatggcaaagaaaayctaggggatgtggatggtgcagggacagcatctactgcagcactcatgtataccagctgcaatatggtaggaaacctgcccctgcccacacaggctaggc

SEQ ID NO: 48182 - DNA, 201 bp, Homo sapiens
tattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcc

SEQ ID NO: 48183 - DNA, 201 bp, Homo sapiens
cttaagtttgcttccccagaagaaggtcctgggatgagaatttgtgttaaagtgatgtatcggaaaggttgctaggaaaaacgtatagggaagtgggaacygagtttggcaagagggagactgagcaagggtgtcatctcaagcgaagttccattgagataactttggcctcatcttccagggagactgggaatgatgtga

SEQ ID NO: 48184 - DNA, 201 bp, Homo sapiens
gtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggc

SEQ ID NO: 48185 - DNA, 201 bp, Homo sapiens
ggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaagg

SEQ ID NO: 48186 - DNA, 201 bp, Homo sapiens
tgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaa

SEQ ID NO: 48187 - DNA, 201 bp, Homo sapiens
ttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggca

SEQ ID NO: 48188 - DNA, 201 bp, Homo sapiens
cttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggc

SEQ ID NO: 48189 - DNA, 201 bp, Homo sapiens
acttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccagg

SEQ ID NO: 48190 - DNA, 201 bp, Homo sapiens
aacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccag

SEQ ID NO: 48191 - DNA, 201 bp, Homo sapiens
aacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgc

SEQ ID NO: 48192 - DNA, 201 bp, Homo sapiens
aaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattg

SEQ ID NO: 48193 - DNA, 201 bp, Homo sapiens
aatcccctgcaggcttttctgtttccttatctgtggtttacaagcattttatacatatggctataaagcacttataataatagactggaattagtcattcmtgcgccttttgctgctagcctgtgaaatccttgaagatgggggtccatgcctcattcattttctatcgttagcattcatctccatgcctgtaacatggta

SEQ ID NO: 48194 - DNA, 201 bp, Homo sapiens
aaaataatattcctgcatttgttcaacaaacagccactgagtgtgggagcagcatccagatgtcagctgggatctgcctgcctttgagaactaaataaatrtgtgataagttgataagtcctgactgcatgccccgtagcagcccagaggcttcccaagatttctgcaaattccagaggattggagaaggaagccttgact

SEQ ID NO: 48195 - DNA, 201 bp, Homo sapiens
aaaattggagtcagtcttctcaaaccctgctgctgctttgtcgactaaatttctgtaatattctaaactcttttttgtcatttcaactatgttcatagtakctttaccaggagtagattccatcttgagaaatgtctttctttgcttatccataagagcaattcttcatccattcatgttttatgatgagatggcaggaat

SEQ ID NO: 48196 - DNA, 201 bp, Homo sapiens
ttctcaaaccctgctgctgctttgtcgactaaatttctgtaatattctaaactcttttttgtcatttcaactatgttcatagtatctttaccaggagtagrttccatcttgagaaatgtctttctttgcttatccataagagcaattcttcatccattcatgttttatgatgagatggcaggaattcattcacatcttcaa

SEQ ID NO: 48197 - DNA, 201 bp, Homo sapiens
accttagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtgg

SEQ ID NO: 48198 - DNA, 201 bp, Homo sapiens
actgaatatttagcttgttcttttagtcccctccagtttgacactgcaaacaccaaatttggtcctctgttattttacttccagaaaataattttttagarctaagattaccaagtcactaatatttttgtggttcttaatggatatatattgccaactgcttttcaaaactattgttatatttaataccatcaaaatata

SEQ ID NO: 48199 - DNA, 201 bp, Homo sapiens
ccttagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggc

SEQ ID NO: 48200 - DNA, 201 bp, Homo sapiens
gattaccaagtcactaatatttttgtggttcttaatggatatatattgccaactgcttttcaaaactattgttatatttaataccatcaaaatatatccaytcacaagtttaattacactgtcttcatcattagtcataacgttttaaaaacataattgccagcataagagggaatctatctatgtctttctatttctctc

SEQ ID NO: 48201 - DNA, 201 bp, Homo sapiens
taacagagtactgggaagatagaaggtggtcaaagcatatgtatggaatgaacactggaaatcagtacacagggctgggaatgtgtgattctgagcactcmgtgatggaaataaccctccagctccttcacagaacagccagcagcatcacctgttttggtgatggtgcctccggatgatgatccgtgagcgcacactgga

SEQ ID NO: 48202 - DNA, 201 bp, Homo sapiens
gtccagacagattcaaaatcagaagatgggccttatatttgtagaagactatattgggataaaaagttatggttaggcaggatgccctaatccaaatgtgrtagcaatacaattgctattgtcaatcatcaaaaccagcaggcatgtttttgttggtgcttataattatgctctttgtaaattaaattttaattgccaaag

SEQ ID NO: 48203 - DNA, 201 bp, Homo sapiens
cttagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggcg

SEQ ID NO: 48204 - DNA, 201 bp, Homo sapiens
tctgtatcttctaagacctttggaagaaaaaggcaaaaatcagctctcttgaaaatgcaaattttgtcatcactggcattctcagaaacacaggggttcaraaatatgtagtagcctaccatttattgggaggaaggaggatttctaatcccaaaaccaggtttcaaaaccagatttaagagtttaaattggggtgactcc

SEQ ID NO: 48205 - DNA, 201 bp, Homo sapiens
aaaccagatgaattctatctttcctttaggcttcagtgttttctttgtatgactattcctgctgctttgttgaatagacatctgcggctttgatctcttcyggttaggtcacactttgtgagtccagacagattcaaaatcagaagatgggccttatatttgtagaagactatattgggataaaaagttatggttaggcag

SEQ ID NO: 48206 - DNA, 201 bp, Homo sapiens
ttagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggcgt

SEQ ID NO: 48207 - DNA, 201 bp, Homo sapiens
ccatcattgactggcgatgggacattttattctgtatcttctaagacctttggaagaaaaaggcaaaaatcagctctcttgaaaatgcaaattttgtcatsactggcattctcagaaacacaggggttcaaaaatatgtagtagcctaccatttattgggaggaaggaggatttctaatcccaaaaccaggtttcaaaacc

SEQ ID NO: 48208 - DNA, 201 bp, Homo sapiens
tagaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggcgtg

SEQ ID NO: 48209 - DNA, 201 bp, Homo sapiens
agggggctccttccatggtcaacatgggaagccttctccccaaccccaaccccactgaaacttaggaacgcacttccagctaagtccaactcctgggccamgtcctgcctcgcatgaggaaatgcacttctcaggcaccactgctcctcggctgaccgcggccagacaccctttcatctccccagggaatgctcaagtcag

SEQ ID NO: 48210 - DNA, 201 bp, Homo sapiens
gagaaaaattctgtaatttcaagtaaatattaactacaaatcaattccaataaaaatgctgctgtccaatcatctgtgtcactgcacttgggagaaaacawtttatgttcaagcctctttagctggattaatctcttcaaacctaagtgatccatatgaagatcttgtcaccggaaattacttttgatccaatacatctca

SEQ ID NO: 48211 - DNA, 201 bp, Homo sapiens
gaggagatattttcctgataaacagcatttagtcatttagtcattaaattagctcttttaaaattgtattatttttaaaggcatctttttattttattttattttattttattttattttattttattttattttattttattttattttatttgagacagaatctcactatgtcaccaggctggagtgcagtggcgtgat

SEQ ID NO: 48212 - DNA, 201 bp, Homo sapiens
catacggcacagacaaagataactgaattggattttcaataagcatagagttctagatttccctgttcttgaattgtgtaccgtaccacccagctgctgtycccagctaattttgccagagctggatgtcagccaaagcacaactgtctatggcttgggaagttctcctttgagtcagattatttagttagctcaggctgg

SEQ ID NO: 48213 - DNA, 201 bp, Homo sapiens
ccatcttcctctccaccacttacctggggttaagctctcttccagcctgcactatgacaacagcctcttcaagccaatcttacaccctctcgccttccccsaggccaggccgtctcctccatcccaacaccaaggtccctcaaaggaaagaccagtgaagtctcaaccctgcttaaaagcctcagtgacaaccattctgct

SEQ ID NO: 48214 - DNA, 201 bp, Homo sapiens
tcatccatgagggttggaatcaacttcttccaaacccctgttaatgttgatattttggcctcttatcatgaaccaagaatgttcttaatggcatctagaasagtgaattctttcccgaaggttttcagtttactttgcccagatccatcaaagaaatcatatgccagctatggcctacaaaatgtatttctgtatctcata

SEQ ID NO: 48215 - DNA, 201 bp, Homo sapiens
tattgtgacaaagtgcaaagatgccacatggattctggatcagtcagacctgggttggaatcctgattctgccagtacacctttctgcctggttagcttgraacaaagcagttaatctattgagcttcattatctctctcctgaggctcttgtgaggactaaatgagacaatacctaatgcttcatacagagacagtggtc

SEQ ID NO: 48216 - DNA, 201 bp, Homo sapiens
caccacttacctggggttaagctctcttccagcctgcactatgacaacagcctcttcaagccaatcttacaccctctcgccttcccccaggccaggccgtytcctccatcccaacaccaaggtccctcaaaggaaagaccagtgaagtctcaaccctgcttaaaagcctcagtgacaaccattctgctgggtgggattgct

SEQ ID NO: 48217 - DNA, 201 bp, Homo sapiens
ccatgagggttggaatcaacttcttccaaacccctgttaatgttgatattttggcctcttatcatgaaccaagaatgttcttaatggcatctagaagagtraattctttcccgaaggttttcagtttactttgcccagatccatcaaagaaatcatatgccagctatggcctacaaaatgtatttctgtatctcataagct

SEQ ID NO: 48218 - DNA, 201 bp, Homo sapiens
ccacttacctggggttaagctctcttccagcctgcactatgacaacagcctcttcaagccaatcttacaccctctcgccttcccccaggccaggccgtctyctccatcccaacaccaaggtccctcaaaggaaagaccagtgaagtctcaaccctgcttaaaagcctcagtgacaaccattctgctgggtgggattgctgg

SEQ ID NO: 48219 - DNA, 201 bp, Homo sapiens
tcctcaccacctcacttctgtttccagaagcccaacatgaaaatcactcttctgaaataagtcctggagtcttctttaggcttctgctaaaaagtcttatkcgtgagatgtctagcgtaacttctttttttaagtcaaggaaaatgtgtagaatttaggtcaagatgcactgagaataatttgcaaaacccgtaaatccgt

SEQ ID NO: 48220 - DNA, 201 bp, Homo sapiens
tccagcctgcactatgacaacagcctcttcaagccaatcttacaccctctcgccttcccccaggccaggccgtctcctccatcccaacaccaaggtccctsaaaggaaagaccagtgaagtctcaaccctgcttaaaagcctcagtgacaaccattctgctgggtgggattgctggcaggaaggtggccttagggaaaggc

SEQ ID NO: 48221 - DNA, 201 bp, Homo sapiens
cacacttgttaatcagcctgtcaggctggcggccgtgtccttcggcaaaagaaaatgacggcccaacttgagactttcaaccaggaacctgggatgttttyttccccctttggaggagctgctgctagttcatctggctcagggagtgacagggtgattataatttattttgtcactcaggagagtattgtgacgggggaa

SEQ ID NO: 48222 - DNA, 201 bp, Homo sapiens
attgaggtgccctaagaacgggctgcccccaaaatattttcctcaccacctcacttctgtttccagaagcccaacatgaaaatcactcttctgaaataagkcctggagtcttctttaggcttctgctaaaaagtcttattcgtgagatgtctagcgtaacttctttttttaagtcaaggaaaatgtgtagaatttaggtca

SEQ ID NO: 48223 - DNA, 201 bp, Homo sapiens
acaacagcctcttcaagccaatcttacaccctctcgccttcccccaggccaggccgtctcctccatcccaacaccaaggtccctcaaaggaaagaccagtsaagtctcaaccctgcttaaaagcctcagtgacaaccattctgctgggtgggattgctggcaggaaggtggccttagggaaaggctggtttcagccaaggc

SEQ ID NO: 48224 - DNA, 201 bp, Homo sapiens
agtatctaggcttgtctaagggaagaaaggaattgtttcctaacaagattttaagtaactcctgtttctgtagatcctgagagtgagtcctagaagcagtrtgtcttaaaccctaagtggttgggtcccacaagctatttccctcgtcatgattgcactcagcagtgggtcctcacagaactgagttctaaattgtgagag

SEQ ID NO: 48225 - DNA, 201 bp, Homo sapiens
tcacttctcataaaatcatctctcatagttatgtgagttcagaatgcacgtctatgctaccccaaagtccaagcttaatagagaaatctacagcaactctktatattctggagaggttttattactaagcttaagaattgaggtgccctaagaacgggctgcccccaaaatattttcctcaccacctcacttctgtttcca

SEQ ID NO: 48226 - DNA, 201 bp, Homo sapiens
ttgaacttacctttgtgaggttatctgattagtgtctttagagctctctaagtaatgtattccttcaagaaagggattctgtctttccccccagagaaacycccacatgcagcacagagcctgatgtgtgaaacttgctgaatgagttgaaaataataagctaatgattttataaattcatttaaaggatcctcagcttct

SEQ ID NO: 48227 - DNA, 201 bp, Homo sapiens
tacatggaattatccccattatatgagaagacagagtctcacaggagttaaatcacttctcataaaatcatctctcatagttatgtgagttcagaatgcaygtctatgctaccccaaagtccaagcttaatagagaaatctacagcaactctttatattctggagaggttttattactaagcttaagaattgaggtgccct

SEQ ID NO: 48228 - DNA, 201 bp, Homo sapiens
tcgagaccagcctggccaacatagtaaaacctcatctgtgcttaaaaaaaaaaaaaaacgtagccaagcgtggtggcgcgcacctgtaatcccagctactygggaggctgaggcaggagaattgcttgaacccaagaagcaaaggttgcagtgagccgagattgcaccactgcattctaacctcggcaacagagcgggact

SEQ ID NO: 48229 - DNA, 201 bp, Homo sapiens
ccaaccaccccgtgagccttcccagggctggcgttgatgatgctgctatcaatggggaatctacattgtgcacgggtatttatgatgagaaaatcatgtgrcataaaagagaataattgccttcataagtgtataattttttatactataagcttctcaatgaaaaagcattctaagggaggcataattgctaattttcgg

SEQ ID NO: 48230 - DNA, 201 bp, Homo sapiens
tcagtgcccagctctaaaagtcttaaatggaaattgattccctactccttctattttaactgtcaaaatcatagactgcattgtttccaactgaaaatccrctgacagctccccaccaaccaccccgtgagccttcccagggctggcgttgatgatgctgctatcaatggggaatctacattgtgcacgggtatttatgat

SEQ ID NO: 48231 - DNA, 201 bp, Homo sapiens
ggtgtaaagcctcctcatctttagctcaattcaacaagtttccattcagtgcccagctctaaaagtcttaaatggaaattgattccctactccttctattktaactgtcaaaatcatagactgcattgtttccaactgaaaatccgctgacagctccccaccaaccaccccgtgagccttcccagggctggcgttgatgat

SEQ ID NO: 48232 - DNA, 201 bp, Homo sapiens
caaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacatt

SEQ ID NO: 48233 - DNA, 201 bp, Homo sapiens
tctggtgtaaagcctcctcatctttagctcaattcaacaagtttccattcagtgcccagctctaaaagtcttaaatggaaattgattccctactccttctrttttaactgtcaaaatcatagactgcattgtttccaactgaaaatccgctgacagctccccaccaaccaccccgtgagccttcccagggctggcgttgat

SEQ ID NO: 48234 - DNA, 201 bp, Homo sapiens
acaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacat

SEQ ID NO: 48235 - DNA, 201 bp, Homo sapiens
aggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaa

SEQ ID NO: 48236 - DNA, 201 bp, Homo sapiens
gtaagtatatgaatgatgcgtgaattaatgaacaaacttctccctgttgccacattccaggaatagcccatggatttgcaaagagaggcaaaaaatggcawctaccagctgcttcctcttcttaggagtctccaacagagcctaataacatggggaagcattactaaattatgactttgtgcaagattattaactcggagt

SEQ ID NO: 48237 - DNA, 201 bp, Homo sapiens
gaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgca

SEQ ID NO: 48238 - DNA, 201 bp, Homo sapiens
cacacataaatctgcatgagtaagaagagacccatgaaaataaatagtcctacagatgtaagatttgagataaaacatatcttaagtgaatagattgtctktgttcttcatgaaccttcaaccttcatgccacataggtttggtgaagaacgtttttgatgtctgttacccacatggagggtttctgcctgtctattttgg

SEQ ID NO: 48239 - DNA, 201 bp, Homo sapiens
gagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaac

SEQ ID NO: 48240 - DNA, 201 bp, Homo sapiens
ttggccaatatacatgttggttattcacacgatggaggcttcattgcctgatacatcccatactgacagtagcagatttggaactcatgaaaccctcatcscttcaacttcctgcaacaccccagctccttctaatagaacccagtgtctccttaattctttatgtgatgaatacgtattgagtagctactctgtgttagt

SEQ ID NO: 48241 - DNA, 201 bp, Homo sapiens
gagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaa

SEQ ID NO: 48242 - DNA, 201 bp, Homo sapiens
attagtttcctaattcttttatttttaaaataaaaataaaagattaaatcagatcaaacagttggccaatatacatgttggttattcacacgatggaggcytcattgcctgatacatcccatactgacagtagcagatttggaactcatgaaaccctcatcccttcaacttcctgcaacaccccagctccttctaatagaa

SEQ ID NO: 48243 - DNA, 201 bp, Homo sapiens
tgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggta

SEQ ID NO: 48244 - DNA, 201 bp, Homo sapiens
cagcatctcataaattagtcatgctggagtcctctccaggagttcctggtgggagctaaagggaaggtgaactcctttcttttaaacactgctatcatgtkaagatccactgccaggaactaggagggcagagtgaagacagagaaatgcaaagactgtattccgaaaagttaaggaagcagttctgtgggtaaggatagt

SEQ ID NO: 48245 - DNA, 201 bp, Homo sapiens
attcttggaggtggacacaaagtaattgagctttgctaatggagataattaattaggaaacggatgtgcttgcttctgagaaaaatattggaaagatcttytgagaaggcctagccctctgctcttgtaattttccgaagtctgtgccaccctgaggactggtgcttcccctgagccatgacccagccacagttaggaatt

SEQ ID NO: 48246 - DNA, 201 bp, Homo sapiens
gtgtccacagtcacatcgggtcctctgtatctgtggcacgagggcagacagagaggtcagtgtccaacaccgtgggaggaccacaggctcacctccctcartggggtcagcatctcataaattagtcatgctggagtcctctccaggagttcctggtgggagctaaagggaaggtgaactcctttcttttaaacactgcta

SEQ ID NO: 48247 - DNA, 201 bp, Homo sapiens
cagactcacaaaacacaatacactataaggtgtacaatagcactgacagatattttttaaaggttcctctcatctcactatactaacacaaatgttttcarttctacaatctacatttccccctccaatttttctcctcttttttgactgccttgatggtttcagtgggtcctggttaagcctgtctttaagtttctaatc

SEQ ID NO: 48248 - DNA, 201 bp, Homo sapiens
atgcgtagtgtgcgggtatccgaagctgggtgtccacagtcacatcgggtcctctgtatctgtggcacgagggcagacagagaggtcagtgtccaacaccrtgggaggaccacaggctcacctccctcagtggggtcagcatctcataaattagtcatgctggagtcctctccaggagttcctggtgggagctaaagggaa

SEQ ID NO: 48249 - DNA, 201 bp, Homo sapiens
tgacctctgcctttaacacaaacaccttgtttaaaaagtagacttgagggagggcacttgagttcagaagccaaaagaaatgggtattgctctttccgcgstaagcagttctgaacctagaccatatccttgggagaccagagcagctgtaagcagcaaactgcctcttttctgcctccctgtgaacctgcttccctggag

SEQ ID NO: 48250 - DNA, 201 bp, Homo sapiens
cgtgggtaggtaggaaaactggatctgtggtcatgcgtagtgtgcgggtatccgaagctgggtgtccacagtcacatcgggtcctctgtatctgtggcacragggcagacagagaggtcagtgtccaacaccgtgggaggaccacaggctcacctccctcagtggggtcagcatctcataaattagtcatgctggagtcct

SEQ ID NO: 48251 - DNA, 201 bp, Homo sapiens
aacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagat

SEQ ID NO: 48252 - DNA, 201 bp, Homo sapiens
ttccaaacccctgttaatgttgatattttggcctcttatcatgaaccaagaatgttcttaatggcatctagaagagtgaattctttcccgaaggttttcastttactttgcccagatccatcaaagaaatcatatgccagctatggcctacaaaatgtatttctgtatctcataagctatagttttacaaaatgtcttttg

SEQ ID NO: 48253 - DNA, 201 bp, Homo sapiens
caagacacccatgttttctgtgcaccagtttcctcatctgtaaaatgagaatgttaatgtaacctccctcttagggttgttgttgtaatccattgagttgytataatgaagtactgtaggctggtggcttataaaccacagacatccatttctcacagttctggagcttgaaaagtccaatatcaaccttccagtagattc

SEQ ID NO: 48254 - DNA, 201 bp, Homo sapiens
cagatcacttgaggtcaggagttcgagaccagcctggccaacatagtaaaacctcatctgtgcttaaaaaaaaaaaaaaacgtagccaagcgtggtggcgygcacctgtaatcccagctacttgggaggctgaggcaggagaattgcttgaacccaagaagcaaaggttgcagtgagccgagattgcaccactgcattcta

SEQ ID NO: 48255 - DNA, 201 bp, Homo sapiens
ctcaagaatgctcaattcacctttccccaggtctccagctcacacactgcagtccaatttcaaattcttccgtctcaccatgaatctccagtcttgaagcmctctccttgaccccctccttggagggtgatgtggtaaatcaagtcagctctctgtgaatgtctcatcattctccacctgccacagcaattttgccccctc

SEQ ID NO: 48256 - DNA, 201 bp, Homo sapiens
aatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatcttta

SEQ ID NO: 48257 - DNA, 201 bp, Homo sapiens
tatgacaggcagaataatgaccccaatgatatccacattctaatacctagaaactgcaaatatgtgaccttgggtggcaaaagggactttgcagatgtaaytagattaaaatttttgagattgagagatcatgttggacgatgtaagtgggcccagtataatcacaagggtccttatcagaaaaaggaggaggcagaagat

SEQ ID NO: 48258 - DNA, 201 bp, Homo sapiens
tgtaatcccagcactttgggaggccaaggcagacggattgcctgagctcaggagttcaagaccagccttggcaacacagtgaaaccctgtctctactaaawtataaaaaattagccaggcatggcagcatgcgctggtagtcccagctacttggggggctgaggcaggagaattacctgaacctgggaggtggaggttgca

SEQ ID NO: 48259 - DNA, 201 bp, Homo sapiens
ggattacaattcagcatgagatttgggcggtgacccaaatccaaaccatatcaatcatttatttcattcacaagtgcgtattcagcacctgtcatccctgsagctgtactgatgtgaatggagtcacagcccttgataggctcacaggacacaggaagccaaatgtgccattgtgataagtcagatattatgttaaatgta

SEQ ID NO: 48260 - DNA, 201 bp, Homo sapiens
tttagtcagtgctgctctcccacagggtgagatctctctgagccagatcattctcggacagatgatgaatttttctgttccaaacagggaggtgggaggargaagggcaaaatgtttcccatggatgtaccactttttaaagttgtaatctggagtactcatcaacaacatttaattcatgcctttgggggaaagaatggc

SEQ ID NO: 48261 - DNA, 201 bp, Homo sapiens
cagtgaaaccctgtctctactaaaatataaaaaattagccaggcatggcagcatgcgctggtagtcccagctacttggggggctgaggcaggagaattacmtgaacctgggaggtggaggttgcagtgaaccaagatggtactactgtattccagcctgggcaacaaagtgcgactctgtctcaaaaaaaaaaaaatgtat

SEQ ID NO: 48262 - DNA, 201 bp, Homo sapiens
aggattcctttaacacatgattggcccttagtccccatttctctggtgtgagttttcagcttttgttaccacatcaaagctccggcaatttgtgcaggaarccccttgaagcaatcatgaacccacttgtactgtaagagttcttacttccatgtcctaaaagaataataaccacaaaaggatatttccttgctaatggac

SEQ ID NO: 48263 - DNA, 201 bp, Homo sapiens
ctttcctagagcctccagaaggagcacagcctggtcaacactgatttgagccccataagactgagctcagtcttctgacttccagaactgtaagagaatasattcgtgttgtttgcactttatggccatttgttacaggagcaacaggaaattaacataccatgtttgggccaggtgcagtggctcacaggtgagcctata

SEQ ID NO: 48264 - DNA, 201 bp, Homo sapiens
acctgaacctgggaggtggaggttgcagtgaaccaagatggtactactgtattccagcctgggcaacaaagtgcgactctgtctcaaaaaaaaaaaaatgtatatatatatatatttatatatatatacacacacacatataaatatatttacatctatctatctatctatctagatatatacctcatattcttgtgagtg

SEQ ID NO: 48265 - DNA, 201 bp, Homo sapiens
agtctttgagtttagagcctaccctaatctaaaatgaccgtaactttgtcacatctgcaaaggccttatttccaaataaggttgcattctgaggttctggrtgaacatggattttggggaggcatcatttaacccagagcaactgtcactaaaattttcctaccaagatcccttactctagtttaattggcctcttattca

SEQ ID NO: 48266 - DNA, 201 bp, Homo sapiens
aacatatgagaacatatatgtcctttgtgtaagcaaagcttttcgtaattaggatacaaaagtactaaccacaaaagaaaaaaaaaagatagattacattraaattaagagctttgattcttcaaatgacacagttaagaaagtaaaaagtaacctacagagtagaagatatttataatacaaagaaatgctgcaggcctg

SEQ ID NO: 48267 - DNA, 201 bp, Homo sapiens
cctgaacctgggaggtggaggttgcagtgaaccaagatggtactactgtattccagcctgggcaacaaagtgcgactctgtctcaaaaaaaaaaaaatgtatatatatatatatttatatatatatacacacacacatataaatatatttacatctatctatctatctatctagatatatacctcatattcttgtgagtgg

SEQ ID NO: 48268 - DNA, 201 bp, Homo sapiens
atcccctgtgaaggtggtgaagggcagatgggagacggagatattttaatgaaaattgtaacctattttatgaataaaatttattttttattactgtaatttttttttttgagacggagtctcgctctgtcacccaggctggagtgcagtggtgtgatctcagctcactgcaacctgcacctcccgagttcaagtgatcct

SEQ ID NO: 48269 - DNA, 201 bp, Homo sapiens
tattataatgtaataataatagaaataaagtgcaccataaatttaatgtgcttgaatcatccccaagtcatcccctcacctcctcctggtccatgaaaaarttgtcttccatggaaccagtccctggcaccaaataggtttgggacctctgatcaagagtgatagcattgtaatgtaacatttttgaaactcaaaattaat

SEQ ID NO: 48270 - DNA, 201 bp, Homo sapiens
cctggggtcctaaaacataaattttaacattccttgcttctccttgatgatcattcccacatagaaatggaactgcattaataatgattgttgaaaaaatraataaatgattgttgaatgaataaccgaatgaatgccaccagggaaaattattgtctccatttcattttagggcctgaactttaggagaataaagttatc

SEQ ID NO: 48271 - DNA, 201 bp, Homo sapiens
gtacatctgataaaatagaaaaaacaatgaataattgaaaaatgggaaaaggaactgaatagacatttttctaaagaagacataaaaatggccagcaggcrtatttttaaaatgctcaacatcactaataatagaaatgcaaattaaaaccacaatgagatatcacctcatacccgttaatatggctgttatcaaaaagat

SEQ ID NO: 48272 - DNA, 201 bp, Homo sapiens
tgtcttccatggaaccagtccctggcaccaaataggtttgggacctctgatcaagagtgatagcattgtaatgtaacatttttgaaactcaaaattaatgyatagaagtccatgagaagtaaaatgttaaagacaggatcaaaatcaatgcagaaaatccataatgagcaaaatatcaacatgttttaaaaagagggcatc

SEQ ID NO: 48273 - DNA, 201 bp, Homo sapiens
ccatgtagaatgcccacattgtctctggttcccaacaccctgaataactgcagcaataccctttacgattcacatgcagatgggtgtaaaaggttccttgscttatatttgcccagaaatggaatttctggatcacaggtatgacaggcagaataatgaccccaatgatatccacattctaatacctagaaactgcaaata

SEQ ID NO: 48274 - DNA, 201 bp, Homo sapiens
cgaggctgtagcgagcaatgatcgccccactgcactccaggctgggtgagagagcaaggccgtgtcaacacaagacgagacaaaatgagatgagacgagakgagaaaagaaaaagaaaagggaagaagtgagggagggaacatcagtgcaggtaaaatattatttttcttagaatgaaaccaagccagcaagaataataac

SEQ ID NO: 48275 - DNA, 201 bp, Homo sapiens
actgagttttttggtgcctcctttgagatggtgcagaaagcaagctcctcactcatctcctctagcccagccccaatagctaactcactcttagcgcctgyccttgagtgctgtgtgagccattgtgttgcaccagcttgttttaagtcccaacaatcttgttccatggtgtcttttaataatggaagagcaaagaggtta

SEQ ID NO: 48276 - DNA, 201 bp, Homo sapiens
aattcaaagttcatatctcacttcatctcaaaaacaatatgcatatctgtccttggcttcattttcctcctacctcttcagacatctcttctctggctctyccccttaacccctaactgggggctttctaccctgtctttgcacaccatttatcctctctataatgacaactcctaaatctaagaaatgggcacatttccc

SEQ ID NO: 48277 - DNA, 201 bp, Homo sapiens
acttattacatatttggctgtcaatttgtacttaaaaaaccaactagctccagggaggcaaagcaaagtggagaggagaagcgaagcctgttgcatttcarttcaagcctgtggtaatttcagctgcatggagacacttaggactgtttttaaatgaagtcagcaactgtcccaaaatttaaggcattctcattttaaaga

SEQ ID NO: 48278 - DNA, 201 bp, Homo sapiens
gaataataatcggaaatgtaatggaactaatagtggatttctccggactgttaacttctgttcaaagagcccgccaatgatggatagagagcggcgtgcaraaaggaatctttccctggttcagcttgggtgcactgccttgtgctgactctgtcccctcccctacccaccacaccccatgtgtctagaacaatctcctct

SEQ ID NO: 48279 - DNA, 201 bp, Homo sapiens
tgtctttatttctctgcaaaacgagccgctgcagtgcaatcacttgaaatgtagggtctgaatgaaaattaatgctgttgatgaaaccagcagtctaaaayattacaggatattagactgaaaagacagtggtatttgcatccttttgaacattcgcctggatttgcataatggagatgtcacttgtattgcaggagaaaa

SEQ ID NO: 48280 - DNA, 201 bp, Homo sapiens
gcaactgtgcaggtcacacgttcatgaagtccacctgctcttgagcttgccttagacaccaggtctggccgctgaagtgcaggcaagagtgctgtgtgtcrtttctgactgaagcgttcaatgagtcagcatgtgagtttgcaactctctgccgctcctgcagcagtcaggaagctgcatgttcaaggtggcctggctata

SEQ ID NO: 48281 - DNA, 201 bp, Homo sapiens
aggatggcctgaggtgcaagaacaatgaatagaataataatcggaaatgtaatggaactaatagtggatttctccggactgttaacttctgttcaaagagyccgccaatgatggatagagagcggcgtgcagaaaggaatctttccctggttcagcttgggtgcactgccttgtgctgactctgtcccctcccctacccac

SEQ ID NO: 48282 - DNA, 201 bp, Homo sapiens
gtacaggtctatttctctatgagactacccgttgttcaaagcggcaagctaccaacctgatctcattcatctttgcatccttcatgctgattatagtgatyggctgttctcaattaatgaatggaagaattaatggataagtggataaatcacttaataaatcagaaatcttttagactttgctgctcttcctcgaagcat

SEQ ID NO: 48283 - DNA, 201 bp, Homo sapiens
gacggtgccctgtggttgcaacaaatgaaaaccaacccagactttctttaacaaaggggaattgatgaatagatctctcccctaacaagaggctggagatrtgagactggggagagcaggagccatgatgactctggagccctgaggtcggccccgggagctggcttgtagcagaggcagtggagtcagggcaccgccgct

SEQ ID NO: 48284 - DNA, 201 bp, Homo sapiens
gcatctgcattacctgagaacttatttgaaatgcaaattcttgggtccttcctcaggtccgaatcagaaactttggagaatggcactactgtttaacgagmccttcaagtaattctgatggctagagtttgaggaccactgctttaatgcttacgagagttgaattagttgtttaaacagaaatcttagaggctttgaatc

SEQ ID NO: 48285 - DNA, 201 bp, Homo sapiens
acatacaaatttatcacatcacgtttcatcatgcctgctcccaatggtcatgagttattgaatttgtataggagagttaatttgtaatgtccttgaggtaycatttttcactattggcctatgttggccacctttgtttacatttagttcagaaagcactaatttaagaagtgtcaggttgtaacaaaacataagatcaat

SEQ ID NO: 48286 - DNA, 201 bp, Homo sapiens
atttattttttagtgcagtgcttctcaaagtatggtccctggaccagcagcatctgcattacctgagaacttatttgaaatgcaaattcttgggtccttcstcaggtccgaatcagaaactttggagaatggcactactgtttaacgagaccttcaagtaattctgatggctagagtttgaggaccactgctttaatgctt

SEQ ID NO: 48287 - DNA, 201 bp, Homo sapiens
ctcatattgcctagttctgggcctccctgtcctctgtcctgtggccacttttccatgtggggacttttggggcctgatggctttttggtacctctgctgtyctgctagctgccaagaactctccattactccacctttgattgcttgggacacatttttaaataaagcagctttgggccacagcgacaaaaagtgtagagc

SEQ ID NO: 48288 - DNA, 201 bp, Homo sapiens
acctatggaattggaatctacaattagaagaccctcaggagtatgcacgttaaagtttgaggtgtttaaagttaaagtatgcactttaaagtttgaggtgygtttattcaggtagctttcctttcttctcatatagtttttaggtataaatgaaaggtctggattatttcacgtattggcagatgtgtatttattttttag

SEQ ID NO: 48289 - DNA, 201 bp, Homo sapiens
tctgtcctgtggccacttttccatgtggggacttttggggcctgatggctttttggtacctctgctgtcctgctagctgccaagaactctccattactccmcctttgattgcttgggacacatttttaaataaagcagctttgggccacagcgacaaaaagtgtagagccatctttttgttttgcagcctctatttctgtt

SEQ ID NO: 48290 - DNA, 201 bp, Homo sapiens
ctggttagaaattcataatctgtagccaaaacctatggaattggaatctacaattagaagaccctcaggagtatgcacgttaaagtttgaggtgtttaaarttaaagtatgcactttaaagtttgaggtgtgtttattcaggtagctttcctttcttctcatatagtttttaggtataaatgaaaggtctggattatttca

SEQ ID NO: 48291 - DNA, 201 bp, Homo sapiens
cctgcccttagaagtcaattattttatgatggagaaaaaactgtggtccgtagatcagtagaatcagcatacctgggacctggttagaaattcataatctstagccaaaacctatggaattggaatctacaattagaagaccctcaggagtatgcacgttaaagtttgaggtgtttaaagttaaagtatgcactttaaagt

SEQ ID NO: 48292 - DNA, 201 bp, Homo sapiens
gtgacctctgcctttaacacaaacaccttgtttaaaaagtagacttgagggagggcacttgagttcagaagccaaaagaaatgggtattgctctttccgcsctaagcagttctgaacctagaccatatccttgggagaccagagcagctgtaagcagcaaactgcctcttttctgcctccctgtgaacctgcttccctgga

SEQ ID NO: 48293 - DNA, 201 bp, Homo sapiens
ttggcctggcttcgataacttacctaacagagaggtaatcttttcatggggcaccccacacttcacgccacacttaggcaagaagaaatgttcacagtctyagctgatgccagggaactttacagcaaaggaaacgttgaagcgcctcctgggctgtgtccctccatccctgtgcctctgtcatcctgtctacagattctc

SEQ ID NO: 48294 - DNA, 201 bp, Homo sapiens
cagaatgaaatgttgttgtaccatgatgactgccctgcccttagaagtcaattattttatgatggagaaaaaactgtggtccgtagatcagtagaatcagyatacctgggacctggttagaaattcataatctgtagccaaaacctatggaattggaatctacaattagaagaccctcaggagtatgcacgttaaagtttg

SEQ ID NO: 48295 - DNA, 201 bp, Homo sapiens
atcttccttctgcctcagcctcctgagcagctgggaccgcaggattgcgtgccaccatgtatggctaatttttataaagttttcttttttttttttttttttttttttgtagagatgatggggtcttcctgtgttgcccaggctggtctcgaactcctgggctcaagcaatctttccaccttggccttacagaatgctggg

SEQ ID NO: 48296 - DNA, 201 bp, Homo sapiens
ccccaatcacaaagccattaagtggttctgtcaggatttgaatccatagcctaagttcatcaccacattcttctccttgtctcagtttcggtatttctcasaaatcaagggacctggagagaaacagaaactatttccacaacatcaagaatgtcacttagaatcaatattggcctggcttcgataacttacctaacagag

SEQ ID NO: 48297 - DNA, 201 bp, Homo sapiens
tggagtgcagtgacatgatcatgactcactgccacctctacctcctgggctcaaatcttccttctgcctcagcctcctgagcagctgggaccgcaggattkcgtgccaccatgtatggctaatttttataaagttttcttttttttttttttttttttttttgtagagatgatggggtcttcctgtgttgcccaggctggt

SEQ ID NO: 48298 - DNA, 201 bp, Homo sapiens
caaagtcaacaagtgttatttggccatagatatctcttaggccatgacaacccacctcctagtaccttcccagccttgggttaacttcatgtcagtgctcrcattggtgcttcactgtgtgctgtgtcttacctttcaaacacccattctgcatcttcttgtttcctaatctttgctcatgtattcactcaggctggacat

SEQ ID NO: 48299 - DNA, 201 bp, Homo sapiens
ccacctctcctcatatcttcttggcgagctgttgaccatatgactaaatctagctgcaaggaaaatcaagagctattggtctttctttgggggacaaataraagtttctggtaattattttatgtaaaactaatccgaagaaataagtacattttccttccaaacatggcaatcctggcagggttgtgggcactggaatca

SEQ ID NO: 48300 - DNA, 201 bp, Homo sapiens
tatgataaccatctagtgggggaggcaaacttgaatcgaatgatggcacaaataagtgtggaattatagagtatggtaaaagctaagaaggaaaggcaaayagggcttcaagagtacacagcagtgagcctggacccagggggatgtgggaagcccaggaacctggataagtggctgttgttgtttaatctattttttagc

SEQ ID NO: 48301 - DNA, 201 bp, Homo sapiens
tgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaa

SEQ ID NO: 48302 - DNA, 201 bp, Homo sapiens
gtccccacattgcagaagaggagtctccagcactgagactgagtagttcacccaatgtcatatagggtggagtgttaaagtcctaaataaaacccagtctrtaggacgattgagtctgtgattttaatccctgtgtagtctgggtttacatttccattcagattcctgctccaacatttcctatagatgctcctcaactta

SEQ ID NO: 48303 - DNA, 201 bp, Homo sapiens
ttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgaca

SEQ ID NO: 48304 - DNA, 201 bp, Homo sapiens
ccagcaacccttggagctctttggcttgcagaagcatccaccactccagtcctctgtctttacacggctgtctccgtgtgtgtcttcacattgttttcctygtctgaacatctgtctctgtgtcctaatttctcatttttataagaacaccaatcatattggcttagggcccgtgctcatgacctcattttatcttgttta

SEQ ID NO: 48305 - DNA, 201 bp, Homo sapiens
cagtgtgagagacagaaacttcagctgagagttaccgtgcaaggcagaaaatgctggtctagcaaaaggaactctgatttcgatttggaagtacagagaawgagcatctgccttggacagagttatcagtgaaaagatgacatatgagctgagactgaaaatcatgttgaagatagtcaaacaaaagctggcagtgtggga

SEQ ID NO: 48306 - DNA, 201 bp, Homo sapiens
atttgttgcagcagttaatgttgctctgcctaacataagactctgctctaccacatcaggtttcttcatgggtaaagtaaggtcttctcctatgagaatgyatagagccctagacagagcttgcatcatagctttagaatgcaagccccatgggacagaggctgtgtctttcttatccatcattgtacccattccctagca

SEQ ID NO: 48307 - DNA, 201 bp, Homo sapiens
atttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgt

SEQ ID NO: 48308 - DNA, 201 bp, Homo sapiens
gccgttacaagcattaaataaccttcttcaggtaaagttcttgctgttgaatctgacatcaaataagccatcaaatgttacaaccactacctcctcttcckggctagcacctatgtgaaatgaatgtacatggcttgactcaggtgatgcctgtcttttgtggccttttgcgattggcccctgtcacttagcacaatgttg

SEQ ID NO: 48309 - DNA, 201 bp, Homo sapiens
gtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggag

SEQ ID NO: 48310 - DNA, 201 bp, Homo sapiens
agattagaagagttcccattgcaccttgaaattcattttcaaagcattcattgcacttgggactattagtttaatgcccagcacctggaaccagtgcttgraacatgggagtcccttaataaaatgttactggataaatgaatatttgtcttcccagagagacagtgagcttcctagaagccacatgcgggctctttgctg

SEQ ID NO: 48311 - DNA, 201 bp, Homo sapiens
caatacttaggaggaattgagttagagatacatttgtagcttgaagagttgcttatttgataagttatcggagtgtgtttcaaagacattatgcctatgtraaagtaaagatggagttgtttatctctgtatctccttgtcctgtttctcccaggacttggcagaactcttgatggcaagaatcaaatctttgtcctactt

SEQ ID NO: 48312 - DNA, 201 bp, Homo sapiens
ctgagctcaagcaaccctcttgcctcagttctggaaatagctaagtgggactacaggtgtggaccaccaggcccagttaattaaaaaaaaaaaaaaattttaagacaaggtcttgttatgttgcccatgctggtctcgaactcctggcttcaagtgatcctccaggagtagctggcattacaggcttggctgacttttaaa

SEQ ID NO: 48313 - DNA, 201 bp, Homo sapiens
ggtatgtgtttatcaacagtgtgaaaacagactagtacaagctcatacagtgtagaagtcactcctcaaaggtgacttctgtcaccaccctcaccccaagrttagaagagttcccattgcaccttgaaattcattttcaaagcattcattgcacttgggactattagtttaatgcccagcacctggaaccagtgcttggaa

SEQ ID NO: 48314 - DNA, 201 bp, Homo sapiens
gtaaaaggtttcttgcatccatttaactattgtaaatgaataaccatgtgaccctcaagaagattccaagccaaattccattggtttctaaggtcttaggkttgcttgcttttggcaaagagtgtacttatcttttcatgcatgcctttaaagagaccatattttttctctgataaagtcaattatcagtgtatgtgctgc

SEQ ID NO: 48315 - DNA, 201 bp, Homo sapiens
aatcctgttaaagacctgccctcactgaactgtgcccctccacctggaggctgcagcgggtcaaggatggcttcactgaagggatgatatttgaacaagavttatttttatttctttttattcttctatcccatgacatttccttttctagtctcctaggcagccatcaacaaggtgcacaaatatgtctttttgcttata

SEQ ID NO: 48316 - DNA, 201 bp, Homo sapiens
tgccataagcttatttgtatttcacagcgacttgcacagatgtgccagatatgtacagatggatttttatcagaagagagtctacccaagtgaagcagtgkagggtgaggctaaatcccaaaattgaaatttggggacactgattaggcacagagcaggaccaggggttaaaaccatgtgggaaacagatcaatagaatgg

SEQ ID NO: 48317 - DNA, 201 bp, Homo sapiens
acaaagtaggtgttatttgtattattattgctgttgttgttgttagaatacatattcctcatttacagacaagtacacaggctaagcatgactgcaacttytgaattgtcatgcagctcagaactgggggatctagaaactgaattcagcagctgattatttggttcccaataccatggtcttgctacttacctactagaa

SEQ ID NO: 48318 - DNA, 201 bp, Homo sapiens
accacaagaacgtgcaaagcagaaacaaagagcacttggcacccaagtcttatagaggctcatttctgatatcttctagggaacttctttgtataaggacrtcatagagaaggtttgtctttcatttgtctgtagcaaggtcgtaattttttttaatctttaaaaaaaattattgttaatacaaataagtctattgtgatt

SEQ ID NO: 48319 - DNA, 201 bp, Homo sapiens
agtcacagacatgtaaccttccccatgccttctggggtccttgctctaatttgggagatacaacacatagagaaaaaggtacatgaggcagccttgccacyggaagaaaatggcactcaaattcccagctgtcatctgggaaaggtcaattgttttctttacaaagccaccttcatagcaagactttatccatgtcagcag

SEQ ID NO: 48320 - DNA, 201 bp, Homo sapiens
tgtaaattttaagttttatagtagccaagtttgcaaaaggaataagaaactggtgaaattaattttaataacatatatttaatttcatatgtaaaatattrtcatttcaacatgtaattaatatgaaattattgactattttacattcttttccttatttagacattgaaatccagtgtgtattttatacttacaacatgt

SEQ ID NO: 48321 - DNA, 201 bp, Homo sapiens
agaagacataaaaatggccagcaggcgtatttttaaaatgctcaacatcactaataatagaaatgcaaattaaaaccacaatgagatatcacctcataccygttaatatggctgttatcaaaaagataaaatataaatgttggcaaggatgtggagaaatgaggaacccttgcccactgttgatgggaatgtaagtacagc

SEQ ID NO: 48322 - DNA, 201 bp, Homo sapiens
acctagaaaaaattcccaaactgatttcttaaaatttttacttgaaaaaaatttcagcttataaagaagttgcaagagtcgtaccatagttggaaatactstgaatcatttgctttgttttggtgtgatagagattttttgtaacgatcacttataatgtaactccctggaatattaaaacaattgttaaggacctgatgt

SEQ ID NO: 48323 - DNA, 201 bp, Homo sapiens
aatcaacctaaaaattcatcagtggatcaatggatcaatggataaactatttttaattgaaagaattaaaattgtatctttatgagcctattgatgtttcmgagaaataaactctggtcattgaatgaaatctctgtgttgcagaaacctctataagctcctatgtacagataatctcacagggtaaatttctctgactag

SEQ ID NO: 48324 - DNA, 201 bp, Homo sapiens
ttgttacagcatccccaggaaatagatttagtgagtgaagggtgagccatttgcattagcagaacacagaactgaggagacagaaacccagccacacttgwgtgaggcgtagggcaaatctttcctagataataactcaaatcattcagactgctgcctctctgcctctccctttctgtctcttttcaccgcctctccttc

SEQ ID NO: 48325 - DNA, 201 bp, Homo sapiens
ttctcaagtaagtggtttacttaagcatacatatatatacaatttcattttcctaagacctagaaaaaattcccaaactgatttcttaaaatttttacttraaaaaaatttcagcttataaagaagttgcaagagtcgtaccatagttggaaatactctgaatcatttgctttgttttggtgtgatagagattttttgtaa

SEQ ID NO: 48326 - DNA, 201 bp, Homo sapiens
cattttacagatgagaaaattgagacacttatattcacatatcccactctaggtcagtcagtagcagagtcggatgatgcattctgttgttagtgcctggmcaattaagtaccaagaaatgctattgattataggagttcatggtagggaagaataaggctgataagtaatgagtatagtttaagggcagacgtatttgga

SEQ ID NO: 48327 - DNA, 201 bp, Homo sapiens
gaccttgtccatgtgatctgatttggaagaagagtctttgcagttgtgatttattgaagggtctggggatgagagtactgtggattatccaggtgggccckgaatgccatcacaggtgttcttagaagaaagaggcaacaggagagaacacaggtgcacagaagcacaggcaaggtgaaggcagggcagagagagatgtgg

SEQ ID NO: 48328 - DNA, 201 bp, Homo sapiens
taatccacttattttcttctcaagtaagtggtttacttaagcatacatatatatacaatttcattttcctaagacctagaaaaaattcccaaactgatttyttaaaatttttacttgaaaaaaatttcagcttataaagaagttgcaagagtcgtaccatagttggaaatactctgaatcatttgctttgttttggtgtga

SEQ ID NO: 48329 - DNA, 201 bp, Homo sapiens
gctgttctcaaatagctctaacttatctctcatgcaccagagcactcttgtttctcactgaacactttttgaatgcctctttcatgttgggcttgggcacygttctcagtggtctttgtagttagatgtttttgccaaaatgttggaaagagtccttgatatatggaaactgacaaagacataacttcaaccagtcaagga

SEQ ID NO: 48330 - DNA, 201 bp, Homo sapiens
gcggatgtcacacattcatcttccccagccactttgctgcgtttctgaaaagataacatagatgcctggagtgcagacatcttgagatttaggagctggcsccttacagctctttgtgaattgagcctagaaaacgtgtctgtttttagctgaccccaagaacagaactggcaaccgcttcgtgcagaggagtcttcctcc

SEQ ID NO: 48331 - DNA, 201 bp, Homo sapiens
aattaatccacttattttcttctcaagtaagtggtttacttaagcatacatatatatacaatttcattttcctaagacctagaaaaaattcccaaactgayttcttaaaatttttacttgaaaaaaatttcagcttataaagaagttgcaagagtcgtaccatagttggaaatactctgaatcatttgctttgttttggtg

SEQ ID NO: 48332 - DNA, 201 bp, Homo sapiens
aaatacggtgaaaccccgtctctactaaaaatacaaaaaattagccgggcatggtggcgggcgcctgtaaccccagctactcaggaggctgaggcaggagratcacttgaacacgggaggtggaggttgcagtgagccaagatcacgccactgaactccagcctgggtgacagagcgagactctgtctcaaaaaaaagtct

SEQ ID NO: 48333 - DNA, 201 bp, Homo sapiens
acccttctcctcttttttgtatcataatgaccttattttgaattatggtggtactttaaattttatgtccctgaagggttaagctctatgttggctttacstgaactctctcatcctcacccaccagcaagatgaaggtagggtggccactgacaggtgacgttcgtgaggtgcatggcttttctgaagataagcagtaat

SEQ ID NO: 48334 - DNA, 201 bp, Homo sapiens
aagtcagcagtaacaacattacagaaagctgagaaagaaaatacggtgaaaccccgtctctactaaaaatacaaaaaattagccgggcatggtggcgggckcctgtaaccccagctactcaggaggctgaggcaggagaatcacttgaacacgggaggtggaggttgcagtgagccaagatcacgccactgaactccagcc

SEQ ID NO: 48335 - DNA, 201 bp, Homo sapiens
aacctcagcaactgaccagaaaaggtcaacttagaaaatgagattttgtagtttaaactcctggaaattcatagatcataacatttcaacttacttttaasttgagtgacatgaagagataggtcaaaatatttacatttgctaaatgtgtacttactgttctttatatagagctttgcagcttacaacatacagttctgt

SEQ ID NO: 48336 - DNA, 201 bp, Homo sapiens
ttatatcacaacaaatgccatattttaaaatagaaactatccatcatgtactgagtaaagctggtggcaacctatacatctcaaaaatatactgaaaatcyctccatgagtccattaaaaacaaattgattggtttaattccagcacatgctgaaggaaagtataagtgacattaatgtaattttaagtgcataaaattac

SEQ ID NO: 48337 - DNA, 201 bp, Homo sapiens
agttgagtgacatgaagagataggtcaaaatatttacatttgctaaatgtgtacttactgttctttatatagagctttgcagcttacaacatacagttctstgtcaatattttcatttgattttctcaaacctggaagggaggaatggaagatgttatctcaaatttaaagacaaatgaactgagacctgacaagttacca

SEQ ID NO: 48338 - DNA, 201 bp, Homo sapiens
tcccctctgaatattccttttctgcctctctgcattccttttcctcttcccaacacctaagtgattcttaaaaatattctctgactttctatgccttctcsatcagtgttagtttcaagttatcttgtcatagtttcatttaggagataatgcctgaatctttatcttaagccttgaaccctctagaacaatttcatttgt

SEQ ID NO: 48339 - DNA, 201 bp, Homo sapiens
cttgggtgccaagccagccaatggaatctaatgggctttgcttacaatgtgcatggcctggctatttacatgagattgacagcacgagaaaaaccagacgstatactcactaggctgatttagaggtttctctgctcatttgaattcagccaagctagtcagtctagccctgggaaaacctgcaagagtaaaaagagaacc

SEQ ID NO: 48340 - DNA, 201 bp, Homo sapiens
ccacctgagctcaagcaaccctcttgcctcagttctggaaatagctaagtgggactacaggtgtggaccaccaggcccagttaattaaaaaaaaaaaaaamttttaagacaaggtcttgttatgttgcccatgctggtctcgaactcctggcttcaagtgatcctccaggagtagctggcattacaggcttggctgacttt

SEQ ID NO: 48341 - DNA, 201 bp, Homo sapiens
ctctttccctcgctgtttctttcttcttcctttgtttgtctcttttcctaacttttttgcatatgtagctgtgtcttttcctgccttctttttctgcactstatccccagctctctagcttccccgcaacacacatacaccacctactatgctatctggcaattcccactggggaactgtggcaagacatcttatcactgg

SEQ ID NO: 48342 - DNA, 201 bp, Homo sapiens
ttacgagcattaaataactttcttccggtaaagttcttggtgttgtttctgacatctaataagcaatcaaatgttacaactgccaccaccatggtagcacrtcctcttctgggtaacacctatgttaaatcaacgtacatggcttgactcaggtgatatctgtaatcttgactttgtctgtttacatgtaactaggcctct

SEQ ID NO: 48343 - DNA, 201 bp, Homo sapiens
agggctgcctgctgaccgcactcccagcagctggtgccatgggtcctgcattgaagtaggatcttgggggcacatcacaatgtccagcacatagaggatgyagggagtaacagctaaagcaagactaattaggaggctactccggaaatctaactgagagatgaaggtggcttgaaccaggaggtggccaagagttggcag

SEQ ID NO: 48344 - DNA, 201 bp, Homo sapiens
ccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatat

SEQ ID NO: 48345 - DNA, 201 bp, Homo sapiens
ttgtaaaggcaacaaagcaggagttaagggaaaccaaagccataccttggaaggaccaaggtatggggttaataaaacacggatgtttcatcatccaggcrtgtaaattacacatgtctggccgtgtgttctcagagtcacatgtgtattttacatgcaagaacaagccagtgggtggtctcgaggcagaacaactcccag

SEQ ID NO: 48346 - DNA, 201 bp, Homo sapiens
tgaagattattgtctgtcttccttctaaacccatggctctgcgtacctgttcctgctggcccttgaagaggttcatatatttgaaatgagcattttggggrtgttcagcttggtgctattcatgataatttgtaataggttaaatgctttcaattaaagcttaagtcagtgaagctctcagttgagaaatatcagaaaatt

SEQ ID NO: 48347 - DNA, 201 bp, Homo sapiens
gactgagtgctcaacacttttctaggcactgggaatacagaaatgagtaagacaggccaagtccctgctctggtgagcttatgtactggctgggagagagmcaataaaaaaatgaacaggtaggtatgtgatgtctgcaggagggtgatgagtgccatgaagaatgagaaagcaggcgagggggtagatagcgacaggcag

SEQ ID NO: 48348 - DNA, 201 bp, Homo sapiens
gcctgataaggtaacagcattatcccagttcttcgcctaaggaaactggagtctagtgaccacacctttttttggttccctgacttagaacctcttaaatrttccctcaaggtgtgtttgaatttgttgctttgtaaaggcaacaaagcaggagttaagggaaaccaaagccataccttggaaggaccaaggtatggggtt

SEQ ID NO: 48349 - DNA, 201 bp, Homo sapiens
gcaaaagaacttgtgaaatggggtcgggtaagaatctagtgacttctctggatttgcaagcagagggtgcctgatgcagacactgagctggacatgaagcrtgttctctgaagattattgtctgtcttccttctaaacccatggctctgcgtacctgttcctgctggcccttgaagaggttcatatatttgaaatgagcat

SEQ ID NO: 48350 - DNA, 201 bp, Homo sapiens
gtgcatgtcataatgcgtggacattaaaaaaaataaagtttgctccccagggaggatttgccaattcccatattagtaggtcccccaagattgttcccctygggattcatgcctcataaaatcatttgatctggtgggatctcatcttcttaatgtgtctgcccatcatctgttcctgggaggctttattagggcagtgtg

SEQ ID NO: 48351 - DNA, 201 bp, Homo sapiens
gatcagcccccgccagctccaactagtgaaacccaacagagtccttggaccctgcagcctaagaacataaaaattctgtaatctccttctctttatctcasctctgccttcagatgtgtcccttgaatggcccacattctcccaatttcattaacttagcacattttatttccactaagtaaacccaaggtgcttccatgg

SEQ ID NO: 48352 - DNA, 201 bp, Homo sapiens
catattcagctttaatcacacttgcacgcatgccttcttccttaaatctaagtaatatccctgcagctattccaaaaggaacactataactggctatttgmcataataaggatgaggaaattttggttgatcacattttaaatgggaaactgtatttagagagattttaaactgcaaaattaaaaatgcaaacgtgaaatt

SEQ ID NO: 48353 - DNA, 201 bp, Homo sapiens
gccttttttttttttttttttttgagacggagtctggctctgtcacccaggctggagggcagtggcgcgatctcggctcactgcaagctccgcctcccggrttcacgccgttctcctgcctcagcctcctgagtagctggggctacaggcgcccgccacagcgcccggctaattttttttttttttgtatttttagtagag

SEQ ID NO: 48354 - DNA, 201 bp, Homo sapiens
agatcagcccccgccagctccaactagtgaaacccaacagagtccttggaccctgcagcctaagaacataaaaattctgtaatctccttctctttatctcwgctctgccttcagatgtgtcccttgaatggcccacattctcccaatttcattaacttagcacattttatttccactaagtaaacccaaggtgcttccatg

SEQ ID NO: 48355 - DNA, 201 bp, Homo sapiens
tccctccttctgaacaccctagattcctgccaaatataatgttattccacaaacctatgaggaccttgcctgccctctgtcctttgcacatgctcttcctycagcctttgcactctttccttccctcgtccacctgggagactcctgctgatcttttcagactcagcttaaatgtccccaccaaacctcccctccctctcc

SEQ ID NO: 48356 - DNA, 201 bp, Homo sapiens
gcaactccatcaaaacaaaactattctccttattccacattaattgccacaatcacccccaaatgagaaatcctgccatttttcactgtatttatttctgygtctctctctttcttgctttccttcttttgctctcttgctttctcgctagctttcttcttgctttctttcttttcccctattgtagttggttctgttcta

SEQ ID NO: 48357 - DNA, 201 bp, Homo sapiens
tactacccagctcttcctctaagtgggatcctcccagaaagccagagctccgctcctagagagcgtttgaggaacctgcatgtggtttgtcttatcttcakatctttaacataagctgtaacgagggcagctagaagcagagcctatcagatcagcccccgccagctccaactagtgaaacccaacagagtccttggaccc

SEQ ID NO: 48358 - DNA, 201 bp, Homo sapiens
ctccagctcactttatgacagcactctgccttcagggttgtcatcacctgttcagataataatctagctcatcatttttcatctgcctggtgttctttgcrtgttgcttccagaggcagaatcccagagaagagagggaactgtcagctcctaagaatcactcctccagaaaagctcagcaaccaagaggaaaaaaaagaa

SEQ ID NO: 48359 - DNA, 201 bp, Homo sapiens
ctgttagataaggttcctggctctcaaaggcagagccccacctccattctccattctccattctccctcttccactctctccatccaggtgcagcaagccrttttgtgcttcctgttccctggacccgcccaagccctgagcaggcatgggtttaccctccttgtaccatctaatgaggccgggcagagcatcagatggga

SEQ ID NO: 48360 - DNA, 201 bp, Homo sapiens
gagcatcatatagcttctttatctgtagaatagagaggttaaacagcctgcagtggcaaataagtggctcatgtgccaccctactgtcaccgtgctcgtgrcagatattgctaataacccctggcttagcctgagtatccttctcactgcaatgcttctggaacctactatcaattgatcatttagtggtgtttctgaggg

SEQ ID NO: 48361 - DNA, 201 bp, Homo sapiens
cttccgatttcttggggatgtccaggcattggataatggcagcccagttgcttctgcttgcagtggaaggaagggttggcatcgttccccagcacccaccrtttgctgggaaggaaggactgttcttccctttctttaacttgcacctcaatgcataaagaatatctgccctttccccaacatggggcaggggtggcctgc

SEQ ID NO: 48362 - DNA, 201 bp, Homo sapiens
ctgcttggcatgcctagccttctctcctacctgcgagcttggtcttcctcgatttttcacagcccctaattcacatcccttttctccacctgccatattasccacatccctgcttgatctactcattttgttcagtggtggagcgagtgtgggtcacacagctgggagcagagacagtacaactggcaatgtgagagttac

SEQ ID NO: 48363 - DNA, 201 bp, Homo sapiens
tccgtctcttgacttggactatggaagttgccacctgctcagatgccctgaatggtatgttgggctctaaattggcctgacagtaccacagtcctcttccratttcttggggatgtccaggcattggataatggcagcccagttgcttctgcttgcagtggaaggaagggttggcatcgttccccagcacccaccgtttgc

SEQ ID NO: 48364 - DNA, 201 bp, Homo sapiens
gtgtgtatatacatacacatggtatatctgtattatatgtgtgtgtaattgcatatcgtgcttctcgtttgccaggcagcagtgcttgttcccttccacargcacatgcatgcagatccctgcactcccacacatatgcatacactttataagtgtcacaaactgccattcaggcttcccgattgtgccattcagagactt

SEQ ID NO: 48365 - DNA, 201 bp, Homo sapiens
ctgttacgctgggtaacacctgaaggctgagaaaaccaggagcaggggtgacaaagagggaggctgtgacagaaatccaggagggtgacgaagggctcccrggcaggggagaggcagaaggactggaaagagggcacagtgaagggccatggtgggggataccaggcaacactggcaagcaagtggacagtgatgagtgag

SEQ ID NO: 48366 - DNA, 201 bp, Homo sapiens
atatacaggcatatgtaccatatacttatgtgtatatgtacacatacatatggtatatgtgcatgtaatgtatacacatatgtatacatccacatttaatrtatcaaagatatctcaaagctaacctgcccaacctactcatgctcctcctgttgttttgttttgtttcccattgaccttcagtgacttcagtatatctat

SEQ ID NO: 48367 - DNA, 201 bp, Homo sapiens
aaaaaaaaaaaaaaaggaaactttaaaagttaaaaaaaatagaaaaaataccaatagggaatgaggaaataagtcagggaagagaaggcaggtaatgaatrtgagttatcaagctagattctctggtggactttggcactcaatcccaggtggaaactgggagacaaaatgcgtatctccaagtgatctcaccagaggggt

SEQ ID NO: 48368 - DNA, 201 bp, Homo sapiens
taatattggagaaagggcttgcctggttttggagtaatgtccaagttctaattcttacagcaatgaggggtgctgctttactgctttccatccccttaccraagttactgtgaatgaaattgaagagcggatatcggtggcaagttcaagcatagatactgttttgaattctcttaagaaattaaagggcaaggctgggct

SEQ ID NO: 48369 - DNA, 201 bp, Homo sapiens
cgtggcttaaacctgtgcttatagtccgtctgaaacgtgaatctttgtagcaggctgatggtaatttttagataatagaaatcttttgttaatcatagaakttgattattgctgtgctttcaaaggtgtcttggttacctctcatttcttaggtactcactgatgcataaatggacaaacatgtcatagagtaagactatg

SEQ ID NO: 48370 - DNA, 201 bp, Homo sapiens
atagactgtgaaaatctaattttggcaaaatgactgaaatcccagtgaatgattttttcttttcttatataaagctaagcatccaatagtgaaagtttatrtgactcaaatggaagaagaattcatgacaaaaggtgtgattattcgcataagaccctgaaattcctttctgggtgaaataggccctttcttccttccata

SEQ ID NO: 48371 - DNA, 201 bp, Homo sapiens
tgaaaaaaaagttctcctgtgggttagatgctaccaaatagcatcacatgctatagagaaatcattcgtgaaaggaagagtcgatagattggcaaacctcrttgttttcttattttaagaaattgccacagcctccccaaccttcgcaaccgccaccctcatcactcagcagccaccaaaatggaggcaagaccctcacca

SEQ ID NO: 48372 - DNA, 201 bp, Homo sapiens
aaactatcctgttataagtgctctggtaatagaaatacagactataacacacgccagaggatttgacctaagggaagagggtcagagttggctttctgagyggatgtgccatttaggtggagaagtactttgtgcgtctgcattctagggcatgccctgcttggcagttttctcattttatgatgggtcctgtgatgtggc

SEQ ID NO: 48373 - DNA, 201 bp, Homo sapiens
atggttaaaacattcttatactggatgaagatcccatctaggactttcatagctagagagaagaagtaaaggacaagcaaactcttttgtctgggactaaygcaactgatgactttaagttgaagccaatgcttattcaccattgcaaacatcttagggcccttaagaattgtgctgaatctactctgcgtgtgctctaca

SEQ ID NO: 48374 - DNA, 201 bp, Homo sapiens
catgttagcccaattcctttctttctttgtatcattgcttccctttaaatctaaaaagaagattaagtcttccatgccaagccaagcccaattactacaaycagtctttatatggcagtaccccaccatctagactgccgactaacttctctcctcctgatagtctctgctttatgtattttccttaaaaaccacaggaac

SEQ ID NO: 48375 - DNA, 201 bp, Homo sapiens
attcttccagctttcagtttattttctctttcccaaaatgctgtttctctactgttctctcaagtattctcatttggttcattttaagttattggcatattataaatactgagaattttcccaccaacaaacaaatgcaatttataaaaatattgaatatctgtttcaaacacagacattttctcttctgcttcctctctg

SEQ ID NO: 48376 - DNA, 201 bp, Homo sapiens
cctggtcgacctctcctggattccctagtttggaacacacattcaggtgcatctgccatcctgggtcatcccaagggtatgcttaagtcactgttatcagrtgcatttaccctacaggaacaccttcacatcatgttagcccaattcctttctttctttgtatcattgcttccctttaaatctaaaaagaagattaagtct

SEQ ID NO: 48377 - DNA, 201 bp, Homo sapiens
ccagagccataggaaaatggctgacagattcgcagatttgtgaccgtttttctaatgaaggagattttggaaattttgatggtttcatgtaaatgctaaargtaaaacctgtattaagagtcacttgatcacaggaagaaaaataaccaaatgactcaactgcataaggaggtgaaaggaaggatctagaaactacatacc

SEQ ID NO: 48378 - DNA, 201 bp, Homo sapiens
ctgaaacacagcaatattgaagttaggccaatgaataagcctacaataaagtactttctttgcctctaagtgttcaagagaaaggaggagttgcatgtctstctctttaaatcaaacctagaaatgattaagctaagtgaggaaggcatgtcaaaagctgaggtaggctgaaagctaggtttcttgtgccaaagagtaaag

SEQ ID NO: 48379 - DNA, 201 bp, Homo sapiens
gtgaattattcatgcctcccctttttagaccatatagggtaacttcctgatgttgccatggcatttgtaaactgtcatggtgctggttggagtgtagcaaygaggatgaccagaggtcactctcatcgccatcttggtcttggtgggttttagccatcttctttattgcaacctgttttatcagcaaggtctttataacct

SEQ ID NO: 48380 - DNA, 201 bp, Homo sapiens
ttctcagtgtagagtaagctaacaaagttgacagctgttggcctcatgacatcatagaaaatgtgcctaacctaaagtcagaatccctaattttaagcccygcttttacttcccggatattcatcctttattggttacttttaacctcctgttgcttcagttttctaaatctgtaaaagggaatgtaatactgacattata

SEQ ID NO: 48381 - DNA, 201 bp, Homo sapiens
taaattaggatcacactatgtttttagttatgtctattaatgacaagatataaagcacttatatatatagctactgaacaacagaacctgtgaaaaaaaaatctcagtgttttttagctaagtggaaatcctgtttggtcaaggtttttcatgaaataaaatccctgaaatttaaatagacaaaaaaacacacacacaaat

SEQ ID NO: 48382 - DNA, 201 bp, Homo sapiens
aaagccaagagataaaagccagcagcagttaattttctagtccgtgtgctagtgaccacagatatctaaccactgatttccaaaggcttactattattcakacatatttactatggtaaatagctcatgttttcaggaacactgaggatctgtttagtcactttggatttctggtttcatcaagagtttgtgtccgacatc

SEQ ID NO: 48383 - DNA, 201 bp, Homo sapiens
attctaatcccaaaatatgtatatgtcatggcacttttggagggttttgtctttctttgtacagcgttgcggtattatcataagaaaagtctagaagttgsaattatatcttccaagttggcatcccagttcttccacgtagcagctataaccttgatgcagtggaatacaggcgacatggcatgtgacttggagccagat

SEQ ID NO: 48384 - DNA, 201 bp, Homo sapiens
tatttttaatccctgcataattctgagtttaacatgttcatggttattgtaaagaaaattaaaaatagataaatgtattattttaatgttaattacctagrgaaataatcaccacttacatttttatatatgtctttctaatttttctctaatcatatgtagatttttaaattaggatcacactatgtttttagttatgtc

SEQ ID NO: 48385 - DNA, 201 bp, Homo sapiens
gaccagccaggacaaatctatttctgaagctgttgtaaatgatttgaaacaggaagatgaatggaatggaatgagggttgtttaaaagagatttatccctmttattcttgctcaagaaatgagtggccagttgctaccagcctatcccaaaagccaagagataaaagccagcagcagttaattttctagtccgtgtgctag

SEQ ID NO: 48386 - DNA, 201 bp, Homo sapiens
acaatgggattaatactacttaccttaggatgttggtgaacagatattatactgtaaagctacctagtaggaggccaaacgcataatagatactcaataarttgtagctgtcgcaattattgacctcctggactctgtgtcctaatctacaacataggaataatgacagtgcctaacttgcaggtttggtgtgaacaatac

SEQ ID NO: 48387 - DNA, 201 bp, Homo sapiens
tgcatgcctctgggcctacctctgggaagatttgggacaagtggctggaaaagtctactactttctaagacttctcagagctaacttctgaaagtttgtgwtgagatcctaacattctgtgcctatgaaaccaacccatctgatatggtttggctgtgtccccacccagaatctcttcttaattgtaatccccacatgtca

SEQ ID NO: 48388 - DNA, 201 bp, Homo sapiens
tactctggcgcaacccccctggaaaacataatgaagtggtcccgccagagtatcctcacacagggtcaccaccaacacattgcatcagctgccatgcagaygaacacaggtctgttttgcattgtcacccaagtgacattcagtattgccattggttaggcaattttccagaattggtgagattctgaaccaaacaaaaaa

SEQ ID NO: 48389 - DNA, 201 bp, Homo sapiens
caaaactgaatacaggggcttgaatcttgttaaatggtttctctccatctcttggctctacttttttctatggtgacttcactctcaggcagggtcttccsatgtgataccggctattggcagactcagatctgtagccttataatttcacaaccccagcagagagagagagggctgctattactgaacagtccttgcaga

SEQ ID NO: 48390 - DNA, 201 bp, Homo sapiens
gatcattctaatctagaacagggtttctcaatctcattcttggcactattttcatttgaggctgccctgtgcactacagaatattcagcagcatccctttmctgcaccccctagatgggtgtagatacctgtagcattctgcagcccaggttgtaataaccaaaaatgtctcccgacattgccaaatattccctggctggg

SEQ ID NO: 48391 - DNA, 201 bp, Homo sapiens
tgctcattagctcacatctaaattgtggctcctctcagatgggcccatcttcctgattatcctcccagaatgtgggcctcaggcttccttgggacactagycaaggtccctctctatgtccctggtatgggcaccctgttctgagtcccagctctgcagacctctgccccaccacacactgttttctccccaagggttaga

SEQ ID NO: 48392 - DNA, 201 bp, Homo sapiens
actcctaagcattaccactgcctgggaacttcactatggggatgttctgctgaacccctatcaactccagtgggggtggcagcaggttcaagatgccaaasaggagacctggagccagcgatgagacgaggggttttattggatgcttccatacaggggaatccagtggtggcaggctgaacaggagaaccacaaccacct

SEQ ID NO: 48393 - DNA, 201 bp, Homo sapiens
tagttatccccactgaggaatgagggacctggggtatttatctaccaactccccttctattattggttgagtccctcttctgacgagtcacaggtattccyagtaagcagcctctgtagggcacaggtgagtgatgatgggattcaccgctgacagctctgctgtagatttccccgggcaggtgacctctgaactgccacc

SEQ ID NO: 48394 - DNA, 201 bp, Homo sapiens
ctcaatctcattcttggcactattttcatttgaggctgccctgtgcactacagaatattcagcagcatccctttactgcaccccctagatgggtgtagatrcctgtagcattctgcagcccaggttgtaataaccaaaaatgtctcccgacattgccaaatattccctggctggggaaggtggggagctaacgttgtcact

SEQ ID NO: 48395 - DNA, 201 bp, Homo sapiens
ggggccatagattgtaccgctcttgtgtccatgctcaagattgctcattagctcacatctaaattgtggctcctctcagatgggcccatcttcctgattaycctcccagaatgtgggcctcaggcttccttgggacactagtcaaggtccctctctatgtccctggtatgggcaccctgttctgagtcccagctctgcaga

SEQ ID NO: 48396 - DNA, 201 bp, Homo sapiens
gctggtggtcccatagggcctctcactctgggaacaccattcttggctgtgggtgtttcttcaaagtgaacatagctctgaggagcaggaggcaggttcarcagccacatccttaagaacataaaaagttgaagagagacagaagagagacagacgtgtgcagtgcgaagctggggccctcacaatggggactggcttctt

SEQ ID NO: 48397 - DNA, 201 bp, Homo sapiens
gagcccagacttcacccaccaaaaatcctttccagccaagcacgtgataactatagatcttctttgtcctttgcctcaagcagaagccttacacgggtccstcgtaagatgcacctctagggctcattccttcttcaagtcccggtgtagagtttggtgttagaagggacaattagagacttagagattccttcgtccaga

SEQ ID NO: 48398 - DNA, 201 bp, Homo sapiens
tttgagatgttctagattttcctggtgagatttcaaggtccaacacaggattctaatattctcagaagatctcctacatgaattccttcaaacttgagaaytacatttactctccacacaaagggagtaggaatttttcagtataaggcaaatggcaacaaaaacacactagagattacaaagccaacgtcactattattt

SEQ ID NO: 48399 - DNA, 201 bp, Homo sapiens
tccaggtttcctaccaaatagaatgaatgagacaggtagtactgcaaattcatagtttacttacgttaatcataatgtcaaacatgtcaacagcatcctgkagagccccccaagtttcctgtccacttgtccactgtacagccacctacccacgctttacgtactacccagctcttcctctaagtgggatcctcccagaaa

SEQ ID NO: 48400 - DNA, 201 bp, Homo sapiens
agaccaaacactctgaagctggactagagtaatagcaaactggagagtcgcatcctcgttaaatgatggcttagcatgtaaaacattcgtgtgactggatwgtcagtgtttgacaataagatgctgggaggagagccctgtgctcttttgaaattgattgtgtcctccttcaatggatcattaatagttggggaatccaca

SEQ ID NO: 48401 - DNA, 201 bp, Homo sapiens
taaatgtttaattcccctgccccttttgttttcgtcaggccccctgaagccgcagctgagatggctgactccctgaactcttcttatgttcttgactgttygcatagcctttcctgggattacctcccagttccaagtttgcccattctgcaggcagtcttcttgggttccagcttttctccaccatcagcttctccccta

SEQ ID NO: 48402 - DNA, 201 bp, Homo sapiens
tggggtttcaccatgttggtcaggctgatctcgaactcctgacctcgtgatccacccaccttggcctccccaagtgctgggattacaggcgtgagccgccrcgcccagccccctccttctgaaacttggaatgtcctgttgcaatccttagagcacctgtactcagggtatggaagcactcatgaggacatgagcctcagc

SEQ ID NO: 48403 - DNA, 201 bp, Homo sapiens
atgggttcttccatcactcagtccaggtttcctaccaaatagaatgaatgagacaggtagtactgcaaattcatagtttacttacgttaatcataatgtcmaacatgtcaacagcatcctggagagccccccaagtttcctgtccacttgtccactgtacagccacctacccacgctttacgtactacccagctcttcctc

SEQ ID NO: 48404 - DNA, 201 bp, Homo sapiens
aaaaatcaggtgtagaattaattccaacatagacctaccttcttattgcacagacaaagacactgagatccagagacattgaggggctctcttgggctccyccaccttgtccaggggaaagtcaggactgggatccagcgtatagtcacttgctacggctattcccattatgttttgctgctgctgaaacactggaacaca

SEQ ID NO: 48405 - DNA, 201 bp, Homo sapiens
tttgtggacttcagaagtccttccagacaaatggctgctttatttgtgaggtagtgatttatatccctggcagaataatcctgggtgaaagtggctctccstcagcataaaggaatagcaaaacatttatgaaagggagacagagcttcagatgagtgggtacaaaagttccgcacaatatcaatggttgaaagaatatgc

SEQ ID NO: 48406 - DNA, 201 bp, Homo sapiens
gaggtgatgccacttgaaaaaagattagagggttctgaaaaaatcaggtgtagaattaattccaacatagacctaccttcttattgcacagacaaagacaytgagatccagagacattgaggggctctcttgggctcccccaccttgtccaggggaaagtcaggactgggatccagcgtatagtcacttgctacggctatt

SEQ ID NO: 48407 - DNA, 201 bp, Homo sapiens
tggtacgtctgagcctgagtaacacttggcaaccagagtgagccccagaactggctcatgtggaggtcagtgacaaacctttgacatttgatacaatcaamaccaagccgctttgtttaaaatgctcatcaaatacctaccatgcacactgtgtatataaaagtcattgtcacaaaagccctttttcagaatctctagctt

SEQ ID NO: 48408 - DNA, 201 bp, Homo sapiens
cactaagcctcctgaatacttaatttccccaagcctcagtttcctggtctgctaagtggccagaataatatttacatcgtggatttgtatgaaataaatakgataatgcatgaaccatgcttagcgtgagccataacacgcaaaagcaacataatcagtgtttgttaattgtaacaaatcaagcccgggatattgacagac

SEQ ID NO: 48409 - DNA, 201 bp, Homo sapiens
gaaccactgcgctcagcgggaattttttttttttttctttttaaacacaagtcaagtgtagtagtgagaagtgcggaaggggtagaacaaggagtttgatmtgtaactttatccttattaaaataccaatgaaattatttacagaaaaagaaaaaaaattctaaaatttatacagaaccccaaaagacccagaacagcaga

SEQ ID NO: 48410 - DNA, 201 bp, Homo sapiens
tagctgacctataatggtccctgaaatattagctgtcagaaacagcatagggatgattgtagctgaaagcttgctatggccctccaatatttatctttctsatatccagtaggcttcctagttaactctgcctgtcccacatgggcatctaaattcaccttcaggaagtcactattactcctaagactgttcatggagtca

SEQ ID NO: 48411 - DNA, 201 bp, Homo sapiens
ctgattctcaatgtatagtcacataggttgtagtttattatatgtccatgtgtctgtctttccttctagataataagttttttaagggttttattcatttktccatctctagtatctaggccagagcctggcagataatagaaatgttaaattttcactaagaaaatcaattttaaaatgaacctgatgatgctgtcataa

SEQ ID NO: 48412 - DNA, 201 bp, Homo sapiens
tttactcattgactcatacaaccaatgggagtagacacaattattagttgtgttttgcaaatgaggaaactaaggcaaagagaatttaagtaacttgctcrgggtcacatagaaactaactggaaaaattgagatttcgacccagttagtctagcctgcgaatctttactctgagctactttttaactgattctcaatgta

SEQ ID NO: 48413 - DNA, 201 bp, Homo sapiens
ttagagtcctgttcagatgacataagaggcctggcatgtatttgctcacagctgcttattgaaggttcaacagatgcacagctacctagagggaatttggrgccatagattgtaccgctcttgtgtccatgctcaagattgctcattagctcacatctaaattgtggctcctctcagatgggcccatcttcctgattatcc

SEQ ID NO: 48414 - DNA, 201 bp, Homo sapiens
caatcatctttctaatatgtccttgtctgtgacatggtcccagtccttattttcatccaaagagcatgttgttccttcttctttatttccacaatactttrtacataccctctatattaatataactataatattaatgtatacttattatataagaaatatatatcagctatcaatataaataataactagcacataaca

SEQ ID NO: 48415 - DNA, 201 bp, Homo sapiens
tgtgaaaagtttcaatcatctttctaatatgtccttgtctgtgacatggtcccagtccttattttcatccaaagagcatgttgttccttcttctttatttscacaatactttatacataccctctatattaatataactataatattaatgtatacttattatataagaaatatatatcagctatcaatataaataataac

SEQ ID NO: 48416 - DNA, 201 bp, Homo sapiens
cacaatagtagcctgtctgtgtatgatgcttataattgtgatcatcatttatcctaagctcatatgtggaagcccacataagtatggcgtcttaccagtaractccgctgaatccgaggaagggccttaggccttctggcaaggtaacattcagagtgctgagaatgctgctgcaagtggaatttacttatcagaaggtca

SEQ ID NO: 48417 - DNA, 201 bp, Homo sapiens
tcattattttctcatttgaactccctgaggctactaaggcccacccaagagtacctcatataggggctcctttgtttgacttaagggaaacaggtattatwtggcattcgacatcactaatttaattacaaaaaattcataaatagatgcaaataccgccaaccctgagcaggcacatcctctggtttctcctaagggcca

SEQ ID NO: 48418 - DNA, 201 bp, Homo sapiens
cctctacaatgaaaactacaaatgactgcctaagataatttttttctccctatttaagcccacattaacggagagatataccatgttcatggattggaagkctcaatggtattgaaatgacaattcttttcaaaccgacctgagggattcaatgcaataccatgcaaagtcccaatcccagcatggggatcggggcagaaa

SEQ ID NO: 48419 - DNA, 201 bp, Homo sapiens
gctatcttggagttatttctagtcatcgggatcttgcatgatttaaacaaggcccttaggtgaccatcaatttatatctaaattattagtgtgcttgttayagtgggtgaatgttctttcagttcatttgctcattcaccaccaggattctacaccaggaactatgctaggttctagtgttatagggaggttaatatatgg

SEQ ID NO: 48420 - DNA, 201 bp, Homo sapiens
ctgtttcccatcttttgtctctgtggattcaaggtttcttggtgtagaccagacaaggttcccagtgcctgccacatggtaggcattcattattttctcawttgaactccctgaggctactaaggcccacccaagagtacctcatataggggctcctttgtttgacttaagggaaacaggtattatatggcattcgacatc

SEQ ID NO: 48421 - DNA, 201 bp, Homo sapiens
caatatcatcagaaacaccaaatagcaaggtataaatttaaagaaagatatgcaagtcctctacaatgaaaactacaaatgactgcctaagataatttttktctccctatttaagcccacattaacggagagatataccatgttcatggattggaagtctcaatggtattgaaatgacaattcttttcaaaccgacctgag

SEQ ID NO: 48422 - DNA, 201 bp, Homo sapiens
tgcacgcctgtaatcccagctgcactctgtcccaaaaaaaaagaaagaaaaagaaaagaagaaaatcttaactagcccagtgcttatggaaaaaaaaaaaatgttcttgaaaaccaaaaagaaaactacagatccagatggctttgctacatgtttccaaatatttaagaaagaaaaacaattttatacaaacccttccag

SEQ ID NO: 48423 - DNA, 201 bp, Homo sapiens
atttgcttctaattctggatctcttactcaggacttggttgcccagaggaggtttaataaattctttttaactctacttcccaccaatttttctcccttckatctgttcctatatctctaccattcatggcagggttagcacgtggctccaatggtgagcaggaaggacttcacctcttgtctgtcccttagctttggtgt

SEQ ID NO: 48424 - DNA, 201 bp, Homo sapiens
tacatgaaaacacagttgtgcaggacatatctgtgcacctctttgctgaaagcaacatcctcaggaagaccacttcccagcttgcgacctaaacatttagstctaaacacttgagctctaaacatttagttactcgctctcccctgtattaatgtatgctgcataaaggacccccattttcctacattaaaccctgtataa

SEQ ID NO: 48425 - DNA, 201 bp, Homo sapiens
atagctaaggcatgccctgtttcctgacccagttaacccatggttgaataagtacctctttattttaagcttcttagtttgtggcaagataactaacacayacatgaaagtctaggcttgggtatcatcaaaggacctgctagcagaattcttgtacatgaaaacacagttgtgcaggacatatctgtgcacctctttgct

SEQ ID NO: 48426 - DNA, 201 bp, Homo sapiens
tctcaagttgatttccttttacaccacttcctttgcagagctggacagaaagctcgtggcaatgtgtactttaatggaattaattagtatcacagcaagtygatcaacttggaggcacgtcactcacccttcattggcatcggaattatttaagttggcgcggcctctatgttaactacacagttatttttcatgcaatat

SEQ ID NO: 48427 - DNA, 201 bp, Homo sapiens
ggatgatcctttgaagccttttgaagcaccttgaagcagagaagatagctaaggcatgccctgtttcctgacccagttaacccatggttgaataagtacckctttattttaagcttcttagtttgtggcaagataactaacacatacatgaaagtctaggcttgggtatcatcaaaggacctgctagcagaattcttgtac

SEQ ID NO: 48428 - DNA, 201 bp, Homo sapiens
tctcagtagctgggaggagacctgcacaggcattggtttttagtatatgtggtaggcagcttctaagtgaccccggtgatcctcacttcctggtcttcacrgcctcaggtaatcctcttcccttgaggaactggcttctagccaatagagtacctcaacattgagggaggtgtcttctgtgatcgttttacaaaagatttt

SEQ ID NO: 48429 - DNA, 201 bp, Homo sapiens
gagcgtgtgcaccctgcagtgagaccattgcttcagtggttatggagcagccagagaacataaatgaactgctagctttaggggatattactgtggtcttrtttctccaaaactaaaacgaaaagttctagtgcactcactcggtgatgattcatttgttcattgattcatttctttcatttgtcattcaaccaacaaatt

SEQ ID NO: 48430 - DNA, 201 bp, Homo sapiens
agggacatgcagagaaacacctagattttggattcatttacacattcagcaaatatttattgggcatctatggtgtaccaggcgctgcactggactcagaratataacaatcagccaaatgaacaagtctggaccttcagggaccctcgtggaggtgttacctacaagtgaggaaaggaagaccaaagtgtttgttagtta

SEQ ID NO: 48431 - DNA, 201 bp, Homo sapiens
caaagttggtagatcctaacatggtgacccagcaagagtctcttttcaaactggctgtcctcgggggtaggagcagagccagggcaaaccgtcagggatgstaagtaaggagcttcaaggggatccaaggcacctccttggactcagacatgcttgggaccgcgttcgtaggacaacttttactgtccattgccacaatga

SEQ ID NO: 48432 - DNA, 201 bp, Homo sapiens
tctctgggtcatcagtcccttagataacatcatgtgtctacagctgggatagcaagtaggttttgttttgtgggtcaactcacatgaagaggatgcctagrtgtctgcggtgagcaagattctagagctcatcaggaaagtatgctgtagtcaattagtgatgtctgccatgtgcacgggtagagaagttatgtcatgcat

SEQ ID NO: 48433 - DNA, 201 bp, Homo sapiens
cctcttttattaaatctgctctaagcagttggatggggagtgccttttcgcctgtctaccccttcccaaggactatttatattgaggcaaccaaatgatcmaggaagaattcgtgaatagccatgatcaaagtaaccagacagggagttagaggttcaatcgtatttggggaaaatggtccaatgatggggaaagggccca

SEQ ID NO: 48434 - DNA, 201 bp, Homo sapiens
taataaaaacatgacacattaacctttgacttgtctagtctcctcttttattaaatctgctctaagcagttggatggggagtgccttttcgcctgtctacsccttcccaaggactatttatattgaggcaaccaaatgatcaaggaagaattcgtgaatagccatgatcaaagtaaccagacagggagttagaggttcaat

SEQ ID NO: 48435 - DNA, 201 bp, Homo sapiens
aaggaggtggaagagttttctctccttgccaatctctccgttgctctctgataaaaggtgcggcaaacagggtagaaatgactgcacgggaccagaggatrtaaatattcagtcatgacagtccccataggataaatgacagcagcccatgcaatgtgccttctgcacattttcaactgactcttcccctctgcagccaag

SEQ ID NO: 48436 - DNA, 201 bp, Homo sapiens
gtttacttgaaagctctgtctccactctccctacaaaaattcaagtaagaacctggaatgcaaggaggtggaagagttttctctccttgccaatctctccsttgctctctgataaaaggtgcggcaaacagggtagaaatgactgcacgggaccagaggatataaatattcagtcatgacagtccccataggataaatgac

SEQ ID NO: 48437 - DNA, 201 bp, Homo sapiens
ttaacaggcacatgtgaccggtggctgccgcattggacagtggcagctctagagagctggaaccaatttatgctccttctgacattcacagggaatgctcygtataaatcttggtctcttcttcctttttaaggtcacatagcacctggatttaaactccaaagctaccccaattttagctggagggaccatattccaagc

SEQ ID NO: 48438 - DNA, 201 bp, Homo sapiens
acctattcatttactgtttcccatcttttgtctctgtggattcaaggtttcttggtgtagaccagacaaggttcccagtgcctgccacatggtaggcattsattattttctcatttgaactccctgaggctactaaggcccacccaagagtacctcatataggggctcctttgtttgacttaagggaaacaggtattatat

SEQ ID NO: 48439 - DNA, 201 bp, Homo sapiens
taactccccctcctttcccatctctgctttccctcacattagccaagctcctgcagtgtaggagaaagagccaaagcagaatgcaaagagactgagggcastctaaggggcaagcctgacttctttagaaactcatcgcagcagcaactgagatcagaggttggctgaggtattggctgcagccaccagcatcatcctcta

SEQ ID NO: 48440 - DNA, 201 bp, Homo sapiens
gtctatgacaataaaatgaatgtatgtcttgatcacaccaggaagtctctgctaccaacacccccaggagaaaacagctccaggctcttgaggctcctcamgtagcaaagtctcatcgctcaggtcccgcatgtcagaatttgccatgattcactcacagcatgtgtcatgtgtatctggtagaatgtctgaaatgcattc

SEQ ID NO: 48441 - DNA, 201 bp, Homo sapiens
cagccagctgtcatttccaatgcactgagggctgtccataggagcattaactccccctcctttcccatctctgctttccctcacattagccaagctcctgyagtgtaggagaaagagccaaagcagaatgcaaagagactgagggcagtctaaggggcaagcctgacttctttagaaactcatcgcagcagcaactgagat

SEQ ID NO: 48442 - DNA, 201 bp, Homo sapiens
caactacaaacatgaatcaatgacttgaaagaaggagagtaatattccctgaccttaaacaataaaggactatgaccctgtttggggactggggatggtcrttgagggctcccctaaaaataaatacttgctctgaacctcaaatgaagtgtaggatttagaaaggcaaggggccaggtgaaagaaaatggtttcaggagg

SEQ ID NO: 48443 - DNA, 201 bp, Homo sapiens
aatacataagttcataatgataggggaaaacaaaattatttataggttaccttacaaagatgatagaaaccatctcattattttagaaacggaaaggaaawaaaaacataaacaactatcctgcctttgttttcagaattccttgtagaaataattaactagtggatgaagagagtttctctttctaggtaataagcaacg

SEQ ID NO: 48444 - DNA, 201 bp, Homo sapiens
ttgaaagaataaaactcattatcacatggaatatgatagctgtaaaagagcaacgcttggaagccaaagcaaagtcccgcatatgataaattaattagaawagaagttacataaaacctcgaccttctgtgtgacccttatcttataattacctcttctttaaaagcagaatgaaatattttatgtatgaagatgttactg

SEQ ID NO: 48445 - DNA, 201 bp, Homo sapiens
ccttttgttcaaatgacttggcccctttggtttttaaatgacatctaagggcaaaacagacccaagactttgtggaatgactttccaggaaacaaccatayctaggtaaacccatgctcacaggttccctctgttaatggtgaaattacatcaaggatgaccttttgaaagaataaaactcattatcacatggaatatgat

SEQ ID NO: 48446 - DNA, 201 bp, Homo sapiens
tgctcccttgttgcttgtaggaatgggggtggggaaaggtcaggactatatatttaagaaaaaaaccccacatatgtcgacccacaagtggttacaacaamattggtttacttgaaagctctgtctccactctccctacaaaaattcaagtaagaacctggaatgcaaggaggtggaagagttttctctccttgccaatct

SEQ ID NO: 48447 - DNA, 201 bp, Homo sapiens
tttcctgacaataaaggggctgaggtgaggaccccagctgtggaccacactacccgaagagaaccaacaaccaaatcaatatccaaaaaataacaataacrtccaggtcatttcacttatgagacagaagaggtaaaacaaattctcagatacaaatatttctgctgctccacattgttccatggggccaggattgtgaag

SEQ ID NO: 48448 - DNA, 201 bp, Homo sapiens
gtcacttgaactcgggaggcggaggttgcagtgagccaagatcgtaccactgcactccagcctgggcgacagtgccagactccatctcaaaaaaaaaaaawaataataataaacaaatggatgcatgaacaagtgcataataggtagataaatacaccttaggagacagatcaaaatgcagacttgaatttaattggcaca

SEQ ID NO: 48449 - DNA, 201 bp, Homo sapiens
ccaggtgatttgcatacacagtggcatttgagaagcattaatccaggggcttctttgcagtcagtgatggtgatttgccaatcattagcatttcagaaacmccaggccgaaaccatacatttatccttagctaggtcggtatcaagtttctctgctttcagccagaatcctaacaattcagcttggttgattatctaagaa

SEQ ID NO: 48450 - DNA, 201 bp, Homo sapiens
caagcagcttcagcatcacctgagcacttgtcagaaatgcagcacctaggcgccgcaccagacctgttgaataggaatctacattttcacaagattccagrtgatttgcatacacagtggcatttgagaagcattaatccaggggcttctttgcagtcagtgatggtgatttgccaatcattagcatttcagaaaccccag

SEQ ID NO: 48451 - DNA, 201 bp, Homo sapiens
aaggccagtaaaaatagtcttacatgcatattaccatgaccgtgaaaataatcccaccctgggcatagcctggctcttgtttgaaatgtgtggtacttctmtgtgacaagatatagaataagtcattggaagaaaaactgtcctattactatattttatataaaagtgtatcttgtgttataatgggcctggtatacagag

SEQ ID NO: 48452 - DNA, 201 bp, Homo sapiens
ggttaggtagtttggccctcatcacagtgccaggaggtgcgggtgtaagatttgaacccaggaagtgtgattcttgtagcaattgctgtgtggttgagatstggtctgggaagtggggctaacacagaagtgtggataggacagattatttctgcgctccaaagttatgaatatatatactccaaaatatgcttcagtgac

SEQ ID NO: 48453 - DNA, 201 bp, Homo sapiens
cgctaccactgggacgggcaatgggaggcatctgaggctttgctgacaacttcttctgctgtgagggtggaaagcaggccagatctttatgacctggactycacgttttgggattctagcaagatgggacccactccgggtgctgtgcccattctcagtgccagtggggctgatatggggtcatggcaggtagcgggagat

SEQ ID NO: 48454 - DNA, 201 bp, Homo sapiens
gcattgcacagaaggcttgcataaaaaatatgcatcttctgtcatcttcaccctctacactggcctcccaagtccccatggaaggtatctagtacgggaamctttcttttcctgtaagaatgttgtggccaaacatgctgtgtattggatggatggatgggaggatgatttatattttcatctcggtatagttcataggtc

SEQ ID NO: 48455 - DNA, 201 bp, Homo sapiens
cagagttggggagggagggagattttgaagggggaaaacacgaaccaagtaggtagatatttgcatctctcaacttttctcgtcaccaaaaaaaaaaaaaatttcctcttcaaatttgtaggtaaaaagacgtgtttctttaactttacctctcacaaatggtatgttcatctatcggctgggactcttttagttaaaaag

SEQ ID NO: 48456 - DNA, 201 bp, Homo sapiens
cttgaaataataagcattcttatttctttaagtgacagagacatagcaatggctttcctggctaaacgtgatcatcacagacacactgaccagctgtttawctttgcttccacaaattccaacaggcaacttaatagacattttgtggttatatgtttctaagacagccatgggaaatgaatttatttctacctttgtgaa

SEQ ID NO: 48457 - DNA, 201 bp, Homo sapiens
tctagcataattttaatgaatcgtggtcagaatagtaagaagcattgcacagaaggcttgcataaaaaatatgcatcttctgtcatcttcaccctctacaytggcctcccaagtccccatggaaggtatctagtacgggaaactttcttttcctgtaagaatgttgtggccaaacatgctgtgtattggatggatggatgg

SEQ ID NO: 48458 - DNA, 201 bp, Homo sapiens
ctgtctctactaaaaatacaaaaaattagccgggcatgatggtgggcgcctgtagtcccagctactcgggaggctgaggcaggagaatggcgtgaacccgrgaggcggagcttgcagtgagccgagatcacgccactgcactccagcgtgggggccagagggagactccgtctcaaaagaaaagaaaaagaatgatattag

SEQ ID NO: 48459 - DNA, 201 bp, Homo sapiens
ctaggccgtgatgacccctctactggcagctttagtccctccctaatcactgtatttctatcattgatattaatattcttgaaatcacccggattcgaaaygtccagtatcattcttggctcttccctccactcttctctgatcctttcgcaccatatcatcccctactgcttccccacacctctatctaggtgatcagtc

SEQ ID NO: 48460 - DNA, 201 bp, Homo sapiens
catccaaggttcacatcaggaccttgcaggccacagtgagaacttagaagacaattgacataggatgattggaaagcagaatactgaaaggccaatttacrtattcaaagatcgtgtggaaacctgtgtggtgaatagagtgggaggacaagagcagaaagagcaactcagaaacaatttactaagctgggtaagagatgg

SEQ ID NO: 48461 - DNA, 201 bp, Homo sapiens
cgcagtctttgaagctgggccgattggatttcaaattctaactcagtaacttcccaactgtgagtttgagcaaggtatacctcttaaggctcagtgttttmatctgtaaaacaggaataaaatagaaataataacaataactatctcatggggttattataagagtcaactgatataatgtatgcacaccattgagcagtg

SEQ ID NO: 48462 - DNA, 201 bp, Homo sapiens
atccaaggttcacatcaggaccttgcaggccacagtgagaacttagaagacaattgacataggatgattggaaagcagaatactgaaaggccaatttacgyattcaaagatcgtgtggaaacctgtgtggtgaatagagtgggaggacaagagcagaaagagcaactcagaaacaatttactaagctgggtaagagatggt

SEQ ID NO: 48463 - DNA, 201 bp, Homo sapiens
tttcaatatggaagttaacaacgcagtctttgaagctgggccgattggatttcaaattctaactcagtaacttcccaactgtgagtttgagcaaggtatayctcttaaggctcagtgttttaatctgtaaaacaggaataaaatagaaataataacaataactatctcatggggttattataagagtcaactgatataatg

SEQ ID NO: 48464 - DNA, 201 bp, Homo sapiens
aagagcaactcagaaacaatttactaagctgggtaagagatggtggcttggccgagaaggtaaccagcagatgatgagagatggtcaggttcaggttgtartttgaagatacagctgatggaagcagctgatggagtggatgtgtataaggagcattgggcaccctgttagcaggctttaggcttctttgactcaggcatt

SEQ ID NO: 48465 - DNA, 201 bp, Homo sapiens
cacctgagaagtgccccctgctggccagcatcatttctctgtgtctcactacagaaggaggtctttgtttatgaattctgccctccccctcttgccctgasactatcacctgctttggaaagaatggcatcatttccagaatgcccctaggggcattagcttctgttctacactctctctcttgcttttcaatatggaagt

SEQ ID NO: 48466 - DNA, 201 bp, Homo sapiens
tggcttggccgagaaggtaaccagcagatgatgagagatggtcaggttcaggttgtagtttgaagatacagctgatggaagcagctgatggagtggatgtrtataaggagcattgggcaccctgttagcaggctttaggcttctttgactcaggcattgtaccaacattcacctagtagctgatgttgattcctctctcac

SEQ ID NO: 48467 - DNA, 201 bp, Homo sapiens
ttctttgggcttcttttctattcatgaccctttggattataaaagaagagaaacaccatggggcagatatgtccaagaataaagaaaagagaaagttgcgsacctgagaagtgccccctgctggccagcatcatttctctgtgtctcactacagaaggaggtctttgtttatgaattctgccctccccctcttgccctgac

SEQ ID NO: 48468 - DNA, 201 bp, Homo sapiens
gctcaggtatgagcaatgctgcccaagtgcatggcatgaaacccactacagaccatcggaaacctcttgaggacaccattcctctctggtagcctttgggscatcattgaacattgggtcagcatgttagatacgatgaagttccagatccaaggacaagccctttagatgcctagtatatggctctgccctggcatttaa

SEQ ID NO: 48469 - DNA, 201 bp, Homo sapiens
aagtgatagagaaaacataaagaatgcaaattaaattttaaaaatgtgttgattctggtagctgttacattgtatattgccccccagaacacaggacataktctttaaacatttgaaaagtattttgggattcagcaaagaagctgctcaagacattgacaaataagtgaaattctgacttaggtcattggtttattttca

SEQ ID NO: 48470 - DNA, 201 bp, Homo sapiens
aagcagagagcttatacatttctatcgtattagggagacaattccagagagtgagagtgaaggaagaggggattgaggcaggtaaggaggggaggcttgckaaggcgcgtactgagctggccatccccaagtgcaactgattgagaggtttgtagagctttgtccctgagaagcctgcctcaccaggatgtggtgtgggga

SEQ ID NO: 48471 - DNA, 201 bp, Homo sapiens
aaacataaagaatgcaaattaaattttaaaaatgtgttgattctggtagctgttacattgtatattgccccccagaacacaggacatattctttaaacatytgaaaagtattttgggattcagcaaagaagctgctcaagacattgacaaataagtgaaattctgacttaggtcattggtttattttcaatcttgcttgtt

SEQ ID NO: 48472 - DNA, 201 bp, Homo sapiens
atgcttagattagctgagtcttaggaactgaagtatccttggtctttcatttgtgataattttaaatacaagtgttggtctgaagaaaggaaatgatcagkaattagccctggagcctgctgtgtatattaaatcaatctcagatggaagaattgagatcccggaaagcaaagaaatggctggacttagagaggaaagata

SEQ ID NO: 48473 - DNA, 201 bp, Homo sapiens
tgctgtcactatttgttttaggaagtgctggttttaactgaatgaggaagttaaacgcatgttctgttttttgttttcattgcgcccacatgggttgactrtgggttcggttttctctccagattgaacacttagtacttaatgggggaaccaccttggaaaagcagaactgatttgaggtggcttcatccctctcttctc

SEQ ID NO: 48474 - DNA, 201 bp, Homo sapiens
atgaatttgcagttcttactaaattaatatatctaggcagtaaccatcaataaaaagaaagaccatatgacatttgtatgtcctgaagtaagttcacaacrccatctagtcttgagccaaaaatactgcacctgaatctgatccagcctccaggatgtatctatttataggaaacacagtggacaggcgaacatgttaaat

SEQ ID NO: 48475 - DNA, 201 bp, Homo sapiens
aggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaata

SEQ ID NO: 48476 - DNA, 201 bp, Homo sapiens
tcttgatcacaccaggaagtctctgctaccaacacccccaggagaaaacagctccaggctcttgaggctcctcacgtagcaaagtctcatcgctcaggtcycgcatgtcagaatttgccatgattcactcacagcatgtgtcatgtgtatctggtagaatgtctgaaatgcattcttcccatatggcttttcagggcccta

SEQ ID NO: 48477 - DNA, 201 bp, Homo sapiens
catagctgtattgacacatgtttgttgaatagaccaataccttgttttatgcataaaagaaggccagtaaaaatagtcttacatgcatattaccatgaccrtgaaaataatcccaccctgggcatagcctggctcttgtttgaaatgtgtggtacttctatgtgacaagatatagaataagtcattggaagaaaaactgtc

SEQ ID NO: 48478 - DNA, 201 bp, Homo sapiens
ctgatgcacgtggcccctgctactgtgtggttcccctgttggctagggttagaccacacaggctaaactaattccgactggcaaatttaaagagaatgatrgagtgagtgctttggcaggagtcaaggcagagcaggtagcaagtaatctgaatgagttagggtgagcaagtgatcagaatgagttagggtggagcaggtg

SEQ ID NO: 48479 - DNA, 201 bp, Homo sapiens
tagaatgtctgaaatgcattcttcccatatggcttttcagggccctaagtgtgaatatgaactttgcatgtgaaagatgcttcattttgcattttgtttgyttgtttttgtttttttgagatggagtttcactcttgttgcccagactggagtgcattggcgcccaggctggagtgcagtggcgcgatctcggctcactgc

SEQ ID NO: 48480 - DNA, 201 bp, Homo sapiens
gtgaggggtgggagcgcttagaagatgtaaggatgtgctctcttctttcctcacactcatcttatttgtaatgacattaatttgtgttcttacctgctcartgtcttctcagtttgacatgccatgatggcatggactatgtctgtttcttctagcgcttcatagctgtattgacacatgtttgttgaatagaccaatacc

SEQ ID NO: 48481 - DNA, 201 bp, Homo sapiens
aaaagaggatctacagtgtcgtttgcttgtgaatggtgaggggtgggagcgcttagaagatgtaaggatgtgctctcttctttcctcacactcatcttatwtgtaatgacattaatttgtgttcttacctgctcagtgtcttctcagtttgacatgccatgatggcatggactatgtctgtttcttctagcgcttcatagc

SEQ ID NO: 48482 - DNA, 201 bp, Homo sapiens
tctggcaacatccaagaataagttatctcacttagaagagttttctgtgaaactgaagctcaccacttcaagtgctatatctttctatatattgacttcayttctaaaacataggtttccccgattcttaaatagagtatgggaaaggaatttaaggtcatttgaggtaatcattcttataggttaataagtgaaccaaga

SEQ ID NO: 48483 - DNA, 201 bp, Homo sapiens
catggtcactatccttagaattgaatttaagctctgatagaaaattgttgaaagccttcagtgctcatttttcaccaaactgaactctataatggtactayaatagaaaaaaaatttccaaagttcaattggaattttttcccagtaacttaataataaggctccaatttcaggaaaatagtttcagcatgagtgaaatca

SEQ ID NO: 48484 - DNA, 201 bp, Homo sapiens
attactgcataaaaatagctcgttaccaccttagcataggatgcatgtggaggtggggcagggatgagccagggcagcccaggagagcagagcttacagtmctctgggtagaggccagcatttctgatcctgtctgcctctgctatggagcctatgtttccttggttccaatggcaaggctaacaagagcgttcctccttg

SEQ ID NO: 48485 - DNA, 201 bp, Homo sapiens
tagcaggctttaggcttctttgactcaggcattgtaccaacattcacctagtagctgatgttgattcctctctcacaaagacagtatcttagtttgaaatrcttaagaaaaaaaaatgtacctgatccaaggggaaaatggagctccacactagcagggataaaaggaaggtggttctgattatttgtgctgctcatttcc

SEQ ID NO: 48486 - DNA, 201 bp, Homo sapiens
tgtgccagtcatagaggccacatccggtcgtaggccgtaccccatgcacagctgtcctcttggcacagttgactgaacatgctttcgccgtgtgggagacygaagctatatctgtttgagctacaactaaaaccctggagtctctgcatgcctttgccaacatctggtggttccccaaatgtgtcaggttcttctctgcct

SEQ ID NO: 48487 - DNA, 201 bp, Homo sapiens
atttcagtagtgttaaattttttcatgctattgtgaaacacatctccggaaccttttcatcttactcatctgaaactctatagctaccctttgcccccttyctgtgtccttgagagtcaccattctactttctatttctggaaatttgattactttagagagctcatataagtggaatcacacagtatttgtctttttgtg

SEQ ID NO: 48488 - DNA, 201 bp, Homo sapiens
cggtgcactctgtgtgccagtcatagaggccacatccggtcgtaggccgtaccccatgcacagctgtcctcttggcacagttgactgaacatgctttcgcygtgtgggagactgaagctatatctgtttgagctacaactaaaaccctggagtctctgcatgcctttgccaacatctggtggttccccaaatgtgtcaggt

SEQ ID NO: 48489 - DNA, 201 bp, Homo sapiens
tttgcaggtttctacataaagatctactgggaatgactgatttccttacggagcgggggtggtcctatggggatgattggcacctctctcagattgcccarcctccccctgctcttctgggagactgtcagggtgctgctctttggactacctttgaaatcttgacctgtgacaaggctgtggctggtagtgatgttgcca

SEQ ID NO: 48490 - DNA, 201 bp, Homo sapiens
atgcggtgcactctgtgtgccagtcatagaggccacatccggtcgtaggccgtaccccatgcacagctgtcctcttggcacagttgactgaacatgctttygccgtgtgggagactgaagctatatctgtttgagctacaactaaaaccctggagtctctgcatgcctttgccaacatctggtggttccccaaatgtgtca

SEQ ID NO: 48491 - DNA, 201 bp, Homo sapiens
tgattggcacctctctcagattgcccagcctccccctgctcttctgggagactgtcagggtgctgctctttggactacctttgaaatcttgacctgtgacraggctgtggctggtagtgatgttgccaggaagatggcattccaaggtcaccatactcccgctaaggtctaacaaagctttgtttagtatttctacttgct

SEQ ID NO: 48492 - DNA, 201 bp, Homo sapiens
ggctgcaggttacattccttgccgaagccagggctggatgataattcactttgtcattacttaattctgtgatggctgaaacgactgagccagaataaaastctcagtccctgaaaagatgagagactcagtgtcaggatgtttaggaacagaaaaagcaagagggcagccgaatggggccatcgggtggctgcataaaga

SEQ ID NO: 48493 - DNA, 201 bp, Homo sapiens
atgttgccaggaagatggcattccaaggtcaccatactcccgctaaggtctaacaaagctttgtttagtatttctacttgctgggaatttctgtgtacacrtgctcatttatctttttatttatttaacaataaaaccgagagtggtattctaaacaccatatgttgctatggtggaaactaaaacctggaaagctgaagt

SEQ ID NO: 48494 - DNA, 201 bp, Homo sapiens
gttgcctcagcagctgcttaataagcacctactatgtgccaggcactgttgttagggacagagtgggaatcaggaaaacatggccttcctcttggggaatsatcagagaatgggcaggtgaactgctaaaaagttgcaacaggtgtacatatatttcttttgtttacaggttttgggaatgcaatcccatatttccttttt

SEQ ID NO: 48495 - DNA, 201 bp, Homo sapiens
ttcatttgtgtgtgttctactctgtgctgcgagctctttaggggaaggcctgaatctcatccagtggtttcctctcaacatcttgtgtagtgcctgccccrtgacaagccctcggccaatgtttgctaaatgcatgacttataagacatggcccccaaagcacgggcattgtgaaacatgctaaccagatgaaaggtgacc

SEQ ID NO: 48496 - DNA, 201 bp, Homo sapiens
atatataagaaactcattaagctcctcaattcatggatgattttgccacaaatgaggcaagagtaaaaagtagcaatcaatgtaaagcaaagctactaagyaaatagcttagtaaagataatgaaacaaaaaaaatgtaagggagtccatgcaaaaacattcagcaagtgtgagcacagtgaggggaatgtgagtgttaca

SEQ ID NO: 48497 - DNA, 201 bp, Homo sapiens
catggctgtgttccaatagaactgtgttgacacagggagtcagagggccagatttggcccatgggccatagtttgccaacccccatggtacacccctaccrgcattatggtatcttcatttgtgtgtgttctactctgtgctgcgagctctttaggggaaggcctgaatctcatccagtggtttcctctcaacatcttgtg

SEQ ID NO: 48498 - DNA, 201 bp, Homo sapiens
gagatggagagaaaggacagatggccagagctcaggccaaaactttggattccagtctcttaaagaggcatagcctcttccaaagagggctctctgcagtsaatatcatatcagctacctgtttggcaccaggcattgggtccaggcttcaggatttgctaataaactcccgtcctcatgtggccagacagagaggtagac

SEQ ID NO: 48499 - DNA, 201 bp, Homo sapiens
ttttaaaaatgtgttgattctggtagctgttacattgtatattgccccccagaacacaggacatattctttaaacatttgaaaagtattttgggattcagyaaagaagctgctcaagacattgacaaataagtgaaattctgacttaggtcattggtttattttcaatcttgcttgttcatttaaatggaaatggcaatca

SEQ ID NO: 48500 - DNA, 201 bp, Homo sapiens
attgctgagtgatattcgatggtatggtatgccagagttcgttgaaccattcacccactgaaggacatttgactttgttgctagattgaagctactgcagwtagagccaccctgaatatttgtgtaaggcttttgtgtgaacatacatttccatttttctgggtaccagctgctggatcatatattaagtgcatgttagtt

SEQ ID NO: 48501 - DNA, 201 bp, Homo sapiens
ccctccccagcagctgttgggtccagctctctggggatgtctgagatataaatgctcagacctgcacactgacatttaaagagccagtgaggggtctgcaytctttatttaacaccttctttctgttgcaatatgaggtcctcccagatgcccctatgggaattactaatggccatcacatcttggttcagggaatggttg

SEQ ID NO: 48502 - DNA, 201 bp, Homo sapiens
aaaaaagagagaaaagaaaaatgccttaaaattattatgcatgcaactttttctttctttcttttatccatagctatacttggccaaacaacattaagtcmggttatatttgtccttttcctcaattgttcctacctacctaccgacttacttggctattttcattcatcattaagtgattgatggatcatagttgctaag

SEQ ID NO: 48503 - DNA, 201 bp, Homo sapiens
agtcaggttatatttgtccttttcctcaattgttcctacctacctaccgacttacttggctattttcattcatcattaagtgattgatggatcatagttgytaagagaagacacggaaatgaaggaaatcaacccattccttcattgattcattatgtttagagagctaccatgtatgaggtattttccaggactttatga

SEQ ID NO: 48504 - DNA, 201 bp, Homo sapiens
aagccaatattctctctgcatatttaatagctgttctttttaaaaaattgtatctattagtgcatatttgatggtggataatgtatatttaataaacccaytgagtcatgtagctgtacaagcatttaggagattatgccatctaggaaattaaatattatcaagtgttgtcacacttgagcatgaacaaatacagactgc

SEQ ID NO: 48505 - DNA, 201 bp, Homo sapiens
cgcctgtaatcccagctactcaggaggctgaggcaggagaatcacttcaacccaggaggtggaggttgcagtgagctgagatcacaccattgcactccagsctgggcaacaagagcaaaactctgtctcaaaaaaaaaaaaaaaaaaaaaaaaaaaaaaaaaaaccaagaatggctcaggtaggggccaaaaatctgcatt

SEQ ID NO: 48506 - DNA, 201 bp, Homo sapiens
cactcgaggtaaaatggcaaacaagacactttcttccctcaagaagttcacagtctgataaggaaaaaagcaaaaagaacaagtaatgacaagttgaactctgaatattctgacagatcaggcaattcacacacacaaaaaaaggaaatagaattgccgatattataaaacaatctctaaccttcccattcattgaaaaat

SEQ ID NO: 48507 - DNA, 201 bp, Homo sapiens
ccattcattgaaaaattttcaaactaatactacactctcttccaaccatcagattggccaacaaaaataaacattgtattatcaaccgttagcgtgaggaracaactcttagagcccaaatcgataaaaaaaaaaaaaaaaaaaaaaacttagcatctaactaaattttaactgacgtttcatttgaatcagcactttcag

SEQ ID NO: 48508 - DNA, 201 bp, Homo sapiens
aatactacactctcttccaaccatcagattggccaacaaaaataaacattgtattatcaaccgttagcgtgaggaaacaactcttagagcccaaatcgataaaaaaaaaaaaaaaaaaaaaaacttagcatctaactaaattttaactgacgtttcatttgaatcagcactttcagaatggctctgaactacttaaatata

SEQ ID NO: 48509 - DNA, 201 bp, Homo sapiens
aatcaatggtttagccagtggaggattgggacaagaactcagagggagagaggagaataaatctttgcaggctgctctgtccttccattgggggttacagytcttctcagggagccccctccatgtggccgcgtcttttgggtctggaaattgtttcctcccctggccctctaggcttagatgtgggaaaggtgccccatt

SEQ ID NO: 48510 - DNA, 201 bp, Homo sapiens
aggctgagtaatggtcccgtaataagtctacatcctcattttcagaatgtgtcaaggttacctgtatgacccagatgagtatgatgtaatcacaagcttayagaagggaagtaggaggagccagagttagaaacagaagacgatgtgatgaaggaagagagacagagaaaaacaggtgagaagaggccatgctgctggctt

SEQ ID NO: 48511 - DNA, 201 bp, Homo sapiens
gcctggccaagatggcaaaacctcatctctactaaaagtacaaaaattagcctggcgtggtggcctgtgcctgtaatcccagctgcttaggaggctgaggmgtgaaaattgcttgaaaccaggaggtggaggttgcagtgagccaagatcacaccactgcactccagcgtgggtgacagaatgaaactctgtctcaaaaaa

SEQ ID NO: 48512 - DNA, 201 bp, Homo sapiens
tctggccagctgggtgacttgactagcagaccattactccatgtgggccaccgtttcccatgaatagagtgcgacatttgaactaaatgaacctaggtttstcccatggagtgcagtttctccctaaatgaacctaggtttctcccatggagtgcagtttctccctaaatgaacccaggtttctcccatggagtgcagttt

SEQ ID NO: 48513 - DNA, 201 bp, Homo sapiens
gagtgatgtatggagagtcagtcatagtacatgtgcaattcaagatacctgggtgggcatagtagtctttcccctggagttctatgtcattgcagcctccyctcccatcacagcataatttaagtgaagcaggtttaacgggtggtcagtatttaccagagccagccttctgcttctggccagctgggtgacttgactagc

SEQ ID NO: 48514 - DNA, 201 bp, Homo sapiens
gctaattatgatattttgaatggtaataagcaattagagtgagatttaaagaagaaaaaaacacctgtatataacttggcatcttttgtaataaatacaarcacctaaatataacttggcatcttttgtaataaatacaaacttttgtcaatcatgacttgatctaaccgatatgcctcaggtctgcacagaacggaaatg

SEQ ID NO: 48515 - DNA, 201 bp, Homo sapiens
aaacatgaacttactttgacttttccaaatataccatgttccttaccacccagtgtccttgcagctgccattccctctgccaagagtgattcttgctgggmcccttttagatcacatctttattcctggtggacagaaagaaccaggacaacaagcccatgcctgtcccaagtatagctgagtgcttgacacttagagaat

SEQ ID NO: 48516 - DNA, 201 bp, Homo sapiens
gttggccaggctgatctcaaactcctggcctcaagtggtctgccccgcctcggcctcccaaattgctgggattacaggcgtgagccactgcacccagcctrcagtagttttataggacatagctatggtgagtaacaaagatcaagtgtgcttgcttgcctgaacattcactacctgtctccccacactaaactgtaaacc

SEQ ID NO: 48517 - DNA, 201 bp, Homo sapiens
aagtgctgggattacaggcatgagccaccgtgccctgccacactgctgtgcaattctaaagaattctgggagtgctgtcagagagtacttgagccaaagtygcccatcaaaaaagttttaaattcacaggagtgggtttgccttagcatagcttttgaactaagtaactggccagcagcagcatgtggaagcatgaccttg

SEQ ID NO: 48518 - DNA, 201 bp, Homo sapiens
cattcattcatgttctttgtgtctggggcttcttttgaaatctgtaaaggtgggaggaccagggaatccaatagagtgagcacatgaagagacgtccttcragcccacactggatccacctggaactcccaccagggagttcactgggagtggggacttggcagctgccagggagaattcttaggcaagtggttactgttt

SEQ ID NO: 48519 - DNA, 201 bp, Homo sapiens
ctgttccccattcattcatgttctttgtgtctggggcttcttttgaaatctgtaaaggtgggaggaccagggaatccaatagagtgagcacatgaagagaygtccttcaagcccacactggatccacctggaactcccaccagggagttcactgggagtggggacttggcagctgccagggagaattcttaggcaagtggt

SEQ ID NO: 48520 - DNA, 201 bp, Homo sapiens
cagtcgctgggactacaggtgcccgccatcacgcccagctaatttttttgtatttttagtagagatggggtttcatcatgttagccaggatggtctcagtmtcctgacctcgtgatcttcctgcctcggcctcccaaagtgctgggattacaggcatgagccaccgtgccctgccacactgctgtgcaattctaaagaatt

SEQ ID NO: 48521 - DNA, 201 bp, Homo sapiens
gcaccaccatgcccagctaatttttctatttgtttgtagagatggggtttcgccatgttgcccaggtggttctcaaactcctgggctcaagcaatccactygcttctgcctcccacagtgctgggattacagacgtgagccaccacaactggcctcaaggaacttctcaacagggaaacatttctttcctttgttttgcaa

SEQ ID NO: 48522 - DNA, 201 bp, Homo sapiens
caagggatcctcccacctcagcctcctgaatagctgggatcacaggcatgcaccaccatgcccagctaatttttctatttgtttgtagagatggggtttcrccatgttgcccaggtggttctcaaactcctgggctcaagcaatccactcgcttctgcctcccacagtgctgggattacagacgtgagccaccacaactgg

SEQ ID NO: 48523 - DNA, 201 bp, Homo sapiens
atcaaaactaatgcaaaaattagccaggcacggtggttcacgcctataatcccagcatttaggaaggctgaggtgggcagatcacttgagatcaggagttsgagaccagcccggccaacatgatgaaaccccgtctctattaaaaatacaaaaattagccaggtgtggtggcgcgtgcccatagtcccagctattcaggag

SEQ ID NO: 48524 - DNA, 201 bp, Homo sapiens
tcatgttaggcttcccatgcaatgaacatgacctgtgttcacccccacatcactcatgcaagagcatccagtttgctggagttgtctcatgtcccatatcyactcctgctgcagtgggagagaatgggagtgggttactacctcccaccaacactgcacaaaacagggttttctccaaaagaggggttgggatgctatgag

SEQ ID NO: 48525 - DNA, 201 bp, Homo sapiens
agacagactggaaaaaatgagtagccgccagatagaactcaaggggagggaaggagggattagggaccaccacaaagagaacagctgagttctcatgttakgcttcccatgcaatgaacatgacctgtgttcacccccacatcactcatgcaagagcatccagtttgctggagttgtctcatgtcccatatctactcctgc

SEQ ID NO: 48526 - DNA, 201 bp, Homo sapiens
attttagttgatggatttatgacagctttcattgctgatagccacagcaaaaatcattgctgccagatgcctgtaagagcatggggagggagtctggccaratctccatggactcaaggttgctccctggactcaaggttgcaggaggtccctagggatgcattcttcccggcttgctctttccatagcacagaggctctt

SEQ ID NO: 48527 - DNA, 201 bp, Homo sapiens
cacactcaggaaatgtgactcaatgacagccgtcctcacctctctgctcttctgcctcccaaaccaaactgaagccagagaagcgtgccctgtgtgtgcarttaccagacccaatagcttgctctctccaacttctgtttttcagaataaaattgtttgttccatttctgattttagttgatggatttatgacagctttca

SEQ ID NO: 48528 - DNA, 201 bp, Homo sapiens
tgaagggagggtgagaaatgtgagggaacacgtgggcaatcaccaggaagttcctttgtttgttgcagtgacagtctggaaaacaatgtgaactggttgasaagcttaaaaatggatctaagggcaaaaatgctaaaggagagaaagaattgttgacagtgtataagaagatgattaggaacaaagtgagatgggcagttt

SEQ ID NO: 48529 - DNA, 201 bp, Homo sapiens
ttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgac

SEQ ID NO: 48530 - DNA, 201 bp, Homo sapiens
gtgcttagcactgaatacatgtcagccgtaattattatgaaagtgactttatttgcctaaagacactctgacccaacctgccagattccattcccacctcrgtgccagctctttccccagcatcaacggtccttatctctgctttcattttcccatgtccactgcaacctctacaactgttgttgcttacttttagttgag

SEQ ID NO: 48531 - DNA, 201 bp, Homo sapiens
ctttatctttgcaatatttaagagctttggttaccaatcattgtgaacttttgtgttgcagggggtgtaaacacagcataatcaatcaattgatgtctacrctcttcacttttctttaaagttgtctgaaagtgctgtctctttgcctgacagacatagtatatctacccctaccctagacttgtgttcatccaattgtgt

SEQ ID NO: 48532 - DNA, 201 bp, Homo sapiens
ctgaatacatgtcagccgtaattattatgaaagtgactttatttgcctaaagacactctgacccaacctgccagattccattcccacctcggtgccagctstttccccagcatcaacggtccttatctctgctttcattttcccatgtccactgcaacctctacaactgttgttgcttacttttagttgagtgtaaatcaa

SEQ ID NO: 48533 - DNA, 201 bp, Homo sapiens
actagatgtgtacttggaagggcaaaacagttatttcaatgtacaaattattgcctcattactttatcacataccagaagagagtttgggatggatctaaraagtataacaaaaccactgcaagttgttctgtcatttagcatttaattaaaaataactagagaaacaactatttgaaatgctcagtgtttttcttctttt

SEQ ID NO: 48534 - DNA, 201 bp, Homo sapiens
gcaagtttgggagtaggggtgggaatcccactacagtcaaattattttgatgttactttccaggcttagagtttatcttccatatttccaatgagaatcarttcctcaagtggaattttatgataaactgctgaaagtagtatttaaaatggaaaccctgacaagaatgagtgtcacagggagtaatgaattcatgatgga

SEQ ID NO: 48535 - DNA, 201 bp, Homo sapiens
cttttgggattcaagggtttaagtatcaagtttgactgatggatttggagggaagaattgaaaactgcctgagggaaggcgctttgctttttcttttgtgrggcaaaagcttttgaaaactgtgactgtacaaagagccacagctcctctgaggagtctgttatgcggcaacacatactcagatgtggacagcagtgagca

SEQ ID NO: 48536 - DNA, 201 bp, Homo sapiens
gtcaggcaggtccagatggatcctctaggaccttagagaccatggttaagagtttggattttattctataccccatgggaagtcattggtgggttttaagycggggattcacactctgtgatttaacactggctgctctttggagaatggactgtagcaagcagaagagaagcaaagaatcaggtgcattgcagtggtcta

SEQ ID NO: 48537 - DNA, 201 bp, Homo sapiens
ttaacactggctgctctttggagaatggactgtagcaagcagaagagaagcaaagaatcaggtgcattgcagtggtctacacaaaagacgatccctagtcrtcttaccacctgcctcctacaataaccaaagaaagtggacccacaccacagctacctcggtccactgcatgtgtggaaggtgatgattctcttgggcatg

SEQ ID NO: 48538 - DNA, 201 bp, Homo sapiens
gctatgctcagtcatgtaatgctggcaaccatgctgcgcaaacatgggtcccctacatcaggggtccccaacccctgggccacggacggccccaacccctrggccacaacatcagattgttattggagcacaaatcctattgtgaactgcacacacaagggatctaggcggcacactccttatgagaatctaatgcctgaa

SEQ ID NO: 48539 - DNA, 201 bp, Homo sapiens
ctcccaaaggcatttttaccagtgcatgtgcctcgcacagacctagtgaggtgattaattctactgggaaagtcacactggatgaacgagaggagacgtaygagtggggtcttgaaacagtaaaaatttgccaggtggaagcataaatgactctttaaatgaaagcctggtgtttttaaagcagttcattctcatgagtaa

SEQ ID NO: 48540 - DNA, 201 bp, Homo sapiens
cccaagtagctgggactacacacgcaccccaccacaccgagctaattttttgtatttttttagtagagtcggggtttcaccatgttggccaggatggtctygatctcctgacctcatgatctgcccacctcagcctcccaaagtgctggaattacaggcttgagccaccgcgtctggcccaacaaatatttttaagatgca

SEQ ID NO: 48541 - DNA, 201 bp, Homo sapiens
gtgagggtgcatagaagagtaggtcccgccctttttaggagtatactgtggactagagtcaatctgtagacaaagctaggctaacttcctactgggcaacrtctgacccctttcatctttgacctcaagaaagtcactattgttggtaaagtgaggaaggacatggaacctctggggagaatctgacctaaaatggcttca

SEQ ID NO: 48542 - DNA, 201 bp, Homo sapiens
atcataatttttactacactttgtggccacatgaactggcagaagaggctgtcctaaaatcctaatgtggcaaaaaccaattttcagaagtcaatttggaygttataggtagcgctcttcacacccaataaattgcttatctttggctttgaactgatgggcacgtacacaaaagattggagccaactgattgcattatta

SEQ ID NO: 48543 - DNA, 201 bp, Homo sapiens
ggtactgtctcccagtactttgtttttgaagatttgtgactacatggtttcagtgctatatctaataaaactggcttcaaaacgcagagcactagcatttycatatgtttcagtaagtctcccagccttcgtgattctagagacaccaatcagttgatgctagctgcagttgctagagattccttcctggaattttgatgt

SEQ ID NO: 48544 - DNA, 201 bp, Homo sapiens
aaaagttaatcatcaggtctcaggagttcagcaaccgaccatcatgagctatatagtattagtctgcagctctacctgagagcagcccagaaaccaaatasgaatatatcagacattatcccagagagaaggctcagtcaaggatctgcagctgggacctgcatatcttaattcccctgttcctggggaagttatccaata

SEQ ID NO: 48545 - DNA, 201 bp, Homo sapiens
tgaaaaatagttccatttgaaagtccatttctttcaaattcaaagaaagaaaacaactaaaatacgtaagtctaaagggcatggttgatttaggattttckagtgggaagactattaaaagagatgcttgctcaagagagtatagactcttctttggaaattggcatgggccacagacctccataggtaatacatttaaaa

SEQ ID NO: 48546 - DNA, 201 bp, Homo sapiens
tgaaatgctcttccgtttgctgtttaagacaccatactgtccttgttctcccactctttctgtatagaaacccatatgttttcttcctctagttcttcttmttattcctcctgccattggaagtgcctgtccatttcctgtcttgattttcctttgctgttttctaccatcctcaacaattttatccaacctagcagcttt

SEQ ID NO: 48547 - DNA, 201 bp, Homo sapiens
caagcatgctggttgatcaaatgttgcatctatatctttgtgattaacacctgacagatatttctatgatgcgttctgacagggttacacatgacagagtkggctctgtctatgttgtacttaatattattgtagaaagaaaaattgagtatatcttgtgaaaaatagttccatttgaaagtccatttctttcaaattcaa

SEQ ID NO: 48548 - DNA, 201 bp, Homo sapiens
tctctctacctacctacctatctaccaaccaaccaacctatctaaaatctatctataatctattagtttttcttgcttcacaaatgacttaaggcaactcrctttcgggttgatggaagaaaaaatacaagtagcaaacttggatgaagttggaagaaacttggcacccactgtgtctggcatgtgcagatatgagtgatg

SEQ ID NO: 48549 - DNA, 201 bp, Homo sapiens
atactcttagttggttctgctccattgaccctagggaggaagaaacaactaatttgtgctttctgttattgcattgaaagagagtggtgactcgccgggckcggtggctcacgcctgtaatcccagcactttgggaggccgaggtgggcggatcacgaggtcaggagatcgaaaccatcctggctaatacggtgaaacccc

SEQ ID NO: 48550 - DNA, 201 bp, Homo sapiens
cctttactagaaggttgatagattaataatctccccactaagcttatagcttagcagacctccatggtggccatgatgaggattcctttaacacatgattkgcccttagtccccatttctctggtgtgagttttcagcttttgttaccacatcaaagctccggcaatttgtgcaggaaaccccttgaagcaatcatgaacc

SEQ ID NO: 48551 - DNA, 201 bp, Homo sapiens
tatgtcttgatcacaccaggaagtctctgctaccaacacccccaggagaaaacagctccaggctcttgaggctcctcacgtagcaaagtctcatcgctcargtcccgcatgtcagaatttgccatgattcactcacagcatgtgtcatgtgtatctggtagaatgtctgaaatgcattcttcccatatggcttttcagggc

SEQ ID NO: 48552 - DNA, 201 bp, Homo sapiens
gtggatcacctgaggtcaggaatttgagaccagcctgaccaacatggtgaaaccccatctctactaaaaatacaaaattagccgggcgcctgtaatcccarctacttgggaggctgaggcagaagaaccacttgaacccgggaggcggagatggtggtgagccaagatcacgccactgcactccagcctaggcaacaagag

SEQ ID NO: 48553 - DNA, 201 bp, Homo sapiens
aggagccctttactagaaggttgatagattaataatctccccactaagcttatagcttagcagacctccatggtggccatgatgaggattcctttaacacrtgattggcccttagtccccatttctctggtgtgagttttcagcttttgttaccacatcaaagctccggcaatttgtgcaggaaaccccttgaagcaatca

SEQ ID NO: 48554 - DNA, 201 bp, Homo sapiens
gccaggggcagtaggtgcatacagtcctatgctcccagcttatgaggaaatgctctgtccctccacaggcttgatcagcggcctccctgctcctgttctcyagatagaagtttccctagttttgctggtctcaactcatgcacaggaggaagccagaagtgccctgctgtgatgatcaatccatatgcatgtttgcctcca

SEQ ID NO: 48555 - DNA, 201 bp, Homo sapiens
tctctctccattcattcatcccacacctgcaacatactgggtgcttttctaggcattgggggataaagtagccccagaaacaattaaaaatatctgttggycgggagcagtggctcacaccggcaatcccagcactttgggaggccaaggtgggtggatcacctgaggtcaggaatttgagaccagcctgaccaacatggt

SEQ ID NO: 48556 - DNA, 201 bp, Homo sapiens
ttttaataaacccatttgaaatagataaggattgctatataagctactaacatagcactgattgaaaaagccacacatttcaggattgcaacagaagtcasttgcatagggaaaatagctgatttattatctgagtttgtctatcaatcactaacaccagtcagccagcaagcacgaggagcttatcatggcattaaccct

SEQ ID NO: 48557 - DNA, 201 bp, Homo sapiens
tctatctacctacctacctacctgtacatctatctctctagagatcttctccacaaaagcaaggaaagagaatctctgacactatattttcttaatgaagwtggagaagtttttgcagttctcattatttcatttcaggctttcagatgttcaggagccctttactagaaggttgatagattaataatctccccactaagc

SEQ ID NO: 48558 - DNA, 201 bp, Homo sapiens
attttacattcttttttcataccacgtctttaaaatccagtgtgcattttgcacttaacagcacctcttaatttggactcaccacatttcaggggtttaayaggcacatgtgaccggtggctgccgcattggacagtggcagctctagagagctggaaccaatttatgctccttctgacattcacagggaatgctctgtat

SEQ ID NO: 48559 - DNA, 201 bp, Homo sapiens
atcgtgccactgccctccaacctgggtgacagagtgagacttcgtctagaaaaaaaaaatgtagacatagcttgcattagtccattctcaaattgctacayagaaatgcctgagactgggtaatttataaagaaaatgatttaattgtctcatggctctgcaggctatataggaagcatggcagcatccactcagcttttg

SEQ ID NO: 48560 - DNA, 201 bp, Homo sapiens
gccaaggtgggcagatcatttgaggttaggaattcaagaacagcctgaccaacatggtgaaaccccatctgtactaaaaatacaaaaaaagttagccaggmatggtggtgcttgcctgtagtcccagctactagggaggctgaggcaggagaatcacttgaacctgggaggtggaggttgcagtgagccaagatcgtgcca

SEQ ID NO: 48561 - DNA, 201 bp, Homo sapiens
tcatgctttgtaatcccagcacttcgggaggccaaggtgggcagatcatttgaggttaggaattcaagaacagcctgaccaacatggtgaaaccccatctstactaaaaatacaaaaaaagttagccaggaatggtggtgcttgcctgtagtcccagctactagggaggctgaggcaggagaatcacttgaacctgggagg

SEQ ID NO: 48562 - DNA, 201 bp, Homo sapiens
gagagagaacctccctgagccgtggttaaaggaggaaagcacacaagcagggtttacagaggctgagttaatgtgaatcagaacgccggagcttcctccgyaccactgcgcctactgctgatgttggcttaaggctttttgaacatgtcttagtgtaacttcaccaagcttcacacttcctcaatccttgacatcattgtc

SEQ ID NO: 48563 - DNA, 201 bp, Homo sapiens
tatttatgtagagcccactgtgggcctgacgctgtgctaggtgctgtaaattcactggtgaaagaaatagtctctgtctgcagcctcccagggagcttatygtcataagagcaagaacttttgctgcaaatgatggtgtccctataaaggaagaaagaaagggagagaggaagggaagaaggaatgaaataaattgcttcc

SEQ ID NO: 48564 - DNA, 201 bp, Homo sapiens
aaagcgtgactccatcacaaaaaaaaaaagtagccgaaagataattatgcaaaatggaagtaactacatttgctaaaccttctcctacagtgaaatgaaayatgggaactaacgcttccatcagatccctgatttggttacattagggaggcagccggcagctaaatccttctgaatagctgggaggactcacttctttct

SEQ ID NO: 48565 - DNA, 201 bp, Homo sapiens
cattctcctgcctcagcctcccgagtagctgggactacaggcgcccgccaccacgcccagctaatttttttgtatttttagtagagatggggtttcactgtgttggctaggatggtctcgatttcctgacctcgtgatccgcccacctccgcctcccaaagtgttgggattacaggcgtgagccagcgcgcctggcctatt

SEQ ID NO: 48566 - DNA, 201 bp, Homo sapiens
ttactcccatttggaacagatgtatttatccaatgcctgtacccccattgtgtctgggaagtatctaactggctttggattttacaggcttgtaggcctcktctcagatgagactatggacttggagttttcagttaatgctggactgagttatgacttttggggactgttgggagggcagaattgtcttttgaaatgtga

SEQ ID NO: 48567 - DNA, 201 bp, Homo sapiens
tgcctctgccatgaagactctttacgtctgtttcacacacagtcagcccttcgtatccacaggctccacatctgcggattcaatgaactatggatcaaaartatcctctggccgagtgtggtggctcacgcctgtaatcccaagactttgggaggccaaggcaaacagatgacttgaggccaggagttcaatactagcctg

SEQ ID NO: 48568 - DNA, 201 bp, Homo sapiens
tattaggtattatataagtaatctagaaataatttaaagtatacaggaggatatgtatagattatatgcgaatactatgccattttacatagggtattttkgtatttgagaaaaatcctggaatcagtccctcacagataccaagggacaattgtgctaaccttttagataaagtttcatagaccagagacttccacagtg

SEQ ID NO: 48569 - DNA, 201 bp, Homo sapiens
ctgcttaggatgcatactgatggctctttttttgtgaatggatggaagtatgaaaggagcagtaagaaagggcactatcaggctgcatgcagtggctcacrtctggaatcccagcactttggaaagctgaggccagcagatcacttgaggccaggagttcaagaccagtctggccaatgtggcaaaacactctctctccta

SEQ ID NO: 48570 - DNA, 201 bp, Homo sapiens
aacacaagctttgcagccacccacagcccacagcccacagcccacagccactgtgggtcgagttatactttgcctcttagcagctgaccagctttgggtcwgagcctgtttcttcacagtggtcagcccccttgtctgcctgataaatgtctgtctgctcacgcacttggctccgcagaagtgagcttgctgggtccatgg

SEQ ID NO: 48571 - DNA, 201 bp, Homo sapiens
acttagtcatacagccataagaaagtttccccctctaaaaaaaagaaaagagaaaaaataaagaggtgccttccattggtgaagcgtagtcattcagaacrcaagctttgcagccacccacagcccacagcccacagcccacagccactgtgggtcgagttatactttgcctcttagcagctgaccagctttgggtctgag

SEQ ID NO: 48572 - DNA, 201 bp, Homo sapiens
gaaaagcaggggcctgcattagatggctgagctctagtcaattcttggtcatttgtactgaaacagaggcaagagagagatttcaaaaccaccacgaggargcccctaaacatgcaggcatttctttcctttatctgtcgattcaaagagcatctattcagggccaagaaggagatcaggtttatctgacttagtcataca

SEQ ID NO: 48573 - DNA, 201 bp, Homo sapiens
gcgctagccagctcatctgctttcaaaagataagatatgattgctttgtattttttatattaataaccctcagcatgagaggattaactcttgatgcactraaggcaaactaccggaccctgggagatccatttcttctcaccagataggctgacacatctttcagatgaatttaaaggtcaacgccttgtgcatgaaaag

SEQ ID NO: 48574 - DNA, 201 bp, Homo sapiens
tatttaacaaaacccctttctcgagaaatgtattacttaccttgtgggtggggaattgtctctgaacccaatcaggttagtcactggcccatgactatctmatttttaataaataataattttctcaattcagcgctagccagctcatctgctttcaaaagataagatatgattgctttgtattttttatattaataaccc

SEQ ID NO: 48575 - DNA, 201 bp, Homo sapiens
ggttgaaggaagccctggctctgtgcaagtccacagtacagcagctactggggagggaaaacggtgtgtggctacgctgagggtttcttcctggttgatgmgattataatgtgaaaagatcgacatgtgagcccagagcagatgcataataatgctactgcattttgtatttaacaaaacccctttctcgagaaatgtatt

SEQ ID NO: 48576 - DNA, 201 bp, Homo sapiens
gttggcaatatatatacatgagtggactggagagactgaggaggcacaagtcgaggaggaacacatcttttattttgacttaattttctttttatcccctytccttctgccccagggttcttctccgtgtggatcacattaagggagcgtataacctttcataccgcctgactaggatgatggatatggaaatacacactt

SEQ ID NO: 48577 - DNA, 201 bp, Homo sapiens
gagtgcttcccttctggacctcccttaaccattccagggctttccattgcttgtgcagttaatgaagatggaaaatgattcccttccctcccgctctgttyttccatctgtccaggtaatagcctaatgtcaacctagtgacttcatggcatctgttttcaatctactgcctccttgtctggaattctcaggggacactta

SEQ ID NO: 48578 - DNA, 201 bp, Homo sapiens
ttacagttatacctttttaccctgaaatgagtcagtgtgttatggtaacattcccagatggcagacagaaggagagccaatgtgagagaccagtgaactcwgacccgtctcccaagagccttgtgtaagtcatctaaaaaacaaatgtttcggatattcagggttttctgatttcaaatgtgttcataccatgaataattg

SEQ ID NO: 48579 - DNA, 201 bp, Homo sapiens
cactccgggaaacctctcagttctagacaaacagagacagttggtcatcctattatgagaggttagagaggaagcactttctggatgggttgagtctgatrggctctgttgtatttgattagacagctttctatgagatcaaggttttcaataccatcacagaaccatttctggagctgtgttgaggaagagagggcaagg

SEQ ID NO: 48580 - DNA, 201 bp, Homo sapiens
ctggctttggaagaattcatccagcccctggcatgttttgcttatcctctgcctgatgataaaataggggttatttctatcagtggacacatttggcccayatcttaattcaggcaacacagccttagccttgttctgctagtgctaattatttttttgaaaaataatactgttaatatagtaaaatgtagttgttggact

SEQ ID NO: 48581 - DNA, 201 bp, Homo sapiens
acagcctccctgagatcagttgggtaaagctctgagcacagggccaggcacagtgtacacccttgcaaaaatattaatttgcctgggtgcaaggtgagggwcataaccttttcctattctgaaactctactctgcttaggatgcatactgatggctctttttttgtgaatggatggaagtatgaaaggagcagtaagaaag

SEQ ID NO: 48582 - DNA, 201 bp, Homo sapiens
gcgtttaaaacctgttggctcatttatgtctatgtcaatgctatgggaaaggtactctgttatcccccattttatagcagaggaaactaagcctcagagasgttaagtaatgtacccaggcctctctaactgctaagtggtagagcaaaaagtgaaacccaggcattttgtcttctcaattaatgatcttaatacgcatta

SEQ ID NO: 48583 - DNA, 201 bp, Homo sapiens
ctctgacagatttgcttctgtctatcctcatcttcatcctagatctaaaccaccattatctcttgcctgcaaccttttattcctaattctagtctttaatmtctaatttctgctccaaatggcagctgaaggattattttcaagctcagatgtatcctgccacaccctttggaactcctcatggatcgttattacccccag

SEQ ID NO: 48584 - DNA, 201 bp, Homo sapiens
  misc_feature (1)...(201): n = A,T,C or G, or insertion/deletion polymorphism (see Tables 1-2)
gtataaaaagtcctccaaaatgttaaattacctttctcatctcaggaatagagtcccaatcacttccagattgaagcacttacggggggaaaaggcgaagngctccagtaattttaaattgcttcgtacaatgaagagtgcctgtaaattactgaatgtggtaatttgttccataagcttttttgatttgtaagtaactta

SEQ ID NO: 48585 - DNA, 201 bp, Homo sapiens
tacctggaactccaaatttcccagttcttttaaacttttatgagttaggtactttcaagttgtgtaggacagactcacctggtttgggtgagttaagtctrtggaaagggaacagaaaacatgtgaggaaacacttatcccatctattccatcttatcttgatggaattagaatttagggattcacttttcagggacaaaa

SEQ ID NO: 48586 - DNA, 201 bp, Homo sapiens
attctgtcatacctggaactccaaatttcccagttcttttaaacttttatgagttaggtactttcaagttgtgtaggacagactcacctggtttgggtgarttaagtctatggaaagggaacagaaaacatgtgaggaaacacttatcccatctattccatcttatcttgatggaattagaatttagggattcacttttca

SEQ ID NO: 48587 - DNA, 201 bp, Homo sapiens
tgtctcttctgttgagccattcatggtagatttccccaacgaaacctaccatgtttgttttctgtatttcccaccagatgttcttttaaaagccagaagawgtctgccttggtctggttggtataaagagggttcatccaatataaactgccaacagtaggttggaaatactcatcagtatggaaagggcgaagtctgggc

SEQ ID NO: 48588 - DNA, 201 bp, Homo sapiens
tttttcaaatattccattgcaaacttatttagcatttataattgaatactgataagtgaatttatttattcatttatttattcatttattttgagatgcaktctcactctgccacccaagctggagtacagtggtgtgatcttggctcactgcaacctctacttccaggttcaagggattctcctgccatggccagtatta

SEQ ID NO: 48589 - DNA, 201 bp, Homo sapiens
aatcagtgtcatattcattactgctggtgaaatgccatacaacattggcattcattcatttttgtctcttctgttgagccattcatggtagatttccccawcgaaacctaccatgtttgttttctgtatttcccaccagatgttcttttaaaagccagaagatgtctgccttggtctggttggtataaagagggttcatcc

SEQ ID NO: 48590 - DNA, 201 bp, Homo sapiens
cacttagttcacacttctaatgcgtagaacatgcaacatcgtcgcctaattttaaatggcttactcactggccagagtcatgataaataaagatggtgtgraacgtttcttctgtttcatgctcatggaacacagcacaatctttggggctcagtttactgagtatgagacagcaggacaaagtagtaaggggtgtgagct

SEQ ID NO: 48591 - DNA, 201 bp, Homo sapiens
ttgccttctttacaccactcaaaagcagaacctttattacaaacacaccaaaaggtaccatataactaatcttcctggtttgaatgtaaccaatgttcaartatgattgtagagtattaattattttgacatcaatttactgaacacattttaatgaggaccagaaggaaagacaaagtttacttactttcgtgatatata

SEQ ID NO: 48592 - DNA, 201 bp, Homo sapiens
gagtaatttatggaagaaagaggtttcattgactcacagttcagcatggctggggaggtctcaggaaaggtagaattatggtggaaggggaagcaaacacrtccatcttcacttggtggcaggaggaagaatgagagctgagtgaagcgggaagccccttataaaaccatcagatctcgtgagaactcactatcatgacaa

SEQ ID NO: 48593 - DNA, 201 bp, Homo sapiens
aaaatattaggggaagattttcttggaacatcagcagtaaatttaacacatggcatgccttcaatagatttctcttcttccccctttagagttcagtttgytgtcttcatcacagtcccaaaaaatacatttgtgtttcttccttgaagaagaattatttttagaacaaacacatcattatttgggaacaatcaaaagatc

SEQ ID NO: 48594 - DNA, 201 bp, Homo sapiens
cacagtaaatattccagaaagcatgcaaaaataccccagaatctaactcctttccagtctgaagagctcctcaaatctctcctaaagttacttgctttacrcacagccacctctattcatttttttttttttaatttccagtagccagtgtaacctgggggccagggaagacctgaacctctaggactcaaaccctgtcat

SEQ ID NO: 48595 - DNA, 201 bp, Homo sapiens
tggagaggtagcccaaacaaggggaggacttgggcagtgctgagctctgaccatagaaaaaaagtatctgggaactatctcaagcgtcatttaggctcccycatttcaagcatgcacccaaacagctcatatactatacagtaaatacaacttctcaaagtagaagataactggtgttaaaacaagactacatttatgaga

SEQ ID NO: 48596 - DNA, 201 bp, Homo sapiens
catgtaatgttgttaagcctgaaaccatcattgagtagtgaacagtacattttcctagataattaaataatctttgaattgacaagttaatgcctgtataygacattgaaagaacatgcaacccacatttttgtcttattttcaagttttgaaccttttttcttagtaatataatgaaaatcaagttttgtaaaattaaat

SEQ ID NO: 48597 - DNA, 201 bp, Homo sapiens
cctcgtgatctgcctgcctcggcatcccaaagtgctgggattacaggtgtgagccaccacgcccggccccattttctaacagaatcttttaatgtttgagwgttgagagtcttttatgtagtctatatgcacatcctttgtcggagatgtggcttgcaaatatttatctcaatctgtggcttgtctgttctttctcttaat

SEQ ID NO: 48598 - DNA, 201 bp, Homo sapiens
gttatcttttctacccatcattacttgtatctctgccagacagaaatctgtgaattaacatgtaatgttgttaagcctgaaaccatcattgagtagtgaayagtacattttcctagataattaaataatctttgaattgacaagttaatgcctgtatacgacattgaaagaacatgcaacccacatttttgtcttattttc

SEQ ID NO: 48599 - DNA, 201 bp, Homo sapiens
gctcccaagctcctgacttctttcttggatatacagtcccgattaaggactgcccagttatagctccttttctaccaggcttttctggttgattatcttgkggtccctacagccttgagtcttgccatggatcccaagcctggctgtgaaccagttttccagatgtcctgtaccctagagaccccaaggctgtatgtgtgt

SEQ ID NO: 48600 - DNA, 201 bp, Homo sapiens
tgaatagtcacgtgtggatatcaagtccagttatattacttaccagctgtatgtatgagcatggggaagttatttaccttctctgacttttacttttctcwtacgtaaaatggtgtgggatcacactcaccccataggctgcatcaagggttaaatcgctaacatttactgacaccttggaaagatgagctaagcgtttaa

SEQ ID NO: 48601 - DNA, 201 bp, Homo sapiens
tgatctgtgcatggagcaatgtcgttatgagaattccccacattttgctcccttttggacctccctaaaattcccctaagaacacccctcactagtagaartgtagaatcccagaccttaccccagatctactgaatcagagtctgtatttttaacaagatcccctacattggaggaaagttgtagaaagactgccctgga

SEQ ID NO: 48602 - DNA, 201 bp, Homo sapiens
aatctcctgacctcgtgatccacctgccttggcctcccaaagtgctgggactacaggagtaagacaccgtgcccggccagtattgttcttctttatacctrattactcatcattggaattctctttaaaaaaaaaatgtgcttccctaattggttgccaacagagaggctacatcatagtggttaagaatataggctcttt

SEQ ID NO: 48603 - DNA, 201 bp, Homo sapiens
agaggaatctatttacaccctcttccccttctcaataaaacaacattcttccccaccaagtgtggagtcgagactctgaggatgtatggccctgagctggrggattctagggacatttttcatgtcactacctagacagtcgtgtgagtgctccagcagtgagggatctcggctgcaggttacattccttgccgaagccag

SEQ ID NO: 48604 - DNA, 201 bp, Homo sapiens
acgcaaagtctattttcccatcagaggttaacgttcccatttacttgatcagggtttggataatgcttcattcacagctgtttttcgcttgcaagaatccrtctactttatcctcactgaccttaccctggcaggtggtgccaggatttcctcaggcagttgtttgttttagcattttcgagtatttatactggctgcggt

SEQ ID NO: 48605 - DNA, 201 bp, Homo sapiens
tctgcccacctgtcactggtcactccctgtactgttgcccaatgggacggctttcagagcacataccactctctgaagttatcgtattgtgtgttaactayttttatgatctcccttcctcttgtagaacagaagctccatgagaacaggaatttcatgccttgttctctttcatatatgcagagtaaagaagaatgtctg

SEQ ID NO: 48606 - DNA, 201 bp, Homo sapiens
aaaacagaagataatgatcaaaggactccatgtctatgtggttgctttatgataatgctgaatagcagccttgttcatgcagagacaatataaaagccttyccccaacttctccccctcctccaattcgtaaaagtcaacataatgttaaaacaaaacaagaagtttagaattaggatgaaacccatctagtaatacagta

SEQ ID NO: 48607 - DNA, 201 bp, Homo sapiens
cctgtactgttgcccaatgggacggctttcagagcacataccactctctgaagttatcgtattgtgtgttaactatttttatgatctcccttcctcttgtrgaacagaagctccatgagaacaggaatttcatgccttgttctctttcatatatgcagagtaaagaagaatgtctgacatataatagctacacaataaata

SEQ ID NO: 48608 - DNA, 201 bp, Homo sapiens
gttgctttatgataatgctgaatagcagccttgttcatgcagagacaatataaaagcctttccccaacttctccccctcctccaattcgtaaaagtcaacrtaatgttaaaacaaaacaagaagtttagaattaggatgaaacccatctagtaatacagtaatgtcaggaggacaatatcaaaacaaatatttatttactc

SEQ ID NO: 48609 - DNA, 201 bp, Homo sapiens
atgtcaggaggacaatatcaaaacaaatatttatttactcaggtggtggttgcggttttcgggctttttctcagctgcggtgcatttgtggcttttatttstgcactgccgcttgttacttggagccattacttcctatctgtgttgtcaatcgtgtcttgaggttattctagcaccttacgaaaagccaccatccaccta

SEQ ID NO: 48610 - DNA, 201 bp, Homo sapiens
tctgttatgcggcaacacatactcagatgtggacagcagtgagcacgctgcctggaaagggggaacagcaccgcgggcaggcttcagagccacacaccacrtctctgtctcagagtctatcctcgaccacagggtttaagtccttgatgtgcacactgggccctggagagaaggtgcctgttctcacgggctgaccccaca

SEQ ID NO: 48611 - DNA, 201 bp, Homo sapiens
tggttgcggttttcgggctttttctcagctgcggtgcatttgtggcttttatttctgcactgccgcttgttacttggagccattacttcctatctgtgttktcaatcgtgtcttgaggttattctagcaccttacgaaaagccaccatccacctaattttagagcttttaagataaagcccgggagcactaggaaggtgag

SEQ ID NO: 48612 - DNA, 201 bp, Homo sapiens
ttgtgaactgcacacacaagggatctaggcggcacactccttatgagaatctaatgcctgaactgaggaggaacagtttcatctccaagccatcccccacmtgttcatggaaaaattgtcttccacgaaaccagtccatggtgccaaagaggttggggactgctgccctacctcacagaaagcgagtgaccccaagaagcc

SEQ ID NO: 48613 - DNA, 201 bp, Homo sapiens
gcatttgtggcttttatttctgcactgccgcttgttacttggagccattacttcctatctgtgttgtcaatcgtgtcttgaggttattctagcaccttacraaaagccaccatccacctaattttagagcttttaagataaagcccgggagcactaggaaggtgagtgagttaccgttatcaatctggaatgtgaggtttc

SEQ ID NO: 48614 - DNA, 201 bp, Homo sapiens
ctgatgagttgccttttttcttttttctttttttttttttttttttttttttttgctttttccatccccatgattgttccaacagaaggagaaaagatgtrataaacctttaccgggcaccgtctgcgtccaggcactctactcggccctgggggtgcagagcacaccaccccagccttaggcatgaaaaacactgtgtac

SEQ ID NO: 48615 - DNA, 201 bp, Homo sapiens
aaaagcttgcttttcgtaggtttcatgattaattttcatcttaagttaattttgtgtatggtgtgaggtagaggtcaagatgtatgatttttccagttgcygccgcaaaatgtattgagaagatcaccctttccgtcactgaattgcagccataaatcaaataaccaatatgtgtgatctatttccgcactgtctttccct

SEQ ID NO: 48616 - DNA, 201 bp, Homo sapiens
gtttgtttgctttgaaatcctaactcagtcccactagtcccatttttgtaatgtttagctttcaggcaacaaccgctgaagaggtaaagagattatttttsaagagtcatgtgattttggctgctcctagctgacctactagagaaaaatcttaacattttccacaaacttttccattaaaatagaggataggtcattgct

SEQ ID NO: 48617 - DNA, 201 bp, Homo sapiens
gacattaccccgtggtgtctagtgtctcttcatattttcctctgggtttatcttgaccctttcaaatggaatgcgtggatgccattagtatttataacatwcattttcagtgctttagtattgtttttttctttattgttgtgtaatatgtatggaaaaggcatatagcaaagggtgatcaatggctgggcttatcctaat

SEQ ID NO: 48618 - DNA, 201 bp, Homo sapiens
tattctgtagggtaacaatctgttgctacccttatttattcttgtgcgccaattgtccaccgtttgtccagtgggaagcctaacatgcagtttttatattsaagtatcctagcacgtcaacttttattgcttcacttaaaatctgccaccttccaccttcatgtcctgaatcctttatctagaaaatgtgtaattttccaa

SEQ ID NO: 48619 - DNA, 201 bp, Homo sapiens
tgggaggccaaggccgatggattacctaagctcaggagttcaagaccagcctcggcaatatgaggaaaccccatctccactaaaatacaaaaaaaaaaaaatgagctgagtgtggcagcctgcacctgtagtctcagctactggaggggctgaggcaggagaattgcttgaacccaggaggcagaggttgcagtgagccga

SEQ ID NO: 48620 - DNA, 201 bp, Homo sapiens
tactgaatacttgcactgccaggcactgagctagatgctttactttggctaatcttcataggagccctaggaggtagatttcatcatcatcatcctcactstaactattattatcatctttgtcatccttcttctacagatgataaaattgagatttagagaagtaaagtaatatgtctaacatcatagtgggatggctga

SEQ ID NO: 48621 - DNA, 201 bp, Homo sapiens
caatggcttggaagagctggatgttaaattgttaggaattttgcaatctggttgaccccactgacagcttgaaatcagccatggtgagagtatctacaccrtggaaattggccaacattacaaattagggctcccttccctccacccagaagtgttcagtaaatatttactggcatactaccggagctgctggcctttggg

SEQ ID NO: 48622 - DNA, 201 bp, Homo sapiens
atgtgaaccagacaggaagttaaacttgacaaggaagagaaaccaactaggaagagttggggatggagttaactgacactaaatttggcctgagcttctcrttggcttgccgtacacaattgccactgtgcgataagagcaacgtgttaattgcagtggtagttcctaaatgctgctgcacgtcagaaccacttaggaaac

SEQ ID NO: 48623 - DNA, 201 bp, Homo sapiens
aattatggtgatggtgatggttggacaactctgtaaatatgctaaaaacaattgaattgtacactttaaataggtggattgtgcactatgtgaattatatytcagaaagctgttacaaaaacaaaaacaaaaacaaaaagtgtcccacactatagccagaataatcttatcaagtcaaccgcctggttaaatcaccaccgc

SEQ ID NO: 48624 - DNA, 201 bp, Homo sapiens
tttggccataaaaatgaacgaagcactgtgagatgacgtatttttgttgctgaagccacctggcttgtggaactttgttccggcagccatggaaaatgaakgcagatggtgactgctgatggatatggaatttttctttggggtgatgaaaatgttctaaaatcaattatggtgatggtgatggttggacaactctgtaaa

SEQ ID NO: 48625 - DNA, 201 bp, Homo sapiens
attcataaacaaaatgggcctgtccatacaatagaatattatttggccataaaaatgaacgaagcactgtgagatgacgtatttttgttgctgaagccacstggcttgtggaactttgttccggcagccatggaaaatgaaggcagatggtgactgctgatggatatggaatttttctttggggtgatgaaaatgttctaa

SEQ ID NO: 48626 - DNA, 201 bp, Homo sapiens
aatattttaccattatggttaccaaatggcgattctctaatggcatgagtccttctacatttatttgttggcattctattttaaggaaaagctccccccarcttaagaatttatttccaattttaaaagtttcattactatggttttatgggttctttttttattctgtagggtaacaatctgttgctacccttatttatt

SEQ ID NO: 48627 - DNA, 201 bp, Homo sapiens
aggcaggtggatcacctgaggttgtgagttcaagagcagcctgagcaacatggagaaaccctgtctctactaaaaatatgaaattagctgggcatggtggygtgtacctataatcccagctactctggaggctgaggtgggagaatcacttgaacctgggagacagaggttgtggtgagccaagatcatgtcattgcactc

SEQ ID NO: 48628 - DNA, 201 bp, Homo sapiens
gttatatgcattaaatgggataatatctagaaattacctaggaaatatctggccaatgattagcacttaagaaatgatctctagtataactataatgaatrtctcttaaactttttctgctatgaccagttattgcttcttttggagacatgatagctggaaaatgtgcactcataattttgccagtgtttatttcttcat

SEQ ID NO: 48629 - DNA, 201 bp, Homo sapiens
agactgtattccgaaaagttaaggaagcagttctgtgggtaaggatagtgaataataatgttgtgagttgttttgatgagccaggcaatgtgttgatcacytcacatgtagtatggtctttaatttttatttgaaaaactgaaggccagacatggtggttcacacctgtaatcccaacactttgggaggccgaggcaggtg

SEQ ID NO: 48630 - DNA, 201 bp, Homo sapiens
agcagttctagattgacatggtggccccactgtgtcacttagagacaaagtggagacaggggtggagagacataaatctatctgagagatgtgtaggaagstgaatctttaaaacctggcttccctcttattttatggcatttgtggaatgtatcctgtgtcctcatggccccagacaactcaccaccacatccacattct

SEQ ID NO: 48631 - DNA, 201 bp, Homo sapiens
gccaggaactaggagggcagagtgaagacagagaaatgcaaagactgtattccgaaaagttaaggaagcagttctgtgggtaaggatagtgaataataatrttgtgagttgttttgatgagccaggcaatgtgttgatcacctcacatgtagtatggtctttaatttttatttgaaaaactgaaggccagacatggtggtt

SEQ ID NO: 48632 - DNA, 201 bp, Homo sapiens
ctggtcaccccaccctaatcttatgcaaatgggctttccagttgattggcaccatcttgtctgcttcttactgtacatgtggctggcagagaaaggaagayggagctgccatcttgaacatgtctagtccttagttcctgccagcattcacctgtgcaagtctccagcttgcttgtctatgtctgcagctcaactttacat

SEQ ID NO: 48633 - DNA, 201 bp, Homo sapiens
tatcatgtgaagatccactgccaggaactaggagggcagagtgaagacagagaaatgcaaagactgtattccgaaaagttaaggaagcagttctgtgggtraggatagtgaataataatgttgtgagttgttttgatgagccaggcaatgtgttgatcacctcacatgtagtatggtctttaatttttatttgaaaaactg

SEQ ID NO: 48634 - DNA, 201 bp, Homo sapiens
catgtctagtccttagttcctgccagcattcacctgtgcaagtctccagcttgcttgtctatgtctgcagctcaactttacattttctttgttagaaaatkatttggggttgctttttattaaaaagaaaagccttaccaaggattcccatgcccttaccatctgcctgtgtaatttcttcttaactcctgtatcatcagg

SEQ ID NO: 48635 - DNA, 201 bp, Homo sapiens
aaggtgaactcctttcttttaaacactgctatcatgtgaagatccactgccaggaactaggagggcagagtgaagacagagaaatgcaaagactgtattcygaaaagttaaggaagcagttctgtgggtaaggatagtgaataataatgttgtgagttgttttgatgagccaggcaatgtgttgatcacctcacatgtagt

SEQ ID NO: 48636 - DNA, 201 bp, Homo sapiens
ccaaggattcccatgcccttaccatctgcctgtgtaatttcttcttaactcctgtatcatcaggaacgtgaaccctattgtgaattgtacatgccagggawctagattgtgtgctccttatgagaatgtaatgcctgatgatctgaggtagaacagtttcaacccgaatccaccccacccaccaactttccccatcccatg

SEQ ID NO: 48637 - DNA, 201 bp, Homo sapiens
ctttctgtctctaaaaatttaccttttttgatattaagaagaaaagacacccacacatatactcaattgtgtccttccctggcttgttaccctccctcctycatcacacttaggctcaaacacaaatttgccaccatcccctcatcatctggtccttttccatttctttagtctaacttcctgctagtcttttcttcactc

SEQ ID NO: 48638 - DNA, 201 bp, Homo sapiens
gatttttggcaggggagggggctggcaaatgatgttttgcctcctgtattagttttctatttcttctgtaaaaatttatgacaaaatttgtggcttaaagyaacccatggatgtctgaatggctttggttcctttctggaggcccaagggcagaatccactttcttccctctcccagtttctagaggctcacagccccttc

SEQ ID NO: 48639 - DNA, 201 bp, Homo sapiens
tttctgcttcctggttacaagaggttttattaataccttccctccctgccttcttggagttagctgtggccatgccactggatctgaccactgaaatgtasttggaagtagtggcatgcgacccttctcagccaaagtatacaattgccggtgttcaattctccacccctctttacgcatcccatcaaatgccgatgtctg

SEQ ID NO: 48640 - DNA, 201 bp, Homo sapiens
gaaacaatgaacctgagatcatactgcttataattggtggtgtcaaaatttgaacccaggattttagggccctggttttcatccatagttctgtggcctastgtctcttagtttttttgatgttggtggtgatacatcaaggaaatttgccggtgtgttttcccatcacttttatcaaccagggtgagatagagagaactg

SEQ ID NO: 48641 - DNA, 201 bp, Homo sapiens
tataaatcaagcaaggaacttgaaaaatgaaggcaattaatgaaaaagcatgtgagaggtgttttgcatcctaagggaggaaatacactgtcagtgaattwaatgtcacaacaaaggctcttttgaccctgctgaaaagatttcatgtggatagtaataaatggatgaactttgcagcctcacaggtggagaattgcctgt

SEQ ID NO: 48642 - DNA, 201 bp, Homo sapiens
cactttgtggccacatgaactggcagaagaggctgtcctaaaatcctaatgtggcaaaaaccaattttcagaagtcaatttggatgttataggtagcgctyttcacacccaataaattgcttatctttggctttgaactgatgggcacgtacacaaaagattggagccaactgattgcattattagctgaggaaaaagtgt

SEQ ID NO: 48643 - DNA, 201 bp, Homo sapiens
gacagtgccatgagcagctgataaagaccaagagaggggaatgtggggcctggtctaatgagagttactgccataactggcatttactgagcacatcctayatgtgactctgttctaagtactttctgcatgtcgtgtgttagacatcaagagtcgaggcaccctcattcacattctacacatcatgaaactgagacttgt

SEQ ID NO: 48644 - DNA, 201 bp, Homo sapiens
tggccaattcccgagtgggggcagggggttgggctcaactaagggcaccaacaataaatgcctccttgctggtagatgggaaggactgagaagacagaggrgaaattgcttgcattctgctaacatctgcaacgtctgtaacagtgtcttttccagcagttgtaaaggatcctcactctccctttcctccctcagtcccag

SEQ ID NO: 48645 - DNA, 201 bp, Homo sapiens
agtaactttccccagtccaccagcttgtatcggaattgggatttgagctcaggtctgtccagctttagaatgcaaactcttaagtgctgccttaagtttgmttccccagaagaaggtcctgggatgagaatttgtgttaaagtgatgtatcggaaaggttgctaggaaaaacgtatagggaagtgggaactgagtttggca

SEQ ID NO: 48646 - DNA, 201 bp, Homo sapiens
gtcaattatatacagagcactgggctaaactggttatctgtgtacataaactttccaagtttgggattgtctgcttagaaaggatatattaaattggtacsattggacccaatatgactggtgtttgtaagggtctaggtagaggctgcttgatagcatttgtaaagggcaattaatctattctgccgtcagcattacagc

SEQ ID NO: 48647 - DNA, 201 bp, Homo sapiens
tctgtgttgaagcaaacgaagctctctgtaagcctttcggaaatagtacagatacggaaacaggggcatctaaaagtcggccatcaggcactcagggtgasatactctgcttgccctttgttataggaaatgccctggagttgagtctgggaggtactgggaggtgtctcagcaggagataagcagcggggacttgccgtc

SEQ ID NO: 48648 - DNA, 201 bp, Homo sapiens
gacccccaggcctgtaggaaccaggccccacagcaggagaggtgagcagtgggtgagcgaacaaagcttcatctgtgtttacaggcactccccattgctcscattacttcctgagctcctcctcctgtcagatgagtggcagcattagagtctcataggagtatgaaccttattgtcaactgcatgtgagggatctaggtt

SEQ ID NO: 48649 - DNA, 201 bp, Homo sapiens
tgacaactctcaaccgattttctacataaggggtccccgacccccaggcctgtaggaaccaggccccacagcaggagaggtgagcagtgggtgagcgaacraagcttcatctgtgtttacaggcactccccattgctcgcattacttcctgagctcctcctcctgtcagatgagtggcagcattagagtctcataggagta

SEQ ID NO: 48650 - DNA, 201 bp, Homo sapiens
catggggcaccccacacttcacgccacacttaggcaagaagaaatgttcacagtctcagctgatgccagggaactttacagcaaaggaaacgttgaagcgyctcctgggctgtgtccctccatccctgtgcctctgtcatcctgtctacagattctcatgacagcaatgacaactctcaaccgattttctacataaggggt

SEQ ID NO: 48651 - DNA, 201 bp, Homo sapiens
aaactatttccacaacatcaagaatgtcacttagaatcaatattggcctggcttcgataacttacctaacagagaggtaatcttttcatggggcaccccayacttcacgccacacttaggcaagaagaaatgttcacagtctcagctgatgccagggaactttacagcaaaggaaacgttgaagcgcctcctgggctgtgt

SEQ ID NO: 48652 - DNA, 201 bp, Homo sapiens
gtgaatttaatgtcacaacaaaggctcttttgaccctgctgaaaagatttcatgtggatagtaataaatggatgaactttgcagcctcacaggtggagaawtgcctgtttcctgagttcaagctgacttaggcttttatctgtctacattctctatcttgagaacttcctagattcttttacttttgctttcatttcttgt

SEQ ID NO: 48653 - DNA, 201 bp, Homo sapiens
gccattaagtggttctgtcaggatttgaatccatagcctaagttcatcaccacattcttctccttgtctcagtttcggtatttctcacaaatcaagggacmtggagagaaacagaaactatttccacaacatcaagaatgtcacttagaatcaatattggcctggcttcgataacttacctaacagagaggtaatcttttc

SEQ ID NO: 48654 - DNA, 201 bp, Homo sapiens
agcctcacaggtggagaattgcctgtttcctgagttcaagctgacttaggcttttatctgtctacattctctatcttgagaacttcctagattcttttacktttgctttcatttcttgtgatttttaaaaataacaatgataattcttttcccattttctggtcattcttcacacatcctttacatattttatacaagctt

SEQ ID NO: 48655 - DNA, 201 bp, Homo sapiens
aatgggaaatagttttggaataatgggctcattagagatagacaaagctatggcctgggggaagtaacactggtacccagagggttttaactgtttcactmcctttcccagtgactcaaactatgcaccagtattaattttaaatgactttacaaaaagacttaatgagataaatcgtgtaggcacagtataaaagttagt

SEQ ID NO: 48656 - DNA, 201 bp, Homo sapiens
tctggtcattcttcacacatcctttacatattttatacaagcttgtatttactttcaggttgggagactgattaattgattagtgaggttatgtaacgtcmcctgaactgcagtctggacagagctggacaaggttggggtttcaagtagtatatttgttttaatctgttgcgatgtgccaaggaaaattattctggtatt

SEQ ID NO: 48657 - DNA, 201 bp, Homo sapiens
tgctcccaattccagaaagtaaaatattttgcaattgaggattgtaaacatcttagacagttgcaaggactgtacatgacatatccatgcaagagtattcygttctgtttctatcagcttcttatgctttttcaatgggaaatagttttggaataatgggctcattagagatagacaaagctatggcctgggggaagtaac

SEQ ID NO: 48658 - DNA, 201 bp, Homo sapiens
tggactcctatttacattaataagagtttttcctatatttaaacagagctcagtagaaatgttatgctttcacaggttttcccttccctcctaccaatccwtttgtaacaatctagtagtaagtcaattaataatgattagaaacctcataaatgcattatcctacctaacaaatgtgaaatactataataaaatgacgta

SEQ ID NO: 48659 - DNA, 201 bp, Homo sapiens
cgaacttctgcaaaagctgtcagaatcaaaatgaagccacttatgttaaaattttttttaattaataatcaatttaaaaccctgaaaaatgagctgaggarggttatgaagaggggagtctcacacttggttgcctgataacaaaaactgtcacaaaagactgcaaaaaccacaaccttgcacaaaggccatcacaacctt

SEQ ID NO: 48660 - DNA, 201 bp, Homo sapiens
agctgatttccctcaactgtttcttagtcctgaggctgcttgaagtctctgaagcaattaatttttaattttaattttattgaggtaaaatttacataacrtaaaattaagcaagcgatacttaattactttctaatgttgtgcaaccactacctttatctagttccaaaatggttctgttaacccaaaaggaaactgtat

SEQ ID NO: 48661 - DNA, 201 bp, Homo sapiens
caaaatttgaactccagcctgaaaatcacaggatccctggagacaggaatatgcactggcaggcaacagaaagccaaacagaaatgagatcgaagaagagrtaggaaaacaaaacatttcaaaggaggcatagaaaggagcatataatggtgatggaggcaacgataagtaggcaatggaaagtagagaagaaaaatagca

SEQ ID NO: 48662 - DNA, 201 bp, Homo sapiens
gcagatgtaagaagagcttacactttttattatatctgacattcaatgggaaaccactggaaaggttggagattggggtgaccagtgtttctgagatgaastgaaaacacttagcctcttttcttcttatgtccattcttctgtgtattgataaagcctccatttttctgacattggaatgggaagagatgtttcagtctc

SEQ ID NO: 48663 - DNA, 201 bp, Homo sapiens
ctccctggccttgataactgacagttactgtgtgctccctagtgtgttgagggccacctcgaacctcacaacagctcttaggggaaaggtactctcatctkcccattttacaggtgaggacatttaaggctgagctaggtgaaacaatgaacctgagatcatactgcttataattggtggtgtcaaaatttgaacccagga

SEQ ID NO: 48664 - DNA, 201 bp, Homo sapiens
tgctgctgttttaacagcaacagtgaattcgcacgtttgtttttcaggccatgcaaagggaaaaatgatttatgtctattcccagacagtgtgttttaaayggtgtcttccctttcaagagacttttctagtaagaatttttttaatagggaaataagtaataactttgagagcaatttaacttgatcatgaatcagaatg

SEQ ID NO: 48665 - DNA, 201 bp, Homo sapiens
cctaaaatatttactacctggttctttatagacaaaatttacagactcctgaggcagggttttatcaattcctttccatgtctatggatttagatataagygtatattttgttaaatattacagcagactttgaggtggctatcatctccattttacagatgtagaggatcaggctcacaggtagtgaatggcagaaccaa

SEQ ID NO: 48666 - DNA, 201 bp, Homo sapiens
cagtccctactcttaaccttgctgtctgaatgctgttgcttgccattggactattctggaacaggaagtatagcattctaacagcatggtatatgaagccmtatttccctgaatcaacttctagttttagcacttattagctaataagtgtatgatcttaggcaatttattaggaaaaaaattaatctcagtttacccaac

SEQ ID NO: 48667 - DNA, 201 bp, Homo sapiens
acataactctataccgtacagtataaacaaggctgtgatgaaatttgaaaggaagacaataaggataggagagctataaagaaggcaaaacaagtgaacayaattccaatctgtgtagtcctgcacatttgctggaggtggaacaaaatccttgcccccatgttatgcatatggaaattgagatttggagagattactgac

SEQ ID NO: 48668 - DNA, 201 bp, Homo sapiens
gttgcaatacaaacagtgtggattacaatgcctaaaatatttactacctggttctttatagacaaaatttacagactcctgaggcagggttttatcaattsctttccatgtctatggatttagatataagcgtatattttgttaaatattacagcagactttgaggtggctatcatctccattttacagatgtagaggatc

SEQ ID NO: 48669 - DNA, 201 bp, Homo sapiens
gagaaactcgatagaactatagttggaagtgtcttttcaatatgagcctctagctataaatggatgaaatttccactccctcaaagcttagaactttcttrctcttagcagctcactagttgcttaacatacctaatattaaccatctggtcagggagctaaatacaatgaagggcatccagctattatcccacccatttg

SEQ ID NO: 48670 - DNA, 201 bp, Homo sapiens
caagggcagaattgagtagttgcaatacaaacagtgtggattacaatgcctaaaatatttactacctggttctttatagacaaaatttacagactcctgargcagggttttatcaattcctttccatgtctatggatttagatataagcgtatattttgttaaatattacagcagactttgaggtggctatcatctccatt

SEQ ID NO: 48671 - DNA, 201 bp, Homo sapiens
ttggaagtgtcttttcaatatgagcctctagctataaatggatgaaatttccactccctcaaagcttagaactttcttactcttagcagctcactagttgyttaacatacctaatattaaccatctggtcagggagctaaatacaatgaagggcatccagctattatcccacccatttgcctatcccaagttatgttttat

SEQ ID NO: 48672 - DNA, 201 bp, Homo sapiens
aattgcatgcgttgttttgcttggatgttactagcccttgctgggaaaggtacttggcactaatgtgactatttaaactaatattcacaaagcagttaccstgtgccaggcttatatggattcatgtaattctcacattaattctgtgagactggtgccatgactatgccacttacatatgtccagccagaatctctagtt

SEQ ID NO: 48673 - DNA, 201 bp, Homo sapiens
aactttcttactcttagcagctcactagttgcttaacatacctaatattaaccatctggtcagggagctaaatacaatgaagggcatccagctattatccmacccatttgcctatcccaagttatgttttattaggttgagttgtcaattttaaataatcaagaaagatagctccaggtaagtctcactatctcgttaata

SEQ ID NO: 48674 - DNA, 201 bp, Homo sapiens
acaagggcagaattgagtagttgcaatacaaacagtgtggattacaatgcctaaaatatttactacctggttctttatagacaaaatttacagactcctgrggcagggttttatcaattcctttccatgtctatggatttagatataagcgtatattttgttaaatattacagcagactttgaggtggctatcatctccat

SEQ ID NO: 48675 - DNA, 201 bp, Homo sapiens
tgcttaacatacctaatattaaccatctggtcagggagctaaatacaatgaagggcatccagctattatcccacccatttgcctatcccaagttatgtttyattaggttgagttgtcaattttaaataatcaagaaagatagctccaggtaagtctcactatctcgttaataaccctttaccaattgcagctgtttcgaga

SEQ ID NO: 48676 - DNA, 201 bp, Homo sapiens
tttagaacagagatttttcagcaacaaccacaggctagatatagcccactacctgtttttgtcaataaagctttaatggaacataagcatggccattcatkaatatatgatcaatagattttttttggtacaagggcagaattgagtagttgcaatacaaacagtgtggattacaatgcctaaaatatttactacctggtt

SEQ ID NO: 48677 - DNA, 201 bp, Homo sapiens
aagacacattgaagctcttgatggggaatagtcattatatttggcattttgccagagtaaacaaagaacccttaatttattctttagaatacctattaatkcagaagtgttctgaatggcgtcatgaaatactatgttagtgccagctcacatcctttgctgagagagttaaacgtatttgtctcaaatcagcacagcctt

SEQ ID NO: 48678 - DNA, 201 bp, Homo sapiens
acatgagaaagaagcaaaagcagaaacccctgataaacccatcagatgtcttgagatttattcactatcatgagaatagcacaggaaagaccagcccccakgattcaattacctcccctaggtccctcccacaacacgtgggaattctgggagatacagttcaagttgagatttgggtggggacacagtcaaaccatatca

SEQ ID NO: 48679 - DNA, 201 bp, Homo sapiens
tcaaaaaataaaatagcttgagtaagtagaggtgtttttcttgcctaacgagaagtctcagtgtaggtgatgctgggtttggttcaactgttcaacagtgstatgagaaattcaggctattcctctacttcatctcaccatccttaattgtctggctttaatcttcatagttttccccttatattggtctgttttcatgct

SEQ ID NO: 48680 - DNA, 201 bp, Homo sapiens
cagaggatttgatctactgaaccttctactgcactaaaaattctcatttcatcaagtataatgaactgaagtcaaagggatttatttgatgctgaaccaakccaacactctccccaccccaccttagtctaccgttaacgtgtccgaaattgcatgcgttgttttgcttggatgttactagcccttgctgggaaaggtact

SEQ ID NO: 48681 - DNA, 201 bp, Homo sapiens
cacagacgtgggtccacagttatctattttcttagcctcagtgcttggaagttgaaatttgtattgaataactaaattcctttgacaattaaaacataatwatcaaacttttttgcaaagaaataacactatggtatatgacatctatggcatatgacagtccctgcttaccttatgcttgccggcattcagtgcttaggt

SEQ ID NO: 48682 - DNA, 201 bp, Homo sapiens
agatcctttcaaatttgaaatccacaaacaagctgttcctgataaagtctggaagatctccaagatcaacagtaagtctggctaaagcatttctgcctatkcttccagctttcagtttattttctctttcccaaaatgctgtttctctactgttctctcaagtattctcatttggttcattttaagttattggcatattat

SEQ ID NO: 48683 - DNA, 201 bp, Homo sapiens
ctgagacccttctgtctgctttccagccattggactatgaaatttctgccttccacaccctgctgatcaaagtggaaaatgaagacccactcgtacccgaygtctcctacggccccagctccacagccaccgtccacatcactgtcctggatgtcaacgagggcccagtcttctacccagaccccatgatggtgaccaggc

SEQ ID NO: 48684 - DNA, 201 bp, Homo sapiens
tttctgcctgtctattttgggtagaagatacttagaacaaaagtagtcttgaagggaggagaatatcaagaaataaatcatgtctgtgttcctataaaacyaataacaaacttggtaaacatgcatctgaaaaataactagaagtgctattctactgttactataaaggaccctgagtactgtagatttggttaaactgtg

SEQ ID NO: 48685 - DNA, 201 bp, Homo sapiens
tttatttttaagtgagatgatgtgtgtaacatacccaatgcaaagcatgtagtaaatgactatgtgttttcaaaatagtgaccattaccatctgctttgtytgcagtttcaagccacagtcgaggaaggagctgtgggagttattgtcaatttgacagttgaagataaggatgaccccaccacaggtgcatggagggctgc

SEQ ID NO: 48686 - DNA, 201 bp, Homo sapiens
tgtgtctgcagaatcagtcagtggaagagatgacctccaggagactgtgatttccttggcaaaggtactgcatttgcttgcttagcaatatctgtgaactscttgccatagaacagcaagaattcgcaacattccctgccagtggcatccttcagcactgccagccacatgtcctcaccagcaaggtcccatgtcctcacc

SEQ ID NO: 48687 - DNA, 201 bp, Homo sapiens
agtgagggatgtgtctgcagaatcagtcagtggaagagatgacctccaggagactgtgatttccttggcaaaggtactgcatttgcttgcttagcaatatytgtgaactccttgccatagaacagcaagaattcgcaacattccctgccagtggcatccttcagcactgccagccacatgtcctcaccagcaaggtcccat

SEQ ID NO: 48688 - DNA, 201 bp, Homo sapiens
tcatatgagttggttcccctttggggtatgcccacctctggcccagtaagccatggtgctgtggcaaggacaagtgtaccataaggttggcccccccccccgccccaggggctgagggttgggcagattaacctggaagggaaagggtatgtctagcaaattagaacaagtaagaagtatgatcacctgtaagttcatgct

SEQ ID NO: 48689 - DNA, 201 bp, Homo sapiens
atacccaatgcaaagcatgtagtaaatgactatgtgttttcaaaatagtgaccattaccatctgctttgtttgcagtttcaagccacagtcgaggaaggarctgtgggagttattgtcaatttgacagttgaagataaggatgaccccaccacaggtgcatggagggctgcctacaccatcatcaacggaaaccccgggca

SEQ ID NO: 48690 - DNA, 201 bp, Homo sapiens
tctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggcccccccccccg

SEQ ID NO: 48691 - DNA, 201 bp, Homo sapiens
cagtcgaggaaggagctgtgggagttattgtcaatttgacagttgaagataaggatgaccccaccacaggtgcatggagggctgcctacaccatcatcaayggaaaccccgggcagagctttgaaatccacaccaaccctcaaaccaacgaagggatgctttctgttgtcaaagtaagggtgcttccaattgcctctttct

SEQ ID NO: 48692 - DNA, 201 bp, Homo sapiens
gtttggggagacccagtggtgtggagagagggttgtgtttagcttctctttccctgacctcagagtaaacaccagccatctgcataacagcagtgcccttycatagtacttattaggctattgttactcagttgatgtcagttggtgccactagacagagggcactgcagccccatggccatgtctgtctttctgaaagat

SEQ ID NO: 48693 - DNA, 201 bp, Homo sapiens
ctgttgtcaaagtaagggtgcttccaattgcctctttctcctcatgcgagcacggagggccccatgaggcagctcatagaatcattgagtttagaaggccrcagataaattcccccagtctcctccttctgggaattaacaaaggaaaaggctcatggcttaagggtgcactcgtatcctcagcagcataaacaagcagcc

SEQ ID NO: 48694 - DNA, 201 bp, Homo sapiens
catcttgggattggcgccatgatcgatgaggtctgggtgtaaccaacgtcttatgccatgtctctgatctttactcaaattcacctcctattctgggtagygaagtttggggagacccagtggtgtggagagagggttgtgtttagcttctctttccctgacctcagagtaaacaccagccatctgcataacagcagtgcc

SEQ ID NO: 48695 - DNA, 201 bp, Homo sapiens
gggactaaaagcgcacactgccatgcccggctaatgttttgtattttagtagagatggggtttcaccacattgcccaggctggtcttgaactactaagctytgagctcaggcaatccccccgcttcggcctcccaaagtgctaggattacagccgtgagccaacacacctggcccaatagttccaattttttatgtgtata

SEQ ID NO: 48696 - DNA, 201 bp, Homo sapiens
tgcacaatgagagggaagcatccatcctccaagtgtagagcgtgggacgtcttggtagatacctcaccagctcttcccttctcagaggctctgaactcctrgagggtggcactcttggcatccccagactcttggcatccccagtactttgtccggaattcatgcatagcagcagatagccacaggtgatggctcaagtgc

SEQ ID NO: 48697 - DNA, 201 bp, Homo sapiens
gagtgtgtgtttttgtgcacattgcactgttgttacccaaccaatcagaaattctgtttattataaaagtaattctccttaattagagaaaatttggaacrtaaaaaaggaaaaggaagaaaattgctcaaagtttgcagtccaattataatggttcttgaccgtttagttatttagtctttttcctttatgcatacattt

SEQ ID NO: 48698 - DNA, 201 bp, Homo sapiens
ggagtgatgaggaagagtgaaattggcagagtgaagagtgatatttgatgaggcaatcagaaagagccattgtgaggtgaggtttgggctaaaacctgcayaatgagagggaagcatccatcctccaagtgtagagcgtgggacgtcttggtagatacctcaccagctcttcccttctcagaggctctgaactcctggagg

SEQ ID NO: 48699 - DNA, 201 bp, Homo sapiens
tggcttttctaatgcatcagcaagaacacatttaccggaatgcattgcaattaaaaagcaaaattcagttggaaacaatggacttaaacctacgaaatgtracaggataagtcagagaggaaatttgatttcaatggtgagattaacgagcccatgaatgcatggtgcatacggcacagacaaagataactgaattggatt

SEQ ID NO: 48700 - DNA, 201 bp, Homo sapiens
tgatggctccctttctttgagcgtattcattcattcattcattcattcaatgacaactatctaccaggagctgttctaagcattggggtgtggaggtgaayaagaaagcatagagccattgttctagctggggaaccaatatgaagtaaaacataagctaatacttaagtccagaagttcagaagtgataagtgctctgag

SEQ ID NO: 48701 - DNA, 201 bp, Homo sapiens
aagtccactgcctggacaaggccttcatggctgttcacaacctgccccagcctccagtccattacccttgcctattttgttgcagtgatggaattaaagtmcttctaatgaaaaaggctgtaggtgaattttaatccattagccatctaccagacctcctctgccatcctttagactctccatacagttcctctccctgcc

SEQ ID NO: 48702 - DNA, 201 bp, Homo sapiens
acagtttctattgaatgcatatcactttcatactattgtgaagtcaaaaaattatgagtgaaatcatcgtaagtcagggactctctctagctgcattgtgytgggcaagggatttaaccctcaccgtctttgtttcctcatctgcaaaatgaggatttataacagttcaaagggtatctactaggattaaaagatacaaaa

SEQ ID NO: 48703 - DNA, 201 bp, Homo sapiens
cacttgatgtagcccgtagcaggagtgccagggagaacacagctttgttgttccatatccagctgtttggatcagagggaaatgggatctttcaatcactrctgcagtatgagaaagtgagctgcacccagtggttactaggtggggtgctctgtgcagtgtgcttcgagcacaccctctcactgaatgtgagatgatgct

SEQ ID NO: 48704 - DNA, 201 bp, Homo sapiens
agactctgttattagccccgttttaaagatgaggacactaagattcagatggtttaagtaacctgtccagtgtccacagctcctgtattagctgagagtcytgtgccattatatcagaaaagtctgcttgtgtcttacagtcttgatcagaaacaagtatatccctcagaacatagaggcggcaatggggggtgactttgt

SEQ ID NO: 48705 - DNA, 201 bp, Homo sapiens
actgggggtgattgtgctcctcaggggacagacattagagacatgttttggttgtctgtcgtgagagcagagtgtattcccattccccagctgggaccagsgggtatgctgctctcatctaatggacagtggccaggggtgctgctgaacatcctacagtacataacacagttctcatcgctacagagaatctctggcccc

SEQ ID NO: 48706 - DNA, 201 bp, Homo sapiens
ccttcttgggagccagatgttccactgaacactttgcatgcactgtgactatctaatgcaatccttgggacagatctgtgaaatagactctgttattagcyccgttttaaagatgaggacactaagattcagatggtttaagtaacctgtccagtgtccacagctcctgtattagctgagagtcttgtgccattatatcag

SEQ ID NO: 48707 - DNA, 201 bp, Homo sapiens
tctcggttcatccatggtgggaaagagcccttcagctcattcttcagttggaggtggttcagggccccatgttgctcaaattggtgatgacagccagctgyttggtcccaattcgctgagactaggaattcaaacccaggaaaattgagacacctgtgtatgaaaagcataaagagaaaatttggttgccctcatgctcac

SEQ ID NO: 48708 - DNA, 201 bp, Homo sapiens
aatgctttttaaaagtactttcacgtttggactaataaaaatgacatatctgtctcatcccttttcaaggaagctgaagtgcctcatcaaatttattttaytaggatcccgacagcaatcttgtggcctgggtgaaggtcaaggaggttttgccttttgcagaagggagtaacaagtgatgtgatgataaagtgttctttc

SEQ ID NO: 48709 - DNA, 201 bp, Homo sapiens
ctaatctgttataatgctgctcttgcctcataacttttgttctttgtattccttaaaaagacctaagagagctcaagattatggggtgctgccaaatatawcactagtcttctatttttatttttaaataaaactttgtaattggtaaagtcacagaatcagtgtgcatatgatcaaagtctataaaataatgaaccatgc

SEQ ID NO: 48710 - DNA, 201 bp, Homo sapiens
ctcaacaaaatttgatatcaccataaaggaggagactcggttgcctttgtttttattattaaaaggaagcattgagtctaactgatatgaaacatttctgyatatgcctaagaacttatgaagctcataggataagaattcttggcaatccaaataatctcacattgtctctaatctgttataatgctgctcttgcctcat

SEQ ID NO: 48711 - DNA, 201 bp, Homo sapiens
cgactgtagccttctttccagcagaagcagtttgccaaatgcctctgcccttccttagcccaaatgctaatagtagctatttcatgaatagatacagaatracagagtcaactttacctaacttctccaaaatgccgactccagtattccattttcaaattaacttattctgattataaaagtaatgttcagtattgttag

SEQ ID NO: 48712 - DNA, 201 bp, Homo sapiens
agagcttttgagcattgtttgataatattccaaaaagaaaatgatagagccaaatttcccaaatgttccatgtaaaactaggaaatgactgaagcattcaycctcatttctaagtattgtaagtgtctggatcagaatccattgccatggcttattcattcagagcttgttgctggggattgggatgcttagactggcagg

SEQ ID NO: 48713 - DNA, 201 bp, Homo sapiens
cccctctcccatgcccaccctgtgcgcagaaatgtggctttcaaagattgttttcttcccactgagctcattatttctgtgcctcatcaaacccgggactrcatggctttagggtgtttctgtgggagctgaagtggatggaattgaacactgacagggcaacagtggggggtctttatctcatcagtagagccctccagg

SEQ ID NO: 48714 - DNA, 201 bp, Homo sapiens
gcgctttccagtcgtgtgtcaatgcaaagtgagtggatttgggtttaactcccttggactgagtgcaattatatgttgggaggggactaacaaggtagccyatgtaacaatactgtcgtaattatgtgcaatattttcatttttacttctgatcaaccgcaagagtagattgaatgctattgttcagtttgcacttaaaaa

SEQ ID NO: 48715 - DNA, 201 bp, Homo sapiens
ggtctcattctgtcactcaggctggagtgcagtgtcatgatcatggctcactgcagcctcgacctctcaggctcaagtgatccttgcatctcaacctcacragtagctacgactacaggtatgccccactatgcctggataattgttccttttttttttttggtagaaacagggtctcattctgttgcccaggctagtctc

SEQ ID NO: 48716 - DNA, 201 bp, Homo sapiens
atgatttcaattctcaggactgagtatctctgctgaacccaaatttaaattcttaatatgagaagctgcgctttccagtcgtgtgtcaatgcaaagtgagyggatttgggtttaactcccttggactgagtgcaattatatgttgggaggggactaacaaggtagcccatgtaacaatactgtcgtaattatgtgcaatat

SEQ ID NO: 48717 - DNA, 201 bp, Homo sapiens
atagatgccctcttgtctttctgtgcccatcatgggagtctccaagaaagttctggcacaaaaaactaaggaaagatacaataaatttcataatttcttarcagagtgatcaagagctgtgggatctgatatggtttagctgtctccccaatctcatcttgaattgtagctctgagaattcacacgtgtcatgggagggac

SEQ ID NO: 48718 - DNA, 201 bp, Homo sapiens
tgaccacatctcctgagtattttattgccaccacgactcatgatttcaattctcaggactgagtatctctgctgaacccaaatttaaattcttaatatgaraagctgcgctttccagtcgtgtgtcaatgcaaagtgagtggatttgggtttaactcccttggactgagtgcaattatatgttgggaggggactaacaagg

SEQ ID NO: 48719 - DNA, 201 bp, Homo sapiens
ttctggcacaaaaaactaaggaaagatacaataaatttcataatttcttaacagagtgatcaagagctgtgggatctgatatggtttagctgtctccccartctcatcttgaattgtagctctgagaattcacacgtgtcatgggagggacccagtgggaggtaattgagtcatgggggtgagtctttctcgtgctgttct

SEQ ID NO: 48720 - DNA, 201 bp, Homo sapiens
ttgcccaccgtgtaagaagtccccttgttcttcctccatcttctgccatgattgtgaggcctccccagccatgtggaactgtgagttcattaaatctctgwcctttgtaaattacccagtcccgggtatgtcttcattagcagcatgagaacggactaatacagcatctgagatcctccattcaggtctcagtgctgctgc

SEQ ID NO: 48721 - DNA, 201 bp, Homo sapiens
tagtgtagtccgtgcatccgcccttcgatgcttgggttggatcatagagcagtgactgttgatggctcacccagatccccaggaacccaccactcccatayaggctttcaacctgttaatccctgcagctgcctgcctggactttcctctgaccatgggagtgtgctcagtcttactgcccagggaacagccatcagcctt

SEQ ID NO: 48722 - DNA, 201 bp, Homo sapiens
accgtgtaagaagtccccttgttcttcctccatcttctgccatgattgtgaggcctccccagccatgtggaactgtgagttcattaaatctctgacctttrtaaattacccagtcccgggtatgtcttcattagcagcatgagaacggactaatacagcatctgagatcctccattcaggtctcagtgctgctgcgtactg

SEQ ID NO: 48723 - DNA, 201 bp, Homo sapiens
atcgggaaaaaaatgaaaacccagcagcctgactccaaagcccgtgtgcttatccaaacactacagcgtaggttgcttagtgccagcttcagtggttagtkctttacatgcttatcataggtaatcctctgtcaacctgtagaagtaggcatgattaacttaattttccattgtgaacactgaaggttggacagattcaat

SEQ ID NO: 48724 - DNA, 201 bp, Homo sapiens
gattgattgagcaattcattcattttacatacatttaattgagtgcttatagggtaagggacacgcttcaaggtgttcggaggatacagtagcaacaagayacactgggttccttgctttcatgtatcttttattctagttctttgtttcagaataaactggcttgaattcctctcttctgtgtgtaggtgacatggcagg

SEQ ID NO: 48725 - DNA, 201 bp, Homo sapiens
aaaccttaccgtgtgctgaacattagactaagcattttgcaaacattatctaatttaataatcacaccaacactataaaaaagacatagttgttatctgtrtcttacccagctggtaactgatcgggaaaaaaatgaaaacccagcagcctgactccaaagcccgtgtgcttatccaaacactacagcgtaggttgcttag

SEQ ID NO: 48726 - DNA, 201 bp, Homo sapiens
ggtgacatggcaggaagttgtgcctggtttgtaacatggcttgttgataacaccagcacagggtcatataccctcattggaaagggtactggtgtttagtsggaatgcagtttcttacacaagtacttgggttacttacgactggcagactggggcccagcccttggcagcgcactcttcaatgggctcatgagggcctac

SEQ ID NO: 48727 - DNA, 201 bp, Homo sapiens
ctgaaacgagtctgacggctttttctcctggggccattttgtaagaaataaaagcaaaacagtgagatatttaaattcttcagggatattattttcgagtrgataaagtgaagaacattttttattcatattagaagtgatagttggatgtgtgtaatttttttgctctccgagatggagagagaacacagcacagatctt

SEQ ID NO: 48728 - DNA, 201 bp, Homo sapiens
aacaaacctttgttgagttaaggctctgggattttgttttattttgttcagtttttaatttctgtaccatatcctaacccatcctaaccaataaaacctcrtcgctgtcaacatcatcatcatcatcgcaataataaaatgtattaattatgaacataaaaccttaccgtgtgctgaacattagactaagcattttgcaaa

SEQ ID NO: 48729 - DNA, 201 bp, Homo sapiens
gactggcagactggggcccagcccttggcagcgcactcttcaatgggctcatgagggcctactttctgatgccgtttccctccgtgcttcatgcacttcarttcggtcattgtcctgtttacatcatacccgcactgaagcttcttacagttgctgaagcttcttccttgaagaagcaagtttgaggaagagccccgatca

SEQ ID NO: 48730 - DNA, 201 bp, Homo sapiens
gagcaactcctaaagacctactatttagagtttcacttaacattgtttctctgtaatgttgatgagaaaacaaaaatggtcattggtccctgggcctcccttctgtgtgctctgccgttgatgttacttagcttctttctctgtattgacatctttttgccttgctacctagttactaagtctctccaagtttctattcca

SEQ ID NO: 48731 - DNA, 201 bp, Homo sapiens
ccacgatcatgatcgatgacaaaaatgatcactcaccaaaattcaccaagaaagaggtaaacccctgtgccaaacaccaaccaccactgtggtcacagctrcaattactgattgatgttaattcacgtaccacagcacctgctggcccccctttcaaaatcaaaatactcctttgtgggagagacgatggtgttttgctgg

SEQ ID NO: 48732 - DNA, 201 bp, Homo sapiens
tctgtcttgccccggtaggcaccacagtgatgcggatgacagcctttgatgcagatgacccagccaccgataatgccctcctgcggtataatatccgtcarcagacgcctgacaagccatctcccaacatgttctacatcgatcctgagaaaggagacattgtcactgttgtgtcacctgcgctgctggaccgagaggtga

SEQ ID NO: 48733 - DNA, 201 bp, Homo sapiens
tacatcgatcctgagaaaggagacattgtcactgttgtgtcacctgcgctgctggaccgagaggtgagctgaaaagaatacactttctttttcacgagaayagaatgtggctttcatgcaagggatgatgtggggctccagtcagtggttttttttaatactgtaaaggcagaaatgaggtgtttaccatgttttggtggg

SEQ ID NO: 48734 - DNA, 201 bp, Homo sapiens
ggcgcttggcacatcgtatgttttaagtaactataggttgaattaattaatattctttccacacagcaatttggcctgcataaaagacttcaatattttcytgatgttgccagaggcttaatgtgtgacatttcgtatagcaaatgctcaataaatgttgggtgagtgaacatagctgtcactcctcattacatattttaa

SEQ ID NO: 48735 - DNA, 201 bp, Homo sapiens
tgcgctgctggaccgagaggtgagctgaaaagaatacactttctttttcacgagaatagaatgtggctttcatgcaagggatgatgtggggctccagtcartggttttttttaatactgtaaaggcagaaatgaggtgtttaccatgttttggtggggaaaatctataaagggaaatgggatattatgtgacccaagaaaa

SEQ ID NO: 48736 - DNA, 201 bp, Homo sapiens
ggatcacctccccacactgcctgattcagtatgtctggcatagggaccaataacgtgcatttctcccaacttcccaggtgcattcgtttgcaacggctgtsgtaacaaagcatcataaactaagtggcttacaacagcagaaatgtattctcccatggttctggaagccagaactctgaaatcaaggtgttggcaaagcca

SEQ ID NO: 48737 - DNA, 201 bp, Homo sapiens
ctggaccgagaggtgagctgaaaagaatacactttctttttcacgagaatagaatgtggctttcatgcaagggatgatgtggggctccagtcagtggtttwttttaatactgtaaaggcagaaatgaggtgtttaccatgttttggtggggaaaatctataaagggaaatgggatattatgtgacccaagaaaacacgtgc

SEQ ID NO: 48738 - DNA, 201 bp, Homo sapiens
ttgcatcatagctttagaatgcaagccccatgggacagaggctgtgtctttcttatccatcattgtacccattccctagcaagtgtccagcatttggaagmaagtcaataaatactagctattattgctattagtattaatgtgttagcgttgtctgacccttgctccttacagtgtaggccatgggccaccatggcatca

SEQ ID NO: 48739 - DNA, 201 bp, Homo sapiens
tgtttggtaaatgtgactacagagcccagggtgaaaagatgtagaaattgtcttgggatcatcttgacgtctcctggttggagtattcatgttcactcccrctcaatccccaggtcatatggcagtctaatctcagactctcagcccagctgccacctccagcctctggcctacactagtgcccagtggtgagcaaagatg

SEQ ID NO: 48740 - DNA, 201 bp, Homo sapiens
cctccttgctctttctacccaataaatacaaagggctctagaagctcaggggtgcctttgctcactagaagcagggagctctcttcttcttccccagaccsttcctttaaaacagtttcttttgtcttaagtttccatttctacgtttgtccctttgttcagtctcgtaatgacactctcaagtagtaacagtagtaactg

SEQ ID NO: 48741 - DNA, 201 bp, Homo sapiens
tgatcaactcagtataccactggaggctatatgagtaagcgccaaactggtcttcataaatgcagaatgttggcagaccgacaaactgcgtctgctgcccygaaggagtgctgaagacagtcacccccgatgcgcagtgtttcttgtgattaggtacatctgaagcctgttagtaataatataaacctgtgttcagttaag

SEQ ID NO: 48742 - DNA, 201 bp, Homo sapiens
cttgcagaaaaggaaaaccgaaacattgaaagagggaaaatctgacaggagaaggcacagagatgagcatgagggccatttgttgaagtgttggtaacagygataatgataattctagctgatattttcagagcattttctacgtgtcactcatggagtcctcacaagaacttcacgaaataggtactgtaattattccca

SEQ ID NO: 48743 - DNA, 201 bp, Homo sapiens
tacttgttcacatccatgcagcatgtgtgcctgcatgctcacacactctagtcttacgcagcttattcaccaacattggttcgggatgacatttgactgtwttcaaaagtcaaatccacttttcatggacaaagattttccttcataagtgttattcaaaagattgtgctgtctgccctgaaaacagttcttatggaggag

SEQ ID NO: 48744 - DNA, 201 bp, Homo sapiens
atcatgccaatctacatttcaactaccagggcacacacttgaacccatataaacagtggtctattctgaggacttttcagaacttttattaaaccaagatwcattgtaaatctttgagggagtcatctggcatacaaagtgttttcgaaactttgattttaaaggaactcatactaacatcttgagaatctagtatcctta

SEQ ID NO: 48745 - DNA, 201 bp, Homo sapiens
cttaggatggtggtggacgtacaaaacactcaataagaatttgcttttgttattattacttgttcacatccatgcagcatgtgtgcctgcatgctcacacmctctagtcttacgcagcttattcaccaacattggttcgggatgacatttgactgttttcaaaagtcaaatccacttttcatggacaaagattttccttca

SEQ ID NO: 48746 - DNA, 201 bp, Homo sapiens
gcaaatatcatgccaatctacatttcaactaccagggcacacacttgaacccatataaacagtggtctattctgaggacttttcagaacttttattaaacsaagattcattgtaaatctttgagggagtcatctggcatacaaagtgttttcgaaactttgattttaaaggaactcatactaacatcttgagaatctagta

SEQ ID NO: 48747 - DNA, 201 bp, Homo sapiens
acagaaaaattatccttgggctatgaccacatctcctgagtattttattgccaccacgactcatgatttcaattctcaggactgagtatctctgctgaacscaaatttaaattcttaatatgagaagctgcgctttccagtcgtgtgtcaatgcaaagtgagtggatttgggtttaactcccttggactgagtgcaattat

SEQ ID NO: 48748 - DNA, 201 bp, Homo sapiens
aacatttgcaagaaggaatgtgatcctaaaataataggatgtccttgttgggtgagttgaggaagtatgatagagccatagaggaaaagggtagattggcrtcgacttagtagcgctgacgatcatttttatcagggatgtggatgtaggcacagaaagaaaggcatagctcttagattagcagaagagacaaggttggaa

SEQ ID NO: 48749 - DNA, 201 bp, Homo sapiens
aggaattcataaagttggattaaatgataacaaaaattggaactttccctttatcttcttttcttcttaaagaataagttaagatacattgatttcatttyacaacttgcacggaaatgagtgttttactgttgatgtttttatgatctgtagtttccattctttttaatagccttggtgcagtattaaaaaaactatctt

SEQ ID NO: 48750 - DNA, 201 bp, Homo sapiens
atacatgtggtctctttccctataactaaatatttgatacaagccactatcaacttgatactgacagtttaagggtgttgggtacgatgacctttgaggtsccttctggccataagtaccaaggaattcataaagttggattaaatgataacaaaaattggaactttccctttatcttcttttcttcttaaagaataagtt

SEQ ID NO: 48751 - DNA, 201 bp, Homo sapiens
atcatgggctagggacagtgtggacattcatatatgtgaatgctccttaaagcttccctataaccttggatactgctggtcacgtgtcccttaaatatagrtgaggaaattacagctctgagacaattgttgttggtcagtatccttttgatcctttgtttgtaaatcttgcccagttggggctgcatgaggttgaaagct

SEQ ID NO: 48752 - DNA, 201 bp, Homo sapiens
aagagggtaagtcaccatccaaagtcacctatctaaaaaatgcaaagccaagattcaaactcaggaaatgtgttactagaatcttatctactatgccatgytgcctctcagaaagactatcactgcttcctccagcctcatcctcttgtcttttcctgggctggggccatcctcaccctgattggctctccccaaaggctc

SEQ ID NO: 48753 - DNA, 201 bp, Homo sapiens
cagaaaccaaatacgaatatatcagacattatcccagagagaaggctcagtcaaggatctgcagctgggacctgcatatcttaattcccctgttcctgggraagttatccaatagctactgaaatacaagatggaaggtatcctctctgtaccatagctaaaggattgctcacaaaaatgaaagtgcaattacagaaaaat

SEQ ID NO: 48754 - DNA, 201 bp, Homo sapiens
ttctgaattcacagcatgagcaagagataaacaaacctttgttgagttaaggctctgggattttgttttattttgttcagtttttaatttctgtaccatakcctaacccatcctaaccaataaaacctcgtcgctgtcaacatcatcatcatcatcgcaataataaaatgtattaattatgaacataaaaccttaccgtgt

SEQ ID NO: 48755 - DNA, 201 bp, Homo sapiens
caagttcatggagtgcaagggctgtggacaccctgcttgccaatttttctgccttaaccgttccctgcccccttgttgttcaatttctggccaatgtctamattttccaaaaggaagtatggtcttttgcattatgacacatgattgccacccactggttaagaatgttttcactatgaaggtttagaaggtttgctgttg

SEQ ID NO: 48756 - DNA, 201 bp, Homo sapiens
ggcttcttcagtgtgggttcttgagctgtcatatagcataaagccgccacccaccattctgaattcacagcatgagcaagagataaacaaacctttgttgwgttaaggctctgggattttgttttattttgttcagtttttaatttctgtaccatatcctaacccatcctaaccaataaaacctcgtcgctgtcaacatca

SEQ ID NO: 48757 - DNA, 201 bp, Homo sapiens
ggctattaagtggaacttcccaagactctgtaactttggagactagtcacatatgaaatatgctaccctctcacttgtgtgatggcgttcagggtttggcraatgttgagcaagccaataaggtaaggctgtatgcggtacaattctcacactcgttgctctttttgttgtaaccagcctctttaaacactatggcctgac

SEQ ID NO: 48758 - DNA, 201 bp, Homo sapiens
aaaaaaaaagaaaaagaaaaaaaaaaaaggagagagcctgcaggtgaatgtgttgccatcataatagcgccaatgtttctgttgtttaaagttaagtgctrctcacatgcaagtacatgttgatgtattaacgttttccaaatccaacaagaaatattttgatctaaacctcagggatttgtatgataagaaataatctgg

SEQ ID NO: 48759 - DNA, 201 bp, Homo sapiens
aaactaatccttggaatttgctgctttgaagttgatgtcggctgggaaactcatacacaggcgtgtcccagtcctgtggtctagaatcaacatagtgagamgagacagaaggctggtggttgctgctctgctggttaccagctgtttaaccctcggataggtcacactgaaaacccctgggccctgtttgttcttgtatga

SEQ ID NO: 48760 - DNA, 201 bp, Homo sapiens
tgactcattgctgcttggctattaagtggaacttcccaagactctgtaactttggagactagtcacatatgaaatatgctaccctctcacttgtgtgatgrcgttcagggtttggcgaatgttgagcaagccaataaggtaaggctgtatgcggtacaattctcacactcgttgctctttttgttgtaaccagcctcttta

SEQ ID NO: 48761 - DNA, 201 bp, Homo sapiens
tctgaggctaccagagcatgatcagttcatcatctcagtcaatcctcccagctcctctattagatccatatgactgccactttgtgaaagatacaaggagracttggcaaaacaagggccccacctgaaatggatagctgagagcattaccacagtcggatctgctgggttgaattgtacacagcagatgccaacttccaa

SEQ ID NO: 48762 - DNA, 201 bp, Homo sapiens
ctctccttccgtcagcctgctgttcctgcccctctcttcttctctctggcctctagataccggaatgtctcaggcctcccatcccctctatcctccatttygccacctgctctggccaaaaagtttgaaggaggacctatgaaaaatatccctggcctgggcttaagaagccttcaccctcattctcaactctgaggctac

SEQ ID NO: 48763 - DNA, 201 bp, Homo sapiens
agttccagcacatggttagtcctcagtaagtgttagctaatagcattagaaactagcttttttaaaaaataaaggaaggggccaggcgcggtggctcacgsctgtaattccagcactttgggaggccgaggcgggcggatcacgaggtctggaggtggagaccatcctggctaacacggtgaaactccatctgtcctaaaa

SEQ ID NO: 48764 - DNA, 201 bp, Homo sapiens
cagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccg

SEQ ID NO: 48765 - DNA, 201 bp, Homo sapiens
gcttacctttagcgtaatggcttggaaagaggcacactttgatctttgtggattctagggactgtcttatggctgttccaacttgtcagctcgtatcagcrtcgacttaatacttccctgcgtagaagccaggttggaaagctaaagtgcaaagcttgaccgaggtgttgcaagctacggaaatctctttcattgtctctg

SEQ ID NO: 48766 - DNA, 201 bp, Homo sapiens
atggttgtatttggaagtgattgattgattgattgatttggttttcttacctacttaaatgcattattgtgagtttgaagtgagaagatactataagggcrttggaggcataaagtgctggacagacatagagcagtagcatgatggtaggtagtaaagtccccaccctccagcagaacccttactgggcaatgcgctcaa

SEQ ID NO: 48767 - DNA, 201 bp, Homo sapiens
tctccactaaaaatacaaaaaattagccgggcatggtggtgctcacctgcagtctaagctactcaggaggctgaggcatgggaattgcttgaacctgggargtggaggttgcagtaagccaagatcataccactgcactccggcctgggcaacagagtgagactccatctcaaaattaaaaagagaagaagaggagagaga

SEQ ID NO: 48768 - DNA, 201 bp, Homo sapiens
aatttcaatattgccaagggctcataaaattgtcgatataacctactttctctagagaaccttatttgaattttcataatgaattaatatcttctttctcycccaatctctttgctcaaatagctatttgtggagaccactgatgtcaatggcaaaactctcgaggggccggtgcctctggaagtcattgtgattgatcag

SEQ ID NO: 48769 - DNA, 201 bp, Homo sapiens
tataaactttggaggggcacaaacttcagagcatagcagataccatgaatttatagcaacacattatgcttgtttgcccccttgctttgctgacagatatyctagacctagatttctagagtgtaggaatgttcccttcgtgagggtatgctgtctggggcctggtttgctgagtcatcactagcaacctgcaagtcactc

SEQ ID NO: 48770 - DNA, 201 bp, Homo sapiens
gacttggtttaatgatgaccttgggttttttttcaaatccttggccaccattgactttgatgtcttcttccatgcatcttctttctcctttataaaacttscaagcaatgtctcctcccacaagtccttccacataggcaggtggaattcaaaacttaacccaacttctatcacttgccttattaagactgaaacaccaac

SEQ ID NO: 48771 - DNA, 201 bp, Homo sapiens
ctatactcatctccgtagatgatcaatcagaatcttgagagtgaaatgaccagttaagacagaccaacaatttgttgatctagtggaggcggaaaaaatgsagtctgaattgaaatgacttttatgagatttcacccaggtggttgtttctaaatttatactcaaaatatagagtgaaacttgagagaacatttgcaagaa

SEQ ID NO: 48772 - DNA, 201 bp, Homo sapiens
gggcttctcagaaccttcagtaccctaagacagaagcttcttagacattatttgttctacaggaaaaaaaaagtgttgcaaagaatagctacatatagttmttatctaatatagtggcattctatggaaagaaataaatctatattagattaccttgaatttgagaatatcacattttagccccttggaaggaattgtact

SEQ ID NO: 48773 - DNA, 201 bp, Homo sapiens
gcagatctaaagaaggtttcattactgtagggcttctcagaaccttcagtaccctaagacagaagcttcttagacattatttgttctacaggaaaaaaaaagtgttgcaaagaatagctacatatagttattatctaatatagtggcattctatggaaagaaataaatctatattagattaccttgaatttgagaatatca

SEQ ID NO: 48774 - DNA, 201 bp, Homo sapiens
gatagcggctatgggggaaaaatgagtaaaaaccaacagtcattgtcttcatagagcttacaatgtagttggggggaccaatattagtcaaataagcatartaagaaagatagtacaaggtaagagggggaagaccatgttgcaagagagtctttggtgggctgagttgacctgaccacggtagtcatggaaggtctcctt

SEQ ID NO: 48775 - DNA, 201 bp, Homo sapiens
caaattcattagagcacaaatgtcaatgtctaggacaattttataggacaatctgaagaaagcaacagctcagctggaatgtggatatggttgaagtcatyagtttaatcatatctgcagagtttcttttgccatataaggtaacactcacaggtcctgggaattattaggatcaggatattgttggggtcctttttcagt

SEQ ID NO: 48776 - DNA, 201 bp, Homo sapiens
gacatttgagctgcttctacttcctcactattatgagcaatgctgctatgagcatgcatttgcaaacagttattcttatttaaatgtgaattagcagtgcrtatacacacccaaaattgggtcatcaaagccatgattttattgataatgatcaaggatttcttctttacacaaattcattagagcacaaatgtcaatgtc

SEQ ID NO: 48777 - DNA, 201 bp, Homo sapiens
actcattcatttattcaacaaatgtgaactgagcacttcaacgtgccatactgtcttctaggcactgaagatacaacagtggatatgatgggttgaatgtyggccccaaaaagatatgtccacatcctaatccctagaacctgtgattgtgaccttctttggaaaaagggtctttgaagatgtagttaagaatctgataat

SEQ ID NO: 48778 - DNA, 201 bp, Homo sapiens
cctgtcttttgtggccttttgcgattggcccctgtcacttagcacaatgttgtaaggtacgtcatagtgtttactgatccatatgatagcagaggtcagcrcttcttttcatagctgaatagtattccactgtatggataggccacattttgtttgcctatcctttcactgatggacatttgagctgcttctacttcctca

SEQ ID NO: 48779 - DNA, 201 bp, Homo sapiens
aaaatgctggcagtgcattttcatggggccgttacaagcattaaataaccttcttcaggtaaagttcttgctgttgaatctgacatcaaataagccatcawatgttacaaccactacctcctcttcctggctagcacctatgtgaaatgaatgtacatggcttgactcaggtgatgcctgtcttttgtggccttttgcgat

SEQ ID NO: 48780 - DNA, 201 bp, Homo sapiens
ctgtgaacccttgctttcagctgggacactgttgccttccactgccttccacagcctctttacttccccttaaacaacctattccaactggtactacttgrtaatagtcattttctctcacctgaaagcatgcctctgtcaaccaggctcttcccctcaatggctaatgactctcactcctacactcctgcagagggcctg

SEQ ID NO: 48781 - DNA, 201 bp, Homo sapiens
aggttaagactcaagggctgtttgtattcctcttggatttgcctacatttagcaaagcagaaactcaacacattgttgaaaatactgaatttcactgggcmtatattttgggttgtctggaagatcccacctattgagtacactgcaccatcacccctccaactgctcatgcacttatcggacatatgttgttatttttgg

SEQ ID NO: 48782 - DNA, 201 bp, Homo sapiens
agagcctgcatgcctaaccgcagtgcaatgctatcctcacctcactgtgcaaatacatctcagatctctgcattaggatgcacaggtttacattttttaaragcaggtaataactgtcttattctgtacctattgtctgttttcacagtctgctgtgaacccttgctttcagctgggacactgttgccttccactgccttc

SEQ ID NO: 48783 - DNA, 201 bp, Homo sapiens
cctgttctacaaagggaaaatgctggcagtgcattttcatggggccgttacaagcattaaataaccttcttcaggtaaagttcttgctgttgaatctgacrtcaaataagccatcaaatgttacaaccactacctcctcttcctggctagcacctatgtgaaatgaatgtacatggcttgactcaggtgatgcctgtcttt

SEQ ID NO: 48784 - DNA, 201 bp, Homo sapiens
ctcctaccaaagtaagctgcttatcttctatgttcactgaaaatggtatgtttccttccacatctatctctaagggatggcataagtgggttgcaataggwttacaggaatgaggatcagattaagagctgtggcatcagtaaaaccaataactcttgatttattatgtaacaatgtatatttttagccaaacaaatgcta

SEQ ID NO: 48785 - DNA, 201 bp, Homo sapiens
aggtccgtcgtgtctacagcgcatctccacccgtacatttcacttgcctctcggggttaactgtgtgtttctgaacgctcatactggggttaactgtgtgwgtctgaacacctgtacctcattacctcattacttccttacctcatcttcctaagtgcacggtttcttgcagtgccatcctcgtcttcccatgcacctgaa

SEQ ID NO: 48786 - DNA, 201 bp, Homo sapiens
ttttctaccatcctcaacaattttatccaacctagcagctttaaagatctcttcttcagcatgtctccaaatttatagcttcatttctgacctcaggtccrtcgtgtctacagcgcatctccacccgtacatttcacttgcctctcggggttaactgtgtgtttctgaacgctcatactggggttaactgtgtgtgtctga

SEQ ID NO: 48787 - DNA, 201 bp, Homo sapiens
ggtgccacccttcctctccaaccttgttacaaacaattcagaagggaggattgtgaaatccttcctgctgctctttctgtcttctgccaatcagagaagaytggacatgagatccaagagagggctttccctttccccgatggctacactgtgtctcctgcctcccagctgtttatggaaatcagatggtttcctcaactg

SEQ ID NO: 48788 - DNA, 201 bp, Homo sapiens
gtctttttttgatggcttctaataaataaatagaaacctcttttcctctggtccataccccttagaagtgccacatttaaaaaataagaggaaagccttcwtctcactggggcccatagcagtggcagatattgttatttgctgaattgcttctatctttcttaattaggtaggaagtagcaaccatcaaaaaacaaatat

SEQ ID NO: 48789 - DNA, 201 bp, Homo sapiens
ttaagtataacattgctcagtaactatgtgggtgaagatctgaaagttctgcagcactgtttcatttataaaaataaaggtaacggtacttttgcgcaagmtttgtgtggaatctaaaaacttccccaagttagtaaggaaggcactgtgatagtatctactaatgaaaatgtgagcacagagatggttataaaatacctt

SEQ ID NO: 48790 - DNA, 201 bp, Homo sapiens
ctgcctggaacacgcgagttcgtcaaggacatgtcttgattgagtgaagtccatcagcacaaagtcacttgggcacaggcatcttgctgtgggataaaacstaacatttgtgaactctgggttgggaaactatgtggtaattcacacttaataggtcagagatatctcagagataagctgcccaacctactcatgctcctt

SEQ ID NO: 48791 - DNA, 201 bp, Homo sapiens
aatgaagaagccaaataggagagagtgcatactgtatgaccacattagatgccatgcaaatgcaggtaaaaccaatctgtggtattagaggctagaataaygtagcctctggggaagaggttaggaattttactcaggaagggaggggactggtaatgtgtcatgttatggcctggttgctggacagttggttgtgcttac

SEQ ID NO: 48792 - DNA, 201 bp, Homo sapiens
gaacttccagaaggaaggactcttgtagatgtcttcttttgtgcttttggcctccaggactattagagtaaatttctgttgttttgagcccctccggtttrtgacgtgtagttactgcagctcctggacactgagatgcccctgtttcttgatggcgaaatggagactgaaagatcatgtcttacccaggtgcacacagcc

SEQ ID NO: 48793 - DNA, 201 bp, Homo sapiens
ggtggcttatgagccaagatcgtgccacactgcactgcagcctgggagacagagcgagacgctctgtctcaaaaataaaaaaaaagaaaaaagaaagaagkaaaagaaaagaaagagaaaattcataaaggagggaccccgtcttcactgtgccttggttttgattcttggttatgagtggttccatggtggtggaggctg

SEQ ID NO: 48794 - DNA, 201 bp, Homo sapiens
ctaaagtcaggttagctaggagggaacatatgaggaaggcccaagtcttatgctgctagaagccagggcagaggcagtaggctggaaaggaccagtggtcrtcttggaaatatgtgctccacttgaagccatttggataaaaaataagaattcttagaacactggacatcccagaaacacgataaattagcagaccaaatg

SEQ ID NO: 48795 - DNA, 201 bp, Homo sapiens
tgcttaagagaaaggagggagccatacttcaggaatggagaaatgaagaaaaatctatactggctaaagtcaggttagctaggagggaacatatgaggaargcccaagtcttatgctgctagaagccagggcagaggcagtaggctggaaaggaccagtggtcatcttggaaatatgtgctccacttgaagccatttggat

SEQ ID NO: 48796 - DNA, 201 bp, Homo sapiens
aagacgccagagtgctttacaaacttatcaaagtgatatacagggatcgttttagcctctgctgaaatacaggggcccaggggggaaattacagtcattgktgaaaaatcttagattgtcaggtcgacaggaggagggagagtgtacagcacctaaaatatcctcccaaactggatggcatgtcccaagggctgtggtctt

SEQ ID NO: 48797 - DNA, 201 bp, Homo sapiens
tttcccaaaaacaaggatgttttttctctctcatagaatcacagaacaatgatcaaatcagcaaattaacgctattaaaaattatctaatcaacacacttwatttggatttatccaattaccgcactaatgtttttttattgcaaaagaaaatattttggcccaggatctaatccaggatttaatattgcctcagatctca

SEQ ID NO: 48798 - DNA, 201 bp, Homo sapiens
ctcaatattaagaaaagaagtagtataagactgaaagacatgcttaagagaaaggagggagccatacttcaggaatggagaaatgaagaaaaatctatactggctaaagtcaggttagctaggagggaacatatgaggaaggcccaagtcttatgctgctagaagccagggcagaggcagtaggctggaaaggaccagtgg

SEQ ID NO: 48799 - DNA, 201 bp, Homo sapiens
cgcttgaacccaggaggcagaggttgcagtgagccgagatcgcgtcactgcaccctagcctgggcgacagagtgagactccatctcaaaaaaaaaaaaaaagtgactgtggttattgtaaacatttttgcttaggaagcatttattacagctgttcaatgtagcattttacggtattcggtggaaactctaatgtaagttc

SEQ ID NO: 48800 - DNA, 201 bp, Homo sapiens
tggtgctgaaaaaccatattaaagagaacacaaagtataaaataaaacaaaggataaccttagaagactcctggttcacttacagctttctttttttttttctatttttatcttaaacaggaggtacacgtgcaggtttgttacctggctcactctcagttttaaagcaaaggtgaaggtacatttagagtcctgttcaga

SEQ ID NO: 48801 - DNA, 201 bp, Homo sapiens
caatctggtaactcctgtaactgtcagttccagtggaggatgcaccaattgctcgtgctcacatgctaaatcctttctccagacatcaccctggcatggcmctccgtctcctagtcaggcattaactaataggggaaatgcaaaatgttgataccgcagaatatagagacagaagagattcacactgaaagtgcaaattac

SEQ ID NO: 48802 - DNA, 201 bp, Homo sapiens
tgctttagtgccccagaagctgggactatgttgcctacctgagggacattgcagatgtgattaaggagtccttgagtcggggagatgattctgagttatcktggtggatccactctaatccaatgagtccttaaaatcaaagaattttttctggctcagagaaaatgtgaagactgaagaagagaacgggacagattgcag

SEQ ID NO: 48803 - DNA, 201 bp, Homo sapiens
acagtcttgggcagttccacccccatggctttgtggggtacagccccactcccagctgctttcacaggctggcgttgagtgtctgtagcttttccgggagracagtgcaagctgtcaatggatctaccattctggggtctggagggtggtggctgtctctcacagcttcactaggctgtgccccagtggggactctgtgtg

SEQ ID NO: 48804 - DNA, 201 bp, Homo sapiens
tgacctcttcatttttccttttcctgttctacaaagggaaaatgctggcagtgcattttcatggggccgttacaagcattaaataaccttcttcaggtaargttcttgctgttgaatctgacatcaaataagccatcaaatgttacaaccactacctcctcttcctggctagcacctatgtgaaatgaatgtacatggctt

SEQ ID NO: 48805 - DNA, 201 bp, Homo sapiens
gacttacctattctggatgctccatacaaatgaaatatacaaagaggagcgcattaggaaggtggtctgttcatggtggttcagaggcagagctgtggatyctcacagcctggattcaaataccagtcccttcatttttcagctttgtgatcttggctaggttctttgacctcttcatttttccttttcctgttctacaaa

SEQ ID NO: 48806 - DNA, 201 bp, Homo sapiens
gtagttgctccccatcctccatcccccatgccctttgtaatcatctactttctgtctttaaggacttacctattctggatgctccatacaaatgaaatatrcaaagaggagcgcattaggaaggtggtctgttcatggtggttcagaggcagagctgtggattctcacagcctggattcaaataccagtcccttcattttt

SEQ ID NO: 48807 - DNA, 201 bp, Homo sapiens
ctcatcgcccccaaatgaaaaccgcatacctgttaagtagttgctccccatcctccatcccccatgccctttgtaatcatctactttctgtctttaaggayttacctattctggatgctccatacaaatgaaatatacaaagaggagcgcattaggaaggtggtctgttcatggtggttcagaggcagagctgtggattct

SEQ ID NO: 48808 - DNA, 201 bp, Homo sapiens
taaggagggaccatacttaacatggaaaattaatgacctgagagcctgtcccaaaagaaatgctccaggcaggagatcttcaacaatagccatctagagtwtcagttatctaggatagaacagtgtataggctggaaagacccagccctttcagtaaggcatgtgagtttgatcactcaccaccatctccagcctcagcct

SEQ ID NO: 48809 - DNA, 201 bp, Homo sapiens
cccttaggggagtagataatgaaaaaaacaaaagttaagcaaccctgctatagaattgctatgaggctaaaaggaggtatggacttgtacagtcctttgcwtagagcgtagcactcagggaccactcaataaatagtagtgccatgactgttgtctgtccaagcatcacttcattcaaaatgcacacactgattccaacca

SEQ ID NO: 48810 - DNA, 201 bp, Homo sapiens
tagtggcaattagaaaaaaatacttaaaagagcccttaggggagtagataatgaaaaaaacaaaagttaagcaaccctgctatagaattgctatgaggctraaaggaggtatggacttgtacagtcctttgcatagagcgtagcactcagggaccactcaataaatagtagtgccatgactgttgtctgtccaagcatcac

SEQ ID NO: 48811 - DNA, 201 bp, Homo sapiens
ggggggacaaaaactgcacttacaaatgtaaagtatagatatacttgtagtacctaaacagatataagtatatctgtgatattaaaattttacaggaataktggcaattagaaaaaaatacttaaaagagcccttaggggagtagataatgaaaaaaacaaaagttaagcaaccctgctatagaattgctatgaggctaaa

SEQ ID NO: 48812 - DNA, 201 bp, Homo sapiens
ctcattggggctatatttcccccacaggggtgaaataggttcgagggtggggggacaaaaactgcacttacaaatgtaaagtatagatatacttgtagtasctaaacagatataagtatatctgtgatattaaaattttacaggaatagtggcaattagaaaaaaatacttaaaagagcccttaggggagtagataatgaa

SEQ ID NO: 48813 - DNA, 201 bp, Homo sapiens
agattgttggactgtatcattcattatggtatcttctgctgacatgatagaattgaaactctattttatcaaagttggaactgaagcatggaatggaattwagactgttttatgtttgttctgcacttaccaaattctataaagcctttggaagtgaaattcactcctgggtcaaccagtcatggctagaatactcccaga

SEQ ID NO: 48814 - DNA, 201 bp, Homo sapiens
gcagatgtggcctctgtctttttccaagaggaagcccttaagggttacatggcaaaaataggtttctgctgaagattgttggactgtatcattcattatgrtatcttctgctgacatgatagaattgaaactctattttatcaaagttggaactgaagcatggaatggaattaagactgttttatgtttgttctgcactta

SEQ ID NO: 48815 - DNA, 201 bp, Homo sapiens
ttcatatgaaccaacacgctttgatgccacagccatttataccagctggaagagtgcagaactaacataaatgatgtcctgctagcatctgcagctgggtyataaaccaaagcttaatgttttacaaagttttgatatgcagtagtcaatttatccatttttgtgaatcaagtaggttgggaaacaagcccagcaaaacac

SEQ ID NO: 48816 - DNA, 201 bp, Homo sapiens
ctaccttcatgatactgttggagaattgaaagaaataatgtttatcaagtatttagtccacggactgacatatagaaaatgcttcataaatggtaggtatkatatatgatagacatcaaacatgaaatactattagggctctgtactattagcactattagggttttgtagagtgacttgaatatatagggaaacaattca

SEQ ID NO: 48817 - DNA, 201 bp, Homo sapiens
gtcaaagccttgtgcattccctttaggaaggagatccattgttgccttagatggtgttcttgagcccctaaacactaccctgccatctagaaacatttctrgaccctgtcctggaatcaaggtagcacaaggccatctctgcttagaagcattctagatatccacaaggaaggaaggatggggtgtttaaaatgcttttgg

SEQ ID NO: 48818 - DNA, 201 bp, Homo sapiens
tgatccacctacctcggcctcccaaagtgctgggattacaggcatgaaccactgctcccagcccaccataagtactttaatatgctaatttatttcaaacdatatgggaatcagttcaaagcacatagtctcttccatgcacatcttcatgccggaatttgctaggcgcttgtacctccactcccttcttctcagtccttt

SEQ ID NO: 48819 - DNA, 201 bp, Homo sapiens
cattatttttctcaagttctcaatatttggttgaattcatgaagaaatttttaaaacacaccaagcaaagcgttcattttgtttagaaataaaattaatargttgttttttgatattgtattaatgtgtcctgccacattaaaagattgcctatatatttataaatttaatctttatataggaattaaacagacaagccag

SEQ ID NO: 48820 - DNA, 201 bp, Homo sapiens
tggcattattccagggtagtctttcatatgtcagcagagaagagaaggatacaagtgtggccaaatatgttagaggctggagcaaactccttgagagcatytgattcgcattctgtgaagaacctgtattcatagcaagaaatgaggctgaaaagagaagcagtgaatttagaacatgactaccttgcctggagaggggaa

SEQ ID NO: 48821 - DNA, 201 bp, Homo sapiens
ccccttgaaacgtgaggattatgggaatcatggggattacaattcaagatgagatctgagttgtgacacagagccagaccatgttattccgcccctggttmctcccaaatctcatgtccctttcacatttgaaaactaatcacacattctcaacagttcccgaaagtcttaattcattctggcattaacccaaaggtccaa

SEQ ID NO: 48822 - DNA, 201 bp, Homo sapiens
tttctagggaatggatgggccatggacccccccacttggacaaggatgctaaatccaattagccagaaaaggtgtccttggacgttggcatcaattcatgsagcttgtctctggctgaatgggcaggtggaagcctgacagcaggacatttctacattgatcaggcaaatcaactatcttaaacagaacattttcattcat

SEQ ID NO: 48823 - DNA, 201 bp, Homo sapiens
aggtacaagcaattgattctcctgcctcagcctcctgagtagctgggattacaggcgtgcgccaccacgcctggctaatttttgtatttttagtaggcacrgggtttcaccattttggccaggctgatcctgaactcctgacctcaagtgatccacccgcctcagcttcccaaagtgctgggattacagatgtgagccact

SEQ ID NO: 48824 - DNA, 201 bp, Homo sapiens
cagagatgcataagaggatgccaaatcacataaaaaataagggtatggtgaaatcccatctctactaaaaatacaaaaaattaataaggtgtggtggtgckcagctgtaatcctagctactccagaggctgaggcaggagaatcgcttgaaaccaggaggcggaggttgcagtggattgagatcacaccactgcactccag

SEQ ID NO: 48825 - DNA, 201 bp, Homo sapiens
atgtcacctttgcagagagagagagacaaacatggatccaaattagagatggcttcaggttctgacggattcatctctcccaattgcctttgtaacacatmtgctaaatttagataagtcacaaatagagccaaaagaaaatccagaagggagccacaaaaaattattaaacagttgtaaaagttggggattatgagtgga

SEQ ID NO: 48826 - DNA, 201 bp, Homo sapiens
gtttaattagatccccatagtcaattttggcttttgttgcaattgcttttggtgttttagttggggggtggggggcaagggaagggacagcattaggacaratgccgaatgcatgtggggcttaaaacctaaaatatgggttgatgggtgcagcaaaccaccatggcacatgtatacctatgtaacaaacctgcacagtct

SEQ ID NO: 48827 - DNA, 201 bp, Homo sapiens
ccctgaaaccctttccctgcctgcccccagcactgttgggtgtcccttctctgtgcttcctctgccaacactctgtgcggtgtttccgggagtcagaatgrcagggtggtcaagagtacggactcagaggttgcagaaagataaaaagatgattgcattcatgattgttatgatgtcttgtacatagaatattgtcttatt

SEQ ID NO: 48828 - DNA, 201 bp, Homo sapiens; identical to SEQ ID NO: 10496

SEQ ID NO: 48829 - DNA, 201 bp, Homo sapiens
cattggccctcacaagggcacagcggagctcgttggttatgcttcagttacataaatccagccttacaaaggctacacagggagaggggctccttgcctcstagatctgtaccttgtaggtgctcaatacacattggtaagaatgttcacatcatcaggtaagcaaggggtataaagtgaggccttgaatcgctcacgtag

SEQ ID NO: 48830 - DNA, 201 bp, Homo sapiens
ggaaactgttttttaccctttctaccagtgtttagtaccaaccacaagcaccaaaatactcaaacttcgagctctgtggctctggctcttatggacggggmagtgctttacaattgccaggcattccattcactttatagaatagccagaaagctccagggatggggatgccctgccagggggccacagctcttaaacagg

SEQ ID NO: 48831 - DNA, 201 bp, Homo sapiens
tatcaaagcagggttcctgggtatgaggtccaaggatctgcaactggaacatgctctccaggcaattctatacacactggtatctaagaaccactgcgctsagaactaggatatccatcaagcctgatttgaagtacctgcatgagtcccagtgtcatgatgagatcaagagagcttctgtgtccttgaggggctggagta

SEQ ID NO: 48832 - DNA, 201 bp, Homo sapiens
ataagaatcttttggatgctgaataaacctgcagtttctccagcctggccaagacctatcaaagcagggttcctgggtatgaggtccaaggatctgcaacyggaacatgctctccaggcaattctatacacactggtatctaagaaccactgcgctcagaactaggatatccatcaagcctgatttgaagtacctgcatga

SEQ ID NO: 48833 - DNA, 201 bp, Homo sapiens
acttaagttggcttcaccattttcctgcccatgtgtactacaggttgacggctagagacactgtgaacatcccactacttgccactgaggctgaatttttwaaaaaaaataatgatagcagaaacacctcagacagtctttcatgcagagactcaatttaacacttcagaaaatttttgttcttatgtcaagatcctaaag

SEQ ID NO: 48834 - DNA, 201 bp, Homo sapiens
cacttaagttggcttcaccattttcctgcccatgtgtactacaggttgacggctagagacactgtgaacatcccactacttgccactgaggctgaattttwtaaaaaaaataatgatagcagaaacacctcagacagtctttcatgcagagactcaatttaacacttcagaaaatttttgttcttatgtcaagatcctaaa

SEQ ID NO: 48835 - DNA, 201 bp, Homo sapiens
tatttctccccagcacagtcagttctgcgtggcgcagccatcctaccaaggggagtctgtgggaaccaggacacttgattgctttttagctcagtcttcgmgggagtgctggagcaactctgtgcatcggaatcacccgggatcccagcaggtctgggagggactgagattctgctcccaggtgatgctgatactgctgct

SEQ ID NO: 48836 - DNA, 201 bp, Homo sapiens
ttctattttgaaaaaaaagttctcctgtgggttagatgctaccaaatagcatcacatgctatagagaaatcattcgtgaaaggaagagtcgatagattggmaaacctcgttgttttcttattttaagaaattgccacagcctccccaaccttcgcaaccgccaccctcatcactcagcagccaccaaaatggaggcaagac

SEQ ID NO: 48837 - DNA, 201 bp, Homo sapiens
agggacaggaatgagtggggctaggtgtccagtgttctggaaagaattaaattttttattagtatctatttctcatatttctccccagcacagtcagttckgcgtggcgcagccatcctaccaaggggagtctgtgggaaccaggacacttgattgctttttagctcagtcttcgagggagtgctggagcaactctgtgca

SEQ ID NO: 48838 - DNA, 201 bp, Homo sapiens
ctaaaatcatgggagaaattcagattgctcatcgtgcaaccaaatgaacatcattcttgagtgattctaacaattgaaagaggacaaaaatgcttcttacktggctctctcggaagaatttctggtaatagtcaaagatgaggactttcaaactttttggcaggttctcacagtatataatagtttttttttttgtaacca

SEQ ID NO: 48839 - DNA, 201 bp, Homo sapiens
atgttatttcattattacctatgcattttatctgagtccaacttattaaaaaacgaagtcaagtaaggaccagaaattgcttttcccaattactgagcacwggtctgagggttttatttccactgagcaaatagtcacaccttcacttctttttattaatactcaaccaacttagttgattaaaaatcacattttctccct

SEQ ID NO: 48840 - DNA, 201 bp, Homo sapiens
ggaagcaattagatatgcatttgtctcaggtgagcagagggatgactttgagttctgtctgtcctgtgacctgcacctgtgaagatgagcgatcagtttaygttgcccaggtgaaattcaacagaagtttttagagtaaagatcttgaggcccacaaggaatttccttgcaggcaaattgtgagggagatattttctatat

SEQ ID NO: 48841 - DNA, 201 bp, Homo sapiens
gtgaatctgcatttttacgtaaacaatcagactgaggaagcaattagatatgcatttgtctcaggtgagcagagggatgactttgagttctgtctgtcctktgacctgcacctgtgaagatgagcgatcagtttacgttgcccaggtgaaattcaacagaagtttttagagtaaagatcttgaggcccacaaggaatttcc

SEQ ID NO: 48842 - DNA, 201 bp, Homo sapiens
aatggttgcattcttttgagtccttgatcaaagacggcggtagaggaatagtcacttatgtcttagtctagctcagtgaatctgcatttttacgtaaacartcagactgaggaagcaattagatatgcatttgtctcaggtgagcagagggatgactttgagttctgtctgtcctgtgacctgcacctgtgaagatgagcg

SEQ ID NO: 48843 - DNA, 201 bp, Homo sapiens
ttcccatttacattccaaagtctgaactgttattttataaatgaattttccctccaattcagaaagcactggctacattacaaattttaatgctactattmtaggatcataattttaaaaacccagggttctccaagggcttcagcagcatgccatctctccactttattaaaatgaatgaacagatgtacaatttatttc

SEQ ID NO: 48844 - DNA, 201 bp, Homo sapiens
caaaatgcagcagtaaagtgttccataatccacacttcagtctacataaatgtttaattcccctgccccttttgttttcgtcaggccccctgaagccgcasctgagatggctgactccctgaactcttcttatgttcttgactgttcgcatagcctttcctgggattacctcccagttccaagtttgcccattctgcaggc

SEQ ID NO: 48845 - DNA, 201 bp, Homo sapiens
agccagttaagcatatgtttcatacctgcacaatttacctaaatagagattgcccaaagaagttttgctggcttctgaaaactttctcataagattttaawaatatattttatggtcaagaggttgtagcatcctcccaggactaattcatatctagccaagaaaaattacattttcccatttacattccaaagtctgaac

SEQ ID NO: 48846 - DNA, 201 bp, Homo sapiens
aatacattttattctgtcactttgaagcacaaacctccacaaagatttgtataaaaatgctcccttctgggactcacttcagtgatttgtagctaccattmatactgcctctatgtaaatgaaagggaggcataatatcagcaccttgcgtattcttctccatggtaataaatcgtgcctgataacctatgaaaatggctt

SEQ ID NO: 48847 - DNA, 201 bp, Homo sapiens
tgcccttgatgctaagactaaccacaagctcttcccagtctgtagtttttatttgcacatttgcaggctggagtgtgtcctctctatctagtcggtatttyaataggaggcgaagatctctgtgaggcaatctggggtttttctagctgggcccgtgttattcatggccagccagctctcctggtttgtttataccttttt

SEQ ID NO: 48848 - DNA, 201 bp, Homo sapiens
tccactaaaatacaaaaaaaaaaaaatgagctgagtgtggcagcctgcacctgtagtctcagctactggaggggctgaggcaggagaattgcttgaacccrggaggcagaggttgcagtgagccgagattgtgcgcctgcactccagcctgggcaacagagtgagactccgtctccggggaagaaaaaaaaagattcctat

SEQ ID NO: 48849 - DNA, 201 bp, Homo sapiens; identical to SEQ ID NO: 10495

SEQ ID NO: 48850 - DNA, 201 bp, Homo sapiens
gtaatcatagcattttgggaggccaaggccgatggattacctaagctcaggagttcaagaccagcctcggcaatatgaggaaaccccatctccactaaaayacaaaaaaaaaaaaatgagctgagtgtggcagcctgcacctgtagtctcagctactggaggggctgaggcaggagaattgcttgaacccaggaggcagag

SEQ ID NO: 48851 - DNA, 201 bp, Homo sapiens; identical to SEQ ID NO: 10497

SEQ ID NO: 48852 - DNA, 201 bp, Homo sapiens
ttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaattt

SEQ ID NO: 48853 - DNA, 201 bp, Homo sapiens; identical to SEQ ID NO: 10498

SEQ ID NO: 48854 - DNA, 201 bp, Homo sapiens
cttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatt

SEQ ID NO: 48855 - DNA, 201 bp, Homo sapiens; identical to SEQ ID NO: 10500

SEQ ID NO: 48856 - DNA, 201 bp, Homo sapiens
atatcctgaagaatgaagacatcaaaagcaaggtgctgtggcaagttagcccttggtggagggtttttcacaactggatatcctgctgtgtagaactgaayacccacagcagggttattcaggcagctccagggatgagagaaagtgtcttgactgatacataatttatctgtctgccaagtaattagttggttggtaagt

SEQ ID NO: 48857 - DNA, 201 bp, Homo sapiens
ctgaattcctgtaaagaaaggagactcatatcctgaagaatgaagacatcaaaagcaaggtgctgtggcaagttagcccttggtggagggtttttcacaaytggatatcctgctgtgtagaactgaatacccacagcagggttattcaggcagctccagggatgagagaaagtgtcttgactgatacataatttatctgtc

SEQ ID NO: 48858 - DNA, 201 bp, Homo sapiens
ttgcaaaaactatttatttgtccctgctttttatgcctttgaaggtacgtattttcctttttgttcctgcttgtttctatttatctgtcttactctttatrtctcctgtcttatcctcatcaactccaccacagctgacgagctgtgctctgcagagctgtggaagaggacgtaggtgttttcagtgagtgctggggaggc

SEQ ID NO: 48859 - DNA, 201 bp, Homo sapiens
catacttgttctcaacttagattctctacaaagcaactgcttttctaagtgtggtaggctactaactagacaatgcgcaagagccttcaaaacctctagawgttttttgtagaattactgcactgctttgcaaaaactatttatttgtccctgctttttatgcctttgaaggtacgtattttcctttttgttcctgcttgt

SEQ ID NO: 48860 - DNA, 201 bp, Homo sapiens
agacagcagatgggcagggccagcatggtttttgtctggttatttatttctgtggaataagttcctagaaataggatgtctctctgggtcaaaaggtatgyacactttcacttttttttttttttttttttgagacatagtgtcactctgtcacccaggctggagtgcaatggcactatctccgatccctggaacttctgc

SEQ ID NO: 48861 - DNA, 201 bp, Homo sapiens
gggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctggga

SEQ ID NO: 48862 - DNA, 201 bp, Homo sapiens
aggagagagagagcaaaggggaaggtgccacacacttttaagcaaccagatctcatgagaattttatcatgagacagcactaggggggtgggtgctaaacyattagaaagcactcccgtgatccagtcacctcccaccaggccccaactacaacactgggaattataattcaacatgagatttgggtggggatgcagaacc

SEQ ID NO: 48863 - DNA, 201 bp, Homo sapiens
ccctgtccctactaaaagtacaaatattagccaggcatggtgatgggcgcctgtaatcccagctactcaggaggctgaggcaggagaatcgctggaacccrggaggcggaggttgcagtgagccgagattgcgccactgtactctagagagtgagactctgtctcaaaaaaaaaaaaaaagaacaacaacaaaaaaaaaaa

SEQ ID NO: 48864 - DNA, 201 bp, Homo sapiens
cagcatggtgataccctgtccctactaaaagtacaaatattagccaggcatggtgatgggcgcctgtaatcccagctactcaggaggctgaggcaggagartcgctggaacccgggaggcggaggttgcagtgagccgagattgcgccactgtactctagagagtgagactctgtctcaaaaaaaaaaaaaaagaacaaca

SEQ ID NO: 48865 - DNA, 201 bp, Homo sapiens
cttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaaa

SEQ ID NO: 48866 - DNA, 201 bp, Homo sapiens
ttttaagtttaattaaatttgaattgtccatttttttttttttttggtcatgtttgcttttgaggactaggccataaatcctttgccgaggccaatatctrgaagagtttttcctagggtttcttctagaatttttatagttgcaggtcttatgtttaggtctttaatccatcttgagttaatttttgtatatggtgaaag

SEQ ID NO: 48867 - DNA, 201 bp, Homo sapiens
ctaaaaaatattccctactaggagatagttgtggaatatatagcatttgtatttctacatttttatgtgacacatttaggtgttccttaaataaaatgaarttgaccaaagttctggttagtatgtagcaaactaaaattatgtgaaaatatccaaagccttaacagagctaggatattcccgcatccacactcacacagc

SEQ ID NO: 48868 - DNA, 201 bp, Homo sapiens
attgacaacagtacaaatcaggagaatctgttcttaaacagctacaggtataccactctattcattattttttatatattatatataattgtatatttatrtaatagtgtataaacatacagtatataaaacatgttatttgtcctgtaataattgtaatcaatattatgcaataatatgtaatcatatttatgtaatagt

SEQ ID NO: 48869 - DNA, 201 bp, Homo sapiens
gctctcgttgcccaggctggagtgcagtggcgtgatcttagcacaccgcaatctccaccttctggtttcaagtgatcctcctgcctcagcctcccgagtarttgggattacaggcacctgccaccacacccagctaatttttgtatgtttagtagagatgggggttcaccaggttggccatgctggtcttgaactcctgac

SEQ ID NO: 48870 - DNA, 201 bp, Homo sapiens
gcttacaaataagagagaagaaaggaccgcattaactctaaagaaggggctagcaggtcctgtggagccgatggggcagtgcaaaagcctgaccatgctgrtctccattgggtgggtccaatggaagaacgctcagggttacgtcaggaaggtgccctagttttggggaaagaacatttcaactcaggttcagaggaaaat

SEQ ID NO: 48871 - DNA, 201 bp, Homo sapiens
atggaaaaattgtcttccacgaaaccagtccatggtgccaaagaggttggggactgctgccctacctcacagaaagcgagtgaccccaagaagcctgcagragggacttgtcaaacctttgatctctttcaccttcccaccaatacttgagcccctgagggcagaagctggcagcccttggctctggaagtccttccaggt

SEQ ID NO: 48872 - DNA, 201 bp, Homo sapiens
caccaggggattcttttttttttttttttttttttttgagagggagtttcgctctcgttgcccaggctggagtgcagtggcgtgatcttagcacaccgcartctccaccttctggtttcaagtgatcctcctgcctcagcctcccgagtagttgggattacaggcacctgccaccacacccagctaatttttgtatgttta

SEQ ID NO: 48873 - DNA, 201 bp, Homo sapiens
acaaaatagtgaaaggatcattgcagcagcaagggcatgtggaagccctgcgttcgcctcatccgttctccccatctgtcccctgtcacagttgcagcatmaaaacattgttcccctaggctctgctgagtcggatgtttctgaaacattccaggggaccgtgtgagtcacatcagggaggacacacagggccatgacccc

SEQ ID NO: 48874 - DNA, 201 bp, Homo sapiens
ctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcaatctccaccttctggtttcaagtgatcctcctgcctc

SEQ ID NO: 48875 - DNA, 201 bp, Homo sapiens
gcaccaactttccagaaagtgtttcagaagcttagagaattaaaatgtgaaccagacaggaagttaaacttgacaaggaagagaaaccaactaggaagagwtggggatggagttaactgacactaaatttggcctgagcttctcattggcttgccgtacacaattgccactgtgcgataagagcaacgtgttaattgcagt

SEQ ID NO: 48876 - DNA, 201 bp, Homo sapiens
cttctcatctctcaactgagctcttgggtcaagttaatctaaggcagaattgcctgataatccctaaagaattgcttcacagttggtatcattgataaaasacaggcacaggtacactagctgtgaaataccaaatgtgctttatgtgctcgtctaaggggagccatcccatctagcatctgatgattgtatctcactgta

SEQ ID NO: 48877 - DNA, 201 bp, Homo sapiens
ctgttataagtgctctggtaatagaaatacagactataacacacgccagaggatttgacctaagggaagagggtcagagttggctttctgagcggatgtgycatttaggtggagaagtactttgtgcgtctgcattctagggcatgccctgcttggcagttttctcattttatgatgggtcctgtgatgtggccaatgtga

SEQ ID NO: 48878 - DNA, 201 bp, Homo sapiens
aagccattaccagacaccactgggaaagggggctgggatacttcagtgtcagagcataatttgggaccaaggctgaggaataagattgagtaacgttggcygggcacggtggctcacgcctgtaatcccagcactttgggaggctgaggcgggcaggtcacgaggtcaggagatcgagaccatcccggctaacatggtgaa

SEQ ID NO: 48879 - DNA, 201 bp, Homo sapiens
aatggtaaatagagacaacagatataaatatgtcaggaagtatgtcaggtactgagggttcggtgaagaaaaataagacaaggatgatgctggaaggaaargcactactttctttcaataaggtggccagggaagtcctctgcaaagagatgagtataaattgagatttctgtagcaacaatgtaatgagccacaggagac

SEQ ID NO: 48880 - DNA, 201 bp, Homo sapiens
tcattccttaatgtgcttggtggttgattctggctgttggccacagtatccacacatggcctctccacgtggctgcttgggcttcctcacaggatggtagstggtgccaagagtgagcatcccaagggaacaaggtagaaatgagtgatattttatgactgaggcttgactttaccatattttatagcagttggggcagtc

SEQ ID NO: 48881 - DNA, 201 bp, Homo sapiens
ctgttagggaaggcttttatgcccttggctgggtgtgacggaaaggggcagggacagacaaaacttggagtgcggtcccagctgtagaatgccagtctggsagacataacaaaagtgagcacttcttcgcttttgggacaccttccccatttggtcttgacattgagcaccatgctttggcaggtgtcagaggttggctcc

SEQ ID NO: 48882 - DNA, 201 bp, Homo sapiens
cagttagggtagcttgaaggctggggtaactcaatagctggaggttgggctcctttattcattccttaatgtgcttggtggttgattctggctgttggccrcagtatccacacatggcctctccacgtggctgcttgggcttcctcacaggatggtaggtggtgccaagagtgagcatcccaagggaacaaggtagaaatg

SEQ ID NO: 48883 - DNA, 201 bp, Homo sapiens
ggattacaggcatgcaccaccatgcccggctaattttgtatttttagtagagacgaggtttctccatgttggtcaggctggtctcaaactcccaacctcargttatccaccctcctcagcctcccaaagggctgggattacaggcgtgagccactgcatctggccccacatttttttttatcctgtcttctgttgatggac

SEQ ID NO: 48884 - DNA, 201 bp, Homo sapiens
aacccaaatgtaactttgtccctgctatggaacatttaggatgttttccatttttgccccttataaatcatgtctcactaaacgtcttccttcatacagtwttattcttcttttgaatgtaacgtttggatgggttcctagcagtaaaattactgagtgaagggatatgtgcattcataaagctctcgataaatgaatatt

SEQ ID NO: 48885 - DNA, 201 bp, Homo sapiens
ggtcatagcctaggagtattgcctactaacaaacccaaatgtaactttgtccctgctatggaacatttaggatgttttccatttttgccccttataaatcrtgtctcactaaacgtcttccttcatacagttttattcttcttttgaatgtaacgtttggatgggttcctagcagtaaaattactgagtgaagggatatgt

SEQ ID NO: 48886 - DNA, 201 bp, Homo sapiens
atcgtattggataagggtgccgtattgaaaaaaatgtgtaaaagacacactacagtgaattagagggagataatttcatcctaagatttctctgacattasgcattgtggcatcgctttcttggtttaaatgtgaaatagaacctgagattatttttcataaatttatctagcccatctattatttctctatattatatgg

SEQ ID NO: 48887 - DNA, 201 bp, Homo sapiens
gggtataaagattgactaaagagcccaagatctcactaaaaagtgtcagtggtgttacaatcctctgactccaaaccccattatctttccatatggaatgstgtagctggtgttggagtcttctttcacagtaaagtgctcctgtcattgcctctgagaacagactggggtgtcctggatagtttcacaggacagtggtgt

SEQ ID NO: 48888 - DNA, 201 bp, Homo sapiens
ccatcccgtacacctggagatgtgtggctggcctagggctgagcctggggctgggaccagccagtggggcatctgcctcaaggtggaaaagagcccagccyatcagctccaaagcagccacagcctccctctgcatagacacctctccaaaggagaaggaccttccctgcacactcttggacagccaaagcctcatcaccc

SEQ ID NO: 48889 - DNA, 201 bp, Homo sapiens
tatcggagagagaaaaaggcaaacatgatataataaacccttgagaacacaggaaaacggcacatgacaagacgatggttaagtatcatgaaggaaataasgcaaggtcatatgatagagatttctgcatggctgctgaagaatgggtggtcaaagaagatttttctaagaagccaagtcctaaactatgagaagaatcca

SEQ ID NO: 48890 - DNA, 201 bp, Homo sapiens
agattttgtaaaatcttaacatacggagccaccataaaacgtattatcttttattacccatacagagaatgacattttagatggtaataaattgaaacccmaggaaagctatttgctttcggagagtgcttggcgaatgacaggaatagcagtttcccaattttacacggtggcaaatatggccccccagggtcattggag

SEQ ID NO: 48891 - DNA, 201 bp, Homo sapiens
cccatctctactaaaaatacaaaaaaaattagccgggcatagtgacaggtgcctgtagtcccaaactaaggaggctgaggcaggagaatggcgtgaacccrggaggcggagcttgcagtgagctgagatcgtgccactgcactccagcccgggcaatagagcaagactgcatctcaaaaatttttaaaaaatgcatggttt

SEQ ID NO: 48892 - DNA, 201 bp, Homo sapiens
atggctgggtctgtccctgcagtgactgtgctattcatagcaagaatgttgtgttgctaaacttggcatgaaacaatacagttatttatgcgacttcatgrcctagagtatcgccttggatttgagattctgctaaagctacatgagtgggcaaatcaagaaattgtattccataatttgtttccaatctgacagagtact

SEQ ID NO: 48893 - DNA, 201 bp, Homo sapiens
aagcatggtttctggctgggcgcggtggctcacgcctgtaatcccagcactttgggaggccaagatgggcggatcacgaggtcaggagatcaagaccatcytggctaacatggtgaaaccccatctctactaaaaatacaaaaaaaattagccgggcatagtgacaggtgcctgtagtcccaaactaaggaggctgaggca

SEQ ID NO: 48894 - DNA, 201 bp, Homo sapiens
tggctgggtctgtccctgcagtgactgtgctattcatagcaagaatgttgtgttgctaaacttggcatgaaacaatacagttatttatgcgacttcatggmctagagtatcgccttggatttgagattctgctaaagctacatgagtgggcaaatcaagaaattgtattccataatttgtttccaatctgacagagtacta

SEQ ID NO: 48895 - DNA, 201 bp, Homo sapiens
tcccagcactttgggaggccaaggtgggcagatcacctgaggtcaggagtttgagaccagcctcgtcaacatggtgaaactccatctctactaaaaatacwaaaaagaaaaaaaaaagccgggcatggtggcatgagcctctagacctagctactccagaggctgaggcagaagaatcacttgagcccacgagggagaggt

SEQ ID NO: 48896 - DNA, 201 bp, Homo sapiens
gttaactagtctatcagaggcctgtttctctctacattatgcagaataatcttttgcaaggttaaaacagatattatgagactttctgagaatagtcgtgrgaatttatggatggagggtgggctgcagggaaaatgataaatgcataatttacactgttttttcactggctagtaataatgactataatatcatgaaaca

SEQ ID NO: 48897 - DNA, 201 bp, Homo sapiens
aggatgtgtgggcatcaaagagtgtgatttggtggctcacgcctataatcccagcactttgggaggccaaggtgggcagatcacctgaggtcaggagtttsagaccagcctcgtcaacatggtgaaactccatctctactaaaaatacaaaaaagaaaaaaaaaagccgggcatggtggcatgagcctctagacctagcta

SEQ ID NO: 48898 - DNA, 201 bp, Homo sapiens
cacatctcctccttattcctttcatgactttattccagtgaagtcttctcaggccaccctatttaaaacagagccttggccaggcacagtggctcacacckgtaatcccagcactttgggaggccaaggcagtgggttgtttgagtccaggagtttgagaccagcctagtcaacgtggtgaaatcccgtctctacaacaaa

SEQ ID NO: 48899 - DNA, 201 bp, Homo sapiens
ccacatctcctccttattcctttcatgactttattccagtgaagtcttctcaggccaccctatttaaaacagagccttggccaggcacagtggctcacacytgtaatcccagcactttgggaggccaaggcagtgggttgtttgagtccaggagtttgagaccagcctagtcaacgtggtgaaatcccgtctctacaacaa

SEQ ID NO: 48900 - DNA, 201 bp, Homo sapiens
ttcatgatttatggatgatcacattaaaggaagaagagaggaataggagaagatgaggtttcccagcacgtccttttcaggacctccatgtcacgcctcastgccaattaacatttacttgaattcttggttccctccccagcagctgttgggtccagctctctggggatgtctgagatataaatgctcagacctgcacac

SEQ ID NO: 48901 - DNA, 201 bp, Homo sapiens
ccagttgccaacagaagtcaaattctagaaaactaacattaacaacaggcacgttttgacttgtcatgtctcatttcaaagacaccaatgagcatcacccratctgctgcagaggcacaaagaccctgtgtctcctagctgaacgcagcccgggctggggcggagggcagcagctgctcagccatcaacagccctgccaca

SEQ ID NO: 48902 - DNA, 201 bp, Homo sapiens
tatcagcataattctatacagtaaatctgcagtgggtgacttagttttgctgatatgtggcctctagaatattgggaaaatagatacatggaaatttaggragcttgtatcttgcctctccaaccttttaaatttgctgcagaaagttggatatttgttgggtttttcttccttaagtaggcaaacttcagccccaggagg

SEQ ID NO: 48903 - DNA, 201 bp, Homo sapiens
ataggaagggttaaacagcccctgtcctactgtgtccactgaccaagtccccttcatgatttatggatgatcacattaaaggaagaagagaggaataggaraagatgaggtttcccagcacgtccttttcaggacctccatgtcacgcctcactgccaattaacatttacttgaattcttggttccctccccagcagctgt

SEQ ID NO: 48904 - DNA, 201 bp, Homo sapiens
gcaatttgaatctgccaacctgagagtttcctaaaaacttaacaaggggctcttgctacctgatactaactggctccagcacaccatggacctggatcctrtttctagctcaccccctcactcgtggtatgaccttcagcaagcagcttgaatgttttcatctgtaaaatggaccaggttacttggaggttcaagtgagta

SEQ ID NO: 48905 - DNA, 201 bp, Homo sapiens
cctgtttctagctcaccccctcactcgtggtatgaccttcagcaagcagcttgaatgttttcatctgtaaaatggaccaggttacttggaggttcaagtgrgtaaaaagatgttagaatgcagggaagtccaatttgctgcaaagatgcatgcagattatctaaatcattatcacttacaaggaaacaggacctttggcca

SEQ ID NO: 48906 - DNA, 201 bp, Homo sapiens
gggctacaggcgcccgccacagcgcccggctaattttttttttttttgtatttttagtagagacgggttttcaccgtgttagccaggatggtctcgatctmctgacctcgtgatccgccagcctcagcctcccaaagtgctgggattataggcgtgagccacagcgcccggcctatcgtgccctttcaacagatgaagaaa

SEQ ID NO: 48907 - DNA, 201 bp, Homo sapiens
tgggattataggcgtgagccacagcgcccggcctatcgtgccctttcaacagatgaagaaactggtgagtttaaggaactgacccaagatcacagaataayaagtggtgagctgggatttgcacctgggtctgtgcgtgggcgagtccacctggggcccgtgtcttcactcagcgagtatttattgagcatttagggaatt

SEQ ID NO: 48908 - DNA, 201 bp, Homo sapiens
gatttgagctcagctatatctaacatagaagttcagcagtctatctggcttctaaggtaagtttctgtcacaacattaaatattcagtatcattttctggrctatttttaaatggtagggagtcaaagagattaactaccagttgcagctcttatcaggccaacaatatcagctaaggtgaatctgatactagtagaactc

SEQ ID NO: 48909 - DNA, 201 bp, Homo sapiens
gtaaacaggatgccgtgtattctgatcgggtgatgggtgcaccaaaatctcacatatcaccactaaagaacttattcatgtaaccaaacaccacctgtacmccaacaacctatagaaattaaaaaaaaaaaaaaagaaatagactttgtctgggcacggtggctcatgcctgtaatcccagcactttgggaggccgaggca

SEQ ID NO: 48910 - DNA, 201 bp, Homo sapiens
gatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagac

SEQ ID NO: 48911 - DNA, 201 bp, Homo sapiens
atgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagact

SEQ ID NO: 48912 - DNA, 201 bp, Homo sapiens
tgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagactt

SEQ ID NO: 48913 - DNA, 201 bp, Homo sapiens
gttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttc

SEQ ID NO: 48914 - DNA, 201 bp, Homo sapiens
ttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttca

SEQ ID NO: 48915 - DNA, 201 bp, Homo sapiens
ggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggat

SEQ ID NO: 48916 - DNA, 201 bp, Homo sapiens
aagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagtta

SEQ ID NO: 48917 - DNA, 201 bp, Homo sapiens
agactatgaatctttctttttagaaattgaggtggttaggattaatgaccaaccataaaattttataagcaattattacggtttactgtaccttcttcagytgcttgtcgccttgccttcttttctttctcctgtagtcggggtgagttttcacatcactgacaaagatattgggctgggaagaggcacgcttggagtgag

SEQ ID NO: 48918 - DNA, 201 bp, Homo sapiens
tggacttcagaagtccttccagacaaatggctgctttatttgtgaggtagtgatttatatccctggcagaataatcctgggtgaaagtggctctccctcascataaaggaatagcaaaacatttatgaaagggagacagagcttcagatgagtgggtacaaaagttccgcacaatatcaatggttgaaagaatatgcatat

SEQ ID NO: 48919 - DNA, 201 bp, Homo sapiens
attttttgctttgtgatagataaggcaaaagcggtcactttgttcggtgtgtgctctcatcctaatttagggcccctttctgcctagaactctgtagattyccgccgtctgtgtttttccatcatcccagaccctcagctgcaagctcaggcctccagcccctcatgcacaactgctcctttagatcaggattactttgcc

SEQ ID NO: 48920 - DNA, 201 bp, Homo sapiens
ctctttattgtatttttttaattgatgtaaaattcacataacataaaattaaccacgttaaagtgaacaattcagtggcgtttagtacgttaattgatgtraaattcacataacacgaaactaaccatgttaaagtgacaagttgagtggcatttagtactttcacgatgttgtgcatccaccacctccagctggtcttaa

SEQ ID NO: 48921 - DNA, 201 bp, Homo sapiens
gtcatgttaaaaaacgaaaccagtgaaattaactttaataatttatataataactgtatatatgagtgtgtgtgtgtgtgtgtgtgtgtgtgtgtgtgtgkatgtataacagatatatctaacatattatcatttcaacaagtaatcaaggccaggcacaatggctcacacctgtaatcccagcactttaagaggccaagg

SEQ ID NO: 48922 - DNA, 201 bp, Homo sapiens
ggaggctgcggcaggagaatcacttgaacccgggaggcggaagttgcagtgagctgagattgtgcattgcactccagcctgggcaataaaactccatctcmaaaaaaaaaaaaaaaaaaaagaatcttgggagacagtgtgcctccacttttttgtctattggttgtattacaagttctttttcattttctgcccttgatt

SEQ ID NO: 48923 - DNA, 201 bp, Homo sapiens
gaggctgcggcaggagaatcacttgaacccgggaggcggaagttgcagtgagctgagattgtgcattgcactccagcctgggcaataaaactccatctcaaaaaaaaaaaaaaaaaaaaagaatcttgggagacagtgtgcctccacttttttgtctattggttgtattacaagttctttttcattttctgcccttgattg

SEQ ID NO: 48924 - DNA, 201 bp, Homo sapiens
acacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcat

SEQ ID NO: 48925 - DNA, 201 bp, Homo sapiens
ggcatgaagaatgagaacacagggaaagcttgaatgggctctaagtgaataatcaggtcatagctaaatttcaggggataagtgaacagctcactgtttcwgttcttcacctgctcgttcaaaattttcaaaagcccaacgtaaatgaaatgattaatacagcccacagacagtagacgttaggcatcatggaaaaacgag

SEQ ID NO: 48926 - DNA, 201 bp, Homo sapiens
catagccaggctgtaggaaacagactgggaggaacaggagaagagcatcttccttttaaaggacattgactagaagtttctcctaatgctccctttcattscctgttgagcagagctgagtcacatggctatggcccgctgcaatggaggctgggaagtgtagtttctaactaagtagccaggtacctgaataaaacccag

SEQ ID NO: 48927 - DNA, 201 bp, Homo sapiens
gttgatcaacttggaggcacgtcactcacccttcattggcatcggaattatttaagttggcgcggcctctatgttaactacacagttatttttcatgcaawatgctatggcattaaagacaacgactaggctgtcatacctcctcatttttttttctggaaaatatggaaatctggaattttttttttttttttttttttt

SEQ ID NO: 48928 - DNA, 201 bp, Homo sapiens
ggagaagagcatcttccttttaaaggacattgactagaagtttctcctaatgctccctttcattccctgttgagcagagctgagtcacatggctatggccmgctgcaatggaggctgggaagtgtagtttctaactaagtagccaggtacctgaataaaacccagagggtaggagatgagattctattattacaagaagac

SEQ ID NO: 48929 - DNA, 201 bp, Homo sapiens
cacagttatttttcatgcaatatgctatggcattaaagacaacgactaggctgtcatacctcctcatttttttttctggaaaatatggaaatctggaatttttttttttttttttttttttgagacggagtctcactctgtcgcctaggctggagtgcagtggcgcaatcttggctcactgccagctccacatcctgggtt

SEQ ID NO: 48930 - DNA, 201 bp, Homo sapiens
aatgagcgaatggaggtggtggttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccat

SEQ ID NO: 48931 - DNA, 201 bp, Homo sapiens
aatggaggtggtggttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccatctttcttg

SEQ ID NO: 48932 - DNA, 201 bp, Homo sapiens
aagttctacattaagttgtccctgtgcctgaaccatttttgtttgtttgtttttgtttttttttttttttttttgaaatggagtctcatcctatcacccarctaaagtgcagtggtgtaatctcagctcaccacagcctccgccttctgggttccagccattctcctgtctcagcctcctgagtggctggaactacaggtg

SEQ ID NO: 48933 - DNA, 201 bp, Homo sapiens
tggttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccatctttcttgttttctttttt

SEQ ID NO: 48934 - DNA, 201 bp, Homo sapiens
ggttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccatctttcttgttttcttttttt

SEQ ID NO: 48935 - DNA, 201 bp, Homo sapiens
tctttattcataaatgatatgcctaaaataatctaaaagaattttcagagaatctattactgattttagtaaaggtcatcaggtataagatcagtatacamaattaattgttttatataccccagcagtaagcaaatggaaaataaaattctaaaagatactgtttgcaatatcatcagaaacaccaaatagcaaggtata

SEQ ID NO: 48936 - DNA, 201 bp, Homo sapiens
gagaataattcaaagtggctgtgatgcaaggaggaaattgtcacaaataaacttggagaaatcatcaaaggctggaagaggaaaaattgtaaaaactactrtatggaatttggacctttttctacggatgactaagtgttatacattggggaatcacacgatcagatttgcatttcaggaagtttagtcctgttacgctgg

SEQ ID NO: 48937 - DNA, 201 bp, Homo sapiens
agatgggaagaaagcgctctccaggcagtgggaagaacatgatccagtatctacgggcgagagggacggtggtctgtccagagaggtgagaataattcaamgtggctgtgatgcaaggaggaaattgtcacaaataaacttggagaaatcatcaaaggctggaagaggaaaaattgtaaaaactactgtatggaatttgga

SEQ ID NO: 48938 - DNA, 201 bp, Homo sapiens
tcggttctccattttaaaggttcctagaactttattgttattatgaacatctggcctcagactgaatttatatttaattatttgtgaacattcaaggaccwggcatttcagcttgaattagcatccagactcagggttgttgaagaattttcaaattggactagaatgttcactacctaatgaatgtctggatctaagcca

SEQ ID NO: 48939 - DNA, 201 bp, Homo sapiens
cttttgcaaatcacttttttttcttattataagagtaatatgtgtttattgtagaaattttagagaaaaatacacattgaaaaataataatataaaaatayccggccaggcgcagtggttcatgcctgtaatcccagcactttgggaggccgaccgggtggatcacctgaggtcgggagtttgagaccaccctgaccaaca

SEQ ID NO: 48940 - DNA, 201 bp, Homo sapiens
caatgtccacactgagatgttttgtaagcgtaaaatacacattggatttcaaaagcttatcacacgaacacaaaaagaatggaaaatgtctccttaataawctttgtattgatttcatttggaaacaaatcccttgtatttcttttcactttttttttaacgtggctgccagaaaagtattaaattattaatatggctcac

SEQ ID NO: 48941 - DNA, 201 bp, Homo sapiens
tcaatgcagttataaagtctttactaattttaattggggctcaaaaagtaacacttcattccattattgggacaacttggcagttgaatgtacctttttcmtgatacattttaatctatttacagataaaatattttttactgaaaacgcaatgtccacactgagatgttttgtaagcgtaaaatacacattggatttcaa

SEQ ID NO: 48942 - DNA, 201 bp, Homo sapiens
ccactaaccacatgtggtcaatgcagttataaagtctttactaattttaattggggctcaaaaagtaacacttcattccattattgggacaacttggcagktgaatgtacctttttcctgatacattttaatctatttacagataaaatattttttactgaaaacgcaatgtccacactgagatgttttgtaagcgtaaaa

SEQ ID NO: 48943 - DNA, 201 bp, Homo sapiens
ctttaaccggtggctctacccttcacagctggacattgctggatttttggatgattatttcattgtctccactcaaagattaagtttggaaaatagggaawttttctaccaaagcataggaactccaggccccagcccctcctcactctttctccctgttcattctcatctctttccagttccttacctcctgtaacctgt

SEQ ID NO: 48944 - DNA, 201 bp, Homo sapiens
tccttacctcctgtaacctgtgggcatactaaagtaccaaggtaggcttagctgcaggcacggtacttccatgattcagtgccccgcccccaccactgagmtaggccactcccaccaacaacctcaggccttcagatgcccaatttctgtgtagagctttgagcagtgttttccagttgtgaagggcaaaggaaattctcc

SEQ ID NO: 48945 - DNA, 201 bp, Homo sapiens
tggttggttttgttcacttgtttttaatgttgcaaaagtccttcatatgtcattgacaatagaatttaagtatttttgaaatgtactcagttcagattcamcattacatttcatgtccttaaggttggtagcttaagatagcttgtgcttcagttgcacaatactggcgtcagctctcctttaactcaaagctttctggta

SEQ ID NO: 48946 - DNA, 201 bp, Homo sapiens
gctggcctctgaggccaatgcaaatatattttgagctgagaattgctcttgggcggtgagaggactgtagtttggaaaaggtcaagggctgtggattgccrtctctcatggtgtcttcagaatgtttcagtagctttgtgactccaggtagcattgcattgataatttatctatttaactggcttaagtgggttttttttt

SEQ ID NO: 48947 - DNA, 201 bp, Homo sapiens
gttagcccacggtcccagaatcaatcagctacacctgtggcagatttaggattagaatgaagacctccctacttctttctttctttctctttctttctttctttctttctttctttctttctttctttctttctttctttctttctttctttctttctttccttccttccttctttccatctttcttgttttctttttttc

SEQ ID NO: 48948 - DNA, 201 bp, Homo sapiens
gttgcagtgagctgagatcacaccattgcactccagcctgggcaacaagagcaaaactctgtctcaaaaaaaaaaaaaaaaaaaaaaaaaaaaaaaaaaamcaagaatggctcaggtaggggccaaaaatctgcatttctaacaagctcctaaggctgctcatgctgctgatcctggcacagcactttgagaatccttggt

SEQ ID NO: 48949 - DNA, 201 bp, Homo sapiens
ttttcgtaggtttcatgattaattttcatcttaagttaattttgtgtatggtgtgaggtagaggtcaagatgtatgatttttccagttgccgccgcaaaaygtattgagaagatcaccctttccgtcactgaattgcagccataaatcaaataaccaatatgtgtgatctatttccgcactgtctttccctggtctttata

SEQ ID NO: 48950 - DNA, 201 bp, Homo sapiens
atcctgtgtggcacctttctcattgctttggacaatgtgtagcaaagtcctcactgaatcccaggagtctaataggtatttgtgaatgaggagtgagtgartgaatgaatgatttgactaattcttacctcactaagtcacccatggcccaggagggtactgtgtacctttatgttacaaatcatttaactttaattttga

SEQ ID NO: 48951 - DNA, 201 bp, Homo sapiens
ggaaaaagtaaaaactaaaaggcagaaatgaaatccgcaagcagacggcccagcgccacaccctgggccttgtagttaaagattgacccctgacctaatcmgttatgttatctataggttacagaaattgtatagaaaagcactgtgaaaatccctatcctgttttgttccgatctaattaccggtgcatgcagaccccag

SEQ ID NO: 48952 - DNA, 201 bp, Homo sapiens
ggttgttacccagagccctactgaatcaaaagaaatacttattttttctaaaaaaggaatcagtggtgggtttgtgaacctatgattagaaacatcctgcrgggacatctacttgttcatatttaatgtcatttactagtagtggagcttacgtgcagttggttgtagcaaacagctctttggttctccccattctttaag

SEQ ID NO: 48953 - DNA, 201 bp, Homo sapiens
acaaaatgcctaaattccgttcatccacattcatttatttattcattcattaaccattgaatattttggggctcctatacatagtttgctctcaaagaatkttaggttttagttgggagagagcaatgaaaatatgttaactgcatgccaactgggatctcccattcagtgaaatctagatagcgttggaccaaaaccctg

SEQ ID NO: 48954 - DNA, 201 bp, Homo sapiens
cgatgagtatttgttcagattgttttaagccaaatgagacagtgcaaaaaaaggccagacctgtatgggacaccaaatcaatgttagtcctcttctttttaaaaaaaaaaaaaaaaaaaacaagtaatcagtttaatgtactctgatattgtttaccactgggattcttgttcatcaattaaggctacagagtccaccagc

SEQ ID NO: 48955 - DNA, 201 bp, Homo sapiens
actatctcttttcaattttccaaatatagcatctaaatttagagagatgttaaaacaatttgggggttgtttggtttctttccttttttttttttttttttggcccctttgctcaaagaaatagtgctttgctttcttctaatgaagtaagccctggtccaaggaaaatataaaataaaatcgctattttcctaccacctt

SEQ ID NO: 48956 - DNA, 201 bp, Homo sapiens
aggttgggcgaggcaatctttaaatgaagctattttttctttgtctctctgtccctctgtgtctctctctgtgtctcacacacatacacatgcacacacasacacacacagacacacacacacacacacacacagtctagctgaatcacgaattccgtgagaacagagtcagcatttgtatattttctcagagatctattc

SEQ ID NO: 48957 - DNA, 201 bp, Homo sapiens
aggacattggaaaaaattgatgtttatgggaaatgtatgtgtatatttgtatgtgtgtgctatgtctgtggtacatgtacatatgtctgcctgcatctgagtgtgtgtgtgtgtgtgtgtgtgtgtgtatgtgcgcatgtgcgtgctgctccagatagacctacaaacatctgtcttcctggcctgtgtacttgggagtgg

SEQ ID NO: 48958 - DNA, 201 bp, Homo sapiens
ggacattggaaaaaattgatgtttatgggaaatgtatgtgtatatttgtatgtgtgtgctatgtctgtggtacatgtacatatgtctgcctgcatctgagtgtgtgtgtgtgtgtgtgtgtgtgtgtatgtgcgcatgtgcgtgctgctccagatagacctacaaacatctgtcttcctggcctgtgtacttgggagtggt

SEQ ID NO: 48959 - DNA, 201 bp, Homo sapiens
taaaggggatagttaaggcacctgaaggaccaagcccaccagcaatctgcacggatactcggtcactattttgttatttataccacctggcacagttcctrccttctaattcacactcaagcctcaagcaagagccgttcctttgcctccattcctcccagagattccccttcccatgctgaagccttggaaattattgtg

SEQ ID NO: 48960 - DNA, 201 bp, Homo sapiens
caccagcaatctgcacggatactcggtcactattttgttatttataccacctggcacagttcctgccttctaattcacactcaagcctcaagcaagagccrttcctttgcctccattcctcccagagattccccttcccatgctgaagccttggaaattattgtgaatgcaataatggtggccgcttctgtaaacactgta

SEQ ID NO: 48961 - DNA, 201 bp, Homo sapiens
actcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaaatatcctttcctgct

SEQ ID NO: 48962 - DNA, 201 bp, Homo sapiens
aagtatttcattgccttctgccatgcctacctatttgtttttctcacagtaggtttctaccaagtggcatctcacttctaacataaagaacaagcatcagwatgcctccctttgaatgcatatgaggttgttttgtttttagaacccaaacacagccacttgaatctatcatgtaattcaaaggaaacaagcattattcca

SEQ ID NO: 48963 - DNA, 201 bp, Homo sapiens
tgaggattaaatgagttaacacacataacgcttaggatggtggtggacgtacaaaacactcaataagaatttgcttttgttattattacttgttcacatcyatgcagcatgtgtgcctgcatgctcacacactctagtcttacgcagcttattcaccaacattggttcgggatgacatttgactgttttcaaaagtcaaat

SEQ ID NO: 48964 - DNA, 201 bp, Homo sapiens
gccgttcctttgcctccattcctcccagagattccccttcccatgctgaagccttggaaattattgtgaatgcaataatggtggccgcttctgtaaacacygtacttgaccttcatgcccacagtattcagcaggtaactacgtagtgtctgttgtgtgtcagggactgtgctgtggattcacttctgcagagagcagagg

SEQ ID NO: 48965 - DNA, 201 bp, Homo sapiens
tctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaaatatc

SEQ ID NO: 48966 - DNA, 201 bp, Homo sapiens
tgtgaatgcaataatggtggccgcttctgtaaacactgtacttgaccttcatgcccacagtattcagcaggtaactacgtagtgtctgttgtgtgtcaggractgtgctgtggattcacttctgcagagagcagagggtagatgcagaataaagggtcttctcctgccttgagccgttcagagttgtggcctttggaagac

SEQ ID NO: 48967 - DNA, 201 bp, Homo sapiens
aatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaaata

SEQ ID NO: 48968 - DNA, 201 bp, Homo sapiens
ttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaaa

SEQ ID NO: 48969 - DNA, 201 bp, Homo sapiens
catggtgtactagggaagatgttctcctatgtcctgaatgaccagcagcagaggattcagggcacccaatgcaaaattgtcaccaaatgactgtgacactraagtggctcatgctgctctttgcactgcattaagtgaaaccagacgcctccagttaaactccagtgagctaaaaagtatagtgataaatatatgaaatga

SEQ ID NO: 48970 - DNA, 201 bp, Homo sapiens
cttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagctaa

SEQ ID NO: 48971 - DNA, 201 bp, Homo sapiens
ccagatacagaaaatgagtgagcaatgcctttcccagctaaaaattcttccagctcacccatggtgtactagggaagatgttctcctatgtcctgaatgascagcagcagaggattcagggcacccaatgcaaaattgtcaccaaatgactgtgacactaaagtggctcatgctgctctttgcactgcattaagtgaaacc

SEQ ID NO: 48972 - DNA, 201 bp, Homo sapiens
ccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagcta

SEQ ID NO: 48973 - DNA, 201 bp, Homo sapiens
cccggaatacaatgggatgagtaactggcaggtccagatacagaaaatgagtgagcaatgcctttcccagctaaaaattcttccagctcacccatggtgtrctagggaagatgttctcctatgtcctgaatgaccagcagcagaggattcagggcacccaatgcaaaattgtcaccaaatgactgtgacactaaagtggct

SEQ ID NO: 48974 - DNA, 201 bp, Homo sapiens
cccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagct

SEQ ID NO: 48975 - DNA, 201 bp, Homo sapiens
tatgtaacaaacctgcacatcctgctcatgtaccccggaacttcaattaaaaaaaaaaagaagaaaaaaaaaaagattgtatcctctactaaaggaagatrggaaaatgctgtttgatttaatctgccatctcactaggtgagcatcacattagtcattgctgctcctgtcaccttctggtaatgatcatgcttcatctat

SEQ ID NO: 48976 - DNA, 201 bp, Homo sapiens
ctaaggtatggtagtgccaagagtggagatactcctttatcagggcctctggggtcatggtcctgggctgtgacctcagcacgacatcagcacaaccaaarcaaaccacaggctggtgtttaggttcttgtcaagacctcatgcatcattaaacagagggcaactgcagagctctccattctgttttaagaaaatagaaat

SEQ ID NO: 48977 - DNA, 201 bp, Homo sapiens
cttttttgacatttctggatatgatcactagctgcaatcttgcatttggtgctttttgtgattcccagctctccctccacatgctctgagaaaagtgatayccccagagctgtatccaaagaagaaatgtaaatccagaggctataaactaataggatctgagtttccgtggttgactgtatgaaagtagatttggcttct

SEQ ID NO: 48978 - DNA, 201 bp, Homo sapiens
gtttgtgctccccagaattcatattttgaaacctagcttccaatgtgatggtgtctggaggtagggctttcatgaggtggtaaaatcattaggactttacwctcaggatattatgagattagtgtctttataaaagagaccccagtgaactcgctcgtccttttctactacatgaggacacaatgaaaagacagccattgc

SEQ ID NO: 48979 - DNA, 201 bp, Homo sapiens
tttccgtggttgactgtatgaaagtagatttggcttctctgtgttgctgactttaacagggagcttaaaatgtgagatggagcaggtgtttgcgtgctgtrtcaccaagccgttcccatggctgtgaattccgggaagttgagggactatacagacactttatcttgtggtgacctgatgcatgcaccaggccactgttgc

SEQ ID NO: 48980 - DNA, 201 bp, Homo sapiens
atgaaaaccacatctcatagttatccccactgaggaatgagggacctggggtatttatctaccaactccccttctattattggttgagtccctcttctgaygagtcacaggtattcccagtaagcagcctctgtagggcacaggtgagtgatgatgggattcaccgctgacagctctgctgtagatttccccgggcaggtg

SEQ ID NO: 48981 - DNA, 201 bp, Homo sapiens
ctacctaagagcagcccattgctagctctcgcaccctctctgcccttgacctcaataatataccatatcttgattcactggctccaggtctcctaccaccraggacttgccttactttttttttgttgttttctccatggagtccatctgttggaacattctgtctacaaactccttttgttaggtaataatgagttttcc

SEQ ID NO: 48982 - DNA, 201 bp, Homo sapiens
ctgtgaattccgggaagttgagggactatacagacactttatcttgtggtgacctgatgcatgcaccaggccactgttgcccaacaactgccccctaagtktgggtggaacggccattgcaatcgactcggggggaacagtgcatctaaaagatgaaggtctgattttctttgcagagtttaaatggtgcatgtgtcttta

SEQ ID NO: 48983 - DNA, 201 bp, Homo sapiens
ggggctttgtccggatgagtggattttttgtgtcccttacaccatgtgaattcccagcatcatggtttatgctaatcctctttccaaaatagtttcctggkgaccttctccctgtgccaaccccggaatacaatgggatgagtaactggcaggtccagatacagaaaatgagtgagcaatgcctttcccagctaaaaattc

SEQ ID NO: 48984 - DNA, 201 bp, Homo sapiens
acactttatcttgtggtgacctgatgcatgcaccaggccactgttgcccaacaactgccccctaagtttgggtggaacggccattgcaatcgactcggggsgaacagtgcatctaaaagatgaaggtctgattttctttgcagagtttaaatggtgcatgtgtctttaccccaaaaaccacagaaacaatttctcttaaag

SEQ ID NO: 48985 - DNA, 201 bp, Homo sapiens
ccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagccagc

SEQ ID NO: 48986 - DNA, 201 bp, Homo sapiens
ggaggagagttggacctagggcccaggtttccaggatcctggtctagtgtaatgtcagtttctaattatgtggtccacacacatgaatatttaaatcagcrtctcctggagataactcaagaggtgactctaatggtagacaattgaggctgtacatcagggttgcaaaggggctttgtccggatgagtggattttttgtg

SEQ ID NO: 48987 - DNA, 201 bp, Homo sapiens
tgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttc

SEQ ID NO: 48988 - DNA, 201 bp, Homo sapiens
ctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagcca

SEQ ID NO: 48989 - DNA, 201 bp, Homo sapiens
taatgactctcactcctacactcctgcagagggcctggcacatagtgggtgcttaatacaagttccttggcacaaagaatataggaataaatacggggacyaaggtattgcgctctccattttacaaaggagaaatctagccttggtctctctgataccacagtctttcccaaagttgcacagcacagtggaggagagttg

SEQ ID NO: 48990 - DNA, 201 bp, Homo sapiens
gatgctgaggtgggagaatggcatgaacccgggaggcggagtgtacagtgaaccgagatcgtgacactgcactccagcctgggcgatagagcgagactccrtctcaaaaaaataaataaataaataaagtataaaatcatggctttggcaacaatgtggatgccattatctttggtgaaataactcagaaagtcaaatact

SEQ ID NO: 48991 - DNA, 201 bp, Homo sapiens
tctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagcc

SEQ ID NO: 48992 - DNA, 201 bp, Homo sapiens
ctgagggctagagaggtttagtaatgtgttctctgacacatagattaaaaagtggctgagcaagaacttgaatcgcaagccctgcatgccagttgcgagcyccaaaccctacctcctggggagaagacacacattgtatttctcttctcttcatgggggttacagactccgttatttcagagcagaacctaggttctctat

SEQ ID NO: 48993 - DNA, 201 bp, Homo sapiens
taccttaaatgtaagagagcattttcttacacagatgagtgagtttatttattttcatgtgtgtgtgtgtgtgtgtgtgtgtgtgtgtgtgtgtgtgtgtrtgtgtgtgtagatgagaaagagaaagagaaaaccaccaaccttccttagtcattttatagtagcccagcttgccaggtaactccacgcagcccatcctta

SEQ ID NO: 48994 - DNA, 201 bp, Homo sapiens
ttctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctgagc

SEQ ID NO: 48995 - DNA, 201 bp, Homo sapiens
gtccctagtaagttgcctgtcccaaagcagacacttaactaatgtcaagtctccctaaacgttgccctcatccccacaatacgaggagggaagagtccgaygttttcattagaaaagctgccacccacacacaggatgcttttctctacttctgagtgtttatagtttcagtgattctgtgccttacaattttcaaggaca

SEQ ID NO: 48996 - DNA, 201 bp, Homo sapiens
tcttctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctga

SEQ ID NO: 48997 - DNA, 201 bp, Homo sapiens
aggtctgctacagcacaaaggggaccctcaatgaataagcatgtcaacatcaatcactttcctcaaagtttaactcagctatgatagatcatggcatatcygcaagccaagctactcatccaaaatatggagatcttgtaagttggagattgtgatgataatagtacctgtcccttagtattgttgtgaggattaaatata

SEQ ID NO: 48998 - DNA, 201 bp, Homo sapiens
ctcttctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaacctg

SEQ ID NO: 48999 - DNA, 201 bp, Homo sapiens
atcctcttctccccttaatctccagcccactcctcctccctcttcttgtctgtgtccttcccctgagacatgttcaaatgttgtttctgcatgttaatatgttgcttttcacacatcttattttcttaactatttagtgaattcatcatggcggagggagtgagcacgaatggactctgtcatacttcacagaaattaaac

SEQ ID NO: 49000 - DNA, 201 bp, Homo sapiens
tgatgggatgatttgtgcagcaaatcaccatggcacatgtttacctatgtaacaaacctgcacatcctgctcatgtaccccggaacttcaattaaaaaaawaaagaagaaaaaaaaaaagattgtatcctctactaaaggaagatgggaaaatgctgtttgatttaatctgccatctcactaggtgagcatcacattagtc

SEQ ID NO: 49001 - DNA, 201 bp, Homo sapiens
gatatatcatgtcccagcctgtcttctccttcagtcctctgtaagatagatgttccaataatgccagctgattcaaaattgaaatattgttcaaaatatgyttagattgatttttttaaaaaattgttattcagccccagagtgaaatgactactgaactactgaatttatagcccccaaactgagggtgggaggggctct

SEQ ID NO: 49002 - DNA, 201 bp, Homo sapiens
ttccctgtgacgtgggaatcttttatccacaaggttgtcatgcatttggaataagagaaatgaattaccaacatgagctgctgggacaccatggatccgtwcgaggagtatcagtagctgcagtagctccttctagtgctgtgccaggcacagaactcataccatgtcatcctataatctaccccaatggtagttaatata

SEQ ID NO: 49003 - DNA, 201 bp, Homo sapiens
aaaaaggcttaattgggtcacagttctgcaggctgtacaggaaacacaatgctggcatcttctggggaggcctcaggaagcttccaatcatgcacgaagaraaaggaggaatgaggtatctcacatggtgagagcaggagcaaaagagagcaagaggggaagtgccacacactttcaaacaaccaggtctcataagaactc

SEQ ID NO: 49004 - DNA, 201 bp, Homo sapiens
tttcattatgttacattctttggacttgtcctcttatctatgtaccttgtaacttccatttagccctcttttctctttcaacttccttattgtagatactycttaatgttactagcatttaagttgtttttttcccccctcctttgtcagtcccaaagctcctatggctcaactgttggtgcacataaccttagggaggtg

SEQ ID NO: 49005 - DNA, 201 bp, Homo sapiens
ttatctatgtaccttgtaacttccatttagccctcttttctctttcaacttccttattgtagatactccttaatgttactagcatttaagttgtttttttyccccctcctttgtcagtcccaaagctcctatggctcaactgttggtgcacataaccttagggaggtgatttgaagaaattttaccgaaatgttgtatgac

SEQ ID NO: 49006 - DNA, 201 bp, Homo sapiens
gcttttaaatatgctattatcttagggaatctctgagagtgtggtaaagtaagcagcatttctagcacatagttaaccgtgggtctctttttattaaggcragatctcttgggactggtgtttcttgaatagacttgccagacaaaatacaagaccccattatgaaatttcagataaacaatgactagtgttttagaataa

SEQ ID NO: 49007 - DNA, 201 bp, Homo sapiens
ggttcctatcaaactctgcttcctgtctcttatgacttagaacatgccatcccagacccagggaacagaacaggcatatccctggttatttcaaagccagyatcacaccagcatgtagagatatgaccagacaataacaatcctcctccagttatcactcgagggaaaggagagggacttatggggaacagatgcagataa

SEQ ID NO: 49008 - DNA, 201 bp, Homo sapiens
tcaccattcatgagtacctaggttgattccatgtctttgctatttgaatagtgctgcaacaaacatatgagtgcatgtgtctttttggtagaacaatttaktttattttggatatatacccaggaatgagattgcttgttttaagtgctttgagaaattgccaaactgctttccacagtgcctgaagtaatttacattccc

SEQ ID NO: 49009 - DNA, 201 bp, Homo sapiens
gaagtatgcctgtaataatttctgtcacatgggtgtgtccatactgctcagtatctggcacaaggtgggaatttgatgaacatttgttccatgagtgaagygagtttaaggactggtgtgcatggtatgctcagaactacatttggtttatagtaagggttcagtacataagcatatttactgctgttattgttcttaaga

SEQ ID NO: 49010 - DNA, 201 bp, Homo sapiens
gctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacat

SEQ ID NO: 49011 - DNA, 201 bp, Homo sapiens
ttttagaaagtatataccttaaagaacattttattgcaaaaaaaatgttgacatagagactcaaagaacacatgttttaggaaaaatggcgccaatagacytgctcaatgcagggttgccacgaagctgcaatttgtaaaaactgcaatatctgtgaaatgcaataaagggaagcataataaaaggaagtatgcctgtaat

SEQ ID NO: 49012 - DNA, 201 bp, Homo sapiens
tgcggtggcgggcggctatagtcgcagctactcgggaggctgaggcaggagaatggtgtgaacccgggaggtggagcttgcagtgagccaaggctgcgccrctgcactccagcctgggtaacacagcgagactccatttcaaaaaaaaaaaaaaaaacttccatattttcagttctatcttctttttattcttcctttacc

SEQ ID NO: 49013 - DNA, 201 bp, Homo sapiens
tagtgctgcagtgaaaaaatgctcaacatcactaatcattagagaaatgcaaataaaatccacaataagataccatctcacaccagtcagaatggctattrctaaaaagtcaaaacgaaacaggtgctggcaaggttgcagaaaaaaagggaacatttttacactgctagtgggaatgtaagttagttcagacgctgtgga

SEQ ID NO: 49014 - DNA, 201 bp, Homo sapiens
tcaacatcactaatcattagagaaatgcaaataaaatccacaataagataccatctcacaccagtcagaatggctattactaaaaagtcaaaacgaaacasgtgctggcaaggttgcagaaaaaaagggaacatttttacactgctagtgggaatgtaagttagttcagacgctgtggaaagcagtttggtgatttctcag

SEQ ID NO: 49015 - DNA, 201 bp, Homo sapiens
gctttctaaaccgattctaaaaccaccagaaagttattctttcagctgaatataatcaaccctacattttaagtttattttctattctgtcctcaaagaargtagtatccagaaagcatccgttattccccaaacctttcacaggcctaaacatagctattcattcagttctggatcctccctcttccagccaacaaaccc

SEQ ID NO: 49016 - DNA, 201 bp, Homo sapiens
ctcacaccagtcagaatggctattactaaaaagtcaaaacgaaacaggtgctggcaaggttgcagaaaaaaagggaacatttttacactgctagtgggaawgtaagttagttcagacgctgtggaaagcagtttggtgatttctcagtgaacttaaaactaccattcaacctagcagtctcattgttagatatatacccaa

SEQ ID NO: 49017 - DNA, 201 bp, Homo sapiens
tgctgctaggtcctttcagcagacagagcaatgatacagacacacacatatacatacacatatacatccacacaaatatacgtacatatatatgggtgtayacatatatacacatgggtacatctatatgtactcatttatacatgcttgcacatatgtctacaactactgtatctctctgcattgttcatacattaaatt

SEQ ID NO: 49018 - DNA, 201 bp, Homo sapiens
ataacaaccaacgtttgactgcaaaaaatgtggtagattattttcattcatatgaatatgcctgcccttttctctggtggagtctggcccggtaagtctgygggacctgcctctaccaatgaggggtagagcttggtgacttttaacaatgatctcctcattagatgaggccatcagttacagcggaaatgatcattattg

SEQ ID NO: 49019 - DNA, 201 bp, Homo sapiens
ctagaaggaggtgggcctgagccgcccctgaagaatgttgggaatctgggtcaggcaagaggctggaggagagaggtgaagagctggaaggaagttgggaggggagaggcccaggggagggcatagatggagggtgatggggtgtgggtgcccaggcctgggaattcagacctgccaatagccctttcaagggccagagac

SEQ ID NO: 49020 - DNA, 201 bp, Homo sapiens
ctacaaacaaatatccttttcatgaaccatttaatgccacatttgccacaattttatgctatttcttggcaattttgctgtcaaaatggccccaagtggastgcagagtgctctctagtgtctctaagtgcaagaaggctgtgatgtgtctgactgagaaaatgcatgtgttagataagctttgttccagcatgagttaca

SEQ ID NO: 49021 - DNA, 201 bp, Homo sapiens
aaaacataaacaactatcctgcctttgttttcagaattccttgtagaaataattaactagtggatgaagagagtttctctttctaggtaataagcaacgamaaaatggcagaattagaatataatgaatttgcagttcttactaaattaatatatctaggcagtaaccatcaataaaaagaaagaccatatgacatttgta

SEQ ID NO: 49022 - DNA, 201 bp, Homo sapiens
tgaggcaggagaatcactggaacctaggaggcggaggttgcagtgagccaagactgtgccactgcactctagcctgggagacagagtgagactctgtctcaaaaaaaaaaaaagtcaaggaagatcaaatactcaaggctcctagtgatcatcaattagacatccgagttcttctgggaggtcctgtttgccagtggtcat

SEQ ID NO: 49023 - DNA, 201 bp, Homo sapiens
gctggtttggagtaaatccatccccaccactatcaggtcttgcccaggcataccctgcttttcctgaatgtcctgaatgttgttgtaggacaacaaatgcrctttataattattcataggacctctcactactaatctttgagtcgataacagcttctgctatagaagggggcagatcactgggcttaaatgtcaaatagc

SEQ ID NO: 49024 - DNA, 201 bp, Homo sapiens
tgcagttcttactaaattaatatatctaggcagtaaccatcaataaaaagaaagaccatatgacatttgtatgtcctgaagtaagttcacaacgccatctrgtcttgagccaaaaatactgcacctgaatctgatccagcctccaggatgtatctatttataggaaacacagtggacaggcgaacatgttaaatgacacca

SEQ ID NO: 49025 - DNA, 201 bp, Homo sapiens
gatttgtttaagtactcattgctaggcgtactaccctggtttctaactcagttaggtatattaatttcctagggctgccataacaaatcactgtaatgttdatgtttaaagcaacagaaacttattctctagcttctggaagccagaagccaaaatcaaggtgttgccaaggcatgctccctttaaaggctccaggggagg

SEQ ID NO: 49026 - DNA, 201 bp, Homo sapiens
tgtcacaggcggctagtggttctcatgtgcagatgtaggacatccccgccatcacagagggatttgctggacaccactgagtcaaataaatggtagtatgyccatagaatggagtattctccatattctcaatgaagtaaatgcagatattctggcatagaaaggtcacccttgtgtattgccaggtaaacaagttacaaa

SEQ ID NO: 49027 - DNA, 201 bp, Homo sapiens
gccatttagaaattctcattagtatttgttcagttatgataatgcatggtgcttctgttaaaaaaatacttttaatcttttacagataccttctaaatatytatagatgaaatcatatgatatctagaattttctttaagacaatctgtggaaggggtgagtggatgtgtgctcaggtgagctaatggtagccatgagttt

SEQ ID NO: 49028 - DNA, 201 bp, Homo sapiens
tagtagccactagttacatgtgactgtttacatttcatttaatcaaattaaagaaaattgaaaattcagtgtcttgatcacaggagaggaattttaagggytcctttgtcacaggcggctagtggttctcatgtgcagatgtaggacatccccgccatcacagagggatttgctggacaccactgagtcaaataaatggta

SEQ ID NO: 49029 - DNA, 201 bp, Homo sapiens
ctgcctgctttgttctagccatgccgacagccagctggatggtgtccacccacaatgagggtgggtctttctctccctgtccacagtaaaagctgtgtaastggataagattaataagggataatgtgaagggagatgagaacaagggctacatctagaacctaggaggaacactcatattccagtactggaggagaaagt

SEQ ID NO: 49030 - DNA, 201 bp, Homo sapiens
gtgaagtacagccaaaccctatttatgcttttcctagggatggggtggaacagataggaacgggtaattgacagacattaagaaatagacttaaatattgyttgtcctgctttagtacgcacgatattaatgagatgttattgtgagtgctgagtaaagaggttgctgccggctggttctcatgccaggcagccagcagac

SEQ ID NO: 49031 - DNA, 201 bp, Homo sapiens
gcaaagagagagagagagagacagagaatatcatggtgatgagtgctaggacattgtcaaggctcttttaagtgtgaccaccaggggacagcaggaaagayaggagaagacctagagttcaacttggagtactgaaagccttccctttccttcttttctctctgtgaaggttgttttccttctttggggagttgcaggccc

SEQ ID NO: 49032 - DNA, 201 bp, Homo sapiens
attagacgtaattgggtgagaaattacttataaacctgtcatcataacatagctattgttttctttgtccaatatattgacattttattccactgtgcacrtagagttctgcatttggctgtttttacttaatacatcatagcatcaaacagtggtaatgccatttcacagtctgtatttaattggaagtgttttagtata

SEQ ID NO: 49033 - DNA, 201 bp, Homo sapiens
actgattataatttaacattcattaagtttcttttatcaaaaaaaaaaaactattaagttcattgaagaagtcataaaaacaaaccaaacacccaccaccytctcccctcctggggacatggcagtggccacttcaaagtgggtcaggtctccgtgaaggaaaggggctcttgagagagtgatggtggcccaggggccggt

SEQ ID NO: 49034 - DNA, 201 bp, Homo sapiens
ccggcaatacaagtaaaatatatgtggatgttaacaaagatgtaaagagccttttgaagtatataactgattataatttaacattcattaagtttcttttwtcaaaaaaaaaaaactattaagttcattgaagaagtcataaaaacaaaccaaacacccaccaccttctcccctcctggggacatggcagtggccacttca

SEQ ID NO: 49035 - DNA, 201 bp, Homo sapiens
caggcaggtcttcatcatttaaccttctacttctctctgacagatttgcttctgtctatcctcatcttcatcctagatctaaaccaccattatctcttgcytgcaaccttttattcctaattctagtctttaatatctaatttctgctccaaatggcagctgaaggattattttcaagctcagatgtatcctgccacaccc

SEQ ID NO: 49036 - DNA, 201 bp, Homo sapiens
gaggcttaaaacagcagcactgggaaaatgacataaattttaaaaagcagaaagtaatactgcatttattctgtggtttggctgaggttttgggtttcagrggaagctgctgagaaaagagagggagggaaaatgtgacccagaaatcacgggaaccagggaatctcaacaaattgagtatcttggtttgtgtaagattag

SEQ ID NO: 49037 - DNA, 201 bp, Homo sapiens
cacgtccacaagaacccacccacaggccaggtactgtgcgaggcactggaatacaatgggggtaacatggactaggagactcatgaaaacgtcatgacaamcacctgggaaattctgaacgttaaatagtagggaagggtttctccaccatggcatggtggccactttgggcaggaagattgtggtgaggctatcctgtgc

SEQ ID NO: 49038 - DNA, 201 bp, Homo sapiens
cttccatttagccctcttttctctttcaacttccttattgtagatactccttaatgttactagcatttaagttgtttttttcccccctcctttgtcagtcycaaagctcctatggctcaactgttggtgcacataaccttagggaggtgatttgaagaaattttaccgaaatgttgtatgacaaactcccaataacaggat

SEQ ID NO: 49039 - DNA, 201 bp, Homo sapiens
ctttgtcagtcccaaagctcctatggctcaactgttggtgcacataaccttagggaggtgatttgaagaaattttaccgaaatgttgtatgacaaactccvaataacaggatttaagagaataccacttgttcttaccccttcagttctcttaacagggaagaaatatcatagccacataacacatgtttatatatataga

SEQ ID NO: 49040 - DNA, 201 bp, Homo sapiens
tttaccgaaatgttgtatgacaaactcccaataacaggatttaagagaataccacttgttcttaccccttcagttctcttaacagggaagaaatatcatarccacataacacatgtttatatatatagatatgcccttacatcaaaataaattcttgatgataccaagatacgtgttcaaggcaaccataaaacactggaa

SEQ ID NO: 49041 - DNA, 201 bp, Homo sapiens
aggggagttgagggcttatcaagcttaggaagcaatgtgtactgaaaaggatgaggtcagttcggggtctgtcaaatcaattgaacatatcttgaaccctraattctatcatcaatctcactttacaatccatcccttccaattaatgctgcatataataacaccactcaatgatgttcatacatcccatcttcttacttg

SEQ ID NO: 49042 - DNA, 201 bp, Homo sapiens
aatatatttaacctacttagaaactctgtatagaagatatcagtgttgtatttcataaatagagaaagagaatctcagagttgagcactcacagtcatggycaattcatggcagagttggtgaccagctcaaattttctaggttgacataatcctgtcctttctatggcttcaaagccatccacgtttgtctcttgatcct

SEQ ID NO: 49043 - DNA, 201 bp, Homo sapiens
catatgtattagtctgttttcacacttctataaagacatacctgagattaggtaatatataaagaaaaaaggtttccttgactcacatttctacatggttkgggaggccttaggaaacttaacaatcatggcagaatgtgaaggagaaacaaggcacatcttatcacagtaaagcaggagagagagagaaaaagagccaag

SEQ ID NO: 49044 - DNA, 201 bp, Homo sapiens
gaagtgctgagcaatgcgcagggatagccccttataaaagcgtgagatctcttgaaaactcattcactatcatgagaacagcatgagggtaactgccaccrtgatccaattacctctcaccaggcccctccaacaacacatggggattatgggaactacaattcaagatgagatttgggtggggacacggccaaaccttaa

SEQ ID NO: 49045 - DNA, 201 bp, Homo sapiens
ataaaggaaagaggtttaattgactcacagttcaccatggctgggaaggcctcaggaaacttacaatcatagcagtggcagaaggcagccatgattgtttwccaggcagcaggaaggagagtgccaagggaagagggaggagtcccttataaaaccatcagatcttgtgagaactcactcactaccatgagaacagcatgg

SEQ ID NO: 49046 - DNA, 201 bp, Homo sapiens
acatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacgaaagggatgacttttaaag

SEQ ID NO: 49047 - DNA, 201 bp, Homo sapiens
cagcctggccaacgtggtgaaaccccgtctgtgcttaaaaaatacaaaaaattggccaaatgcagtggctcacacctataatcccagcactttgggaagcygaggtgggtggatcacctgaggtcaggagttcaagaccagcctggccaatatggccaaagcccgtctctaccaaaaatacaaaaattggtgtggtggtgt

SEQ ID NO: 49048 - DNA, 201 bp, Homo sapiens
aaattgaaatccaagatagttgagaagattataagtgtatcctactgatttaaacgagttcacacctatgaaactagatgaattatttctcacagaagacmcggagaaaatggtgattagaatctctgcaccagtttctgtgatttttttgagacatcctgaagatgagaggtgagtagacagcagatgggcagggccagc

SEQ ID NO: 49049 - DNA, 201 bp, Homo sapiens
atcccagcactttgggaagccgaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagc

SEQ ID NO: 49050 - DNA, 201 bp, Homo sapiens
acaacaatttacagcactctttttagtatattctgaaatagtctcctcatgatttctttctcttctgtactccaaatgtaacactaaatcacacacatgtmcacacacacacacacacacacacacacacaatcatgaccagctcaagaataaatatgtggggactaagcatccaaagctcgacaccaacaatttgcagct

SEQ ID NO: 49051 - DNA, 201 bp, Homo sapiens
caggagagtggcgtgaacctgggaggcagagcttgcagtgacccgagatggcacaattgcagtccactctgggcgacagagcgagactccgtctcaaaaawaataataataataataataatgtaaatgtagaaacctttgggggagtgagcagtccccagtggaagtataatttccaggctatctcacacaagcctgctt

SEQ ID NO: 49052 - DNA, 201 bp, Homo sapiens
tcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaa

SEQ ID NO: 49053 - DNA, 201 bp, Homo sapiens
aaagtttcatagaccagagacttccacagtgaacacaagattagataccttaggctagagcgatgggttttagaaaaaaggtggacacatggaattcatgkatatgaaacaatacattgtccagaagtaagggtggtccatggagactggttggagtggggtgggagaaccttttcttcatcagagtcaagtcattctggg

SEQ ID NO: 49054 - DNA, 201 bp, Homo sapiens
gaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagct

SEQ ID NO: 49055 - DNA, 201 bp, Homo sapiens
cccagggactcataggaagaaaatgtcttcattcttcacttggtttagattgttctacgcaaaaactcttgtatggacataagccttaacttactccattyggagttgagcagagtcctaattctttgacttgatcttataccattccccactcctaaattagttccaattagttccaagttcatccttacctcagagtct

SEQ ID NO: 49056 - DNA, 201 bp, Homo sapiens
gctggacagttggttgtgcttactttgtaaaaattcattgggttgtatgttctgatttatgtgcttatatgtgtctacattatgcttcaattaaaggtttrctaaacaaataagcctgttcagcagagaccaaaaagcacgtagtacaattctatgcttacccacaaggggcctcaaagtttacaggaggaggcagacagg

SEQ ID NO: 49057 - DNA, 201 bp, Homo sapiens
acatcattatttttctggttttacttttaaattccctataggaccattgacatgaaattctgagggggaatttggaacattaatgactgtttaaggcaaakgagtaagtgttctttccaagaggaaattgtctttataatattggcataaggctatttttaaaatttatactaatgagacgattcgaggcagataactgaa

SEQ ID NO: 49058 - DNA, 201 bp, Homo sapiens
ttctttttatcccctctccttctgccccagggttcttctccgtgtggatcacattaagggagcgtataacctttcataccgcctgactaggatgatggatrtggaaatacacactttgggagccctgtctgcttgcctgttaagccattgactgttatatactcttgggcttgaaacaccttccaggctggaggggccagt

SEQ ID NO: 49059 - DNA, 201 bp, Homo sapiens
atctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgc

SEQ ID NO: 49060 - DNA, 201 bp, Homo sapiens
gctaggacctatgtagatgagcttagattctcagatatttatttggctttaacagtgtgctaggatctatgtagctgttgttaccaaaagatgtacacaaraaagttcctagcaacaatatttggagccccaaagtggaaatagtccagataccagttgagagtaggatagataaagagactcaatacagccacataatgg

SEQ ID NO: 49061 - DNA, 201 bp, Homo sapiens
tactcaaacatgtataatccatatgcatgaacataactcccctattgggaatttctcataaagaatccccccaaaatataataccacgtccacaagaaccmacccacaggccaggtactgtgcgaggcactggaatacaatgggggtaacatggactaggagactcatgaaaacgtcatgacaaacacctgggaaattctg

SEQ ID NO: 49062 - DNA, 201 bp, Homo sapiens
gggaaaccaaccagctatatatttcctgcaacatgagttaatgaaattccgttccttcttacacagctgtattcggtttgttttacattgtttggtatgtraaaggatttggctttgcgttacagaactaattgcttactagatattacatggatatcaaaatactttataaatattaattaatcttcacctaattccctg

SEQ ID NO: 49063 - DNA, 201 bp, Homo sapiens
tggtagtccctgcttctagagctaatgcctcaactgatgggaaacatgcttagaacatagtcacaaataaatggaagctgctattattattattattgtcyttataatttctgctgttactattattatcattactttcattcatagacctcagctagatccacttttcttataatggccatctgaaattggctttaagaa

SEQ ID NO: 49064 - DNA, 201 bp, Homo sapiens
tctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgca

SEQ ID NO: 49065 - DNA, 201 bp, Homo sapiens
ggaacaaaagtatgagtctttcgtggtttctgttgaattttgccatgcttttgaaaaggattatactggtttacaataccatcaggtggaatgtgactctmctgatttataacaagaatgtttgtctttcatttttctaatttgggctcttttttgacaatagtattgataataactgtagcaacaatagcagcagttaat

SEQ ID NO: 49066 - DNA, 201 bp, Homo sapiens
ccccagtaccccacattgcctgggcttagcttatctccattctaacttccttcaattctcccttgctgtctgtgccaatctaactgcttacatccagttckgtagatgccgcaggactttgcatatgttatggttttctctgcctaagtaataggtccccaattatttataagagtagtaaattgatgtctgtcttccaca

SEQ ID NO: 49067 - DNA, 201 bp, Homo sapiens
cggaagcacgggactctggttgagtctaggcactgtctgcatgtacttggcacattccttaaaaatggcagcaagcagtccattctcaaatggaaattggwacaaaaaataacgtaaaaccataaataacagaaaagaatatatactcaaacatgtataatccatatgcatgaacataactcccctattgggaatttctca

SEQ ID NO: 49068 - DNA, 201 bp, Homo sapiens
aagacgatgtttagagtaaccaacattattatttgctgaactttcttcctttgccaagctcttgagtaaacatttcatagatatatctcatttaatcctamagcagtcctacaataaaaatgttattgttactacttttttttcccccagatgagggagcaaagtttttgaaagctgaatggtggcagggctgggatccat

SEQ ID NO: 49069 - DNA, 201 bp, Homo sapiens
tgaactggtgaaaaggtccctgagagttcgggtccctgagagttgcaagcacaaatcctgttaacaggtaataagattatgagcatagcccatgtagagcrcatggttttatcagctgaagtgaagcaccaagatgccaagttgttaatggaattcagcatctgtgtctttcatgggtctctaaatagacaaggttcaatg

SEQ ID NO: 49070 - DNA, 201 bp, Homo sapiens
ccatcctcaaaagcacgcctacactcaagtctttgtctcaggctcagcctggaggagcccaagttagaatggaaccccagctctctttctttcccccccckcctctctctctgtctctctcccctttctctttttctctctctctctttctttctttcagtggagtcttgcttcatcgcccaggctggagtgcaatggcac

SEQ ID NO: 49071 - DNA, 201 bp, Homo sapiens
ctagaatatctactcccccaagtctgataatgagacataggttcaaagctgtccccaaggatggggggctttaatttccaggcacttgccgccagctgtgygcaagggaaacctgggatccatcagctccaatatcctgtcttcttgaggcctcggccttccaacaacatcaggagctggctgtaggttgtgttcgctctc

SEQ ID NO: 49072 - DNA, 201 bp, Homo sapiens
agggtgaagaaggtgagaaatgccttctgcagagagggagcactatacacaaagggtgggacagtagagtagggagatgcaagagtgggtgaggtgtgagstatgcagtgaagacaaaggcagaggggaggctgatggacagcctagtcatggaggaccttgagtgctaagtattgttttgcaatgaagatccataattat

SEQ ID NO: 49073 - DNA, 201 bp, Homo sapiens
gaagaaaacagtgcacagttgctgctggttcccaatagttgatttgactcctttaaagatttagcacctgagttagaatccggatggcagaacttctctaytggaacctagtcccactattcctctctcccttcattcaacactgggtttagaatgcttgccagcagcattgtggaaattacctcaaaggtagaaacacgt

SEQ ID NO: 49074 - DNA, 201 bp, Homo sapiens
ttataattacctcttctttaaaagcagaatgaaatattttatgtatgaagatgttactgttgaccctaaatgcattaagagtcaaggagacatttttcacrtattgaaaataagatttgattgagtgcttgcaagtggcctagtgaaatctcattaaaccactgtttaatactttataaatggcagaatattaaccattaa

SEQ ID NO: 49075 - DNA, 201 bp, Homo sapiens
ttcaaagctgtccccaaggatggggggctttaatttccaggcacttgccgccagctgtgtgcaagggaaacctgggatccatcagctccaatatcctgtcytcttgaggcctcggccttccaacaacatcaggagctggctgtaggttgtgttcgctctcctggcttttagccaccccaaatggcagccaggacagctggg

SEQ ID NO: 49076 - DNA, 201 bp, Homo sapiens
tcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactact

SEQ ID NO: 49077 - DNA, 201 bp, Homo sapiens
agaagaaaacagtgcacagttgctgctggttcccaatagttgatttgactcctttaaagatttagcacctgagttagaatccggatggcagaacttctctmttggaacctagtcccactattcctctctcccttcattcaacactgggtttagaatgcttgccagcagcattgtggaaattacctcaaaggtagaaacacg

SEQ ID NO: 49078 - DNA, 201 bp, Homo sapiens
atcctgtcttcttgaggcctcggccttccaacaacatcaggagctggctgtaggttgtgttcgctctcctggcttttagccaccccaaatggcagccaggrcagctgggagaatggcagccccccaccctggacgggtggggcagctttgagaaagataggtggtgagaggtcacagaaggaaagaattagctcccaaact

SEQ ID NO: 49079 - DNA, 201 bp, Homo sapiens
ttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactac

SEQ ID NO: 49080 - DNA, 201 bp, Homo sapiens
aatataatatgatgcttatatatttatagactgtgcattctcattggggctatatttcccccacaggggtgaaataggttcgagggtggggggacaaaaaytgcacttacaaatgtaaagtatagatatacttgtagtacctaaacagatataagtatatctgtgatattaaaattttacaggaatagtggcaattagaaa

SEQ ID NO: 49081 - DNA, 201 bp, Homo sapiens
gaaggttctcgctctaggcctttctggatatgggaccacgagctagtcagtcaatctctctgagactcagtctcttctcctgtaaaatataatatgatgcktatatatttatagactgtgcattctcattggggctatatttcccccacaggggtgaaataggttcgagggtggggggacaaaaactgcacttacaaatgt

SEQ ID NO: 49082 - DNA, 201 bp, Homo sapiens
cattttaatatacttacttttcttcatacctgtctcaagagagaaagtagctcagtggttaagactggagtcaggctgcctgggtataaattgcacctccrttgcttattagctgtatgaacttgggcaagatatttaatctctctgtgcctcagttttcacatctgtaaaattatgtcaaatagtactgatctccaaggg

SEQ ID NO: 49083 - DNA, 201 bp, Homo sapiens
cagtttccttgatccccaaggaggactcatggttaagatttattacggtgaaaatatacaaaatgaaatcagcaaagggcaaaggcctgtgagcgaagtcyggaggaaatcagttacaagatttccacaatcccctcccaatgcagtcacacaggatgtgcttaactcccccaagcaacatatggtgacaccgtgtgtgaa

SEQ ID NO: 49084 - DNA, 201 bp, Homo sapiens
ccttataaaattattgaaatggttatgctaaaaaaaatgtgcaaagtctttagaacagtgcccggcacatgttaagtactgtttagctatcagccataatyttaaaaatagtgtttttaaaatcagtaatattattgacaaccttttctgaatattgtccaagtgctttacagggattatttcacttatcatgggaatgat

SEQ ID NO: 49085 - DNA, 201 bp, Homo sapiens
tcctgagagctcagctttgcttggaagttgctattttccaaaacagcttgagctaaataaagatggctgggatagttgatagttgatatttgacacctagstcagccgatggtgttcaggttgttgctatggcctggtagtaaagtcccttttctggttactttttacttgttgcagtaactgtgatgtggcttttcaacc

SEQ ID NO: 49086 - DNA, 201 bp, Homo sapiens
ttcctctacctagcataatcaaatactactatgaaatatgcaagagtctgtgtcatcactgacattcagtcttggatttattttttttaactctgtgtacyagacactgcctcttggatgtcccatagttcattgaactctccaagtgcaaagttaaactcaatctccccaccaacctctaacctcaacccagccccagac

SEQ ID NO: 49087 - DNA, 201 bp, Homo sapiens
cccttttcattgcagatgcttgcgtgttcccatcactgagttctaatttctctaatggaagtatcattctaaagttatcctttgtccttcttttattcttrttcatgggtatctccactagaaggaggatatatttttctggcagaagaacatgcccgtcctatttattgtgttatcactagtgtccactatagggatgga

SEQ ID NO: 49088 - DNA, 201 bp, Homo sapiens
agtagaaaagtgaggaaataagacaggggagggaaggcagccaataacgtaaccagccagctgctttcatgagagactggagcatcgtcccaccaggaaayaataaaaaatagtgtaaaaacgcataagcttcagagaaagatatgggagctggggagtggatatgccaatcccattcttgactgattgaaggctgctgct

SEQ ID NO: 49089 - DNA, 201 bp, Homo sapiens
cgattattcaccctgaatctaaggcaagctctgctctaaaatgtcacacaagaaagaagtggaaaacctcttctccaggaggggtttgcaatgtaaataargagacaaagaatgccttaggtgtttcctctacctagcataatcaaatactactatgaaatatgcaagagtctgtgtcatcactgacattcagtcttggat

SEQ ID NO: 49090 - DNA, 201 bp, Homo sapiens
aacaccagtagaaaagtgaggaaataagacaggggagggaaggcagccaataacgtaaccagccagctgctttcatgagagactggagcatcgtcccaccrggaaacaataaaaaatagtgtaaaaacgcataagcttcagagaaagatatgggagctggggagtggatatgccaatcccattcttgactgattgaaggct

SEQ ID NO: 49091 - DNA, 201 bp, Homo sapiens
ccaatttcctatcgatttaagttgttttcacttttctacacttccatcaattctgcagaagagagctcatctcttcccatgtttgtgacaatttctatagratatatttacatgagctggattaatgggatggcggatatgccctgttatgttttgatccctattcaggtgatgcttctaatcagaggattttagtctgta

SEQ ID NO: 49092 - DNA, 201 bp, Homo sapiens
gcagttcattaaacatgcattcgtttttgtttttatttggcacctactgtgaatcagtcactgtgttaggtgctgtgaatacagtggggggacaaaaacakatacaattgtgttagagaaaaataaactttgaaggaaactgcactagaagatacagcatttagtcattgctgggattctcttcattgcaagcagctactg

SEQ ID NO: 49093 - DNA, 201 bp, Homo sapiens
aaagataccataaaaatacagtataaaatatttaaaatggtatccctgtataggaaagctcgattataatctaatgagacaactttcctatatgtggcccrtcattgactgatatattgttatccagcaatgactgtacttaagtaactttaatagaagcatgaagaatgtagtagttgtcatttgaaaagggccttgcta

SEQ ID NO: 49094 - DNA, 201 bp, Homo sapiens
tgcatgtcatgttgagaaacttggatttcaccctggaggcgcaggaactaggggggatttttcagcagcagtgacagacgctcttaaatctgggttttccwatgatcagcatgcttgtgcctgcaccggggcgcaggatgggagacagatgccttttgcagtagttccggagaagaagactgaagaccacattcaaggccc

SEQ ID NO: 49095 - DNA, 201 bp, Homo sapiens
ggaaaacattgagctgaatacttgggcttttgcacctttttgtagtgccttagtgtattttacacaaaaaaataaataaaagtatgctcagcctcaggtgygttggaaatacagaggagagaccagcccaactttggaggagaacagagagagggacccaggaaggccttctggggaatatatttgacttgggccctgaag

SEQ ID NO: 49096 - DNA, 201 bp, Homo sapiens
cacccaataacacgggtttatgtaatgtacatgggtaaatgtacatcttccaagggagaaagggtgctctgtgtttccagcatgatggaacccagtttcaygatggattggcatattccatagatgaagaataattactggaaagaatgcagagccattggggactttctaaatagaggaatgatgagataagatatttgt

SEQ ID NO: 49097 - DNA, 201 bp, Homo sapiens
ttctaaacttttttaatgaaaggaatcatgcaacacttgcccttccatgagtagcttcgttcacttagcaagatgttttccaggttcccccatgttgtagytgatgtcagagcttcatcccattttatagctgagtaatattccactgcgtgaatatatcacgttttgttcattcattcactgatggacagttgggttgtt

SEQ ID NO: 49098 - DNA, 201 bp, Homo sapiens
aagttctacttgaaccaattaaaatttttagcctgtgtcacctcttgaggcagaggatattcactaggactttactcaagctgcttacataaaattatttygaatatctgcatagatttcttccacataattaaagttacttcaaaagttaaatgtttaagaatgccctgaaagtctagtgtgattgtgagcgtgcataca

SEQ ID NO: 49099 - DNA, 201 bp, Homo sapiens
accttgcaagattatctgttataaataaacaatatagtatactgacacaaaaatctttgtgggcttatttccatggaatctctgcagaattttgttttaakctttgaacatctctgtggttcttgagacatactttcagactgccttccaggaagattgtatcaagttgagattccactacggtgatccttgtgtttgtgt

SEQ ID NO: 49100 - DNA, 201 bp, Homo sapiens
cctaatttctagacatactcagcagtctgctttgaaagctcatcagcttctagaagcagctcatcgttaaggagataccatcagggtaaacacatcagttyagtcttttttgcaacattgctaattccacgttgtaatcaaggagaaataaatggaaaactcttacttagtattagtttatttagacccatttatttccat

SEQ ID NO: 49101 - DNA, 201 bp, Homo sapiens
gatctcctcattagatgaggccatcagttacagcggaaatgatcattattggaaagctggagaccagctgctgtcagagagggatgggctcctgtggaagsttgcaaactgatgactacttaatccttgaacttcagcagcaacaacattagctgaaggtctgtaatgcattcacagttctcatctgacattttccccaca

SEQ ID NO: 49102 - DNA, 201 bp, Homo sapiens
cttggctcttgagacaggaatcttgccgatgcccccggctgaataaaccccttccttctttaactcggtgtctgaggacttttgtctgcggcttgtcctgytacagccctacagctatattctattactagatatttggggccaggcatggtagctcacacctgtaatctcagcactttgggtgcctgaggtgggtggatc

SEQ ID NO: 49103 - DNA, 201 bp, Homo sapiens
aacaatgatctcctcattagatgaggccatcagttacagcggaaatgatcattattggaaagctggagaccagctgctgtcagagagggatgggctcctgyggaagcttgcaaactgatgactacttaatccttgaacttcagcagcaacaacattagctgaaggtctgtaatgcattcacagttctcatctgacattttc

SEQ ID NO: 49104 - DNA, 201 bp, Homo sapiens
catcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgcaatggcaca

SEQ ID NO: 49105 - DNA, 201 bp, Homo sapiens
tctcaggctcagcctggaggagcccaagttagaatggaaccccagctctctttctttccccccccgcctctctctctgtctctctcccctttctctttttytctctctctctttctttctttcagtggagtcttgcttcatcgcccaggctggagtgcaatggcacaatcttgtctcactgcaacctctgcctcctgggtt

SEQ ID NO: 49106 - DNA, 201 bp, Homo sapiens
ctaaacatagaaaagataccataaaaatacagtataaaatatttaaaatggtatccctgtataggaaagctcgattataatctaatgagacaactttcctrtatgtggcccgtcattgactgatatattgttatccagcaatgactgtacttaagtaactttaatagaagcatgaagaatgtagtagttgtcatttgaaaa

SEQ ID NO: 49107 - DNA, 201 bp, Homo sapiens
tgataagagaccaaatggtttagtcatgaaaagaatgttggaagatcattcatatgcaaaagaggaaattggaaaaaaccaatagcagctttgaatattaygggatcaacatggtagatgatgttgaaattacgcaggaagatgtcaatggttaagaaacaaggctcattgcttttatagattatattcaggtgatcacca

SEQ ID NO: 49108 - DNA, 201 bp, Homo sapiens
ctcagctacttgggatgctgaggcaggagaatcgcttgaacctaggaggcagaggttgcaatgagccaagttcacagcaatgcactccagcctgggtgacwgagttagactaggtctcaaaaaataaaaataaaaatgaataaataaataaatgtgtctacaaacagaggtttttgagagtcaggcataagcccccacctt

SEQ ID NO: 49109 - DNA, 201 bp, Homo sapiens
aaataaataaaattagaaatgaaagagggaacattaccacttataccacagaaataaaaaggttcataagagacccctatgaacagttccctgccaaaaaraatgaaaaaaaaacctaggtaacctagagaaaaatgagtaaattcctaaaaacatacaacctaccaagattaaatcgtgaagaaatagaaagtccgaacg

SEQ ID NO: 49110 - DNA, 201 bp, Homo sapiens
atctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagatagga

SEQ ID NO: 49111 - DNA, 201 bp, Homo sapiens
ccccacacccttcctgtttattgacttaaagtattgtctttgaatgttgaaaaaagtttttagaaaatgctgaacttacagggaaattcaccaaagtaatwgtaatatcatgaagatgctcattgcttctgggctttccaaatctcatctttcctcaattgtgccttctctgcatgagcctaatttgaaaaaaacctggtt

SEQ ID NO: 49112 - DNA, 201 bp, Homo sapiens
tctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagataggag

SEQ ID NO: 49113 - DNA, 201 bp, Homo sapiens
tccttaggtcatcactggaattttagtgaagaagtgctgcccagggatggcatcattaacatgctgcagagcccttgagcttggaggagacagcacttgarttatggtacaattcactgtaaatgtgttttatggtcgcctaaaatgtgtttaggtgaccataaaacacgttttatgaaagagttgcataatccaatcaga

SEQ ID NO: 49114 - DNA, 201 bp, Homo sapiens
cccacacccttcctgtttattgacttaaagtattgtctttgaatgttgaaaaaagtttttagaaaatgctgaacttacagggaaattcaccaaagtaatastaatatcatgaagatgctcattgcttctgggctttccaaatctcatctttcctcaattgtgccttctctgcatgagcctaatttgaaaaaaacctggttc

SEQ ID NO: 49115 - DNA, 201 bp, Homo sapiens
tccctccgtcctatggcagtctgggacgtggctgtacactataactaaactttaagacatctacaagtaagaaacgtgaataagaacttcacctgggaaamcagtctagaagagggaaatccaacatggactgaacagtctagaagagggaaatccaacacgtactgaacagtctagaagagggaaatccaacagggactg

SEQ ID NO: 49116 - DNA, 201 bp, Homo sapiens
attgtccattcagtgtgaatgagcttgggagtacaaccactttggaaacccattttgttaatttacctttgatagatacttattgaacggtttttccaagygtctgtgaagaagacatggtggtggtagggggtgggtggatggtttctgaggacctgataatgtttctccttgattttagtgccagttacgtggcaactc

SEQ ID NO: 49117 - DNA, 201 bp, Homo sapiens
atctcatctttcctcaattgtgccttctctgcatgagcctaatttgaaaaaaacctggttcacagagggctgcttaagaagttgatggttttgtttatacycaaagtcattgtggggacctctattttcaccttttttggcctaggttgtcccagtacttctctcattctgtgattgatgtcataggtgacaagtgtgatg

SEQ ID NO: 49118 - DNA, 201 bp, Homo sapiens
caccatagcatgcttacaacctcggtcaagaaagagctgtgatcccaccgtttgtccatcgagttctaagctatggtatttgtaaaaggtcattctgctckcccgacattaacctgaatggaacagctggaacgtaaattggaaggaggagtgatgattctccctttggccatttgatgacttgggaattaaatgggaccc

SEQ ID NO: 49119 - DNA, 201 bp, Homo sapiens
taacgtgtgagaaattgcttaatgagtacaatatatgttactcaggtgatagttacactaaaagccaagacgtcagcactctgccacatgtccgtgtaacraaactgcacttgtactgttaaatctatacaaataaaaaagaaactgaatctttgccaagttgctcctaactatgtctgaaggtcctctggtgatatctca

SEQ ID NO: 49120 - DNA, 201 bp, Homo sapiens
gacgggctattgacattaacagttggataggctgctaggtcagtccagggaaaagcaggagggaagataagacatgactgagaattcaggaagggccagcrccatccaatcagaacaagttggagcttttcgtcttctttaagcctactagtttcacttctcattttgaaagaaacaacttgctcggccaacctattgttg

SEQ ID NO: 49121 - DNA, 201 bp, Homo sapiens
gccttctctgcatgagcctaatttgaaaaaaacctggttcacagagggctgcttaagaagttgatggttttgtttatactcaaagtcattgtggggacctstattttcaccttttttggcctaggttgtcccagtacttctctcattctgtgattgatgtcataggtgacaagtgtgatgggtcacttcactggcctctcc

SEQ ID NO: 49122 - DNA, 201 bp, Homo sapiens
ttccaatatttcccaccataaatctcctcctggaccataaccttttgtttctcccaattttctctctcatggaaacaactcccatggaaacaatcacacamacacacacacacacacacacacacacacactcacgtggttacctttttgccagttttccagcctcctggactgaacagtctagaagagggatccaacatg

SEQ ID NO: 49123 - DNA, 201 bp, Homo sapiens
ggtcaaatctctgagattcaaatcctggctctgccactaaatagctatatgtctttaagccacctaattaacctctctgtgcctaaggattctcatcagtragatggggataaaaatacttgccttataaaattattgaaatggttatgctaaaaaaaatgtgcaaagtctttagaacagtgcccggcacatgttaagtac

SEQ ID NO: 49124 - DNA, 201 bp, Homo sapiens
ttgctcctaactatgtctgaaggtcctctggtgatatctcacaccggctcagaaccaagacagtcggctcccttgtcatagccattgggatttccctcctscatatcccaggcccccaccctgatgggcaccattgcacatgtcaggcccgccctgatgggcaccattgcacatgttaggacccttggctgctggctcatg

SEQ ID NO: 49125 - DNA, 201 bp, Homo sapiens
ggtttgagtctcaactccgctgccctgtaaccttgagcaaaccccataactgtctctgcttccgacccctcatctgttgaatgggaaaagagtaataagcyctatatcctggggttcctgagaggaggaattgaagcatgtaacatgcttaagacagtgcccggtgtgctgtaagttgaaactgtgtagggatcctgttgc

SEQ ID NO: 49126 - DNA, 201 bp, Homo sapiens
ggagcttcttccttctttttgactctcatgaccctgtcctcagcagattcacctgtgactatatctgtttctctttctgggtcttatctcttcttgtgcckctcatgtttaagtatctcccaatattcagttaataacattttctgttttctgtaggtagaaactgccatgcccacaggtcgagctatgacatgcatactg

SEQ ID NO: 49127 - DNA, 201 bp, Homo sapiens
aagtgtgatgggtcacttcactggcctctccaggcggtttattctttagctgacttcaccttgctctggccttatgtaaaggtccctgccctctggctttyagtgggttcaacccacaagtctgcaaactttctcaaagagccagataataaattttcagacattgcaggccatccagtctctgggcagctacactactct

SEQ ID NO: 49128 - DNA, 201 bp, Homo sapiens
aagtagttgccacatgcctgactctcctaaatgctctgcaaataggttagatttccagcaaatgaaaacaggttaggcagctcaatagaatattacataaycattaaagaggatggttataaagatgatgataatggcatggaaaaatcatatgaatgagaattgaatactaaacaggagattgtgtgtgcagtaggattc

SEQ ID NO: 49129 - DNA, 201 bp, Homo sapiens
gtcacttcactggcctctccaggcggtttattctttagctgacttcaccttgctctggccttatgtaaaggtccctgccctctggcttttagtgggttcarcccacaagtctgcaaactttctcaaagagccagataataaattttcagacattgcaggccatccagtctctgggcagctacactactctactctgccatt

SEQ ID NO: 49130 - DNA, 201 bp, Homo sapiens
ggtatataaaatccctttcaagtatatgtcttataaaatataggtcatgaattgagtttttcagtatcaaagaaaaaaagtttaatagacttacagctttsttgctttaattatgggtgcattttttaaaaaccaagtatagtacccaagctattttattattcagaagactggctcttttcaaagaagtgtcaaaagttt

SEQ ID NO: 49131 - DNA, 201 bp, Homo sapiens
taactgaagcttaggggcaggttttccctgtgccgttttcatggtagtgaataagtctcacgagatctgagggtttcataaggggcagttcccctgcacaygctctcttgcctgctgccatgtgagacatgcctttactcctccttcgtcttccactgtgattgtgaggcctcctcagccatgtggaactgtgtgtccatt

SEQ ID NO: 49132 - DNA, 201 bp, Homo sapiens
tattctttagctgacttcaccttgctctggccttatgtaaaggtccctgccctctggcttttagtgggttcaacccacaagtctgcaaactttctcaaagrgccagataataaattttcagacattgcaggccatccagtctctgggcagctacactactctactctgccattgtagcatgaaagcagacatacacaatag

SEQ ID NO: 49133 - DNA, 201 bp, Homo sapiens
aagtatagtacccaagctattttattattcagaagactggctcttttcaaagaagtgtcaaaagtttggtttggggaattcttgtgttttctttcttgctscagttttccacttttctttagtgtgtcaccatctttatctcctatgatactagtttataataggcttctaacatggatgccttcctcttggaagtgggtt

SEQ ID NO: 49134 - DNA, 201 bp, Homo sapiens
atcatccccatctacagatgagaaaactgagtcagaggaagagttaggtatgtcagtagcaggcatgggcaaaggaaggagaaagtaatgatcaagatgayagagggagaattgcaattaagccagagagaggaaggatgatgttataagctcgagggaagcctgagtccagatctgaagcagatatactcacagcacgtt

SEQ ID NO: 49135 - DNA, 201 bp, Homo sapiens
gtggcccgtgggctttggtttgccaatcaatggtttagccagtggaggattgggacaagaactcagagggagagaggagaataaatctttgcaggctgctstgtccttccattgggggttacagttcttctcagggagccccctccatgtggccgcgtcttttgggtctggaaattgtttcctcccctggccctctaggct

SEQ ID NO: 49136 - DNA, 201 bp, Homo sapiens
aagtttggtttggggaattcttgtgttttctttcttgctgcagttttccacttttctttagtgtgtcaccatctttatctcctatgatactagtttataawaggcttctaacatggatgccttcctcttggaagtgggttggggttcgtgtttctatagtcaagctctgtatccttaaaaaaaggcctgcttttcagaatg

SEQ ID NO: 49137 - DNA, 201 bp, Homo sapiens
gaggtgcatcttgtcatcatccccatctacagatgagaaaactgagtcagaggaagagttaggtatgtcagtagcaggcatgggcaaaggaaggagaaagyaatgatcaagatgatagagggagaattgcaattaagccagagagaggaaggatgatgttataagctcgagggaagcctgagtccagatctgaagcagata

SEQ ID NO: 49138 - DNA, 201 bp, Homo sapiens
tctgtccttccattgggggttacagttcttctcagggagccccctccatgtggccgcgtcttttgggtctggaaattgtttcctcccctggccctctaggsttagatgtgggaaaggtgccccattattactggcatgttgctttatgctgtgggccccttttccttgactctgactgtacttttgctggttcctgcgtcc

SEQ ID NO: 49139 - DNA, 201 bp, Homo sapiens
ttggggttcgtgtttctatagtcaagctctgtatccttaaaaaaaggcctgcttttcagaatgatggaggacctcgctggcctgtttccctggcccatcamatccagactccagagctgctttgccatctgttcctctccttccttctcatttctgcaattttaccctctatctagctgaagaggttctatgcttgttggc

SEQ ID NO: 49140 - DNA, 201 bp, Homo sapiens
gttagaagccatttcttacctgtcttctatgaagtgtgggttgtgagcgatgctttcattcaaacctatgaggtgcatcttgtcatcatccccatctacaratgagaaaactgagtcagaggaagagttaggtatgtcagtagcaggcatgggcaaaggaaggagaaagtaatgatcaagatgatagagggagaattgcaa

SEQ ID NO: 49141 - DNA, 201 bp, Homo sapiens
gggaggagaggtcacaggaggccaaggttgtaatatggttagaagccatttcttacctgtcttctatgaagtgtgggttgtgagcgatgctttcattcaamcctatgaggtgcatcttgtcatcatccccatctacagatgagaaaactgagtcagaggaagagttaggtatgtcagtagcaggcatgggcaaaggaagga

SEQ ID NO: 49142 - DNA, 201 bp, Homo sapiens
tgaccatgttggccaggctgatttcaaactcctgacctcaagtgatctgctcgcctcgacctcccaaagtgctaggattacagacatgagtcaccgcgccyggcctaagcacatgacttttaatttactggtgctgcatggtctgtgaaaagtgggtcaaagaaatgggaagtgatgggaggagaggtcacaggaggccaa

SEQ ID NO: 49143 - DNA, 201 bp, Homo sapiens
agtatattaacaagcagtgctcactgcccatgcatatgggctcagccatcagttaggtggctctgctgatcttagctgagcttgttcacgtatttgaggtrggctttgctccgtgactttcccatattgtagcagtgtagcttgggcatgtttttagagcattggaggaggcatgagagacaagctcaattctacaggtga

SEQ ID NO: 49144 - DNA, 201 bp, Homo sapiens
tggacaggcaggttctaactgttgctgtaggcctaggaataccatgttcaaagtatggaagattggagcattggtaagaatgagctcttgaattctaaggyagtgctatctctagtctctttagtgttttctgccaggttggaagagtctttgcatgtcaagcatatgtttgccttcaaaaacaaaggtgaaagctggttg

SEQ ID NO: 49145 - DNA, 201 bp, Homo sapiens
gtttcaccgtgttagccagggtggtcttgatctcctgaccttgtgatccgcaagcctcggcctcccaaattgctgggattacaaacgtgagccaccgcacmcggcctacttttacgtctcataacccaaaagctctatggcttcaaaaattcccaactcctcaaaaagctgattttctgttttatcagtgcccctttgatt

SEQ ID NO: 49146 - DNA, 201 bp, Homo sapiens
gagtcttagaaggcccgttaacctcccagtatgtggaaaaatgcttcagatgttgacacatttcacagaagtgtcatcacattaacaaagggctcataacscataaaagttaagaaccattaattttcaggtaattcttctaaataatgggtcctggccagctctacatgatttggagcatatttacatacatttgcatac

SEQ ID NO: 49147 - DNA, 201 bp, Homo sapiens
ggcctcccaaattgctgggattacaaacgtgagccaccgcacccggcctacttttacgtctcataacccaaaagctctatggcttcaaaaattcccaactsctcaaaaagctgattttctgttttatcagtgcccctttgattgataaacaatatattaatataagatggatataaagcagatgtattttgttgccacaac

SEQ ID NO: 49148 - DNA, 201 bp, Homo sapiens
ctggtgatccgcctgcctcagcctcccaaagtgctgggattacaggtgtgagccaccgcgcccggcctaaatatgtttcttacatggtcaaagaaaccttytagatgtgattaagttaaggatcttgagatggagacagtgttattgactatctggatagacccaatagaatcagaagtgtccttacaagagggatagagg

SEQ ID NO: 49149 - DNA, 201 bp, Homo sapiens
agcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaat

SEQ ID NO: 49150 - DNA, 201 bp, Homo sapiens
ggaagagagatattcatccaagttgatctcattgtatccatgagcctgttaattttcagggagcaagattctctagtcttaaaaatgtgtgtgtgtgtgtktgtgtgtgtgtgtgtgtgtgtgtgtgtgtgtgtgtgtgttattgggatcttttaactaggagaatcactcagaatgactctgttggaggataccagaata

SEQ ID NO: 49151 - DNA, 201 bp, Homo sapiens
gccacacactttcaaacaaccaggtctcataagaactcactctcatgaggatagcaccaaggggatggcactaaaccattcgcaagaattcacccccatgrtctaatcgcctcccgccaggccccacctccaacactggggattactattcactgtgagatttgggtggggtcacagatccaaaccatatccatcattacg

SEQ ID NO: 49152 - DNA, 201 bp, Homo sapiens
tcaaacctcaccatttttatttcccagtatacgctgaacagctttctgtcccaagaaatagccattatttttcgtcgctgaatagtgtgctattattccaytacagggatatactcatctgtttatttattcccttgttgttgactatttacattgtttacacttgtttgcagttttttaaaacattagtgggtatgctta

SEQ ID NO: 49153 - DNA, 201 bp, Homo sapiens
ctttggttcctctgctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttata

SEQ ID NO: 49154 - DNA, 201 bp, Homo sapiens
aacttaggaacgcacttccagctaagtccaactcctgggccacgtcctgcctcgcatgaggaaatgcacttctcaggcaccactgctcctcggctgaccgyggccagacaccctttcatctccccagggaatgctcaagtcagcaaagggcgccttgatctccaaggaacctgtgactacaaagacaaggggtgtccaaac

SEQ ID NO: 49155 - DNA, 201 bp, Homo sapiens
tttggttcctctgctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatat

SEQ ID NO: 49156 - DNA, 201 bp, Homo sapiens
cttgtgttgactgctgatgtgatacctctgttcttgtcttcttagtttaaaagaatttaaacaagagacacacaccaaaagaagtgcagcatagagtaatytactgcaacagaaaaagaatatgttgaaagttaggtgcagaatagcagtatcctctgagagagatgattccgggcaggctgctcacaacaatgaggcagc

SEQ ID NO: 49157 - DNA, 201 bp, Homo sapiens
aggtgccccattattactggcatgttgctttatgctgtgggccccttttccttgactctgactgtacttttgctggttcctgcgtccatctcttgtcacawagctcaatttgcgtgtgccatcaatttcctgctgggattaagatacctggcagtgcagggtttcctgggatatgggacctctaaaaccgaaacctagaca

SEQ ID NO: 49158 - DNA, 201 bp, Homo sapiens
ctgctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatatataaaacata

SEQ ID NO: 49159 - DNA, 201 bp, Homo sapiens
gtgtttgctgatttcagacaccatggagcagtggtccaagtttgaatgattttgttcccaggagacactttgggttccacactggggaagaagagggtacmactggcatcgagcgggccaaggtcaaggactggtaaacatacgtcaatgcatagaacggcctccacagcaaagaatcatttgcctcaaaatgtcagtagt

SEQ ID NO: 49160 - DNA, 201 bp, Homo sapiens
ttcttcagggagcaggcactggaagaagaaacttagctcgaaaagaactcttccttcttctcctcctcctcctccacaaaacaggaatcaggtgtctcctrataacattttagtatctctaatatctttttcttcttcttccttgtgttgactgctgatgtgatacctctgttcttgtcttcttagtttaaaagaatttaa

SEQ ID NO: 49161 - DNA, 201 bp, Homo sapiens
tgctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatatataaaacatag

SEQ ID NO: 49162 - DNA, 201 bp, Homo sapiens
gcccaaatgtaaagttggcaggagagatgctacaaattgtaggcattggttggtacctttttatagtgagccacaggaacccattcctctaagcaggatcratggacatggagctcgttttaacagtgagcattttgcgagtgggagatgttgccaggccctctgctgagggcttcctgtgtgttatctcattgacttgcc

SEQ ID NO: 49163 - DNA, 201 bp, Homo sapiens
ccccggcttctcagacagatgcaacggccttccaagttgtgatgttactgctgttgtgatgattcttcagggagcaggcactggaagaagaaacttagctsgaaaagaactcttccttcttctcctcctcctcctccacaaaacaggaatcaggtgtctcctgataacattttagtatctctaatatctttttcttcttct

SEQ ID NO: 49164 - DNA, 201 bp, Homo sapiens
aattccaaccatgttgccaagagatggcatagctggtgagggctggactttaggggccaatctccactcctgagctcccctgaccacacaggaagaaaacrttaatgatgttcccatactgatgttgtggtgtaagtgtctcctgtgtaaatagaactaaatatttaggaaagaaaacagaagagtcttatgtagtgcatt

SEQ ID NO: 49165 - DNA, 201 bp, Homo sapiens
gctgaagtgcagtggcgtgatctcggctcactgcaacctccatctccagagttcaagcgattctcgtgcctcagcctcccaagtagccaggattgcaggtrcctgccatcaggcccagctaatttttttttgtatttttcattgagatggggtttgaccatgttggccaggctgatttcaaactcctgacctcaagtgatc

SEQ ID NO: 49166 - DNA, 201 bp, Homo sapiens
gctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatatataaaacatagg

SEQ ID NO: 49167 - DNA, 201 bp, Homo sapiens
aatactagcaaactgaatccagcagcacattaagaggatcacaggtcatgatcaagtgtgcatgggagtcaggaattgttcaacacacagaaatcaatcawtgtgatacaccacattagcagactagaaaataaaaaccacatgattgtctcagatgcagaaaaagtacttgacaaaattcagtgccctttcatgataaaa

SEQ ID NO: 49168 - DNA, 201 bp, Homo sapiens
ttctctccagaattattttacataagagaattatgaacttctgtcttatgtaactcagtgttatgttgaattccctgtatttgtagccaaatctaataacwgctgaaatatgcagcatcactcaaccagtaaaaattagagcccagactatatgacgttgagtcaagccacgctttttaaccactgtgctttgctgcttga

SEQ ID NO: 49169 - DNA, 201 bp, Homo sapiens
ctgcgctgggctaccccggcttctcagacagatgcaacggccttccaagttgtgatgttactgctgttgtgatgattcttcagggagcaggcactggaagragaaacttagctcgaaaagaactcttccttcttctcctcctcctcctccacaaaacaggaatcaggtgtctcctgataacattttagtatctctaatatc

SEQ ID NO: 49170 - DNA, 201 bp, Homo sapiens
cgtgcctgttactatctaattgacttcccgaagaataactgtgatcatatcatgccctcttcaaaggctgtcagtcttcccatgcttactgagccacaacsaaatgagtcccaacctgctttgtcactttcagccctcacaattccctgtcattcatgtgattctcctaccaaagtaagctgcttatcttctatgttcact

SEQ ID NO: 49171 - DNA, 201 bp, Homo sapiens
agacggagtctcgctctttcacccaggctgaagtgcagtggcgtgatctcggctcactgcaacctccatctccagagttcaagcgattctcgtgcctcagyctcccaagtagccaggattgcaggtgcctgccatcaggcccagctaatttttttttgtatttttcattgagatggggtttgaccatgttggccaggctga

SEQ ID NO: 49172 - DNA, 201 bp, Homo sapiens
cttgcttgcccttggaacaaagcctgtggctggtgtttaactatcatgggagatactagtgtggctgaaaagtctgtgttctgaacagtactatggcactrtagacaaactttcaaggtcaaattgattatcctgtagtttagcaaagcagcagctccctaattatgtcaggaggcaggattatctctgatcatttgagct

SEQ ID NO: 49173 - DNA, 201 bp, Homo sapiens
ctgtcgccctaaccaaggatatgccccaatttctctcttggactctttcaacagcctcatacctggcatacctgcacctatttaaaatatatatatatgtgtgtgtgtgtgtgtgtgtgtgtatgtgtatttaaaataaacccctattttatttatatatataatatataaatatattttatttatatataaaacataggg

SEQ ID NO: 49174 - DNA, 201 bp, Homo sapiens
tggctgcatagtattctgtggtgtatgtgtacattttctttatccagttcaccattcatgagtacctaggttgattccatgtctttgctatttgaatagtrctgcaacaaacatatgagtgcatgtgtctttttggtagaacaatttattttattttggatatatacccaggaatgagattgcttgttttaagtgctttga

SEQ ID NO: 49175 - DNA, 201 bp, Homo sapiens
aggatgggagacacttttctaatctaatcatctgcgctgggctaccccggcttctcagacagatgcaacggccttccaagttgtgatgttactgctgttgkgatgattcttcagggagcaggcactggaagaagaaacttagctcgaaaagaactcttccttcttctcctcctcctcctccacaaaacaggaatcaggtgt

SEQ ID NO: 49176 - DNA, 201 bp, Homo sapiens
agatactagtgtggctgaaaagtctgtgttctgaacagtactatggcactatagacaaactttcaaggtcaaattgattatcctgtagtttagcaaagcarcagctccctaattatgtcaggaggcaggattatctctgatcatttgagctaggactccagataaaacatcaaaagcaatatttaaataacacacagccat

SEQ ID NO: 49177 - DNA, 201 bp, Homo sapiens
agctgatggtatcatttccagtctaaacgccagcaggaagggccaatgtattgtttaagtccgaaggctggagtggactgatgttgtagttcaagacaggyctctgactcagctttttggttctgttcagacccgtaagtgagtagatgaggcccaccacattaggaagggtcatttccttttctcagtctaataattcaa

SEQ ID NO: 49178 - DNA, 201 bp, Homo sapiens
agtgtcactcggcccatggtcacattcccagggcagctctgccttgctggagctggggtcatgcacctccctgctccaggcaccttggctagtgatcaacygggatgatgttcccagatacacagcacagagggccgctgactgagaaggagggatgaacatcctgtctggcaaatgaagcttactgctgggagtatggag

SEQ ID NO: 49179 - DNA, 201 bp, Homo sapiens
gggctccctctgattcttaaagcctttccaggtagcaacaggagatcacgcaaagccacgtaagtgtctgattcagtcctccctggtcagttttccagcawagcgttttgcaaaatgtgttctgaagagatactggttccatgggaggttaatatgggttctggggaaaaaaaattaggggaatcaaaaaattacttgtat

SEQ ID NO: 49180 - DNA, 201 bp, Homo sapiens
ttatctctgatcatttgagctaggactccagataaaacatcaaaagcaatatttaaataacacacagccatggttaaggattcattgcattttctcttacyataaaaccaaaattgtggtggcccattttgttccattactggaagggttttccaggctgttttaactcatacatagtgtaaccctttcccttattacaaa

SEQ ID NO: 49181 - DNA, 201 bp, Homo sapiens
gtcatttccttttctcagtctaataattcaaatggtaatctcttccagacatgcccttacatccagaataagagttgcccaagtacctggttaccccatgstcagctgagttgactcataaaattaatcatccaactgttgtaggccaaatgttggccccatgatctccacctcctggcattactcctgcagttatgtggc

SEQ ID NO: 49182 - DNA, 201 bp, Homo sapiens
ctggccctgagcacagtccttgaacggagagagaagggagccactctgggtgacctcctgcatctcagaaacttgcctactttgtcatcagcactgctttrtgacaaaggttttgctaactccgtttacagatacaggtattgtggattcgcagattcgtagaggttcggtacttgctcaagcagcccagcttggtggtag

SEQ ID NO: 49183 - DNA, 201 bp, Homo sapiens
gggaaaggagctcccacttcttacattcagtgctcatcactctgcaaatcaaggccccccgaactcctcccacccctgccttctgcgtctccctctgtgcyctccatcacccccctacggagttcctttgattctcaggtcccttaaccatggaacgtactcctgtctgccctcactcgtgggttgatgatttctatcctt

SEQ ID NO: 49184 - DNA, 201 bp, Homo sapiens
ctactgtgaaccccacggaggtcatacttctcacccacagatactgttgttgttttaagccacttaatttatgataattttttacaatagcaatagaaaamtaatacagaatgtggttacattatcttacataccatttaagagtaaagctgcttttcacaacaaaataacagggatttttttaaaaaagcacacacattc

SEQ ID NO: 49185 - DNA, 201 bp, Homo sapiens
aatataaaactttggttttcctgttccatttgatccactgtgatcacagaggcagggttatcttgctataaagctactgaggattgggcgttggagtctcrtttaccagagcccccgtgggtgtcgggggtacggagttacaggttccaggcagggaggctttaggcatcaccattgccagggagttgcctaacgatatct

SEQ ID NO: 49186 - DNA, 201 bp, Homo sapiens
agatgtaaatgctctggagctagatagtggtggtgattacgttagctctctgtaaataaaccccaaacctgggaatcatatatcttaaccggctaagcttyatagtatgttacacatgtctaaataaaactggtattgaataggaaaacaagcaaaccttgggcaggtcagcctcagggctcctgtttgttcatgagcaca

SEQ ID NO: 49187 - DNA, 201 bp, Homo sapiens
tgtggtggttgacacttaggaactctcaaaaaagtgtataaattgccttgatttatcacatactgtgcgtaagttatgctgttctcattcagccaacagtrtgtttaatacccaaagccctctttttttttctccttctttgtttttggcatataacagcttattgcagtataattcatagactgtatgattcacccattt

SEQ ID NO: 49188 - DNA, 201 bp, Homo sapiens
ggtaacagaaagaattatggtagtggtaatttttaaaaccttctgaatttggttaagcaccctcctgcagatattctctttcccactagatggtaccagtrtgccaaagccctagaatgctaccttagggcctcgtctttgacatgtgatatattctcattacttttcaacaatgaatgaataagccagttgaggtcaaag

SEQ ID NO: 49189 - DNA, 201 bp, Homo sapiens
tgttctcattcagccaacagtatgtttaatacccaaagccctctttttttttctccttctttgtttttggcatataacagcttattgcagtataattcatmgactgtatgattcacccatttaaagtatataattcaatgttttttggtctatttataaagttacacaatcatcgccacaatcaattttagaccatttaat

SEQ ID NO: 49190 - DNA, 201 bp, Homo sapiens
atcatggtacttctttagggtcacatatcactagattatttgcattaacttttatcaaggtaaagatgctaatagtcaactatggaacataattctcagastagatctaacataggaataatttagctttgtaatatttatctggactacaatttttaaggcacttttgctacccaaaagtatcttggggttaaacacgct

SEQ ID NO: 49191 - DNA, 201 bp, Homo sapiens
gcacattacatttatcgtacacttaatttctattattattaccttatataatgaaatagttatacaactcaccagagtgtagaatcagtgggagccctgarcttgttttcctgcaactagacagtctcatctagggtgatgggagacagtgacagatcatcaggcattagattttctgaaggagcatgcaacctagatccg

SEQ ID NO: 49192 - DNA, 201 bp, Homo sapiens
atataacagcttattgcagtataattcatagactgtatgattcacccatttaaagtatataattcaatgttttttggtctatttataaagttacacaatcrtcgccacaatcaattttagaccatttaatgactcccaaaatgaaattctgggctcattaacgatcatttctcatttcctcgaaaactctttggtactaga

SEQ ID NO: 49193 - DNA, 201 bp, Homo sapiens
cataaaatcatttgatctggtgggatctcatcttcttaatgtgtctgcccatcatctgttcctgggaggctttattagggcagtgtgtgcgtgtgtgcgtktgtgtgcatgcacgcaccagtgccatgagtacttgtttaaagtacctccatgtaaccacaattcactgtagttgctatgcactagttacccatgttatct

SEQ ID NO: 49194 - DNA, 201 bp, Homo sapiens
tttttgtgagaattaaataagtgtatgttaatgatgtcatcctatgcttaagaaatgttggttgtattacttttcaccctatgctccaaggaattttatgktctgaaggtgtcatggggtcttggctttcaggatgtgactcacttaaggggggaaatgactgtgcatgtcataatgcgtggacattaaaaaaaataaagt

SEQ ID NO: 49195 - DNA, 201 bp, Homo sapiens
aggtgttctttgtctttctcctccactagactataagctctgttgtggtccacattgtggcttgatttgttcatttctatactcccagggcttagaacagygcctggcacatagtactcagcaaacatgaatgaacaaatgaatgaatgaatataagaaagacatcagaggcagatgaaggatctgggcggcttccctgac

SEQ ID NO: 49196 - DNA, 201 bp, Homo sapiens
gaatagggctataggctatttgggataatgttcggatatatttttaaggtagaaaaagtaagatggagaaaattgtgtgttatattactgcctgtctttgrggggatgcacattcacatacaaatttacttttttaaaaaataaaagttaggttaaatcatttttttaaaaaaatagttactgttccagttatcttttttc

SEQ ID NO: 49197 - DNA, 201 bp, Homo sapiens
ctcctttattctctagagtgctgcttcccaatgcgtggtccatggaccaagcagcttcagcatcacctgagcacttgtcagaaatgcagcacctaggcgcygcaccagacctgttgaataggaatctacattttcacaagattccaggtgatttgcatacacagtggcatttgagaagcattaatccaggggcttctttgc

SEQ ID NO: 49198 - DNA, 201 bp, Homo sapiens
caagaaagaaggaaccctaagtatgttcatcgagctactcacagaaaacagaaaatatgattacaacataaagtgataatttccataaaagaaaaagttayatgagcacatacaagagggaataacatttgaggaatctcttgaaggatgggtaggagttttttagaaaggggtggggaagcaaaaagattttgcttttca

SEQ ID NO: 49199 - DNA, 201 bp, Homo sapiens
cgtagatgaggaatttgagtctctaaaacttgaagttgcccggccaaggtcacgtagctagtaagttgtgaagctgatattcaaactaaggactaaaagayaaaaaagaccactttcttccaatgcttaaaagatgttaacagaaagagagcaaagcaacaacaagaaagaaggaaccctaagtatgttcatcgagctact

SEQ ID NO: 49200 - DNA, 201 bp, Homo sapiens
ctcttatccagccaagacagggccactttcttttaagtttatctttctcccttttcctgtgatccaatctgcgtgcctgttactatctaattgacttcccraagaataactgtgatcatatcatgccctcttcaaaggctgtcagtcttcccatgcttactgagccacaaccaaatgagtcccaacctgctttgtcacttt

SEQ ID NO: 49201 - DNA, 201 bp, Homo sapiens
gtatttaaaataaacccctattttatttatatatataatatataaatatattttatttatatataaaacataggggttttatttatataaataaataaatwtatatatatatatgtatatatatacacacacacatatatgaaggaacatagggtttggaattcagagagagatatcgagagagtttcgctcctgtttttc

SEQ ID NO: 49202 - DNA, 201 bp, Homo sapiens
cctgccatattagccacatccctgcttgatctactcattttgttcagtggtggagcgagtgtgggtcacacagctgggagcagagacagtacaactggcamtgtgagagttaccttcccgccagtgctgtctgtgtgatcttgagagcatcatatagcttctttatctgtagaatagagaggttaaacagcctgcagtggc

SEQ ID NO: 49203 - DNA, 201 bp, Homo sapiens
tgcggcaggagaattgcttgaacctgggaggtggaggctacagtgagttgagactgagccaccgcactccagcctgggcagcagattgagacttcatctcaaaaaaaaaaaaaaaaaagcgggggagggagattaatcctggtgcccttctagaactaccacctggcctttcttaattgtccacttggagtgtttgccaag

SEQ ID NO: 49204 - DNA, 201 bp, Homo sapiens
ttcatgctgaggaagaattgaattctgtttttccaagtaggcaaggaataccaggatagctgggtctctccatctcaggcaaaacagacaatctacattcwtatgctctggggcagttcctatctgtgtcatgtccttgagacagctagtataggtacttctgagagctggtaaaaattttagaaaagttgcaagccaact

SEQ ID NO: 49205 - DNA, 201 bp, Homo sapiens
ttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttg

SEQ ID NO: 49206 - DNA, 201 bp, Homo sapiens
aagaaaaaatcctttctctggaagcaaactccaaagttgggtatattcttgaatcagtacctgtcaggataaaaaaaaaccctttctttttaagaaagaamgaaagttctgtactacagcaaataaatggaagctaaaaagaaaacctggtataaagagtgtgatttaagaatttgctttctgtgcatacatttagggtag

SEQ ID NO: 49207 - DNA, 201 bp, Homo sapiens
caggaggctgaggtgggaggatcatttgagcccaggaggttgagactgcagtgagccaagactgcaccactgcactccagcctgggcaacagaggaaaccstttctaaaaaaaaaaaaaaatcaatggtacctcctatagagtcaggtgatggtgttgattatgatgatgatggcaaagacggtggtgaaggtgatggcga

SEQ ID NO: 49208 - DNA, 201 bp, Homo sapiens
cttgagtctagtattgctgtcccccgcccggcaaatggttgtagagccctcgagtcaattgaaaatgctcccatacattttcacatgccctcagttgggccagggcccagcggcttaactccatgtggctcagactttcaaatccttttccctacatcatactctactagaaaccatgcacccaggctatacttgaaggga

SEQ ID NO: 49209 - DNA, 201 bp, Homo sapiens
tttttcttcccaagtgctccatcttgcctgtaaccttagcgccttccctgggatgatgggagctccatttgaccttggtgatgaacacagacagccctagstggcgtgagcaccgctgattgataaggtgggtgtggagcttctgtccttctcagtggattgcgagaactttggctccatgtttcttcaccagggtatggg

SEQ ID NO: 49210 - DNA, 201 bp, Homo sapiens
cgctgcccattgacactggggtaggacaatccaccattgtgtgggactgtcctgggcatggccttgagtctagtattgctgtcccccgcccggcaaatggytgtagagccctcgagtcaattgaaaatgctcccatacattttcacatgccctcagttgggccagggcccagcggcttaactccatgtggctcagactttc

SEQ ID NO: 49211 - DNA, 201 bp, Homo sapiens
cacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtctt

SEQ ID NO: 49212 - DNA, 201 bp, Homo sapiens
cctgtccctgacacagaggcccagcaacagacaaagcacattagtaagattgtgtgctttgtgagatcttggagggcttcttaatccaattacagcactcsgaggggattaggaacagagacccatgtgtcagcagctccaggtggtctggccctgggcatcatacagctggagttagtagatcccaccttaggcaaatgg

SEQ ID NO: 49213 - DNA, 201 bp, Homo sapiens
cagtgggggatcctggattggattttggattaaaaaaaaaaaaaggttactagaggccgggcgtggtggctcatgcttctaatccgagcactttgggaggmcgaggcaggcagatcacaaggtcaggagattgagaccatcctggctaacacagtgaaaccctgtctctactaaaaatacaaaaattagctgggcgtggtg

SEQ ID NO: 49214 - DNA, 201 bp, Homo sapiens
taattcatagactgtatgattcacccatttaaagtatataattcaatgttttttggtctatttataaagttacacaatcatcgccacaatcaattttagamcatttaatgactcccaaaatgaaattctgggctcattaacgatcatttctcatttcctcgaaaactctttggtactagacaaccaatgatccactttcta

SEQ ID NO: 49215 - DNA, 201 bp, Homo sapiens
aggaggcagccaggcaaatgagagaaggtgctcttatgagaccctctcctcttatcggggcagaaaacatcctttctaagggtcccccggccaatttcccrtgatgtttcattgaccaatgacatacgttcttccttaacttcaaggaaagctgagaaagtccaaatctggcctttgggcctttacagtgcataaggcaga

SEQ ID NO: 49216 - DNA, 201 bp, Homo sapiens
cgaggtgggtggatcacctgaggtcaggagttcaagaccagcctggccaaaatgatgaaaccctgtctttgctaaaaatacaaaaaaacagccaggtgtgrtggtgcacacctgtagtcccagctactcaggaggctgaggtgggagaatcacttgaactcaggaggcagaggttgctgtaagccacaatcacaccactgc

SEQ ID NO: 49217 - DNA, 201 bp, Homo sapiens
tgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttat

SEQ ID NO: 49218 - DNA, 201 bp, Homo sapiens
ttttacactgttggtgggaaaattagctcattttctagtagcagtatatctctccaacaaacaagtcacctgtttttttttcctgaacacaccatctctcrtcattcttgatgctaaaatataagcatgtaggtccaaacctgtctctcctcctttcagagtgaccagagagacccttctagtgttttgttttgttttttt

SEQ ID NO: 49219 - DNA, 201 bp, Homo sapiens
tcctgtgctggtccacaatgcagtggctctcaaatgctagcatatataagaatcatctgcaatgttagttaaaatgcagatttctgggcttgccccagacytgctgtgtcagaatatgagagagaggtgtgccaggtggttctgttgttcacagggcacaccacttgtcaaggggcatggccttaggggaagcagtttcca

SEQ ID NO: 49220 - DNA, 201 bp, Homo sapiens
ccaagtgctgggataaacagacgtgagccactgcgcctggccaagtacccttatccataggacactgtcacatcctagcaccgtcctggagcttgtgtgawgtttttatatctgttttaacagttaacacccacggccgttctacatacagtgttaatgctacaattaatgctctctggctctgtaaatactagactaatc

SEQ ID NO: 49221 - DNA, 201 bp, Homo sapiens
taaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggc

SEQ ID NO: 49222 - DNA, 201 bp, Homo sapiens
ttcttgatgctaaaatataagcatgtaggtccaaacctgtctctcctcctttcagagtgaccagagagacccttctagtgttttgttttgtttttttgagytggggtctcctgtgttgccagtctagagtacagtagtgcagtcatggctcactgcagcatctagctccaaggctcgggtcatcctcccacctcagcctcc

SEQ ID NO: 49223 - DNA, 201 bp, Homo sapiens
tgtagcaaacacattttggggaggcctgagctccaggatatgtgatggagatgtctatttacccaagttttatcttccaaacttcaggtctggaaaattgyctgacagattttatagactcaggactagccacggaggacagccagtggctatgtcattctatgacttttacagcttcgaaagtgcaacagccatggacac

SEQ ID NO: 49224 - DNA, 201 bp, Homo sapiens
attgtaaaatgcaccaatcagtgctctgtagctacctagaggtttgtaaaatgcaccaatcagtgctctgtaaaaacgcaccaatctgcactctgtggctygctagaggtttgtaaaatggaccaatcagcactctgtaaagtgggccaatcagcactctgtaaaatagaccaatcagcaggacatgggtggggacaaata

SEQ ID NO: 49225 - DNA, 201 bp, Homo sapiens
gctaggactacaggtgtgcaccaccaggccctgccaatttttttaaatttatttttcgtacagatggaatctcactgtgttgccgaggttggtctcacatycctggcctcaagtgatcctaccacctcagcctcacatagtgttgggattacaggcatgagccaccatgactgtcttcttctagtcttgatgcctctcctc

SEQ ID NO: 49226 - DNA, 201 bp, Homo sapiens
gatagagtgaggcagctctctggattctcttttttttttttttttttttttttttttttttttgagacagagtcttgctctctcaccaggctggagtgcartggcctgatcttggctcactgcaacctccacctcctgggttcaagtgattctcctgcctcagtctcccgagtagctgggattacaggtgcatgccaccac

SEQ ID NO: 49227 - DNA, 201 bp, Homo sapiens
ccctgctctacgtagtgttctaccaagagcatggctgtccttggagaacagtgacagctgggcatcatcattccatgagtgttgctccctcacggtatagwcataaccagaacgtcacaataacttactctacttagacttgccaaggcctccgggaacactgctctaatattcagcacctttgtaacttcaggataaagc

SEQ ID NO: 49228 - DNA, 201 bp, Homo sapiens
tagaccccactcctcctaggtcacttcctgtgaccccacaccaacatcctttctctagaaacggccattcccaaactgtgagcctcgtgtttgtattcatsacacatatgtagcatccactgtgaagtcaaaattaaggtgaatggtaaactcaaccacctggcttcatgttgaccttgtccctagactcccattccctgc

SEQ ID NO: 49229 - DNA, 201 bp, Homo sapiens
ccatggactggtactggcctgtggcctggaggttgggaacccctgctctacgtagtgttctaccaagagcatggctgtccttggagaacagtgacagctgrgcatcatcattccatgagtgttgctccctcacggtatagacataaccagaacgtcacaataacttactctacttagacttgccaaggcctccgggaacac

SEQ ID NO: 49230 - DNA, 201 bp, Homo sapiens
aaatcatatcattgcttagaagtaagttaaatttcaaaaatcaatttaaagtatattgaaagtagattaatagtggtactgtcaatacttacatatgaatsactgaaatactggaaggctttgcatgtaagaaaagcagaactttaaagacaaacggaactcagagtggatagtacccctgaatggacagtgcttcacgag

SEQ ID NO: 49231 - DNA, 201 bp, Homo sapiens
taattataaatgtaaaacctctagctcatgctggtaatccagaaatattagtgggggtggtagcacagaaggcttgctacaggtggccttggtattctggsagaaggcatttctacacagtttcactctttctgggaagttctggggagagtttctgccagagaccaggaccttcatgggaacacattttcttttctagtg

SEQ ID NO: 49232 - DNA, 201 bp, Homo sapiens
tcaatagccactctgtagggagaattctggaaaattatcctacctgcaaaatgtaatgtgaaatatctgacatgagctgtgtggagctgagtagggaagtkgggagaataaaccacacttcctgggtttgcctctcgtctcagccacttaccagctagataactgaggtgatgggcaagcggctttacctccctgggcctc

SEQ ID NO: 49233 - DNA, 201 bp, Homo sapiens
gtgtaagagtcatgcagagaagtgacacgctgcagctctgagtcagtacgagccctggcacaccagtgtgttggtacaaaatgtcatcacgcaccagcagycaagggactctgaaaccctgggatcatatagaggcctgcataccctctctgtcagcagtcctcaaccattttggtaccagggaccggtttcgtggaagac

SEQ ID NO: 49234 - DNA, 201 bp, Homo sapiens
cgacatgacttcttaatcttccttagtgagctcaattattccttaaaaacacacacaacatagttattggtgtgaaaccctctgtgacccttgctaactcrcacactgaccctctctatggcaacaagtagaacaaggaggaaatgtaattataaatgtaaaacctctagctcatgctggtaatccagaaatattagtggg

SEQ ID NO: 49235 - DNA, 201 bp, Homo sapiens
gtgtgtacatataccccaatttagcaaggcggtttggagcatgcctcagacagaaaggattcagacagatccttcctgccatctgctagtggtaccaaccygggcaagttgtttaacctctttgagcttccaagttctccattgtaaaataatctgctgccttcctaggactgctgagtggataggattgcattcaacagg

SEQ ID NO: 49236 - DNA, 201 bp, Homo sapiens
aagacagggaaccagcaggccaggccatgcaagccttgcagctaaaagacagggaaccagcaggccaggccgagccaagccaatagtcactgacccactcygcatccaagatccctgaggcaaaatctgaaaacacacatgttaggaaagacatttgtctctctcccagatttctgatttgacaggtcatggcaccctaaa

SEQ ID NO: 49237 - DNA, 201 bp, Homo sapiens
cagtcacctctgcacctcagagatttcgggaagtttgagtgcaggaaagcagcgctccgaggccaggcctggggtgctggccgctgcggggggcacgcccwgcgctgctcaggggcctgtggtttcggagagcaccccgatccagtcccccatcgcctctctggcaggcgttgggacttggagtgagctggcagcctgcaa

SEQ ID NO: 49238 - DNA, 201 bp, Homo sapiens
ggtatttctatatgcaaagctgagacaacacttggaaagtaattaccatagtccctggttaatagtaagctttcaatgagtgttggctagcattcatgccsgtaagttatcctcttgcctagagcagtgatggctctaatgtgagttcagatccctacaataggagaaacagtgcttgttgcttttcaaaaagcagagaat

SEQ ID NO: 49239 - DNA, 201 bp, Homo sapiens
aagaatcaaatggctttttaaagtacccctagtgttttttgatgcagaaatttcttgtgatcaaatacgtgtgcaaagatccagcaacaagggtttttgtyggatctttgtttaaagcaccaaatgaaatggccaaccagtgggggtttgttcaataaattatggtatattcctacactggtattctattaaatcatgtaa

SEQ ID NO: 49240 - DNA, 201 bp, Homo sapiens
ttggggggaaatgcaaatcaatactggtcatttgttgagtattttgtcaataagaatcaaatggctttttaaagtacccctagtgttttttgatgcagaartttcttgtgatcaaatacgtgtgcaaagatccagcaacaagggtttttgtcggatctttgtttaaagcaccaaatgaaatggccaaccagtgggggtttg

SEQ ID NO: 49241 - DNA, 201 bp, Homo sapiens
ctgctgtcccctttagatgggacatgtgctcccacctcgattacgtttccacgtgcatgggcccctctggtcctgccctttcctgagtttgaggtccaccstgtagcttaccataagctactttaagtagaagaccctcgcggacctccaaacacagcatccttaaaccaactcgtggattcctacccatccttcactctc

SEQ ID NO: 49242 - DNA, 201 bp, Homo sapiens
tgtgtaagcatgttcacaaaaatggtatcactatccccctgtgggtaaggaaagttaaaacgtgccacatttcacatcagtttctgtatacttcaagttgytacctagaccactgtttgagaacgctgattccatgacaaggtcaatgggaaacagaaccatgttgttcctgctgccatccaaaggcaagggggctgcatg

SEQ ID NO: 49243 - DNA, 201 bp, Homo sapiens
cagaaatatatagttacacttaaatgcacacacatatatacatacaaatatagagtgggtgcagtggctcacacctgtaactccagcactttgggaggccraggtgggtggatcacctgaggtcaggagttcaagaccagcctggccaaaatgatgaaaccctgtctttgctaaaaatacaaaaaaacagccaggtgtggt

SEQ ID NO: 49244 - DNA, 201 bp, Homo sapiens
cctcctcctatgtctttggccacatggagctccctttagcatgtccctgggtaagatcgcaggcctgaaatctgcctctgatttctgatggggatatcctyaagtttgcctagatcaggaagtttaatatgtgtcacatttcacatcagtttccatagactgtgagtggctgcctagaccactgttggataacactaattc

SEQ ID NO: 49245 - DNA, 201 bp, Homo sapiens
tcacgcagcttgaaaagacttgaacccagatatgtcacctcagagtcgttgtcttcaatgctgcaaacctatttacataactcaggcacaatgcggttccytcagaggcgcgatttcctccagagtaaatccagtgatgcattcgtgtctgggtgaagacaaacacggggcttaagaccgagttcacctgttccctaacaa

SEQ ID NO: 49246 - DNA, 201 bp, Homo sapiens
ttgtaaaatgcaccaatcagtgctctgtagctacctagaggtttgtaaaatgcaccaatcagtgctctgtaaaaacgcaccaatctgcactctgtggctckctagaggtttgtaaaatggaccaatcagcactctgtaaagtgggccaatcagcactctgtaaaatagaccaatcagcaggacatgggtggggacaaataa

SEQ ID NO: 49247 - DNA, 201 bp, Homo sapiens
aacaaacctgtacgttgtgcacatgtaccatagaacttaaagtgtaataataataaaaaataataaataaataaaaataaaaatagaaaaacagagcaagaaaaaaaaaagaaaaagaaaaaaaaaaaaggagagagcctgcaggtgaatgtgttgccatcataatagcgccaatgtttctgttgtttaaagttaagtgct

SEQ ID NO: 49248 - DNA, 201 bp, Homo sapiens
ccataaccttttgtttctcccaattttctctctcatggaaacaactcccatggaaacaatcacacacacacacacacacacacacacacacacacactcaygtggttacctttttgccagttttccagcctcctggactgaacagtctagaagagggatccaacatggactggaagaggggaatccaacatggactgctgt

SEQ ID NO: 49249 - DNA, 201 bp, Homo sapiens
acaaccaaaggggaatgttgaaaacagggaaaccgaggctcagagagagatgaataatgtggccacggtcacgcagcttgaaaagacttgaacccagataygtcacctcagagtcgttgtcttcaatgctgcaaacctatttacataactcaggcacaatgcggttccctcagaggcgcgatttcctccagagtaaatcca

SEQ ID NO: 49250 - DNA, 201 bp, Homo sapiens
gcggctcattaggcagaacccgtcctttctctttgctaaagttagggaggaaacaaatgcctgccgaacagaaggaggagatgagaggatctgtcagccakggagaggtacagctaccagaaaagcactggacagtttcctctaatccttgggaactttaatcgtctcctcaataattctcattttgagaggatctcaaag

SEQ ID NO: 49251 - DNA, 201 bp, Homo sapiens
ttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaact

SEQ ID NO: 49252 - DNA, 201 bp, Homo sapiens
atgcattgagattctagggctctggattctggttcagttttcctgtctcctttcagcatttgagtgatttctgcatccgatttaaagggtcagtttcttgrttttcattattccaataatgtttctctccccctcatttgagaagccaactcataagactaaactctagtccttgctaatatgccaactactctaattcca

SEQ ID NO: 49253 - DNA, 201 bp, Homo sapiens
cggtattctatagaattaacgttttgtgatggagtgagagggtgtcaagtcgaataaatgtctgaaaatattcttgggggaaggtgttaatggaaacacargaggctcagagagcattgattcactcaatgcctccaacaacccatgagagaagagccattttgtcaatgaaaagttgaggtggggcgtgatggctcacat

SEQ ID NO: 49254 - DNA, 201 bp, Homo sapiens
gtccgcttgccagaggactggagtggtggttgtcatctaccacattgtgatgacatgagtgctatttttttaattccatgggtttttggggaacaggtggygtttggttgcatgagtaagttctttagtggtggtttgtaagattttgctgcacccatcacacgagcagtatacactgaacccagtttgtagccttttatt

SEQ ID NO: 49255 - DNA, 201 bp, Homo sapiens
tctgggtttccaccctaatgcattgagattctagggctctggattctggttcagttttcctgtctcctttcagcatttgagtgatttctgcatccgatttraagggtcagtttcttgattttcattattccaataatgtttctctccccctcatttgagaagccaactcataagactaaactctagtccttgctaatatgc

SEQ ID NO: 49256 - DNA, 201 bp, Homo sapiens
tcattcttttgcctttgcatcctcacaacttagctcctaattatgagtgagaacatatgatgtttggttttccattcctgagttacttcacttagaataakagtcttcaatcccatccagattgttgcaaatgccattaattcactccttttgactgctgagtactattctaccatatatatatgtatgtatacacacacc

SEQ ID NO: 49257 - DNA, 201 bp, Homo sapiens
gaattgttgtatctttccgccatgagataaatcctaatcatagaagaaaaccagatatctaatgccgctttcccttccaaatgtggacatgataggattgmcatcatttgcctcatgtctgttgttggagcataacaagaatgagcaagtgtgtgagtgccaggcatacataactgaaaaaaaaaagcttcttccacacca

SEQ ID NO: 49258 - DNA, 201 bp, Homo sapiens
tatgatgtttggttttccattcctgagttacttcacttagaataatagtcttcaatcccatccagattgttgcaaatgccattaattcactccttttgackgctgagtactattctaccatatatatatgtatgtatacacacaccacagtttctttattcactcattgattgatgggcatttgggctggtttcatatttt

SEQ ID NO: 49259 - DNA, 201 bp, Homo sapiens
accactccgcatcttcaaagaaaacaaatcatttacagaattttaatcagataaagagaggagaaggctgggcacagtggctcatgcctgtaatgccagcracttgggaggccaaggcaggaagatcacttgagcctaagagtttgagaccagcctgggcaacttagtaggactcccatctctacaaaaaaaaaaaaaaaa

SEQ ID NO: 49260 - DNA, 201 bp, Homo sapiens
tcaccgtcgtcaccatcatcactaccacctgctagaaacttcggggggcggggggtgggggggaatgactcatcatctcatctctgcactcctgaagctcmaactcagcacaggatacaacgaaaggataatgtgatgcttggtaccaagactttaaggacattcaggagcggacagaaaacatgacctaaaagagaggga

SEQ ID NO: 49261 - DNA, 201 bp, Homo sapiens
gcagttttcacccaagaagacctgggtagtgaatgggattagtccaaactcatagtgaagatattaaatataccttgggatgaaaagagtagcaggaatgyggacttgtgggaggagggcaggccataccgggcctcacagggcaggataaggtgcttggattttactctaaggaagcctcagcctcagagggttctcagg

SEQ ID NO: 49262 - DNA, 201 bp, Homo sapiens
tcatggttactggaattctcacctctagcatctgatttctttctttcctgtgtgagctacctcccatgggcattaaaaatcaagtctctgacaccactccrcatcttcaaagaaaacaaatcatttacagaattttaatcagataaagagaggagaaggctgggcacagtggctcatgcctgtaatgccagcaacttggga

SEQ ID NO: 49263 - DNA, 201 bp, Homo sapiens
tgagatcaggatgtttataaaagaatgtgacacagaaacagaaaaccaaataccgcatgttctaacttataagtgggagctaaacaatgagaacacatggvcacaaggcgggcttttcagagggtagagggtaggagaagggagaggatcaggaaacataactaatgggtgctaggcttaatacctgattgatgaaataat

SEQ ID NO: 49264 - DNA, 201 bp, Homo sapiens
gtggactgaacagtctagaagaggaaaatccaacatggactgaacagtctagaagaggaaaatccaacatggactggacagtctagaagagggaaatccarcatggactgctgtgcaccagcctacatcatagtcacgtggttagcattggttgcatatctgcagtagcctagagtttaatcacacaagcagccttggagc

SEQ ID NO: 49265 - DNA, 201 bp, Homo sapiens
ctcttttgtaaatttttctctcaatttctccattcttttgcttctccatgcatattggatttctctgataatttatccttatccaaatgacaaaaaatggycaccccttgcacaaatgctgggaaacctatatttctcttagttcaaatttatcaaagaaataatcccatttttcatgaatcaactgatggagtggttacc

SEQ ID NO: 49266 - DNA, 201 bp, Homo sapiens
gtttacaacaaacccccatgacacaagtttgcctgtgtaacaagcctgcccttgtacccttgaaattaaaagtgttttctttttttttttttttttttttaaaaaaaaaaaaaaaggctgggcacggtggctcatgcctgtaatctgagtgccttgggaagccgagccgagcagatcacttgaggtcaggagttcaagacc

SEQ ID NO: 49267 - DNA, 201 bp, Homo sapiens
tcctttcaacccaggatcaccctgggtgggtgggtcacatggggcaggacatcagtgagggggacattagtatcagtccaggatcaagaaccacactaccwgggatgccaatgggttttggagaggactcttcactcaggacgtttctttcttgttgagatgctattccttattatttttgaactatttccacattcgagt

SEQ ID NO: 49268 - DNA, 201 bp, Homo sapiens
tggtatttctatatgcaaagctgagacaacacttggaaagtaattaccatagtccctggttaatagtaagctttcaatgagtgttggctagcattcatgcmcgtaagttatcctcttgcctagagcagtgatggctctaatgtgagttcagatccctacaataggagaaacagtgcttgttgcttttcaaaaagcagagaa

SEQ ID NO: 49269 - DNA, 201 bp, Homo sapiens
caggagaatcgcttgaacctgggaggcagaagttgcagtgagccaagattgcgccagctgcactccagcctgggcaacagcaggactctgtctcaaaaaaygacaacaacaacaacaaacaaacaaaaaaaaaaaaaagtgtggcacctcccttcccccacacactttgctcttgcctttgccatgttatacgcctgcatc

SEQ ID NO: 49270 - DNA, 201 bp, Homo sapiens
gcttaaagaaagtaccttgcgctgtgtgttcctccattagcatttgttattatgaaagcattagactatctctggatgttttccacacacctgagagtgtsaaagaatgacaggtacctcattaaagatgcataatatctagtctcctgttctcacacagactccaaccactggtatgaatatactgcttccatatgagcc

SEQ ID NO: 49271 - DNA, 201 bp, Homo sapiens
taggaacatcattttcctttcaacccaggatcaccctgggtgggtgggtcacatggggcaggacatcagtgagggggacattagtatcagtccaggatcargaaccacactacctgggatgccaatgggttttggagaggactcttcactcaggacgtttctttcttgttgagatgctattccttattatttttgaactat

SEQ ID NO: 49272 - DNA, 201 bp, Homo sapiens
tttgttattatgaaagcattagactatctctggatgttttccacacacctgagagtgtgaaagaatgacaggtacctcattaaagatgcataatatctagyctcctgttctcacacagactccaaccactggtatgaatatactgcttccatatgagcctgctgcaagccagccagatcctattcagaatatctcctttct

SEQ ID NO: 49273 - DNA, 201 bp, Homo sapiens
acaaatgtgttttgcattttctttcattttttaaagagagaaactcaagtgaaggagagctactaacgtccaatgaaataaagtatccaagcctgaaattsaagaaaaaaaaatgtaggcatatttgctctttggtttttatttttctgtcaccatctaatgtaatatttatttaatcattcccctaaggcaatgattttc

SEQ ID NO: 49274 - DNA, 201 bp, Homo sapiens
gttgtgctggggctgaattaaatgtgcaattactgcacattttctcgaaaggagttttgacaatgataaatgcatagacatttttccacactcagacaacrtgactccttgctcatcaagtggctcaggattcactttgaagaactggtctcttgttaacaggagaacgtgggtgctgcccgagaagcgcatgggcctgag

SEQ ID NO: 49275 - DNA, 201 bp, Homo sapiens
aaccactggtatgaatatactgcttccatatgagcctgctgcaagccagccagatcctattcagaatatctcctttctaccacatccaaatgtgggcagcmtatatatacagatttgaagtgcaaagggtttgagtcaactttttgataaccgtggggattttccatctcaagaaattccgaaaatgatgtaatgatataa

SEQ ID NO: 49276 - DNA, 201 bp, Homo sapiens
ccaactagaatttgccccacttcattgaattccctactcctttaaatatgcagaattgcataagccaaactccagtgtctttagaaagcagactatgttaytgtttcttgaaaagccattcttcctccagattcagatgttggtggtcaaatgagtatctctacagaaaatctctctgcttctccgaattaaactattttc

SEQ ID NO: 49277 - DNA, 201 bp, Homo sapiens
aatgtagcagaattttaatttagtaggtaggattaagagctgacaaatttcctctctttaagtttctttaattctgtctgtgcaagtcagagcattcggtrtattcccaccctcccagctgatatgctaaaattggtttcactgtactactctcaggcatgcaatgagctaggcaaagctgtttagttacttgcgatctgt

SEQ ID NO: 49278 - DNA, 201 bp, Homo sapiens
gtaccctttggacccgctaccatgcatggtggctttgaaaaagccaggcatttgcttcctaagagcacaccttgcagaagcagcatcaccatcatcactaygatttatccagcctttgctctatggtagatgctgtgcaagtgctttcggtctcatcctgaaacaactattgatatagatgccacatagatgacaaaacaa

SEQ ID NO: 49279 - DNA, 201 bp, Homo sapiens
atacaaaattagctgggtgtgatggcacatgcctgtcatcccagctactcaggaaggctgaggcaggaaaatcgcttgaacccgggaggcggaggttgccrtaagccaagatcgtgccgttgcgctccagcctgggcaacaagagtgaaactccacctcaaaaaataaaaaagagttaagggcaggctgtcttggacacat

SEQ ID NO: 49280 - DNA, 201 bp, Homo sapiens
tcattaggaccatcaaaacaattgtgttaaaatctcagggacaagaatgagtgcagggattgtaagctcctctgctgggtgcttcgttctgctcttctatrcaacctgctctgcatcctcttgagtgctttttaaacttccctcgtctcctccttcgtttccaggctttctcacccactactcctctttgccgttcctctg

SEQ ID NO: 49281 - DNA, 201 bp, Homo sapiens
gtgcttcgttctgctcttctatacaacctgctctgcatcctcttgagtgctttttaaacttccctcgtctcctccttcgtttccaggctttctcacccacyactcctctttgccgttcctctgcctgactctattaagataaactaatccttggaatttgctgctttgaagttgatgtcggctgggaaactcatacacagg

SEQ ID NO: 49282 - DNA, 201 bp, Homo sapiens
taagaagcagtagtccattctacctgtctgccaatttctatgttctagttaaggacatgggaacacatgatcagcaatacatgatcagatataatcaccaygagacaaggtgtgttaacaactttacgttcagggcctggaacataatagatgcactgtattttttgactaaataaatagctattcctggaggtgtgatga

SEQ ID NO: 49283 - DNA, 201 bp, Homo sapiens
ttttcttaaaaaatcaaaagatggctggacgcggtggctcatacctgtaatcccagcactttgggaggccgagtcgggtggatcacgaggtcaggagatcsagaccatcctgactaacatggtgaaacctcatctctactaaaaatataaaaaattagccaggcttggtggtcccagctgcttgaggcagaagaatggcat

SEQ ID NO: 49284 - DNA, 201 bp, Homo sapiens
caaaaaaaactcttaaattggttaaacaaacaaaaaaaaccacaccgtgtccttttgttgtttttaagggtttatggaaaaatatattggagagttacaaytacttcaggctaattcaatataaagagtatttttattattagtttggaatattaaagtttccacttaaaattgattttttgaagtgttttcaggcaacat

SEQ ID NO: 49285 - DNA, 201 bp, Homo sapiens
tccacctctcctaattcctccccaacacttcccaacatcatcgccattaacaactgtgtgtagtcctcttatattttcctttccttaaatataactacatrtctacagacaggtctttgttttgatatgattttacaaacctatggagttatagaatggagttcatcttataactcatctccccccactacaaaaaatctt

SEQ ID NO: 49286 - DNA, 201 bp, Homo sapiens
gaatcacatgaggtcaggagttcgagaccagcctggctaacatggccaaaccccatctctactaaaaatacaaaaattagctgggtgtcgttttgcatgcmtgtcatcccagctactgaggaggctgaggaaggataatcaattgaacctgggaggcagaggttgcagtaagccgagatcgtgcccctgcactccagcctg

SEQ ID NO: 49287 - DNA, 201 bp, Homo sapiens
cccaggctggctccaactcaagatctgctgcttctcctgtacttgacacctggttctttgggctgttcctttgttgatctgttattgtttactttttagtygcctttgaattaccaaactaagtcattcttgtagcaaaatctcaagcacagaaatgactacattaaaatgagccttccacctctcctaattcctccccaa

SEQ ID NO: 49288 - DNA, 201 bp, Homo sapiens
aaccccagggctttcctcgtctgctgggacgtctctgtcttcctgtgcctgctcctgctggatccaggatcccaggctggctccaactcaagatctgctgyttctcctgtacttgacacctggttctttgggctgttcctttgttgatctgttattgtttactttttagttgcctttgaattaccaaactaagtcattctt

SEQ ID NO: 49289 - DNA, 201 bp, Homo sapiens
tttcaaaagctccccagggaattttgcttttccagcaggcgtctgagaaccctcatcggacatacgcagtgatgctggtaaagcctgagcagaaacaaaasagggtcccgggggcagaatgggaggcagctctgggtctcttaagatggccctggtgtgctaagtgcaccagaggtaggaactcacccactgtcgccatta

SEQ ID NO: 49290 - DNA, 201 bp, Homo sapiens
cttcttgtgctcttctctgcttccagctgcgttttcctcaaaggctttctggtatccgtcaatccctagatctctaagaaccttgagctttgcaatttatscctcttcagaatcctatatgtcagtggcattggcggagtgggtggacacctggacaactgttcctgctttccattcgttttcctttgtcacttaaagtgc

SEQ ID NO: 49291 - DNA, 201 bp, Homo sapiens
acatgctatagagaaatcattcgtgaaaggaagagtcgatagattggcaaacctcgttgttttcttattttaagaaattgccacagcctccccaaccttcrcaaccgccaccctcatcactcagcagccaccaaaatggaggcaagaccctcaccagcaaaaagacaaccacttgttgaaggctcagagatcattagcatt

SEQ ID NO: 49292 - DNA, 201 bp, Homo sapiens
caccacttacgatccagtcaacctttttaactgtcagtgcttccagtctttgccgaaatacacagcattaaaattcataagtcaacccatgtccgtgcgtsctttttctctcccatatccagttggtcacttgcttcatgctgatccatccatagcggtcgtggtccacactccagccctcctttacatcctccagacaga

SEQ ID NO: 49293 - DNA, 201 bp, Homo sapiens
tttgtgtattcccacgcaggagcttcagccattgctacacgtggctccttcttgtgctcttctctgcttccagctgcgttttcctcaaaggctttctggtrtccgtcaatccctagatctctaagaaccttgagctttgcaatttatccctcttcagaatcctatatgtcagtggcattggcggagtgggtggacacctgg

SEQ ID NO: 49294 - DNA, 201 bp, Homo sapiens
agcaagtttatgggtgctgtttttccaacagtatgtgatcactttgtgtctctgtctcatgttttgataattctcccggtttctttcctttttttaaattrttactttgtctattttggtgatgtctgatcagtgacctttgatgttactattgtgatttttttttttttgggtggggggaggcaccacaaactgtgccca

SEQ ID NO: 49295 - DNA, 201 bp, Homo sapiens
aaagcttgccatgagtctgtagtgccagctcaaatggcatcatgctgtgctcctgccttcccaagcagggtgtgcacgcaggcaccctctgaaggctaggytctagatatcctctcatctttatctttgcaactttatcctggcttctaaggggcatgggtgtttcactgtcactatctgtggaaaaattgattcagtctg

SEQ ID NO: 49296 - DNA, 201 bp, Homo sapiens
gagtgcccactaacaactgccaaatttagtcatccaaatcaccacgacaataagctccaggtattgaaacatcaagactgaagccaccacttacgatccartcaacctttttaactgtcagtgcttccagtctttgccgaaatacacagcattaaaattcataagtcaacccatgtccgtgcgtcctttttctctcccata

SEQ ID NO: 49297 - DNA, 201 bp, Homo sapiens
aaagggctgtcatgaagagcaaatgaattaatacagcacatgcttaggagggtaatagctgagcatgagctattgctgttatctgtattttctagtttggrtgcagtggccacatgttatttttgtaatttagaaaaccaattctgttaatcttttttttttgagacgaagtctcgctattattgctcaagctgtagtgca

SEQ ID NO: 49298 - DNA, 201 bp, Homo sapiens
gtaaatatttattgagtaccctgtatgtgtaggtagtggtgatacagcagtggacacacagacaaaaatccctactctgaaggagcttatattccgggggraaaaagagaggaaaataagtaaaatgtgtgctggttttgtgcatgaagatggcaaaggctatggagaaatcaaggaggatagagttggggaggaacagtt

SEQ ID NO: 49299 - DNA, 201 bp, Homo sapiens
gggcatggaagctctgcatacctttccacatacctttccctatgcatctcttggtgtgactgttcatctatactctttgtaatattctttataataaatgsgtaaatataagtaaagtgttttcctgagcacttctgtgagtcactgtagcaaattaatagaagtcaaagagggggttgtgggaactccaatttatagtgg

SEQ ID NO: 49300 - DNA, 201 bp, Homo sapiens
ggaatcaaccatgtatttttagaaggttggggctttcatcatccaccccacctccagggaggaaagggaggctgaagactgagttgatcaccaacggtcastgagatactcaatcgtgcctatgtaacaaagcctccatgataaccccaaaggacaggggttaaagggcttccaggttgctgaacccatggaggtttctgg

SEQ ID NO: 49301 - DNA, 201 bp, Homo sapiens
aattattagttgtgttttgcaaatgaggaaactaaggcaaagagaatttaagtaacttgctcagggtcacatagaaactaactggaaaaattgagatttcracccagttagtctagcctgcgaatctttactctgagctactttttaactgattctcaatgtatagtcacataggttgtagtttattatatgtccatgtgt

SEQ ID NO: 49302 - DNA, 201 bp, Homo sapiens
cagtatcagctctcatcgggacattattatgttctagttgtctgcaacgataatatatgtgactgttattttgtctcatatctccaataaaggggtccccktcagttggattggccataccttcaggtgggatgcaactgtgagtctgtgtacatggcccagaagcaaatgcagcacagtggagtgattaagactctgata

SEQ ID NO: 49303 - DNA, 201 bp, Homo sapiens
ataaagttcatctatgctcaggatgacagccaaccagtagctccaaagtgttccttgacaatcattttctactttactgaacagcccaccttcctctgcarcagaccgcttctttgctggagaggctgtgggctggggatatggagaacaaactgatgagtgagggatgtgtctgcagaatcagtcagtggaagagatgac

SEQ ID NO: 49304 - DNA, 201 bp, Homo sapiens
atcctttgcctgtaataggaataagacagcatggtgtaaggaattacttgattttagaaggcatttcatctctccaagtcaatctttagggatcgacactrctggtggcttatgaatttcagatgtggtacattctgggaatgccagctcttgggctccaggaaaggtgattaaaggacaggctgatgccaacatttatgg

SEQ ID NO: 49305 - DNA, 201 bp, Homo sapiens
cactgagcagaggcccgaatggcaagatggtgccagtacatgaagacaagagtctgtcagagagaacgacacaggtagagtcctgcagcttgagcaactgyttacaaacccatggcagagcccatgtgaatgagggagaaaaggcagagatgggcagatcccagaaggcctgggaacccatggaaaaggctctggattttg

SEQ ID NO: 49306 - DNA, 201 bp, Homo sapiens
tgtctgatttagaattttgtaggacggattcctgttgttgaacacactgagtgatgagaaacttggcaaatcttgttggcaaatctctcaccttgattccstttggcatcctttgtgtctgtctgatccttccagcctggcctttggatagcaggtacccacttcttaggatgtgccagacaccacggtaagagtttgatc

SEQ ID NO: 49307 - DNA, 201 bp, Homo sapiens
atttatgtatctatgtagcatctcactcccacatagggacaacactcatgacagaaggggcctcctatggtttgtccgctgctgtgtccggcattaagaamggcgctcagcacggcgtcatcagccataaatatttgtggaatgtacagacaggggattgaaggcttggataggggaatatgtccttggagagtgaaatga

SEQ ID NO: 49308 - DNA, 201 bp, Homo sapiens
ggaccccacgcatactggaataggtccactctaacggcttcctcttaactcgatgacatgtgcacagattctattcccaaataaggtcacttttgcagatwccaggggttaggagttggacgtttcttttagggggacacaattcaacccctaaatggggatctcctgacagttcttaatagggtcaatatttcaatgcgt

SEQ ID NO: 49309 - DNA, 201 bp, Homo sapiens
tgcgtctctgtcttcacatggcattttcttatatggaccccacgcatactggaataggtccactctaacggcttcctcttaactcgatgacatgtgcacarattctattcccaaataaggtcacttttgcagataccaggggttaggagttggacgtttcttttagggggacacaattcaacccctaaatggggatctcct

SEQ ID NO: 49310 - DNA, 201 bp, Homo sapiens
aaccctcaaagccctgggatgcagttcttctggatctcaagtcttgaacacattaaatgataagctctttacagactttctcttcccaattattaagcagsaattacccttcacatcaccttctcccatatcacctctataattccaaccactctcacctaaaaaagctcacctaaacccaccacttgtctatctgagtca

SEQ ID NO: 49311 - DNA, 201 bp, Homo sapiens
tctctgctttgttcctcacacagtgttctccctgcgtctctgtcttcacatggcattttcttatatggaccccacgcatactggaataggtccactctaayggcttcctcttaactcgatgacatgtgcacagattctattcccaaataaggtcacttttgcagataccaggggttaggagttggacgtttcttttagggg

SEQ ID NO: 49312 - DNA, 201 bp, Homo sapiens
aacaccttccttcctttactagatccagggtatttttcaactgaatgcagccattgccaccctatatttggcttttagagacagactgaagtctaacaagwtgctccttatacttgaattcacaagtataaaatcatatggatgacttgtgcaccttgctgtcattctgtgcagagctccgcctgtgcactccttccctca

SEQ ID NO: 49313 - DNA, 201 bp, Homo sapiens
gaaatcaaagtgctgtcaagggccacactactttcagagtgtctaggggaggattcggcctcaccttttttaggttctggcagccccaggtgttccttggyttgtagctgaatcactgcaatctctgctttgttcctcacacagtgttctccctgcgtctctgtcttcacatggcattttcttatatggaccccacgcata

SEQ ID NO: 49314 - DNA, 201 bp, Homo sapiens
taaaacagaaactacttgtctcatagctctggaagctagaagtctgaaatcaaagtgctgtcaagggccacactactttcagagtgtctaggggaggattsggcctcaccttttttaggttctggcagccccaggtgttccttggcttgtagctgaatcactgcaatctctgctttgttcctcacacagtgttctccctgc

SEQ ID NO: 49315 - DNA, 201 bp, Homo sapiens
ctttaaattttatgtccctgaagggttaagctctatgttggctttacctgaactctctcatcctcacccaccagcaagatgaaggtagggtggccactgayaggtgacgttcgtgaggtgcatggcttttctgaagataagcagtaattgaaggaggagaatcagatttaaagcctggggctgcaaggatatgagattcat

SEQ ID NO: 49316 - DNA, 201 bp, Homo sapiens
agatgagcagaaattatttgagatgaagcaggaacaacctggggcaggggcattgaagattctattgctgaatgaacagcagggaccaaggcccaggcgtsagatagcacagccagctggtgaaagttcaagttaagtgcatcagccaggatgggccagcttatgctgtcatagtaaagtacccaaaatgcagcgattcac

SEQ ID NO: 49317 - DNA, 201 bp, Homo sapiens
ctggtttgttttgaagagaaaatgagctaatgcaagggagagggagctcagaccacagatttgtgcagagaaagtgccgaataagtgacggctgctgtttytgtttttattctgcgaggaactctaatagaagaaaaagagcatttgatgactgaatcaccggtcttcgctagcagggcagaggcagatagttcccccgcc

SEQ ID NO: 49318 - DNA, 201 bp, Homo sapiens
atcttggacaaatcctttatcctcactgcaccttcgttttgtaaatagggacgttaacgctgggacgtactctgctggtttgttttgaagagaaaatgagstaatgcaagggagagggagctcagaccacagatttgtgcagagaaagtgccgaataagtgacggctgctgtttctgtttttattctgcgaggaactctaa

SEQ ID NO: 49319 - DNA, 201 bp, Homo sapiens
cccttacctgatcacacatcttcgtcatgtccttcagggccccagatcctgttctaatgcagagcaggaagatggtgactttttgaaatttctggaaatakcactcggtgaatcaaagcaaattaattctctcttttagtcactctgagcctggatttccagtccttggaatttcgcttctaccaacagttctttcagagt

SEQ ID NO: 49320 - DNA, 201 bp, Homo sapiens
tgaacactttggggttctaaaagccgtgatcaaccttattggacatatggcactatgatgtcacattcaacaatgaaaggcacttcaagttataggatcakctattgcattggaggtcaggaaactttttttttaaagggccaaatagtaaatcgtatagactttcttggccaacaggcaaacttgaagatattattatca

SEQ ID NO: 49321 - DNA, 201 bp, Homo sapiens
cacagagctgtgacttggacagaaaatgagttaagctaaaggagagatcgtcagtggcaaagttcaggcgttttggagacaggttgagactgacaagttgrttctcgacatttctagcctgatggagagaagagctgaggagctaccacttgaatctaaattctgagcttgttaaatagattaataaacctcagtccgtag

SEQ ID NO: 49322 - DNA, 201 bp, Homo sapiens
gatatcaggacgcaaagattgagctgcctgcattggaggtaaagcagatatgtcgacagcacacgcatgcaaagatgtgctgttcaaaccgaaccttgatrgctgtgtggaaacctggagtgcggaagcagaaggaagggcatcgtggggaaaggagtggcatggacaaaggcatggcatattcacatgctacttaaagac

SEQ ID NO: 49323 - DNA, 201 bp, Homo sapiens
caccaaatatttcaaaggaatatatagtgaaaattcctcctatgtgcctaaatcttcctcggtacccttccccagaacagccactgtgtcttcccagaaaktgtgttaagaaacaaacatgtatatccttttgtgctgtgttttgtagaagtggaagctttctgtgcagccagttttgcattgtgttcctcaccaacagga

SEQ ID NO: 49324 - DNA, 201 bp, Homo sapiens
acatgcagagaaacacctagattttggattcatttacacattcagcaaatatttattgggcatctatggtgtaccaggcgctgcactggactcagagatawaacaatcagccaaatgaacaagtctggaccttcagggaccctcgtggaggtgttacctacaagtgaggaaaggaagaccaaagtgtttgttagttagtta

SEQ ID NO: 49325 - DNA, 201 bp, Homo sapiens
acacagccaaatgtttgcacctatgtgtaataaatcaacttgaatttaggagaagtaagatgattcagaaatgcatttctttttttccagtgtctcttctrcagaatattttctgaatcataatcattgcagattaaaaatcccacaaaaaatgttcatacaaggagtcaggctcttggctcagaaaattctgaagaagtt

SEQ ID NO: 49326 - DNA, 201 bp, Homo sapiens
ctgaaatttagttccatgagtgcaggcctcctgctgatggcaatggggattggtgggagggttagagatggggaaggccagggtctttatcttgtggcctyatttgctcctccactctggataaattctagaagaagaccttgatgagtctcaggactccactggtaaccgtaaccacttcccccatccctctaagtgtga

SEQ ID NO: 49327 - DNA, 201 bp, Homo sapiens
aagggccagcctttcaggcaggcctttccaacattgcagtctgcaatctgcttcgtaactcttttctgcccaggactagaggtcataaggcccctactaastctctggcttcatccccagtactacctgttaaccaacctgacattcctcccatcaccccgcagatcctggccccaaagccttaccttggtgctagcagct

SEQ ID NO: 49328 - DNA, 201 bp, Homo sapiens
ctctgcctgatacatagcaacattcctgactcccggaagaaaagcaagagttcagcataaaccgaatagttcatacaaacatgaggcacttggagccactsttaccagttatgggcatgggaatactctccaaacccaagttcccagatgccagccaagggccagcctttcaggcaggcctttccaacattgcagtctgca

SEQ ID NO: 49329 - DNA, 201 bp, Homo sapiens
atgtctcaaggacaactttatcttttatcagactcatttcagggatttctgtattcattgctcctggacttttcacatatttggggagcttgattgagttyccctcagctcttccattagaaagcccatgtggtacagtggctcagagcttgggcttaggaattcacaaatgtgaatctgtgaatctgagctctgcatctt

SEQ ID NO: 49330 - DNA, 201 bp, Homo sapiens
tgggaattagttttagcaaagagagagagagagagacagagaatatcatggtgatgagtgctaggacattgtcaaggctcttttaagtgtgaccaccaggkgacagcaggaaagataggagaagacctagagttcaacttggagtactgaaagccttccctttccttcttttctctctgtgaaggttgttttccttctttg

SEQ ID NO: 49331 - DNA, 201 bp, Homo sapiens
gcaggcccatttggtaaatgaagtgtcatatggagaattttcagcagatgcttctcttctgatagggaatggcaaagccccctaaattcatgaaacatatrcaggtgccagccaactttgcactgccttcatgacacctcatctgttttctcaaacagccaagcagcactctgtgcccttagtgaagtaagggggaatagg

SEQ ID NO: 49332 - DNA, 201 bp, Homo sapiens
ggataatgtgaagggagatgagaacaagggctacatctagaacctaggaggaacactcatattccagtactggaggagaaagtggcataagtctagaaccsttccagagaaggagaaaactctcaggaaagtataggattagtgaggtgaagagaagaataaatatccagaagagggttaattgtttaagctatattaagc

SEQ ID NO: 49333 - DNA, 201 bp, Homo sapiens
tttataaaagggattatcagctgctaattcaaaaattgtagggtaatgaaaactacatcaataattttcataataattatagtctttggttttacccttgmatgtttttctggcaacatctgattcaattaccccagaaaatgttactatgctcttccagcattttcctatgaggtttgaatctatgaccaaataagtgat

SEQ ID NO: 49334 - DNA, 201 bp, Homo sapiens
cttcttatgatttttaattattcaggaccagattacatggccacccctactgttgaggagactaatgaagtatttggcttttccaggctttgttgttagcstccagtaaggatgcaattggaaatggactttgtggtgaacagccaacaagattggccacagtggaattaacgacatcagtgttctttcagacattgaaat

SEQ ID NO: 49335 - DNA, 201 bp, Homo sapiens
aatacactttaatcacacaatgggaggtgaggaaatacgggcccctcttgtgaagggaacgagagggtggttgggctcagagctgctttttctttgttacrcatgttgtggttgttttctaattggagagtcatgaacatgtttatggacctgcaaggagaaataagttgatgtgcagggaaggagggcaggaaggggtaa

SEQ ID NO: 49336 - DNA, 201 bp, Homo sapiens
ccagacagagtggctcaggccctgtaagcaactggtgttagggcagataatgagattttctggtgtctgcttggtgacaagagtagtggcttcaaggaatktttttaaaaaataacatttgtttatagttgtgttttttaaagtagaaaatatattcatacgagcaagtaattagtgtcctgccaggtaagtctcatggtg

SEQ ID NO: 49337 - DNA, 201 bp, Homo sapiens
ataattcgttttgaagatgttgtatcattgaactaaaaatcatattaatactcatccaaagaattacacagtcattctctttaataggggaacttaagaamcagaactgtttcctatgatgtttaggagacattcagtgaattttgatcatgatgaactagaacatccaattctaagttggacactggtctcagaaagaat

SEQ ID NO: 49338 - DNA, 201 bp, Homo sapiens
ggtatttttcaactgaatgcagccattgccaccctatatttggcttttagagacagactgaagtctaacaagttgctccttatacttgaattcacaagtayaaaatcatatggatgacttgtgcaccttgctgtcattctgtgcagagctccgcctgtgcactccttccctcacttaccgagggcctagttcatcctccac

SEQ ID NO: 49339 - DNA, 201 bp, Homo sapiens
tgcttcttgtgcttcattgacttgatagttggcatctctgtgagtctttggactttcctttgtggctccaagaaaaagaaaacatataaagcagtatttawatatgtgtaagcacatatgtgagtatgcatgtgtgcaagtatgtgtgtatacatgcattgtgggctagggaggaaggaatttggaatggatttggggtta

SEQ ID NO: 49340 - DNA, 201 bp, Homo sapiens
ttctctctctccctctccccatctctgtctcctgtctttattttcttccttatctatccccctttttctctttccctcgctgtttctttcttcttcctttstttgtctcttttcctaacttttttgcatatgtagctgtgtcttttcctgccttctttttctgcactctatccccagctctctagcttccccgcaacacac

SEQ ID NO: 49341 - DNA, 201 bp, Homo sapiens
gcaacatatggtgacaccgtgtgtgaaatggtttctacgagggaagctcactggaggctcagtgcccgagtttttactgggagctcatcgagctggtcacrtagacagcctctgcctgatacatagcaacattcctgactcccggaagaaaagcaagagttcagcataaaccgaatagttcatacaaacatgaggcacttg

SEQ ID NO: 49342 - DNA, 201 bp, Homo sapiens
caacattgcaaacgcatcagcatattccttccttcaacattccataacgtggtggtggtattcccaccttaccccgggagaagctgagagtcacagggagyatttactttccaagttcacacattcagggaatgggtagaagtggaattcacacccaggtcagtgtaagaccaaagaggctgtcagaatggtttgctgttc

SEQ ID NO: 49343 - DNA, 201 bp, Homo sapiens
gaggaggagaatttggcaattatttcctgagtacccactatatgtaaaacactatgccaaatactaggaatacaaaggtaaattagacatgcaagatttaygttccagaaagcttcatttttgtgttctctaattctgtacatgtctttcttccatttataatgtagatttacatgtaacagcaaactcactggaaatgtg

SEQ ID NO: 49344 - DNA, 201 bp, Homo sapiens
tacttgaattcacaagtataaaatcatatggatgacttgtgcaccttgctgtcattctgtgcagagctccgcctgtgcactccttccctcacttaccgagkgcctagttcatcctccacctctgtggacacaggaacgacgaaaaagtctcccttatgacctaacggcttagagcatgggtcccataatccaatgtgaatg

SEQ ID NO: 49345 - DNA, 201 bp, Homo sapiens
ataaggtaacagcattatcccagttcttcgcctaaggaaactggagtctagtgaccacacctttttttggttccctgacttagaacctcttaaatattccstcaaggtgtgtttgaatttgttgctttgtaaaggcaacaaagcaggagttaagggaaaccaaagccataccttggaaggaccaaggtatggggttaataa

SEQ ID NO: 49346 - DNA, 201 bp, Homo sapiens
tccaacaatgacacaaagatttcctgacaataaaggggctgaggtgaggaccccagctgtggaccacactacccgaagagaaccaacaaccaaatcaatayccaaaaaataacaataacgtccaggtcatttcacttatgagacagaagaggtaaaacaaattctcagatacaaatatttctgctgctccacattgttcca

SEQ ID NO: 49347 - DNA, 201 bp, Homo sapiens
gaggctcacagagaagatgatccagtttatgctaccgcatctccaccataactccccttttagctcattaactccctcaaaaatatccttctgctaattcstctcccttcccctctcttccactgttgcctttggagctttcactttatcctaaacttctttatgtctttagtcatctcctagaacacacatttcctcacc

SEQ ID NO: 49348 - DNA, 201 bp, Homo sapiens
gcaccttgctgtcattctgtgcagagctccgcctgtgcactccttccctcacttaccgagggcctagttcatcctccacctctgtggacacaggaacgackaaaaagtctcccttatgacctaacggcttagagcatgggtcccataatccaatgtgaatgggcttccaccccaactctaccagctacttattgtgtggtt

SEQ ID NO: 49349 - DNA, 201 bp, Homo sapiens
ctgggcttctgcaaaacctgataatcaagggactctgtttccattcagaaatagctgtttttgacagagaaggaaaattcacagatttttccatattcggrgattatctagaatatgattcccctcaaatggcccatctttttatcctcaacaatcataggatctgtgacacgtgaagaataagtgttatctggttggtgg

SEQ ID NO: 49350 - DNA, 201 bp, Homo sapiens
actccctcaaaaatatccttctgctaattcctctcccttcccctctcttccactgttgcctttggagctttcactttatcctaaacttctttatgtctttrgtcatctcctagaacacacatttcctcacctttagagaaacttgactctttcttcaactaatctgcagtgttcaaatatgaatacctttctgtctttcct

SEQ ID NO: 49351 - DNA, 201 bp, Homo sapiens
caggaacgacgaaaaagtctcccttatgacctaacggcttagagcatgggtcccataatccaatgtgaatgggcttccaccccaactctaccagctacttmttgtgtggttgtgagtaagtcacctaccttctcagaacttctgtttcttcatctatagtagaaggatactaattcctccaccatagggatgatttgagga

SEQ ID NO: 49352 - DNA, 201 bp, Homo sapiens
ttgaactgagttacttatgagctgggcttctgcaaaacctgataatcaagggactctgtttccattcagaaatagctgtttttgacagagaaggaaaattsacagatttttccatattcggggattatctagaatatgattcccctcaaatggcccatctttttatcctcaacaatcataggatctgtgacacgtgaagaa

SEQ ID NO: 49353 - DNA, 201 bp, Homo sapiens
ctgccctgatggtgtggagtgatttcctttttccatggctccttgtacatttatggttggcattctactgcaaggaagactgtttcctcttctcccattartatattcattcatttattttttatatcagaatggactcatgtggttttaattctttgggttgttttctgttgctgtctttcttttttaatgctgtgctta

SEQ ID NO: 49354 - DNA, 201 bp, Homo sapiens
ccgtgttgctcacgggtgaccccaggaggcttacctttctgttttgtttgtgaaagtttctcccccattttgcttgtgcttccagagcaatgatgctagaygttggctcactttggaaacactcccttcctacaacataaatgtgtgtatgtgtgtgcatgcatgcgtgtgtgtgttgaactgagttacttatgagctggg

SEQ ID NO: 49355 - DNA, 201 bp, Homo sapiens
gcattctactgcaaggaagactgtttcctcttctcccattagtatattcattcatttattttttatatcagaatggactcatgtggttttaattctttggrttgttttctgttgctgtctttcttttttaatgctgtgcttaaattgtgtcatatttggccagggggagcctggggcttttgataattcctcatttatttt

SEQ ID NO: 49356 - DNA, 201 bp, Homo sapiens
ctacctgtaggaagtaccgtgttgctcacgggtgaccccaggaggcttacctttctgttttgtttgtgaaagtttctcccccattttgcttgtgcttccakagcaatgatgctagatgttggctcactttggaaacactcccttcctacaacataaatgtgtgtatgtgtgtgcatgcatgcgtgtgtgtgttgaactgag

SEQ ID NO: 49357 - DNA, 201 bp, Homo sapiens
cttgaggcctatcaatagcaggaagttattactacctctaggcctgaaagggcaaggagaagggggccaatggaaccaggagatagaaggctggtggagargaccgcctaacctgggtggtggccataaagcgagggagctggagagaaaaagacaccttaaactcacttgctcagtagctcccatgagccaaatctagtg

SEQ ID NO: 49358 - DNA, 201 bp, Homo sapiens
tcaaggaaccttggtttcttttcatggagggtggtctttagaaatcagtgtctgggtatttggtgaggttgtggctgctggagtgtcactgctgctaggtsctttcagcagacagagcaatgatacagacacacacatatacatacacatatacatccacacaaatatacgtacatatatatgggtgtacacatatataca

SEQ ID NO: 49359 - DNA, 201 bp, Homo sapiens
ccacacaaatatacgtacatatatatgggtgtacacatatatacacatgggtacatctatatgtactcatttatacatgcttgcacatatgtctacaactmctgtatctctctgcattgttcatacattaaatttaaaacacaagttcaaactgatatctccaattccaatctaatatctaagggtttttctagccctcct

SEQ ID NO: 49360 - DNA, 201 bp, Homo sapiens
tcatgttaattctaagaaactgtatgcctcattaggcagctaaggcatattatgatttggatgcagaataaccccagtgataaatgaatctcccagcagartagcttccagattataatttctttctttgcaagattgctataggcaaggtggcctgatcacttttcagaggcccatcttaatagtcagagtaagctcagc

SEQ ID NO: 49361 - DNA, 201 bp, Homo sapiens
cagtggaaatcttgagtgggtggttagaaataagagtctggagccaaggggagatgtgggaagctggagagaaagtggaaaaggactatgtctataaataygcccgatgcaaagcgtggcatagtcacaggcaaaagctatccacttgatctcaagaacaatcttttttcaccttctgggcttcacaaacaaaatagcacc

SEQ ID NO: 49362 - DNA, 201 bp, Homo sapiens
agtgaccaagaccatttagaactctattcttaagacattgccaccttcctgggaggagaaaggtgccaacagaaatggataagccagataatttaagtttyggataaaataaaacaaggtacattgttttattgacataaggtcaagaaaagtcctctctaaagaggtgatgttgaagctgagcccagtgaaataaaggag

SEQ ID NO: 49363 - DNA, 201 bp, Homo sapiens
tttccaagacaaacaaaaaagttgtttttttatgctgccttcttcattgagatctgaaagtagttccctatggaagtgattcatggtgttgtgaaatcctmcgaaattgtaaacagcctggtgggcaggaatcccgaggtctcattcaggccccctgcaaattctgagttcctagcctgaggaaagcccccaacaaatact

SEQ ID NO: 49364 - DNA, 201 bp, Homo sapiens
ggctgaggcaggagaatggcatgaacccgggaggcggagcttgcagtgaaccgagatcatgccactactgcactccagcctgggtgacagagtgagactcwgtctcaaaaaaaaaaaaaaaaaaaattacactagcatccactcttaccctacctgtaggaagtaccgtgttgctcacgggtgaccccaggaggcttacct

SEQ ID NO: 49365 - DNA, 201 bp, Homo sapiens
aaccatatcactcctcatggtgtgcaagatggctgatacatgtctagctatcatgtcagcaagactgggagaatgtggaaagggtgagccagccagccatrcttgtcctctttggaataagaaagtcttatcaaaaaccactagaagtctactgtttgtctctcataggccaggactgtgttatgacacagctatgcttag

SEQ ID NO: 49366 - DNA, 201 bp, Homo sapiens
gacattcagctctttgctcagcccaagaatgaaactcatcacatctgttttcagtccagtgaccaatactagtcatgtggccccagcataactacaggagmggctggagaatatatgggaacctcctcacattcaccaaatggaatctttggtgaattctaaagattcccggcatgtcccactatctccttttggggctga

SEQ ID NO: 49367 - DNA, 201 bp, Homo sapiens
gctaatgatcaggagggaggtgctaaatattctgggctcctcgcttggacttcaaacctacaagctccccactcttgaacctaaccccattcctgagtttycttctatgctcacatccactcccaaatcctctaaccaccctgagctacattatattaaaagggctactcctcatatgttcaccacagcactattcacaat

SEQ ID NO: 49368 - DNA, 201 bp, Homo sapiens
aatgaaagaaaaaactgacaggccaatgtactgactgctctctcacctgggtctgatcccatctgaagctactttgggtggttatcacaatgtagtttatyatagtgctgtggaatatgaactatgaccatagccagccctatattctagaaccagcatctccatttgtagctatgggtgcttggacaaacacttcaatgt

SEQ ID NO: 49369 - DNA, 201 bp, Homo sapiens
aaaaactgacaggccaatgtactgactgctctctcacctgggtctgatcccatctgaagctactttgggtggttatcacaatgtagtttatcatagtgctrtggaatatgaactatgaccatagccagccctatattctagaaccagcatctccatttgtagctatgggtgcttggacaaacacttcaatgttctccatct

SEQ ID NO: 49370 - DNA, 201 bp, Homo sapiens
agttttctgcttctgttcattaagacaaaagcctccagctccattcatggtgctgcaaaggacatgatttcattattttctatggttacatagtattccayggtgttttctaacccaccattgatgggcacctgggtttgttgcatgtctttgctgttgtgtatagtgctgcaatggatatatgggtgcatgtgtcttttc

SEQ ID NO: 49371 - DNA, 201 bp, Homo sapiens
ttggaatggctactttcattatgttagagccctgataggtgagaggagagggggcaaggggagacggagatgggaacagaagatttcccagatgaggggcrctccctggagctgagtcttggagccagatggacttgttcacaccagcatggactgaaataaggagaatcagaggacctgggctcataccctgtctctaga

SEQ ID NO: 49372 - DNA, 201 bp, Homo sapiens
agaaccagcatctccatttgtagctatgggtgcttggacaaacacttcaatgttctccatctcagtttcctcatctgaaaatagagtaaacaacagtaccmacctcatagggttgtgtggattaagtagttagaaacatgtcgctgttgaggaaacatgagctgctgttgtatttgaaatggtgctgaattcagaatccca

SEQ ID NO: 49373 - DNA, 201 bp, Homo sapiens
ttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgt

SEQ ID NO: 49374 - DNA, 201 bp, Homo sapiens
tttcagcttgacttgcaaatagagcctgaaagttcccaactcttaaaaatgttcagtgtgtccagtcttatagcaggaggaagaatttgaagatggccagygttgctgtttctcaggccctaatatttctttgtgctcagtgaacgggcaagttatcctgaggaagaaaatatttcagaggcttcagtgctaagtattaat

SEQ ID NO: 49375 - DNA, 201 bp, Homo sapiens
catcaggacattggccacaaagggataggcgtcccaggatgctggaatgttgggggcagcgctattattagagacacctggtcactgacccagctttcttyccatggctcaagctgagacttgatagtaaaaactgccttaaatggaagcaactatatttttgatgtatgctcttctaggatgatactaaaagccatatat

SEQ ID NO: 49376 - DNA, 201 bp, Homo sapiens
tgtatttttacatctaagtccatgatcctttcggaactgatttttttatgtaaagtgtaaggtttaggttgagttcatttatctgccagtggacacacagytgctccagtagccttttagaaatagctatccttcttccattgaattgctattgtccccttgattaaaaaaaaaaaaatcatgtgggtgcaggtgtatttg

SEQ ID NO: 49377 - DNA, 201 bp, Homo sapiens
catcatctacctctattatcctcaacaacaatgacatccacagtagcaataagcagggggagcacctaaggcagactctgctttagagagatgagttcagrgcttgaggctgaaagacagggaaccagcaggccaggccatgcaagccttgcagctaaaagacagggaaccagcaggccaggccgagccaagccaatagtc

SEQ ID NO: 49378 - DNA, 201 bp, Homo sapiens
ggaaattatacacagaggattgtcatcctggacagttaaaaatttaaagtaaatgaactgaacaaacctcctcccttaaatagtgctcagaaatcaaagarctgaaaaaatgtaaatgggattcattaagagctacaaaattatcttcttgtgttgctttgataagtttttcttgcaaatctctagaagtttagctcaggg

SEQ ID NO: 49379 - DNA, 201 bp, Homo sapiens
acatggatcctcaataaatcacagatgttgtcgttgtcatcatcatcatctacctctattatcctcaacaacaatgacatccacagtagcaataagcaggrggagcacctaaggcagactctgctttagagagatgagttcagagcttgaggctgaaagacagggaaccagcaggccaggccatgcaagccttgcagctaa

SEQ ID NO: 49380 - DNA, 201 bp, Homo sapiens
gcactcttcccatgatgctgatttaccaatctctgcatggccactttaggccctgcgttggtgtaccccatccagattgtctccattgtaaagccatatakttccaagggcacagcaggtgtgtgtggtatgctgagagtccccttctatctctccaccaccctctccatacttgctccccaggatggccatggatacagc

SEQ ID NO: 49381 - DNA, 201 bp, Homo sapiens
agccctcaggagaccctgagaacatatgcccaaggtggtcgggccacaaataagttttatacattttagggggacataagccattaatcaatacttgtaaratgtacaatggttcggtctggaaaggcaggacaactggaggagggtgtgtttccaggttataggtggattcaaatattttgtttggcaattggttgaaag

SEQ ID NO: 49382 - DNA, 201 bp, Homo sapiens
cccatgatgctgatttaccaatctctgcatggccactttaggccctgcgttggtgtaccccatccagattgtctccattgtaaagccatatagttccaagsgcacagcaggtgtgtgtggtatgctgagagtccccttctatctctccaccaccctctccatacttgctccccaggatggccatggatacagctacattag

SEQ ID NO: 49383 - DNA, 201 bp, Homo sapiens
tctttgtttatacacgtagagcatcttggtccaaggtacaaaaggatttgtgtgatgttttaggagtggtcctgttgggactatggttgattttaactttyccacagtgcagtgtctgagatgaccgtcttcagatctgggttgcttgagtctgaactttaacttcacctttcaccagccttgtgctagagaaacatcatt

SEQ ID NO: 49384 - DNA, 201 bp, Homo sapiens
gcatatgccataatttacgtagatactatggaggtggaaccatgtatggttaagtcccggggccctggagcagtagatcttaaccttattggacacagtawcccatttctatttacaaatacttttttttttttccatgagaacaaccacagggacttttaacttgcctaaagataatgtgtgattttgagatgtgattag

SEQ ID NO: 49385 - DNA, 201 bp, Homo sapiens
tcattcccacagtgatcctactatcaacaggaactgctgtttctattatcaacaagaatatgcctccaagccaggagtcctgctgatcccactgtctcccyaccccaacagccatggcccgagatcagattgtctccatggattctagtgctcagggaagttaagaaaactcaattcacggtgctcagttcaaccttagac

SEQ ID NO: 49386 - DNA, 201 bp, Homo sapiens
ttcctgcttttggcaagcaaagcaaaagaaccttctgggttcccttcctgcctttcctactgagatcaagctgaaggtggaatttttctatatatccagtycagcctttgtgacctctgcctttaacacaaacaccttgtttaaaaagtagacttgagggagggcacttgagttcagaagccaaaagaaatgggtattgct

SEQ ID NO: 49387 - DNA, 201 bp, Homo sapiens
gaaaatatctgaattagaaatgggcccatacaggttccagtgggaatggctttctcagcaggtatgaatcactgctattaaaaatgtattccgtaggtaarttgttagttatcatattcatccactcttacagaaagccaatgttatcatttgggtccattattaagactatcattatcatagtcagtttagtaacctcct

SEQ ID NO: 49388 - DNA, 201 bp, Homo sapiens
agaagaaataaaggctgatacctctgtctttatggaggccacgttgaacctctaattctggagaatggtaacattgaagaggacattagtggccattgacrtttatgtctcctgatgccaccctacatataagtgaatgaatattaccaggatgaatgctacttttcttatgataggaattgattgaggaggataggagca

SEQ ID NO: 49389 - DNA, 201 bp, Homo sapiens
ttaacctgttctccacctgtagttttgtcacttcaaggatggtacataatggaatcatacaatatgtaactctttgatattaactctttttttttttttttgagacggagtctttcccagccacccaggctggagtacagtggcacaatctcggctcattgcgacctccgcctcccaggtttaagccattctcctgcgtca

SEQ ID NO: 49390 - DNA, 201 bp, Homo sapiens
cattgcactccagcccgggcgacgaagcaagactccctccgtctcaaaaaaaaaaaaaaaaaaaaaaaaaagcctagcaccaaagtattagcaagttcctsttatttattaatgttctcatactttcattgaatttttaaacctaatgatgtttattttcaaacacttcagtccatttattattgaatataaaatgggtgc

SEQ ID NO: 49391 - DNA, 201 bp, Homo sapiens
tatgtatgcccttgggttgtctagcaagatggtttcataggtagtaataagagcagcaagagaagaaaatagtgtggcctttacctttactgaacactcamtttggaataggcctcatgcttgggactgcctccgtcagtgtgcagccttcagcggctacatttggaaatggtacaagtattaggttggcgcaaaaagtag

SEQ ID NO: 49392 - DNA, 201 bp, Homo sapiens
ctttctctcgtttttgtttccaaaatcactatttattgcccttcaaaacaggttgcgtttgaattagggttctgggcctgtacagtctgtgggagcccaartgcaaagtagattccatcataaacaaggtatcccccctccaaattaacagtaaaataggccatgtgatcccagaatgcatcatttcaggcttataaagaa

SEQ ID NO: 49393 - DNA, 201 bp, Homo sapiens
ctactatcaacaggaactgctgtttctattatcaacaagaatatgcctccaagccaggagtcctgctgatcccactgtctccccaccccaacagccatggyccgagatcagattgtctccatggattctagtgctcagggaagttaagaaaactcaattcacggtgctcagttcaaccttagacatgcatcagaatcactc

SEQ ID NO: 49394 - DNA, 201 bp, Homo sapiens
agcactttctctcgtttttgtttccaaaatcactatttattgcccttcaaaacaggttgcgtttgaattagggttctgggcctgtacagtctgtgggagcscaagtgcaaagtagattccatcataaacaaggtatcccccctccaaattaacagtaaaataggccatgtgatcccagaatgcatcatttcaggcttataa

SEQ ID NO: 49395 - DNA, 201 bp, Homo sapiens
agattgtctccatggattctagtgctcagggaagttaagaaaactcaattcacggtgctcagttcaaccttagacatgcatcagaatcactcacattgctktttaattttttaattaaataaaaatatttattcagccgaggtagctgaagcaggagaaggaagagcctcaactcaggggaagatttgctgtcaccccctg

SEQ ID NO: 49396 - DNA, 201 bp, Homo sapiens
catctcttactttgcgtctatcattatgatcttactcggagagaaaatggtatcttcctgggctgattgctcattggtggaggcttggcttccaggaagaygcacactggctttccgtagcactttctctcgtttttgtttccaaaatcactatttattgcccttcaaaacaggttgcgtttgaattagggttctgggcct

SEQ ID NO: 49397 - DNA, 201 bp, Homo sapiens
ctccatggattctagtgctcagggaagttaagaaaactcaattcacggtgctcagttcaaccttagacatgcatcagaatcactcacattgctgtttaatwttttaattaaataaaaatatttattcagccgaggtagctgaagcaggagaaggaagagcctcaactcaggggaagatttgctgtcaccccctgacactga

SEQ ID NO: 49398 - DNA, 201 bp, Homo sapiens
tagtatccttctgtgacattcataagatgttaacctgcctacacacttttttttttttttgagacagcgtcttacccgtcgcccaggatggactgcaatarcatgatcttggcttactgcaacctctgcctcccgggttcaaatgattctcctgcctcagcctcccgagtagctgggattacaggtgcctaccaccacacc

SEQ ID NO: 49399 - DNA, 201 bp, Homo sapiens
ctaacacctaattgtcacctcccactaaatgccagtaacacccccgattattgtgacactcaaaaatcgccccctcgcacttcgaaagcacacccctatasacactgatcttctgttaaccctgccttgaatgacttcggtagcctgaattcccatcctggccccactgcctcatagcttcgtggccctgggcaagcccac

SEQ ID NO: 49400 - DNA, 201 bp, Homo sapiens
caagcccacaacccccaaacctcagtttcctcatctgtgatatgggtgcatggaggaggttaaataacagctccaatcttaaagcctccttagcgccgtgmctcacgagctgtaagtactaaatgaatgccggctattatatataacttatattgtatattatttatgattgttcctaaaattatcactaataagtgcttc

SEQ ID NO: 49401 - DNA, 201 bp, Homo sapiens
ggaggatggaggtagcttctagaaggaggtgggcctgagccgcccctgaagaatgttgggaatctgggtcaggcaagaggctggaggagagaggtgaagarctggaaggaagttgggaggggagaggcccaggggagggcatagatggagggtgatggggtgtgggtgcccaggcctgggaattcagacctgccaatagcc

SEQ ID NO: 49402 - DNA, 201 bp, Homo sapiens
aggttttatatactgtatcctcctgtgttagaaaatggggtattaaaaaggcttcatgccctcagcatcagggaagaagaagaaataaaggctgatacctmtgtctttatggaggccacgttgaacctctaattctggagaatggtaacattgaagaggacattagtggccattgacatttatgtctcctgatgccaccct

SEQ ID NO: 49403 - DNA, 201 bp, Homo sapiens
aaggaatgtgttcattttattgccattttactaccacagcatggtagattccagctattaatcctcatggtataaggtgctttttatatcttcaaaaatakggtatagccttgatctctcttcttgctgctctggaattaaaatagaaatctttatccctatctcaaaatctttggggcaggttaggagagctgggcttca

SEQ ID NO: 49404 - DNA, 201 bp, Homo sapiens
tatacagtggatgttggaagggtgttcataggttgcatgccgatactttgccgctttatataagagacttgagcattccaggattttggtgtttgtggggragggatgttgaaaccaatatctgcgggtaccaagggacaattgtaactggattctagagcacattctgagtttgttggcagttttattaatcatatttgt

SEQ ID NO: 49405 - DNA, 201 bp, Homo sapiens
tctggttcagacaccttttctgcacccagttattctcactcataatttctttctccttgggtttttgttttattttggaacggctttttaaccttcagaartacattttgtctggaggaccagagcatcgatgtgatcctacctgtagattcttggcaagagagaaaatgttcttattaatgcagaaagtcctacccagaa

SEQ ID NO: 49406 - DNA, 201 bp, Homo sapiens
gggcttggtcaggcttcctggtcactgccagtgctgagacattaaagatccaggccccacggagaaccagggcacctggactttgatcttgccataatggyatgcctccatttaagaactaggtcagctgtctttcacaccagctgtgttcttcatgcttagggcaataacatgtataaagtaatgggtatttttctagta

SEQ ID NO: 49407 - DNA, 201 bp, Homo sapiens
ccaagccatatcagtgggatagatatcatttggaatatggttgccttccattctgatctcattctatcaaagttggtagatcctaacatggtgacccagcragagtctcttttcaaactggctgtcctcgggggtaggagcagagccagggcaaaccgtcagggatgctaagtaaggagcttcaaggggatccaaggcacc

SEQ ID NO: 49408 - DNA, 201 bp, Homo sapiens
tcataggtagtaataagagcagcaagagaagaaaatagtgtggcctttacctttactgaacactcactttggaataggcctcatgcttgggactgcctccrtcagtgtgcagccttcagcggctacatttggaaatggtacaagtattaggttggcgcaaaaagtagttgcggttttgccactgaaagtaatggcaaatac

SEQ ID NO: 49409 - DNA, 201 bp, Homo sapiens
acattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgt

SEQ ID NO: 49410 - DNA, 201 bp, Homo sapiens
gtcagtgtgcagccttcagcggctacatttggaaatggtacaagtattaggttggcgcaaaaagtagttgcggttttgccactgaaagtaatggcaaatayttagaaatatttagaatatttagaaagtacctgctgttctgactatcttaattcagatgtgcactcaccttttggctcacgacaacaaaagccttcgaaa

SEQ ID NO: 49411 - DNA, 201 bp, Homo sapiens
ccttcagcggctacatttggaaatggtacaagtattaggttggcgcaaaaagtagttgcggttttgccactgaaagtaatggcaaatacttagaaatattyagaatatttagaaagtacctgctgttctgactatcttaattcagatgtgcactcaccttttggctcacgacaacaaaagccttcgaaattcctgcctgtt

SEQ ID NO: 49412 - DNA, 201 bp, Homo sapiens
gtgggcagaggcatttggctctgcactggtttttatggtgtgggaaaggaagcattctcgtgggaatattgttcttgcctccaggaagggctgtgggaacrtgcagttactgcagagggacatttctgagcatacatgcttgtttatgatgatggatgactggctcaggagagagctaaaatgatcctttccctagagatg

SEQ ID NO: 49413 - DNA, 201 bp, Homo sapiens
agttactgcagagggacatttctgagcatacatgcttgtttatgatgatggatgactggctcaggagagagctaaaatgatcctttccctagagatgtgargagaagccagcccagaatttctgtcacaatctgctgcccgagtccagtgactcagaaacaaagttcatctttactgacgtgccatggctgccaggaacca

SEQ ID NO: 49414 - DNA, 201 bp, Homo sapiens
tccagtgactcagaaacaaagttcatctttactgacgtgccatggctgccaggaaccagggcagctgctaagccaccaatccccagcccacagttttgtgyggaggagacatagacatatatgttattgcaattatggctctactgaaagaatgaatgaatttaatcgaatcaatcattcattcaattcagttgaatcatt

SEQ ID NO: 49415 - DNA, 201 bp, Homo sapiens
cggcagcagtctgtctgcctgtgttgtcaacagtccctgaattaaatcagtcactgctgccgccaatgaacttgtaggttgttgtgggataaggggccctmggcagtttcttcatctctgcttgaccaaaccacgcatcaaggtcatggatcccaggtgcccctgaagacattcaagaagtctcgttcgccagctgagcaa

SEQ ID NO: 49416 - DNA, 201 bp, Homo sapiens
aggagacatagacatatatgttattgcaattatggctctactgaaagaatgaatgaatttaatcgaatcaatcattcattcaattcagttgaatcattcaytcattgaattgaatcattcattcaatgaatgaatcccctggtcaaggaaccaggctcagcccacaatgtatgcatttattcattcattcatttaacaagc

SEQ ID NO: 49417 - DNA, 201 bp, Homo sapiens
gcttgaggtggacagtgtcaaaatggcaagctccccaaagaggaaaggaaagagggatgtcactctaggatgcgccaacgagatgctccttaggaaccacrgaagtgacacttgtcagcatccacacaacaaaatgttgatgaggggagccagccttggtgactcctagcagctcccggcagcagtctgtctgcctgtgtt

SEQ ID NO: 49418 - DNA, 201 bp, Homo sapiens
aaaatgatggagttctttcatttagcagagttacagcttgaggtggacagtgtcaaaatggcaagctccccaaagaggaaaggaaagagggatgtcactcyaggatgcgccaacgagatgctccttaggaaccacagaagtgacacttgtcagcatccacacaacaaaatgttgatgaggggagccagccttggtgactcc

SEQ ID NO: 49419 - DNA, 201 bp, Homo sapiens
tcagtaacagaaatgtattttagctgccgtatttcatagagccctgataccacccttacttcccacatgacctgtcatctgacagcaggctggcagacagscatttaacagattcatctcgggttggcaaacatctagcctagctttgaaaacccacgtgttgatctcagacctgcctttacatccctgcaccaccatttt

SEQ ID NO: 49420 - DNA, 201 bp, Homo sapiens
ctccctcatttatcactctggggacataaacgagaagtctactctccacttcattcactttggactaatatcctcgacacaatttaaatcccatctcttcmagactattcaatgagagcaaggcagtggaacacccagcatccaattggaaaactccttggccatcaatgtagaagattgacaagctcagtcacatgagct

SEQ ID NO: 49421 - DNA, 201 bp, Homo sapiens
ggcatgtgcctgtaatcccagctacttgggaggctgaggcaggagaatcactggaacctaggaggcggaggttgcagtgagccaagactgtgccactgcaytctagcctgggagacagagtgagactctgtctcaaaaaaaaaaaaagtcaaggaagatcaaatactcaaggctcctagtgatcatcaattagacatccga

SEQ ID NO: 49422 - DNA, 201 bp, Homo sapiens
tgtgccactgcactctagcctgggagacagagtgagactctgtctcaaaaaaaaaaaaagtcaaggaagatcaaatactcaaggctcctagtgatcatcarttagacatccgagttcttctgggaggtcctgtttgccagtggtcatcctgtcatttccatcagtgatgtctggaaggtttgataccaagaagttacctcc

SEQ ID NO: 49423 - DNA, 201 bp, Homo sapiens
tctcaactaaattgcaagctgatgtcttactattgacaggaataaagtttcataaggtgttccctgcagtggcctgactgtgcaaggtgctgatagatacytgctagttgataatgatgcctctcacatggccagtcattttagcaattagtttcattgatattgtgggactgggcttattggagatttgactgaattgac

SEQ ID NO: 49424 - DNA, 201 bp, Homo sapiens
gcattcctcggtgcaaaatatgagatgtcctttgactatataatataaaatatactataacatataatattgaccttatattgaagatgtatttgtacccracatacaatatttttagaaataatgtttcattataaaattttttacacgtacagaaaagtttaattttgcagtgagcactcatgtacccaccacctagat

SEQ ID NO: 49425 - DNA, 201 bp, Homo sapiens
gtctttaccatatatcattatccaatatattcctttatatcattatccaaataaatacatctgatcaaatcccccaaattgctttcttctcagcattcctyggtgcaaaatatgagatgtcctttgactatataatataaaatatactataacatataatattgaccttatattgaagatgtatttgtacccgacatacaa

SEQ ID NO: 49426 - DNA, 201 bp, Homo sapiens
attatcaaaatacagggttatcatttgcagagaacatgtgttttgtgtttgtggggtctggagagagtgatcatacaatttctaattcaaagcagaatacycttgaaagtaaatcaggactttcctgttgaaactagaacaggaagtcaccttagcagtggtagatctttgaattcgtctcctcctggttctgcggagagc

SEQ ID NO: 49427 - DNA, 201 bp, Homo sapiens
aatctgctctaagcagttggatggggagtgccttttcgcctgtctaccccttcccaaggactatttatattgaggcaaccaaatgatcaaggaagaattcrtgaatagccatgatcaaagtaaccagacagggagttagaggttcaatcgtatttggggaaaatggtccaatgatggggaaagggcccaggttttgacacc

SEQ ID NO: 49428 - DNA, 201 bp, Homo sapiens
atatccaagtatgaaagttaatttcggtatttaataatcattaagtaaagagagagtgaaatatctacactatgtaattacataaaacatgcttctggcartatttgccccctaggaaattcaaataggaagtctccaaggagcaaggttgtattcttggaggtggacacaaagtaattgagctttgctaatggagataat

SEQ ID NO: 49429 - DNA, 201 bp, Homo sapiens
atgtctaaccgcctgggaacgcagcccagtaagtctcagccttatttcagtcagcccctgttcaagatggtgttgatctggttcaaacgcctctgacactrccatgccaggctaattttgcatattttttggagaagcagggtttccccttgttgcccaggctggtctcaaactcctgagctcaagtggtctgcccacctc

SEQ ID NO: 49430 - DNA, 201 bp, Homo sapiens
catcgccatcttggttttggtgtttttccggcttctttactgcaacctattttatcagcaaggtcttcatgacctgtatcctgtgccaacctcccatcttrtcctgtttatgtctaaccgcctgggaacgcagcccagtaagtctcagccttatttcagtcagcccctgttcaagatggtgttgatctggttcaaacgcct

SEQ ID NO: 49431 - DNA, 201 bp, Homo sapiens
caagaaagaattcgaggcaagtccgtaaagtgaaagcaagttttttgggaaaatcaatgaatacaagtatggctacaccatagacagagcagccccaaggrccaaaggactatttcttgactgtgtgttaaacaaggagcagattattcaagacttttccaggaaatggatgggcaattcccagggctttttagaccgtat

SEQ ID NO: 49432 - DNA, 201 bp, Homo sapiens
aagagatgctctgaggaccatactttgcatagcaagaaatgagaacagtccaggagcctctaagatccctcacatttgaggctagaagcatgtaacatgartgggttctcaaacctaaaagtcagggcttgggcataaactaaaactgtgatcacctcgcgtagatttgaggctttgactggtcgtcaaccccacccacaa

SEQ ID NO: 49433 - DNA, 201 bp, Homo sapiens
gcctcttctctgtcccagtatgtgtggtaggtgctcagtagaaccagtggttggttgttggggggaggtaatacctgtttttatggccttatagcctttgygtactaaaccttaagaccatttcttatttcactaagtcacaccttgcccaggagagaatcgtatacatctcatacattatgttccaaatcacgtaaccta

SEQ ID NO: 49434 - DNA, 201 bp, Homo sapiens
ccccaagagagggttcttggatcttacacaagaaagaattcgaggcaagtccgtaaagtgaaagcaagttttttgggaaaatcaatgaatacaagtatggstacaccatagacagagcagccccaagggccaaaggactatttcttgactgtgtgttaaacaaggagcagattattcaagacttttccaggaaatggatgg

SEQ ID NO: 49435 - DNA, 201 bp, Homo sapiens
agaccccaagagagggttcttggatcttacacaagaaagaattcgaggcaagtccgtaaagtgaaagcaagttttttgggaaaatcaatgaatacaagtawggctacaccatagacagagcagccccaagggccaaaggactatttcttgactgtgtgttaaacaaggagcagattattcaagacttttccaggaaatgga

SEQ ID NO: 49436 - DNA, 201 bp, Homo sapiens
gtctgcagtgagccacagttgcactccagcctgggcaacatggcaagactcggtctcaaaaaaaaaaaaaaaaaaaaaaaaaaaaggaaactttaaaagtyaaaaaaaatagaaaaaataccaatagggaatgaggaaataagtcagggaagagaaggcaggtaatgaatgtgagttatcaagctagattctctggtggac

SEQ ID NO: 49437 - DNA, 201 bp, Homo sapiens
cagtctcggcctctcaggctcaagcaatcctctcacctcagccccccaagtagctggggttataggtacacgccactgttaccggaaagaggtcccaatcyagaccccaagagagggttcttggatcttacacaagaaagaattcgaggcaagtccgtaaagtgaaagcaagttttttgggaaaatcaatgaatacaagta

SEQ ID NO: 49438 - DNA, 201 bp, Homo sapiens
aaaatactagctgggtgcagtggctcacgcctgtagtcttggcactttgggaagtcgaggtgggtggatcacttaagctcaggagtttgagagcagcctgwgcaacatagtgaaacctcctcagtacaaaaaatagaaaaattagctgggcttggtgacgagtgcctgtagtctcagctacttgggaggctgaggtgggag

SEQ ID NO: 49439 - DNA, 201 bp, Homo sapiens
gtcacccaggctggagtgcagtggtgcaatctcaactcactgcagtctcggcctctcaggctcaagcaatcctctcacctcagccccccaagtagctgggrttataggtacacgccactgttaccggaaagaggtcccaatccagaccccaagagagggttcttggatcttacacaagaaagaattcgaggcaagtccgta

SEQ ID NO: 49440 - DNA, 201 bp, Homo sapiens
aaagcagactttgggtcgagactgccgagtctctacttttactgaatttagtcctgaatcccacacagactccctgtacccgctctccctaggacgcctcrgaatggtcctccgtgatgccgctgcgcctgtgctgtctggaccaccttctgccttggtgttctgacaacatcctagagcatctcacctctctcggctctt

SEQ ID NO: 49441 - DNA, 201 bp, Homo sapiens
acagtgtagtcaagtcaaggcagtagctcaggtaaacacacaatgccacaaacaggagttctcaaaccttggctgcattttagaatcacttgagcttccaraagcttcaatgcccaagacacaccccagatgcaccccaattgccagtgaccctggaatctttggggaggacctggtcatcagcatgtctttgagctcccc

SEQ ID NO: 49442 - DNA, 201 bp, Homo sapiens
cggagccatgaccaaaagcagactttgggtcgagactgccgagtctctacttttactgaatttagtcctgaatcccacacagactccctgtacccgctctscctaggacgcctcggaatggtcctccgtgatgccgctgcgcctgtgctgtctggaccaccttctgccttggtgttctgacaacatcctagagcatctcac

SEQ ID NO: 49443 - DNA, 201 bp, Homo sapiens
agcatctggtgtgggtctgaaggctgggcaggaattagctggtagcagtgtgcattccaggctaggggaaccccagtactaaagcttcttcagcacaaagwggcttggtttgtgctttgaacatagcgtggttataaattaaagaataaccaaactccttgagttgaatcagtacacaccataatgcatcagctcacattg

SEQ ID NO: 49444 - DNA, 201 bp, Homo sapiens
atcctgtgtatgtgccacttgggatgccagcattttgattgcttccagagcgatctaaccagagcctgctctcaagacaagggaatccatgattcacaagyggaaccgtacagatgccagaccacagcgttcttttcactttgatttgagggagatgatgttggtcagggtgatgactcccccatttcaatttctctgatg

SEQ ID NO: 49445 - DNA, 201 bp, Homo sapiens
cttgccatcagtagataggctcatctctctgatccggaaggcggcagaggcactccttctgacattgcagatgaaaataaggtctgcttttttcccacagygctcttcaaaggagcaattttctaaaattcgaacaagggtgtcatagttaataagatggaattctccttttctttttcttattatattttccaaatcaag

SEQ ID NO: 49446 - DNA, 201 bp, Homo sapiens
gaatgggccctgcaaagtaatctcagagattgagccacacatagacaaagatggagaacacagctcacctgcagagtgctgtttctcatcactaactgtgstttctctcagtcctgactttttatgctgaggattctgggagaaatttcaccttctttacttcctacaggatatccagtttcctggtctgggagctgagag

SEQ ID NO: 49447 - DNA, 201 bp, Homo sapiens
actcaatcatatcaggcactgatgttctgatggtgcagctgatcctgagatgcaaacaccccatgatcttctgctgtctgattccctgctatgtccctgtrtgtagtctaaacagtctattcactgaacagttttttagtaacaacaaaagtaataatatgttggtaatagtttgtcaatgtctaccctggagaatatcag

SEQ ID NO: 49448 - DNA, 201 bp, Homo sapiens
gtgtagaatttaggtcaagatgcactgagaataatttgcaaaacccgtaaatccgtagctgatatatttaacaccaggtccaaactgtttctgaaggattraatctcttgcctgaatactgaagaaaatggaggcatgatctgaggttggggaatattctaccttgccaaggataactgtagagtattgtgacaaagtgca

SEQ ID NO: 49449 - DNA, 201 bp, Homo sapiens
tttatgatgagaaaatcatgtggcataaaagagaataattgccttcataagtgtataattttttatactataagcttctcaatgaaaaagcattctaaggraggcataattgctaattttcggtgttaaacatacctctgaagagtatttcacagtctaactctctgagtgtcatgtcttcctgtggcccggggaagagag

SEQ ID NO: 49450 - DNA, 201 bp, Homo sapiens
ttccctactccttctattttaactgtcaaaatcatagactgcattgtttccaactgaaaatccgctgacagctccccaccaaccaccccgtgagccttccyagggctggcgttgatgatgctgctatcaatggggaatctacattgtgcacgggtatttatgatgagaaaatcatgtggcataaaagagaataattgcctt

SEQ ID NO: 49451 - DNA, 201 bp, Homo sapiens
tctctcataatgtttgtttgcctcttactcattttctgagctagtcaccaaaacgtatctgacactttcttgcttaacctggcgggagtggtagcggatgytcctggtgcccccgttgcattccctcacctttctgccagctcagcttccagtagccagcgcctgcctgtgtttctctgcctgagggctctctccggctgc

SEQ ID NO: 49452 - DNA, 201 bp, Homo sapiens
caggactgcctacaaaggccagtgtctcagagcacaaatgaggatgcagatgagagcaggtctgttctggcatggcaaaggggcttgcccagcactatcascaatctgcaaaaagatattcttgggaagactctggtgtctgaaagattaaagggaaaatgcatccacgtgataaaatattattcagccagaagaaggaat

SEQ ID NO: 49453 - DNA, 201 bp, Homo sapiens
gcaagtcacaaatgtgtggtttccaaacctggactgggtggggctgacagggatttcttccattttttctgtttatctctgaatggttcctttagctgctsacttggcaactgaactcaacgttgtcctctgcccccaaggctctcttttgtccattctctctttctcggaggatgactttgcctcctacttccaattcaa

SEQ ID NO: 49454 - DNA, 201 bp, Homo sapiens
gggattacaggcgtgaggcaccgcacctggccaataaagtatttttaagcctctcagattttagaactttgttacagcagcattatgaaattgatacacgsgggcatgttttcctgaaatcagagcctgagaggagaaccaggtacaggtagttttctttgggaggtgatccaggaagcaggagtaaggaaggatgagaag

SEQ ID NO: 49455 - DNA, 201 bp, Homo sapiens
agcaacactgtcacaggtaaaacgtgaggaaacaagcttgcttcttttttttttttttttcaaagcagggtctcactctgttgcccaggctggagtgcagkggaacaatcacagttcactgcagcctccacctccaaggctccaatggtcctcctatgtcagcctcctgcgtagctggggctacacaagtttgcttcttat

SEQ ID NO: 49456 - DNA, 201 bp, Homo sapiens
cggcagaggcactccttctgacattgcagatgaaaataaggtctgcttttttcccacagtgctcttcaaaggagcaattttctaaaattcgaacaagggtrtcatagttaataagatggaattctccttttctttttcttattatattttccaaatcaagggcagtagattccagaactccaatgacgtcaggccactgta

SEQ ID NO: 49457 - DNA, 201 bp, Homo sapiens
tcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagtggaacaatcacagttcactgcagcctccacctccaaggctccaatggtcctcctatgtc

SEQ ID NO: 49458 - DNA, 201 bp, Homo sapiens
tgtgtgctcatgtgtgtgtgtgcatgtgtgtgtgcacacgtgtgtctatgtgtgtgtgtgtgtaatttaagccaaaatgacggaccctgtgttatctttgsagatccgtggtctcaggccatgcttaattcttccacgctggtttattggttcctgtgttccaaagctccgcatgtaccctgtttaaaggacggtccactt

SEQ ID NO: 49459 - DNA, 201 bp, Homo sapiens
attctgttggccagtgcttagtcacatgtctaaaattgtaatggagcagcagcaccatgtcctattgtgagaagtagccagagactaatctcaatgacagktcttatagcttgaaaaggtatttgcaaaatctaaagcaaaagttgccaactcgaatgcctagatgtccaagcaagtgtttaactgaattgagtgagcaga

SEQ ID NO: 49460 - DNA, 201 bp, Homo sapiens
ctttgggagagctgattgccgcatgtcttgccggttctgcatgtgtgcggtgatatcgagtacatagcttgaaattggccatggggggaatatttaagcasaaaaatggacacaagctacaaatcagggcttttccccctgaattgccattaaacatttaccagcacaatactgtgggttagttatggtgtttgcccacct

SEQ ID NO: 49461 - DNA, 201 bp, Homo sapiens
ggtgatctttgaggtgagcttttatgaataggcaaaatttgggtaaagaggtagacccatttttaagagcagggtgacatgaaaatctcaggatatattastcagcaattaatcctcattgttgtaacaaatagttacaaaattctcgttgcatggctctggcttacctgcaaagcaaagtagaaaatggagaagctccca

SEQ ID NO: 49462 - DNA, 201 bp, Homo sapiens
accttgggagtccttccttcctatttccatggataggagaagagaagatatcatgcaggacattcaggggccatgtctagaagacgtgagaatccttccamccttattctgttggccagtgcttagtcacatgtctaaaattgtaatggagcagcagcaccatgtcctattgtgagaagtagccagagactaatctcaatg

SEQ ID NO: 49463 - DNA, 201 bp, Homo sapiens
aactctgccccttcacagcacagggcccggtggaggctgcccttccagggagcccaggctcacgtgtacttgccagggctggctgtccctgtccagcaggkcacagacctctcctggtctgacactgaggagtgaccagtgctgactcagagcagcccatctacgggcgcactgttcagaaagtcgtggaggtagatatac

SEQ ID NO: 49464 - DNA, 201 bp, Homo sapiens
gcagtccccagcctttttggcaccagggaccggtttcgtagaacacaattttttcacagatggcaggggtggtgggggatggtttcgggatgacactgttycaccttagatcatcaggcatcagttagattctcttaagaaacgtgcagcctggatccctctcattcccagttcacaataaggtttccgttcctatgagaa

SEQ ID NO: 49465 - DNA, 201 bp, Homo sapiens
gactgattctgggctctttctattggatgactctgccaccttgggagtccttccttcctatttccatggataggagaagagaagatatcatgcaggacatycaggggccatgtctagaagacgtgagaatccttccacccttattctgttggccagtgcttagtcacatgtctaaaattgtaatggagcagcagcaccatg

SEQ ID NO: 49466 - DNA, 201 bp, Homo sapiens
acgtgtacttgccagggctggctgtccctgtccagcaggtcacagacctctcctggtctgacactgaggagtgaccagtgctgactcagagcagcccatcyacgggcgcactgttcagaaagtcgtggaggtagatatactgctccagcgttggggtcataaggccacaggccggggactgctgcagagccacgttaaaca

SEQ ID NO: 49467 - DNA, 201 bp, Homo sapiens
aaacccaaacaaactgaattgtccacttgtaccagcctcacacaggaatggtcaaaatacctcttttccttcagctctgggaaattgaaaagacaaatcasttagcggaagcctaagactagaggctcacccttcgacaaggaaattcacttgtattttctccggagtcaaggatcccctgtttgcactcatttcgttgtt

SEQ ID NO: 49468 - DNA, 201 bp, Homo sapiens
gaaagcaacaatgggaccgacgaaactaaaagcagtctccccttttacctccccaagaactgtaaaaccatttgtaagtgtctgtgaccttaatgaccagmaacgtgtcaggttttctgtgttcctggggctgtaaaacaccaggaacattttaaggaggtcagactcagcaggggcgtggacatgagtacatgcacatgt

SEQ ID NO: 49469 - DNA, 201 bp, Homo sapiens
tactcacttcctaaataacactgttctcaggaccttcattactgcatatatattaataattcacaaatctgaatttcatcctttgcctctcatttggtttycaaatttattttcactcacaattcctacatagtcagacaccttcaacttcacgtttccattttgattctttgtcttgccttccatgtcttgtagcttatc

SEQ ID NO: 49470 - DNA, 201 bp, Homo sapiens
ggtgtctttgctaatcgcccctgaatgcacggttcaattcagggctgtaaatccatatatcagagccagaaccagttagctgtctggtctataataaccaygcactggcctctcacatcatgggcactggaccctgtggctgaaaagaaagtctcaacaaacccaaacaaactgaattgtccacttgtaccagcctcacac

SEQ ID NO: 49471 - DNA, 201 bp, Homo sapiens
aatacagtttcctttgctattgatcccctttccgcaatccaggctctcattgatctgctttctctaataatggttttgtcttttctagaatgtcttaaagygtaccagtattttgttcctttctattgcgaaacgtattatggacagacacggcctgcaaaggcattaaacccaggtagagtgggctgtcttcggcctgca

SEQ ID NO: 49472 - DNA, 201 bp, Homo sapiens
agtgctagccaaagtgtgtcatctccactctctttctttccttggtaccatggatgtgtttgatatggtgccagctgcaaagtagtggaggcttcttcagygtgggttcttgagctgtcatatagcataaagccgccacccaccattctgaattcacagcatgagcaagagataaacaaacctttgttgagttaaggctct

SEQ ID NO: 49473 - DNA, 201 bp, Homo sapiens
agctctacaaataggaacaggtgtctttgctaatcgcccctgaatgcacggttcaattcagggctgtaaatccatatatcagagccagaaccagttagctrtctggtctataataaccacgcactggcctctcacatcatgggcactggaccctgtggctgaaaagaaagtctcaacaaacccaaacaaactgaattgtcc

SEQ ID NO: 49474 - DNA, 201 bp, Homo sapiens
agagaagcagttggattttatatgtgaaaatgcctctatttgctgcatttttactttttgagaagttgcaagttacatgaaaataaacatactatataagraaacacggcagatttctcctggtgttttaataattccccgaaggtttatgaatattggcaaacgtatttgcagtggtacttccctgctatttactttgta

SEQ ID NO: 49475 - DNA, 201 bp, Homo sapiens
acattgtgtgcagatgccctgaggcatacaagagcccggttgaggggctgagaggtggggccagggcgggttgggagaggtggcacacacccagggactcwgtcccctattacagactccaggaagccatgcatttccctcgagttcccccaaatcactccccagtcacgattaacgggctctcttttctttcacttgggc

SEQ ID NO: 49476 - DNA, 201 bp, Homo sapiens
ctactgtgagccagtttctgtcctgaaacatttgatttgtgtttactcattgactcatacaaccaatgggagtagacacaattattagttgtgttttgcaratgaggaaactaaggcaaagagaatttaagtaacttgctcagggtcacatagaaactaactggaaaaattgagatttcgacccagttagtctagcctgcg

SEQ ID NO: 49477 - DNA, 201 bp, Homo sapiens
gagggttgaaaaactactagatgctgtgctagctaggtgacaggaccaatgatactcaaacctcagcgccacacaatatacctaggtaacaaacctgcacwtgtacccgctgaatctaaaacgaaagttgaaattataaaataaataaataaatgtggtgcttatttttaaaataaatgaacaaaaaaaccccaaagagct

SEQ ID NO: 49478 - DNA, 201 bp, Homo sapiens
atataggggctcctttgtttgacttaagggaaacaggtattatatggcattcgacatcactaatttaattacaaaaaattcataaatagatgcaaataccrccaaccctgagcaggcacatcctctggtttctcctaagggccagccagcaagccaggcattcccagtgtagtaacttaaattcttacaaaactgtatttt

SEQ ID NO: 49479 - DNA, 201 bp, Homo sapiens
agggttgaaaaactactagatgctgtgctagctaggtgacaggaccaatgatactcaaacctcagcgccacacaatatacctaggtaacaaacctgcactygtacccgctgaatctaaaacgaaagttgaaattataaaataaataaataaatgtggtgcttatttttaaaataaatgaacaaaaaaaccccaaagagctt

SEQ ID NO: 49480 - DNA, 201 bp, Homo sapiens
tttaaaaattgaaaatcaacaaatccaaaagtttgtcctataaaaagattgaataaaattgtaaactcatatcgaaactgttgggcaaaaaaagaaaaaarcacaaattaccaacactgggaataaaaaagggaaaatgactatagccatcaaaaagatacaaagatattatgaacggcattatgcaatatatttgacaat

SEQ ID NO: 49481 - DNA, 201 bp, Homo sapiens
tattaactattattgtaatctgtcaagaatcatcccaaatataccttgtgctaagaacctttcctcatcatttccttggggtgtaatacaaaaatctgacrtattccagaggcttggataccctccttggtactcacttggcatagcttccatcacactgtattttgtaattgctcatgagtgtgctagttaggataagta

SEQ ID NO: 49482 - DNA, 201 bp, Homo sapiens
gctctttggagaatggactgtagcaagcagaagagaagcaaagaatcaggtgcattgcagtggtctacacaaaagacgatccctagtcgtcttaccacctrcctcctacaataaccaaagaaagtggacccacaccacagctacctcggtccactgcatgtgtggaaggtgatgattctcttgggcatgatatatattact

SEQ ID NO: 49483 - DNA, 201 bp, Homo sapiens
gaatttcagaattctatcagctaaatacctcttgaagctccgattaccaagactataagcccttctacagcattaagggattgctcgtaaagatactgctrttatgcatctggtgtaaagcctcctcatctttagctcaattcaacaagtttccattcagtgcccagctctaaaagtcttaaatggaaattgattccctac

SEQ ID NO: 49484 - DNA, 201 bp, Homo sapiens
tgacctcagatgatctgcctaccttggcctcccaaagtgcactgccttcattcattcttaaatcattcatttctttgtggaagccccttagctccatgtastttatggatgtgtcagaacaaactgaatattgtttattcttttactttttaaagagatgagtatttgagtcctctgattcacagtgaatttcagaattct

SEQ ID NO: 49485 - DNA, 201 bp, Homo sapiens
attttcatataatattttagttgttgtaaaacctgcatttcagtagtttaatctgtcagtaattcacgcaataaattagagctctaatggtggcttagaarggccttctcccctgtattacttaaatattcaatgactttattcctcctaatacttaaatccatctggaattcattagactatactttaaatttgtatgta

SEQ ID NO: 49486 - DNA, 201 bp, Homo sapiens
taatgagtatacatgttgctacacacatacacacacaaccacacacgcacatatcaggctaaatttctacaagtgaaattttcaaagcttgtgatgggtgytaacaaattgcatttcggaaagattttttcatgtaattgataatatatgagagtttatttcctcataagtctgtcaaacactatgaactttttctaatta

SEQ ID NO: 49487 - DNA, 201 bp, Homo sapiens
tgtatacactaattttagtcagaatttgtacttcttaacatgcatactataccattagtatatttttacattctctaaagtgtgtctgcaatgcagtgttstactttctgcagataccatagtttctttcatcaatcttttataacattgtgttgattgtagttttttctatctttaagcaatattgtaatgagtatacat

SEQ ID NO: 49488 - DNA, 201 bp, Homo sapiens
tataccccaacttttacatgctcccagagagatctatattttcctttccagttaaattttaatcttggtgaatcacttaaattatgatttgttaatgcctsttttctttttgagaccataattatatttaacaattattgactccttatcctgtgtggcacctttctcattgctttggacaatgtgtagcaaagtcctcac

SEQ ID NO: 49489 - DNA, 201 bp, Homo sapiens
aaacctgcacttgtacccgctgaatctaaaacgaaagttgaaattataaaataaataaataaatgtggtgcttatttttaaaataaatgaacaaaaaaacsccaaagagcttagctaggtgttaagtaccatccaatggacggtgccatccattatataatatagatatttacacacacactcaaacacgcatacatgtat

SEQ ID NO: 49490 - DNA, 201 bp, Homo sapiens
aacttattctgattataaaagtaatgttcagtattgttagtaaaataaattttaaaaaaaacgaacttgtaatttccccactcagagatagcttctgatamcatattggtgcttttacttctatttttttctatccatatgagtataattaaatacatattcacatctatatctatactcattcatatatattcatatgta

SEQ ID NO: 49491 - DNA, 201 bp, Homo sapiens
tataattaaatacatattcacatctatatctatactcattcatatatattcatatgtaagattaaactatatgttcaaattgtattctgctttttaaaatyacactttattttctgggaatgttctcttcataaagttcttccaaaccatgatatttaatgtccacataagaaaacatctcatggactctcaatttattga

SEQ ID NO: 49492 - DNA, 201 bp, Homo sapiens
ggagtgcagtggtgtgatctcagctcactgcaacctgcacctcccgagttcaagtgatcctcccacctcagcctcctgagtagctgggactacagttgccygccaccacacacaactaatttttatgtttttagtagaaatggggtttcaccatgttggcctggctggtcttgaactcctggcctcaggtgatccacccac

SEQ ID NO: 49493 - DNA, 201 bp, Homo sapiens
gttttcatgctgttgatagagacatagctgagactgggaagaaaaagaggtttaattggacttacagttccacatggctggggaggccctagaatcatgamagggggcaaaaggcacttctttcttggtggcggcaagggaacatgagaaagaagcaaaagcagaaacccctgataaacccatcagatgtcttgagattta

SEQ ID NO: 49494 - DNA, 201 bp, Homo sapiens
ggactacagttgcctgccaccacacacaactaatttttatgtttttagtagaaatggggtttcaccatgttggcctggctggtcttgaactcctggcctcrggtgatccacccacctcggcttcccagagtctggaattacaggcgtaagccaccacgcctggccccaaacaaaatttaatttaatccttacaacagtcac

SEQ ID NO: 49495 - DNA, 201 bp, Homo sapiens
ttcttgcctaacgagaagtctcagtgtaggtgatgctgggtttggttcaactgttcaacagtgctatgagaaattcaggctattcctctacttcatctcascatccttaattgtctggctttaatcttcatagttttccccttatattggtctgttttcatgctgttgatagagacatagctgagactgggaagaaaaaga

SEQ ID NO: 49496 - DNA, 201 bp, Homo sapiens
ggtttcaccatgttggcctggctggtcttgaactcctggcctcaggtgatccacccacctcggcttcccagagtctggaattacaggcgtaagccaccacrcctggccccaaacaaaatttaatttaatccttacaacagtcactcaaaggaagaaggatatttgcattattagagcaccttcatgagcttgacattttta

SEQ ID NO: 49497 - DNA, 201 bp, Homo sapiens
ctgtaaattccgtggacacagcagtgaacagaacagaccaagccctgtcctagagtccacctgctagtaagggaacctgacaaatcaaaagttaataaaayacatggtgtgtcagttgctatgataggtcctgataggggctatggaggtcaatggctagagatgagagtaggttgcagttttcaacagggaggccctcag

SEQ ID NO: 49498 - DNA, 201 bp, Homo sapiens
aatatgttaccttacagggcaaatgggactttgtagaagtgattaagtcaaatatattgagattggaagattattctgaattatccagatgggcctgatayaatcacagggtcttaataagggggaggtgggaatggctgggttggagatttaaagatgctctagtgctggctttgaagatggagcaagggcccaccatgc

SEQ ID NO: 49499 - DNA, 201 bp, Homo sapiens
aaaacttcatctcaaaaaataaaatagcttgagtaagtagaggtgtttttcttgcctaacgagaagtctcagtgtaggtgatgctgggtttggttcaactrttcaacagtgctatgagaaattcaggctattcctctacttcatctcaccatccttaattgtctggctttaatcttcatagttttccccttatattggtct

SEQ ID NO: 49500 - DNA, 201 bp, Homo sapiens
gatgcctggcccacagtaggtgctcaataaacgtgtgttgaataatacatgaaggacacgaataaatgtgtgttgaataatgaatgaaagacacaaattcrggaggtaattttgtttgctggtttgtgtccctttatctctttatcttgtgatgtggaaccacactcacagagtcccttcatcttcattcatttcattcat

SEQ ID NO: 49501 - DNA, 201 bp, Homo sapiens
gctacttctcaatcaattatttgggatcagttggtttcatcacatggcattgcatcatgaatatgctgaacaaggccaagggaaggcaacaattaactggsagtttgtaggcttgtgattagatataattaaaagtcacataaagttccaaaaaatatttttcacttgtttcatatctcaacaacttccacttgtttaagt

SEQ ID NO: 49502 - DNA, 201 bp, Homo sapiens
gctgctccacacataggcatatctgtgccagttagacataagcacccggctcattgcgggtacttactgagggggtagaaggaacatagtaccgcccccgyaaaaatgcaattagcctgttatcaaaataacagggagagatgaattcttatctttttgctggaaggtcggaagaggcattgggcttaggaagtggccaca

SEQ ID NO: 49503 - DNA, 201 bp, Homo sapiens
gtgtataacataaagagatgtcctcagatagctcatggcatttgttagctcaggggggttgtagaaagtttcctgtaagcgttttacactcaaagttttcyttatagtgccaaagaatgagaagcaaaagcaattcagcactggaaccgtttggggagtgtggctccattctgaggttctcttctcatcagagtgggggca

SEQ ID NO: 49504 - DNA, 201 bp, Homo sapiens
tcaaacattgttcctcgtgatttattcaaaaattcgcttttccaagtttccgtctaagagcatgtggtgggttcttatcttcatcataaaagtgtataacrtaaagagatgtcctcagatagctcatggcatttgttagctcaggggggttgtagaaagtttcctgtaagcgttttacactcaaagttttctttatagtgc

SEQ ID NO: 49505 - DNA, 201 bp, Homo sapiens
agtttaatgaatcactttccagacctttctctcacatttaggtacatacaatcacccctcggtatctgtgggggccaaaatccagaaacctctgtgaatamcaaaatctgcagatactcaagtctcttttataatatagtgtaatgtttgcgtaaaacctaggcacattctccctatacggttgacccttgaactacatgg

SEQ ID NO: 49506 - DNA, 201 bp, Homo sapiens
tttctgttccaaacagggaggtgggaggaggaagggcaaaatgtttcccatggatgtaccactttttaaagttgtaatctggagtactcatcaacaacatytaattcatgcctttgggggaaagaatggctctaccaacagacaaggtcaaaagctggtgggcctcagaccgaagcttgccataacctcttttgtttggcc

SEQ ID NO: 49507 - DNA, 201 bp, Homo sapiens
tccaaacagggaggtgggaggaggaagggcaaaatgtttcccatggatgtaccactttttaaagttgtaatctggagtactcatcaacaacatttaattcrtgcctttgggggaaagaatggctctaccaacagacaaggtcaaaagctggtgggcctcagaccgaagcttgccataacctcttttgtttggccttctagt

SEQ ID NO: 49508 - DNA, 201 bp, Homo sapiens
ccttgaacccaggaggcagaggttgcagtgagccgagatcgcaccattgcactccagcctgggcaataagcacaaaacttcatctcaaaaaataaaatagsttgagtaagtagaggtgtttttcttgcctaacgagaagtctcagtgtaggtgatgctgggtttggttcaactgttcaacagtgctatgagaaattcaggc

SEQ ID NO: 49509 - DNA, 201 bp, Homo sapiens
gggaaaagtttgttttgacgtggaaggtcaggagtttttgtttgtctcttgtgtccctttttacgttcatgtctgtccagaagtattcatcttctctttgwggtttaaatgccctgggcagctgaattactgtgtgacctcctattgtcagagcatctttgtggaggagaacccatcacctgtctctcgaaaacagttgtc

SEQ ID NO: 49510 - DNA, 201 bp, Homo sapiens
gtaaattcagaggactaagcaaatgtactcagcacatctgcttgtgaacatactgccagcaagtgccatttgttttaagcgatagagaattagatatcctstttgctgtactgttccaaactgcttatttctttctccttctttttcctcatagactatgatcttttgatattatagcaggaaacttggcgtgggctagca

SEQ ID NO: 49511 - DNA, 201 bp, Homo sapiens
aaggatctgtgacctgggaaaagtttgttttgacgtggaaggtcaggagtttttgtttgtctcttgtgtccctttttacgttcatgtctgtccagaagtaytcatcttctctttgtggtttaaatgccctgggcagctgaattactgtgtgacctcctattgtcagagcatctttgtggaggagaacccatcacctgtctc

SEQ ID NO: 49512 - DNA, 201 bp, Homo sapiens
cagaaaggttattgccaaatatggccataaaggttttattgctccaatttttatagcaaaaacagatacacttcttaatgaattttggtttattagatcascaatgaccaacatggggtttctagctcttaggagaccctgatggtggcaatgaaggtctgcaagctattttaaatatttcagaaaatctaatataatctt

SEQ ID NO: 49513 - DNA, 201 bp, Homo sapiens
tttttttttttgagacagagtttggctcttgttgtccaggctggagtacagtggtgtgatctcggctcaccataacctccgcctcccaggttcaagcaatyctcctgcctcaggctcccaaattgctgggattacaggcatgcgccaccacgcccagctaattttctatttttagtagagacggggtttcttcatgttggt

SEQ ID NO: 49514 - DNA, 201 bp, Homo sapiens
ggccatgattagcccaatgaacatttactaatcattgaaatttaagcatggcagcctggtgtgtaaccattgtttgagttagcatacttcagttttccccygttgatttagtctcatgtaaatctctgaagcctcggccagtcttttcttaaatacacgtaacagctaccataattctctttctgctagtcctttggtcca

SEQ ID NO: 49515 - DNA, 201 bp, Homo sapiens
tgagcacgtcactgattctccctcatctcagagttttgccatctcataaacaggcttgacctcgattaatgggttttactccacaatccatggggcccttkattctgtgggtccacctcagaagctgtccaaacatcaagagagaagtggccttggtccagtcctgggcaccccatctcccatcaccaagggccatctgtc

SEQ ID NO: 49516 - DNA, 201 bp, Homo sapiens
aagaaatgataagctgatatttgggtataatattatcttgttatccatgttctttgtattagctgaattatttccatttctgctccaaccaagaaaatcarttcaaacattgttcctcgtgatttattcaaaaattcgcttttccaagtttccgtctaagagcatgtggtgggttcttatcttcatcataaaagtgtataa

SEQ ID NO: 49517 - DNA, 201 bp, Homo sapiens
agtctaagctactcaggaggctgaggcatgggaattgcttgaacctgggaggtggaggttgcagtaagccaagatcataccactgcactccggcctgggcmacagagtgagactccatctcaaaattaaaaagagaagaagaggagagagacagagacacacagaagatccaggagagaaggccaagtaaagttggaggca

SEQ ID NO: 49518 - DNA, 201 bp, Homo sapiens
gacttacaatcatggcagaagggaaagtcaaccgtccttcttcacagggtggcagcaaggagaagtgctgagcaatgcgcagggatagccccttataaaascgtgagatctcttgaaaactcattcactatcatgagaacagcatgagggtaactgccaccatgatccaattacctctcaccaggcccctccaacaacaca

SEQ ID NO: 49519 - DNA, 201 bp, Homo sapiens
taaaatttgagaacctctgatcaagccctgcaagctttttaaccctggtcctgggcagtcagctaaatccaggaagtatttcgcagattgggaataaatargaaaaaaaaaaaggcataagtgtctttgggttgaatctcattttaagccccagaattaggcttgtgaaaacaattcaagaattgtcttcgagcctataat

SEQ ID NO: 49520 - DNA, 201 bp, Homo sapiens
ggtggaggttgcagtgagctgagatcatgccactgcactccagccttggcaacagagtgagactccgtctcaataataataataatataataataataatwgtaataaagaaagtacatggggaaggaatatgttctacatgagctttcacaggggcaccgatctagaccagtgtggactagaagtagccacatcccctga

SEQ ID NO: 49521 - DNA, 201 bp, Homo sapiens
tgagcggagattgcaccactgcactctagcctggcggacagagtgaaactccgtctcaaaataaataaataaataaataaataaataaataaataaataawtaaataaaataaaaataaaggaagggctgggcgtggtggctcatgcctgtaatcccagcactttgggaggccgaggtgggtggatcacgaggtcaggagt

SEQ ID NO: 49522 - DNA, 201 bp, Homo sapiens
accaaaaacaccaggaaatgctgcagccaccaccttcgaaccagcttcaaaggtcagccagtcatcagagtcagaagttttgttttgtgggggcggtggtkgttattgttttgttttgtttttttcctctttattctgaaaagtgccagctctcaagctggggcaaaaatagctttgtgttgtagcctcaatcaatagtcc

SEQ ID NO: 49523 - DNA, 201 bp, Homo sapiens
agtttacttctcctgtccccggttcaataactcacttactggggttctggaggatagcagtgagaagatggggtaaaaaattagagagaagttttgcgttrccccatggctgcttctgtagtgtagtccgtgcatccgcccttcgatgcttgggttggatcatagagcagtgactgttgatggctcacccagatccccagg

SEQ ID NO: 49524 - DNA, 201 bp, Homo sapiens
tccagggtcactcccttgcttcatggtagacccttgatgtcagttccctggcagctggcttgggctcttcctagcgctcagattccacctcagtgggcatrtccggttgcacatcccagaagtatatatcttccccattctgtggcatggttgcaaggacaacattgaacattgggaaaaggaggcaagaacgacaacagt

SEQ ID NO: 49525 - DNA, 201 bp, Homo sapiens
ctcagctagcatttttgaataaataaatgagtgcatggatggaagaaagcaaggttgtctggcagactgtcttggttgaacatgatttcctattcatgatracctagcccatgctcttcaatcctgatagcttttttagattttttaagcccaaggctctgtcttgtcatatgtaccctacccttttcattatccttgaag

SEQ ID NO: 49526 - DNA, 201 bp, Homo sapiens
aaaggttattgccaaatatggccataaaggttttattgctccaatttttatagcaaaaacagatacacttcttaatgaattttggtttattagatcagcartgaccaacatggggtttctagctcttaggagaccctgatggtggcaatgaaggtctgcaagctattttaaatatttcagaaaatctaatataatcttact

SEQ ID NO: 49527 - DNA, 201 bp, Homo sapiens
ggtctgcaagctattttaaatatttcagaaaatctaatataatcttacttttacaaatgataaagcttcacaaacaaaaacatcaagatgttttgcttttkactgaaatgatattagctctgcatggtgaacttagtaatttaattctgatcagcagctctggttggcagttatatgtgcctttgattaataaaacatggg

SEQ ID NO: 49528 - DNA, 201 bp, Homo sapiens
aagcttcacaaacaaaaacatcaagatgttttgcttttgactgaaatgatattagctctgcatggtgaacttagtaatttaattctgatcagcagctctgrttggcagttatatgtgcctttgattaataaaacatgggtgagaaaataaattattacttaatctgtgcagtttgctagataaagtctttgaaaacctgga

SEQ ID NO: 49529 - DNA, 201 bp, Homo sapiens
attccagtcaattatttgtttttagtaataacaacgacaataataatgatgatagtaggtaacaattattaagtggccagacatagtgctgaaatgctctscatgtaatattttatttcttccttccaatagacctaggaggaatgcactctgattatcccttatttcaggttggtctccttcagaagcagactcagacat

SEQ ID NO: 49530 - DNA, 201 bp, Homo sapiens
gtttttggggagacctgtcctcttggttcacagacagctgccttttcattgtaaactcacacagtaaagagagagagagagagagaaagagagagagagaragagctcgcaaggatcatctccttagaatggtactaattccatcatcgggttccaccctcatgacctcatctaaacctaattacctttttttttttgaga

SEQ ID NO: 49531 - DNA, 201 bp, Homo sapiens
ggaattcaaacccaggaaaattgagacacctgtgtatgaaaagcataaagagaaaatttggttgccctcatgctcactcttatgccaagtatttattcaasaattaaatgaataagaatagggatttcaactacgttctatcctcctcctcctcctgcatctgcctgaccttcttgggagccagatgttccactgaacact

SEQ ID NO: 49532 - DNA, 201 bp, Homo sapiens
cagaattttataccacgccctagtcaaaatacagtttcctttgctattgatcccctttccgcaatccaggctctcattgatctgctttctctaataatggytttgtcttttctagaatgtcttaaagcgtaccagtattttgttcctttctattgcgaaacgtattatggacagacacggcctgcaaaggcattaaaccca

SEQ ID NO: 49533 - DNA, 201 bp, Homo sapiens
aatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacat

SEQ ID NO: 49534 - DNA, 201 bp, Homo sapiens
cattatcagtctactaactatgttattaaatatagcttgcaaatatgttgtcgaggattttgtttttatattcctgagagatattggtctttttttctttwgatatctttaaatggctttggtagtaatgtaataatgtaatagtggcctcatagaatgagttgggaagtgttctctcctcctatattttttgggagagtt

SEQ ID NO: 49535 - DNA, 201 bp, Homo sapiens
cggtgtgtgttatgagccatgcgttgtgccaacatcccggcagacggaattcagcagtgccacgggagagagccagcggcctcccctgcatctgagcagcstggcttgttagttcccagtccttcagccaccagctgtttctaacacaaactcgtggtgacagagctctctgtaggagaagctaactacaattgtcagtct

SEQ ID NO: 49536 - DNA, 201 bp, Homo sapiens
aggtagtatttacaggttgcaggggtcaggatctgacatctttgggacccattatcagtctactaactatgttattaaatatagcttgcaaatatgttgtygaggattttgtttttatattcctgagagatattggtctttttttctttagatatctttaaatggctttggtagtaatgtaataatgtaatagtggcctca

SEQ ID NO: 49537 - DNA, 201 bp, Homo sapiens
atatttgtcttcccagagagacagtgagcttcctagaagccacatgcgggctctttgctgctgcatccagagtgcctagctcagcgctagtgcatggtagsttctccataaatatttgctgaatgaataaatggctgcttgtctcctcaagtagcctatcagctccacattcgccatgtcagtttcttcctctgcaatctc

SEQ ID NO: 49538 - DNA, 201 bp, Homo sapiens
tctggccaacatgtctggccaacatggtgaaaccccgtctctactaaaaatacaaaaattagccaggggtagtggtgcacacctgtagtcccagctacttrggaggctgaggcaggagaattgcttgaacccaggagacggaggttgtagtgagccaagattgcaccactaccctccagcctggatgacagagcgagatac

SEQ ID NO: 49539 - DNA, 201 bp, Homo sapiens
aattcaggtagtatttacaggttgcaggggtcaggatctgacatctttgggacccattatcagtctactaactatgttattaaatatagcttgcaaatatkttgtcgaggattttgtttttatattcctgagagatattggtctttttttctttagatatctttaaatggctttggtagtaatgtaataatgtaatagtgg

SEQ ID NO: 49540 - DNA, 201 bp, Homo sapiens
aaattatttttccattaagtcttctccttggggaaatctcttcctctgttgcagttgggcggtctggatgggctggttacccttgtgtggggtgtatagtkaaacatcaactcccatgaggctcattctcaggggttgagataatagtagtccctagtggggtcgtctaagagcccttgggagggcacttatcttcatgta

SEQ ID NO: 49541 - DNA, 201 bp, Homo sapiens
ggcccacgtcctgactctacgatttgcgtagctgttggtttgtgcctcagagtcctcatctgtaagtggggatattatacctactataataaattagtaawgccacggtaacaaagtattgcaaacatggaggctagaaatttattctcccacagttctggaggacagaagtccaaaatcagtctaactgagtcaaaacca

SEQ ID NO: 49542 - DNA, 201 bp, Homo sapiens
ctacctcttcagacatctcttctctggctcttccccttaacccctaactgggggctttctaccctgtctttgcacaccatttatcctctctataatgacarctcctaaatctaagaaatgggcacatttcccctgctaagctacagacctgtgtatttacgtacttcctagatattgccccatgcatggcccaccatcacc

SEQ ID NO: 49543 - DNA, 201 bp, Homo sapiens
tagtcccagctacttgggaggctgaggcaggagaatggcgtgaacccaggaggcagagcttgcagtgagccgagatctggccactgcactccagcctgggygacaaagcgagaccccatctcaaaaaaaaaaaaattaaaaattaagaatgggaattcagatacaaaaagagttgtcttctgcgttaaccgcagcacaggg

SEQ ID NO: 49544 - DNA, 201 bp, Homo sapiens
atgagcctcctttccaccaaattctcttctcattatgtaaataggatggcctgaggtgcaagaacaatgaatagaataataatcggaaatgtaatggaacwaatagtggatttctccggactgttaacttctgttcaaagagcccgccaatgatggatagagagcggcgtgcagaaaggaatctttccctggttcagcttg

SEQ ID NO: 49545 - DNA, 201 bp, Homo sapiens
gtgaccttgaaaaagaaatctaacctcttgcattttcaataacttcacctataatacagggcaaatcatcctactatatgaggtcgttgaagtttaaatgraagagtgtagagtctgcccttgaaacacgttgttatttttcaagcgattttctgaagctagagcccctcatgtgagggatggagagatgaatccatcagc

SEQ ID NO: 49546 - DNA, 201 bp, Homo sapiens
gaaaggtcagacttatccttcatatattccatgcctgagagagcacaatattaaatagcaaataaaaaacaccatgacagattgagagaaagaccatggaraacaggtaaaaaaaaaaaaaaaagttttgtctgctttttagacaagagatcgcacgttttcgttttgtacctagctctgcaaattatgttgcaggctctg

SEQ ID NO: 49547 - DNA, 201 bp, Homo sapiens
tcattggcaaatgcagatggatattagagaaatcaatctaaattgtatatgtagacaccagccacccccggaaaagaacatgagtgggtaattcttccacstatgggttttcccatgggatgcaacctgggtgcatggaaccagccctggcttcagagttagaggggcctggctagtgctggttctgccactgaccttgac

SEQ ID NO: 49548 - DNA, 201 bp, Homo sapiens
tagtagcggccaggtgacctttagcaggttccttaatagtgtgtcaccaccaacacagtgtaaacaccaatacggtgtcaacaacagcaataaaatgcagkttaaagacagcttatcccagggtatgctatgagaattggatgagaatattgttaaatcccttgtgagttttaaagggatgtaaaagtcttagaaatattg

SEQ ID NO: 49549 - DNA, 201 bp, Homo sapiens
ggcaacagagcaagactctgtctcaaaaaaaaaaattgttttaattaaagaataatttaaggctgggcgtgctggctcacacctgtaatctcagtgctttrggaggctgaggcaggcagatcacgaggtcgggagatggagaccatcctagccaacacggtgaaaccccatctctactaaaaatacaaaaaattagctggg

SEQ ID NO: 49550 - DNA, 201 bp, Homo sapiens
tgttcactgttctatcctttgttgctgacacatagtggccattcagtaaacatctgttaaatcgaggaagcagtgaatgagttggaagctgccttccttargctgttttacttccagaattctactttttcactgacagtaagcctaacctctcaggttagaaatctaagttgccttgcattcctccctctctcttcccca

SEQ ID NO: 49551 - DNA, 201 bp, Homo sapiens
agatcacttgaacccatgaggcggaggctgctgtaagccgagattatgccactgccctgcagcctgggcaacagagcaagactctgtctcaaaaaaaaaaattgttttaattaaagaataatttaaggctgggcgtgctggctcacacctgtaatctcagtgctttaggaggctgaggcaggcagatcacgaggtcgggag

SEQ ID NO: 49552 - DNA, 201 bp, Homo sapiens
atccattctctcactgcctccagaacattctccttttctgaaacactctcctctgcttgaaagtactgaaggcttcatcttgcctagtgcagcaattccamattccttataatctagtcccaaaccactgtctggcctcctctcctttccctccttctgaacaccctagattcctgccaaatataatgttattccacaaac

SEQ ID NO: 49553 - DNA, 201 bp, Homo sapiens
gggtttcatcgtgttagccaggatggtctcgatctcctgaccttgtgatccacccgcctcggcctcccaaagtgctgagattacaggtgtgagccaccgcrcccggccaagatgtgatgggtttttttttgttttttgttttttgtttttttttgagacggagtctggctctgtctcccaggctggagtgcagtggtgcaa

SEQ ID NO: 49554 - DNA, 201 bp, Homo sapiens
tgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcctgcct

SEQ ID NO: 49555 - DNA, 201 bp, Homo sapiens
gtgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcctgcc

SEQ ID NO: 49556 - DNA, 201 bp, Homo sapiens
ggtgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcctgc

SEQ ID NO: 49557 - DNA, 201 bp, Homo sapiens
ggtggctcgtgcctgtaatcccaacactttggaaggccaaggtggacagatcacttgagatcaggagttcaaaaccagcctggccaacatgctgaaacccmgtctctactaaaaatatgaaaattagccaggtgtggtggtgcacgcctgtaattccagctagtcgggaggctaaggcaagagaatcagttaagcccaggg

SEQ ID NO: 49558 - DNA, 201 bp, Homo sapiens
aagacagagactgcagtgagccaagatcgcaccattgcactccagcctgggtgacagggcgagactctatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaat

SEQ ID NO: 49559 - DNA, 201 bp, Homo sapiens
tcctggctttatgtatcacctatttttatatataatataaatgaaatcatacaatacttgggcatttatgactggccacttttttttttttttttttttttgagacagagtctcactctgtcgcccaggttggggttggagtgcagtggtgcgatctctattcactgcaagctccacctcctgggttcaggccattctcct

SEQ ID NO: 49560 - DNA, 201 bp, Homo sapiens
taactaacctgcacattgtgcacatgtaccttaaaacttaaagtataataataataataataataataataataataataataaaaacagggattaaagcrgggcaaggaagagaagttggtcagtaggaagcaggtggtcctttaggcaatcctgatggatgaggggtctggctcctcattatccagaggcagtggtctg

SEQ ID NO: 49561 - DNA, 201 bp, Homo sapiens
aaatgtaagcattcgcacaattataaatgaaaatgcaatgcctgtttggtgtgactttcatcaccaaaacctcactcttttattggaaaaagtctcatccrctctcaccagaaccctccttgcctttacagatacacacgccctggtaagccttcttcaaaatctgaacaaagcaaactacaacctgcccatcatggtgac

SEQ ID NO: 49562 - DNA, 201 bp, Homo sapiens
ggctacactgtgtctcctgcctcccagctgtttatggaaatcagatggtttcctcaactgtctatctttctgcagcaaatcctttgacagagaatgtgcaytgtcaaccaaccccttcatcgagtcaggcaaattaggattcctttgacagcaactttttacaacttccttcctttgaagatataaagctttaaacagtag

SEQ ID NO: 49563 - DNA, 201 bp, Homo sapiens
cttggtaatcaatcatcttcatgaaaggagctctccttgaaactgattataatcgcgccgaggcacagaactctggtgatggaaacactctgtctctgtgytgttcattacaggagccagcagccatgtgtggcttctgggcacttggaatgtggcaggtgccactgaggatctgaactggtattttcacttgatgttaat

SEQ ID NO: 49564 - DNA, 201 bp, Homo sapiens
acccgatttaagctcacaacaatgcctggatgcagatggtgtgtttttcgttttctgagtgaggacagtgagactcagaggtgggtcttaggtcgcggtcrtggagttggttgagtggcagccagtgcggccatccacaggctttcccaagtgcatcgctgcagccatagttagctccccagcagctgctcggggctttca

SEQ ID NO: 49565 - DNA, 201 bp, Homo sapiens
ggaacgcagtctttgtcaagatggctttttcgtgtaataaatttgcagggaggagttcttggtaatcaatcatcttcatgaaaggagctctccttgaaacygattataatcgcgccgaggcacagaactctggtgatggaaacactctgtctctgtgttgttcattacaggagccagcagccatgtgtggcttctgggcac

SEQ ID NO: 49566 - DNA, 201 bp, Homo sapiens
gctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaat

SEQ ID NO: 49567 - DNA, 201 bp, Homo sapiens
tgaaaccacatctctactaaaaatacaaaaattagctgggcatggtggtgcatgcctgtaatcccagctactcaggaggctgaggcaggggaactgctagrtcatgccattgcactctagtctgggcaacggagcaagtgtgactctatctcaaaaaaaaaaaaaaatcaatatgaacattattcataagataccttttta

SEQ ID NO: 49568 - DNA, 201 bp, Homo sapiens
gatgggaaaatgctgtttgatttaatctgccatctcactaggtgagcatcacattagtcattgctgctcctgtcaccttctggtaatgatcatgcttcatstatttttatttccctgtcattactctcttgttttttctcctggttttacctaatagataaatgccttctaaatgattttgttgtctcacagttttttttt

SEQ ID NO: 49569 - DNA, 201 bp, Homo sapiens
tgtgataacttcaaaaaacctgtgaagtaccatgctccatggcaaaagcctccccaggtactgttaaggaaagttagtatccatttaactgtcacctaaaktggagaaaatatatagcttgaaaattattgtacggatccaagaattgggcctagaattcaataataggctgttacatcttgacacatgcctaaattgtta

SEQ ID NO: 49570 - DNA, 201 bp, Homo sapiens
catgtttacctatgtaacaaacctgcacatcctgctcatgtaccccggaacttcaattaaaaaaaaaaagaagaaaaaaaaaaagattgtatcctctactmaaggaagatgggaaaatgctgtttgatttaatctgccatctcactaggtgagcatcacattagtcattgctgctcctgtcaccttctggtaatgatcatg

SEQ ID NO: 49571 - DNA, 201 bp, Homo sapiens
agggtggaacctatctgccattcctgggctggatgaacttcacaattccccttcagcatctgtgaagctgtgagttaaggatagatggcaacctaaaaacsaatgtacggcacgtcagtcatgtttcagagcaaactggatattggtgaattcataccagtgtggaaatccattgacaccacaaaggcaagcttttctctt

SEQ ID NO: 49572 - DNA, 201 bp, Homo sapiens
tggtgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcctg

SEQ ID NO: 49573 - DNA, 201 bp, Homo sapiens
gttttatttgctagtttttatggctatagcctatttgaataatcatctccagttctttccaattggaactttctcattcaagagtttcttttttgggggcrtgcagaggggggtgagcatcaggataaatagccagtgcatgtggggcttaatacctaggtgatgggatgatttgtgcagcaaatcaccatggcacatgtt

SEQ ID NO: 49574 - DNA, 201 bp, Homo sapiens
taagtaagacaaaatcagatctttaatggagctgagggtggcatggtaaaaacaggcttgtatgttgtatatttagcaaactgtgttaagtcctagaagasagatgggtaaatatcccaggaaaacactgagagcaaagtaagctgatggggtgaggctagggagaaggcaaaagatctagaaggctcccaggcagaaagt

SEQ ID NO: 49575 - DNA, 201 bp, Homo sapiens
ctggtgggaggtaattttatcatgggggtggttaacctcatgctgttctcatgataatgagtgagatatcatgagatgtgatggtcttttgttttgttttgtttttttgagatggagtcttgttctctcacccaggctggagtgcagtggcgtgatcttggctcactgcagctctgcctcccaggttcatgccattctcct

SEQ ID NO: 49576 - DNA, 201 bp, Homo sapiens
ctcagctgtctttccagtctcagagacagagaactgtgttaacattaactttcaccagcgcattggagagacttttcgtggtgtacctgctgtcataaaasactaaaggaaagagaagtgctaggataagaatctttatagtcttcaacctccaaccttccatagtacgctgcagacctcctcagacttgacttggtttaa

SEQ ID NO: 49577 - DNA, 201 bp, Homo sapiens
ccacagatgctgatgctgaggcaagaaatcaagtcaaaattggtttattttgggaggtacaggaaacaccagtagaaaagtgaggaaataagacaggggasggaaggcagccaataacgtaaccagccagctgctttcatgagagactggagcatcgtcccaccaggaaacaataaaaaatagtgtaaaaacgcataagct

SEQ ID NO: 49578 - DNA, 201 bp, Homo sapiens
gtcatcagcagtttgcaaaaattatggcgctggtcctctccccagccaacttaactgggcttctaccatcctcctccttcctgatctttcttttctcttcytgagcatctttccagttccctatttaatcatatgtaatcttcagtatgtgcttttatgtggaaagccagatgtgtaccagttgatgtcaccatgatggac

SEQ ID NO: 49579 - DNA, 201 bp, Homo sapiens
tcttctcttatctgccaccatgtgagacatgccattcaccttccaccatgattgtgaggcttccccagccacatggaactgtaagtccaataaacctttayttttgtaaattgcccaatctcgagtatgtctttatcagtagtgcaaaaaatggactaatacactcacctatgtagggaaacctctttgttccctacatag

SEQ ID NO: 49580 - DNA, 201 bp, Homo sapiens
cacttggagggtctccatttaaagggacccctgcaaattataaggatagggagggtattaagtcccttttcaactcctaagcattaccactgcctgggaasttcactatggggatgttctgctgaacccctatcaactccagtgggggtggcagcaggttcaagatgccaaacaggagacctggagccagcgatgagacga

SEQ ID NO: 49581 - DNA, 201 bp, Homo sapiens
ggctgctcccaagtctagcacactcattgatatggtttggctgtgtccccacgtaaatctcatcttgaattgtaacccccacaattcccatgtgtcgtagraggaacctggtgggaggtgattgaatcattgaggcaggtctttcccatgctgttcttgtgatagtgaataagcctcacaagatctgatggttatataaaa

SEQ ID NO: 49582 - DNA, 201 bp, Homo sapiens
tgaacatagctctgaggagcaggaggcaggttcaacagccacatccttaagaacataaaaagttgaagagagacagaagagagacagacgtgtgcagtgckaagctggggccctcacaatggggactggcttctttcctggggaataagtaatttcaattcagcagcaggagccaactcagctaggtcctgcctctaagac

SEQ ID NO: 49583 - DNA, 201 bp, Homo sapiens
ctagcttgggctgctcccaagtctagcacactcattgatatggtttggctgtgtccccacgtaaatctcatcttgaattgtaacccccacaattcccatgkgtcgtaggaggaacctggtgggaggtgattgaatcattgaggcaggtctttcccatgctgttcttgtgatagtgaataagcctcacaagatctgatggtt

SEQ ID NO: 49584 - DNA, 201 bp, Homo sapiens
attggggactgttgagatgcctaaatccccaacttgtagagctagcttgggctgctcccaagtctagcacactcattgatatggtttggctgtgtccccaygtaaatctcatcttgaattgtaacccccacaattcccatgtgtcgtaggaggaacctggtgggaggtgattgaatcattgaggcaggtctttcccatgct

SEQ ID NO: 49585 - DNA, 201 bp, Homo sapiens
tgtaggccacccttggagaaatggtgttatagctggattggggactgttgagatgcctaaatccccaacttgtagagctagcttgggctgctcccaagtcyagcacactcattgatatggtttggctgtgtccccacgtaaatctcatcttgaattgtaacccccacaattcccatgtgtcgtaggaggaacctggtggga

SEQ ID NO: 49586 - DNA, 201 bp, Homo sapiens
gattcaataggcctgagattagtccaaaatctgtatttgtggcaaactccccaggtgatttcaacagagacagtctgtaggccacccttggagaaatggtkttatagctggattggggactgttgagatgcctaaatccccaacttgtagagctagcttgggctgctcccaagtctagcacactcattgatatggtttggc

SEQ ID NO: 49587 - DNA, 201 bp, Homo sapiens
ttcttattgcatctagactgagcatcagcatgcctggtgttcttatacgtcatacatgaaagagattggcaacccttcctgaaagctttgaatttttgatrtcatttgttccacgtgattttctaaggctatattggaccactatacattctagaacaaattaattaaagcctccagtttccagggagatatactaatatc

SEQ ID NO: 49588 - DNA, 201 bp, Homo sapiens
cgaaaacccgtatctactaaaaatacaaaaaattagccgggcatggtggtgcatacctgtaatctcagctactcaggaggctgaggcacgagaattgcttsaacccaggaggcagaggttgcagtgagccgatatcacaccactgcattccagcccgggtgacagagcaagactctgtctcaaaaaataaagagaaaaaaa

SEQ ID NO: 49589 - DNA, 201 bp, Homo sapiens
agtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctc

SEQ ID NO: 49590 - DNA, 201 bp, Homo sapiens
tgggctgggcatggtggctcacgcctgtgatcacaacacttttggtgtctgaggcaggatgattgcttgacgccaggagtttgaaatcagcctgggtaacrtagtgagacaccgtctctacaaaaaatacaaaaattatcctcttagatgtaaatgctaaaaaaataaagttagccaggtgtggtggcgtgcacctgtggt

SEQ ID NO: 49591 - DNA, 201 bp, Homo sapiens
ttaggttctgtctgtcttatgtggaaaatgggtctttaatttattatgttggctaagattccttttgttattgttgttgcaaatgacagaaatccaactcwaaaaatgtagatgaggggcagcgggaattaattgattcatgtaactaattgaggcatagttcgtggattaattcatggaactattttagggatacttctg

SEQ ID NO: 49592 - DNA, 201 bp, Homo sapiens
tgccttccgtgggtccagaacttcttgcttgttctctttgcccccagtctcctatttgacagagcagctgcactataataaatgactccctggcatttcarcatcatagctggggactctgccaaagccctggccacgtctctgtagtgggacgtacaacaacgaagaaaagaggctggatccacaaaccccacaggaaat

SEQ ID NO: 49593 - DNA, 201 bp, Homo sapiens
taagctgcccaacctactcatgctccttctgttgtttcgtttgtttcccagtgaccttcagtgactgtaagggaaacgacaagctacgctatgaggtctcvagcccatacttcaaggtgaacagcgatggcggcttagttgctctgagaaacataactgcagtgggcaaaactctgttcgtccatgcacggaccccccatg

SEQ ID NO: 49594 - DNA, 201 bp, Homo sapiens
aaaacaaggctttaaaaataaggcccaaagattatatgatgattgcttctatgcccctgtagccagctagtgatctcatttctcatcactaacccagcttyctaaatctgtcctgtccagcagggtcagccatcccagcccccagtggcaccatcagccatctgagactctttttcacccccagaagaaaatgtcttggat

SEQ ID NO: 49595 - DNA, 201 bp, Homo sapiens
ttggagttaaattccatctcagaagtgaataaatgaatctacataaactgcagagatccctgaatctacttccctatcggtcaagtaaaaagaaaaaaaaatcaagaaaactcaatgttaataaataatacataaaggaatcgttagagtggagacaggttcaacttatcctgtgagttaaaaaaaaaaatgaaagcaaga

SEQ ID NO: 49596 - DNA, 201 bp, Homo sapiens
gttgcctgattgattttatgatcaggcacttactgggttgtctagggtaacccagtaattgctgtcatccctctacctcttttaaaatctattgttttgtrccctttatctatgtctaactatatacacttttctcagaaatttacatctgcttaatttctaccccccacccaccccccaacacccccccctttttttttt

SEQ ID NO: 49597 - DNA, 201 bp, Homo sapiens
attatgagggccattatcttaaaatagtatttcctaaaatgaaaaacatttcaggaagtagctgaaatatcaggaaaaaaacaaggctttaaaaataaggyccaaagattatatgatgattgcttctatgcccctgtagccagctagtgatctcatttctcatcactaacccagcttcctaaatctgtcctgtccagcagg

SEQ ID NO: 49598 - DNA, 201 bp, Homo sapiens
gatcacttccctcaaatgtcactctgccagatctgactcttcactccactgagaaggcactcaagtgtgcacactcagagcttagcacctgcctggaacaygcgagttcgtcaaggacatgtcttgattgagtgaagtccatcagcacaaagtcacttgggcacaggcatcttgctgtgggataaaacgtaacatttgtga

SEQ ID NO: 49599 - DNA, 201 bp, Homo sapiens
ggttctgctcagtcacccacacatgccaggattagatcacttccctcaaatgtcactctgccagatctgactcttcactccactgagaaggcactcaagtstgcacactcagagcttagcacctgcctggaacacgcgagttcgtcaaggacatgtcttgattgagtgaagtccatcagcacaaagtcacttgggcacagg

SEQ ID NO: 49600 - DNA, 201 bp, Homo sapiens
cgtggtgaaatcccatctctactaaaaatacaaaaattagctggacattgtggtgcacacctgtaatcccagctacttgggtggctgaggcatgagaatcmcttgaacccaggaggcagaggttgcagtaagccgagaccacaccactgcactccagcctgggtgacagagtgagactcaccaaaaaaaaaaagaaagaaa

SEQ ID NO: 49601 - DNA, 201 bp, Homo sapiens
gataagaacagatctgtacttcatcttagccaagaggccaagaaacgattgtactactgtataaaattatggtgctgtaattttagaggtgcttcaaattrttttgggaataaggcaaatctgtatacttaaaatgtgtgacctatgaatttggctctaacctttcttgcagaaaattagaaactactaacaaatggtttg

SEQ ID NO: 49602 - DNA, 201 bp, Homo sapiens
gcctgcccctctcaggacacagctgctgctgtaaaactgctgagaagcagcttggagttggctctactgcaacatcccttctttctgttgcagttgtccaktcccttttattctgccatgacctgcgccaaggccatcatgcccacgcctgcttctactgtctaagtaataagctgtctgcatctaaagaggtctccttgc

SEQ ID NO: 49603 - DNA, 201 bp, Homo sapiens
gctaattaccacacagtctatctgattaacggtattgtgattcagatcaagcggtgagatgactacaggtaacagacccttgctatcatttgggtgttctyacaaggaacaggagccaggtagtgaaccatgtgcctaccctttgggcagggaatgggtggctctaagagatgacagatgctgtcatccggaatcagttct

SEQ ID NO: 49604 - DNA, 201 bp, Homo sapiens
cgtgtgctttctgaagataagtcagatcagattgttcctggatcactgcctttccggaaagcctctggtggcctcgtgcactctgtagaattggtacaggycccttgtgatgctactcaaggccctccaggagcccatgccatcctcagtgccctcagctctggaggagcagctccaccacggcaccccatgactttgcat

SEQ ID NO: 49605 - DNA, 201 bp, Homo sapiens
ttagtcttttcaaaggtgtactttttaagtgtctgcataatgcgaatgttgtgaagtatgtcaactcttgggatttaggaatagcagagtattagtattcyagaggcaaaattgtaattggccttttcacttgcattttccccacaagtgacaaaaggctaaaattaacaatagaaaggcatttgtttacatccaggcaac

SEQ ID NO: 49606 - DNA, 201 bp, Homo sapiens
atgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttcct

SEQ ID NO: 49607 - DNA, 201 bp, Homo sapiens
cgttagcacaatcaagactgaaccgctggtcttcccacttcccactgcactctgctcttcgggcagcctcatctgagtgcttgatcaccaagaaaagacastgctttcctgctcgagctgcacacatcatgcctctcttcatccatggctggtccgcctgcctgcagggtctcacatttcctatcaatccaatcgtgtgct

SEQ ID NO: 49608 - DNA, 201 bp, Homo sapiens
aaatggcagcttggcagtgatacccagttgtatcactctaatccccagagcctgtggccaccatacagggctgcctctcacaacacacataaatagccatrtgtctcataggtagcattgacagagtcaattcttttccagtacggagagcggtgaattttgagaagtgactttttggcagaaatgcaatctagtgacaaa

SEQ ID NO: 49609 - DNA, 201 bp, Homo sapiens
tatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttcc

SEQ ID NO: 49610 - DNA, 201 bp, Homo sapiens
tagggatttttttgaaaaccaggagaggattttctgaacccaattggtccagttaatgtatctatacgtcttacttctctcttttccaggcataaatctcygggctggcttctagaataccaggtccctttcccctcagttcctgtgtatcctgtgttatagctccaagaaggagctataacagggttagaacaaagatct

SEQ ID NO: 49611 - DNA, 201 bp, Homo sapiens
gtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttc

SEQ ID NO: 49612 - DNA, 201 bp, Homo sapiens
tgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggttt

SEQ ID NO: 49613 - DNA, 201 bp, Homo sapiens
cacctggtaacttagctaggctggaaaatccaagaaagcttcactcatacacctggcaccttggtgattctttgcatgcaccttggtgattctatgtgctrttttgtctccctcatagctaatcagatgtcttatgtggtggttggcattttttttttttttttttgagtcagagtattgctctattacccaggctggagt

SEQ ID NO: 49614 - DNA, 201 bp, Homo sapiens
ttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtt

SEQ ID NO: 49615 - DNA, 201 bp, Homo sapiens
ttgtggcagatataattagttaagatggggttatactgaatgatatagattgggtctttaatccaatatgactggtgtccttagaaaaaggaaaaatacgsacatagacacgcccacaaagaaagaacactgtgtgagcaggaaagcagagattgggatgatgcatctacaaggcacggaatgccaagaacagacagtaac

SEQ ID NO: 49616 - DNA, 201 bp, Homo sapiens
aaatccacagaaactgagggccgtgatcagacatcaccaactgtagtcaaccacatgttaaagttgaattgttccgtcttctgttttccacatccaccttsttccgtccaccctttcctgaaggtccgtgtgaggcctgaccttgctttgattcttgcagtcctcttctaactgtgcccctttgcctccacttcctgcctg

SEQ ID NO: 49617 - DNA, 201 bp, Homo sapiens
gaggctacagtgagatgagatcacgccgctgtactctggcctgggcaacagagtgagactccatcttaaaaaaaaagcccatggaggctgcactccaaagrtggagcgatagcatagtgtaacatgatttttgagatgtgtgaagaggtcaaatccacagaaactgagggccgtgatcagacatcaccaactgtagtcaac

SEQ ID NO: 49618 - DNA, 201 bp, Homo sapiens
atgtgctttcactttaggagctcaactagcaactcccccatgcactccctcctccagtgtcagagcacactgcaggacccacccagtctttgaataggaargcactggctgaaaagccccagaaagtggggatgtaccagtacaagtttcccacctgtgtatcccactgttttgtttggggagaacaacggatataaccga

SEQ ID NO: 49619 - DNA, 201 bp, Homo sapiens
ataatcccagctactcgggaggctgaggcaggagaatcgcttgaacctgccaggcagaggttgcagtgagccgagatcacaccactgcactccagcctaarcgacagagcaaaaaacaacacctgcagagatccaggagcaactggaactcaagaataacagagtttggataaatcggagagcagtacttcctatgtgatt

SEQ ID NO: 49620 - DNA, 201 bp, Homo sapiens
atggcatctcaagcaccttcgcagaccagcgccggctgacccagccagaactggaactgggtacggtgtcaattccacttgtactcagcagtcagagaacygtgtgaccttcgatcctggcggagctggaattgaaaccgaaacatgaggcgtagagccatcacaggagcacactaacttcccactcatcaccgtgaattg

SEQ ID NO: 49621 - DNA, 201 bp, Homo sapiens
ggagcctgagtggccaggtctctcaggagtggagacattcacttcccagccgtgggacatttacccaaaccactgcaaagagccacaaatagcataagacygtgtgctgacggccagtggaaatggagctcagcgttgacagagcttcctgaagactgagctctcttgaaaatgtaaaattgctgaggaccttaagcagag

SEQ ID NO: 49622 - DNA, 201 bp, Homo sapiens
ttttccaggttactgagcccagtggcttctatagctcggttttaggaggctatggagaacagactctctcctgcccttggggggaaatgcaaatcaatacwggtcatttgttgagtattttgtcaataagaatcaaatggctttttaaagtacccctagtgttttttgatgcagaaatttcttgtgatcaaatacgtgtgc

SEQ ID NO: 49623 - DNA, 201 bp, Homo sapiens
ctcatttcccattgtgtagtcctggcacctttgtcaaaaataattcagccatatacataagggtttatttctaggttctctattctgtttcattgagctakatatttgtcttcatgtcaatacatacaattttgattaccattgctttgtagtatgtttctaaaacaggaagtacgaggactccaggactaagagattttg

SEQ ID NO: 49624 - DNA, 201 bp, Homo sapiens
ttttgcttgtggatattcagttttccaaacaccatttggggctgctcatttcccattgtgtagtcctggcacctttgtcaaaaataattcagccatatacrtaagggtttatttctaggttctctattctgtttcattgagctagatatttgtcttcatgtcaatacatacaattttgattaccattgctttgtagtatgt

SEQ ID NO: 49625 - DNA, 201 bp, Homo sapiens
gttttgcttgtggatattcagttttccaaacaccatttggggctgctcatttcccattgtgtagtcctggcacctttgtcaaaaataattcagccatatayataagggtttatttctaggttctctattctgtttcattgagctagatatttgtcttcatgtcaatacatacaattttgattaccattgctttgtagtatg

SEQ ID NO: 49626 - DNA, 201 bp, Homo sapiens
gcacgctgcctggaaagggggaacagcaccgcgggcaggcttcagagccacacaccacgtctctgtctcagagtctatcctcgaccacagggtttaagtcyttgatgtgcacactgggccctggagagaaggtgcctgttctcacgggctgaccccacaagcctgtgagccgtaagcggtgtgattcgctaacagttgaat

SEQ ID NO: 49627 - DNA, 201 bp, Homo sapiens
aaatccaatgtcctgaagctttcccattatgttttccactagcagttgtatagttgtaggtctcacatttaggtctttaatccattttgagctgatttttrtatatggcatgaggtaagggtctaacttcagttttgcttgtggatattcagttttccaaacaccatttggggctgctcatttcccattgtgtagtcctgg

SEQ ID NO: 49628 - DNA, 201 bp, Homo sapiens
cattctgaactttcaccctgggtaaccactttgttagagaagtttcaaagccatctatgtgttgatgacttcccaacccctaactcagcctgggcacttcygccaagctgcacaggtgcattgaattcaaggggtcgttagcacaatcaagactgaaccgctggtcttcccacttcccactgcactctgctcttcgggcag

SEQ ID NO: 49629 - DNA, 201 bp, Homo sapiens
agtatttgctaaacgggcaaaaaatggaagaaaaatcaaaacatcactgttggctgggcacggtggctcacgcctgtaatcccggccctttgggaggccgrggcgggcagatcacgaggtgaggagatcaagaccatcctggctaacacggtgaaaccccgtctctactaaaaataccaaaaaaaattagccgagcgtgga

SEQ ID NO: 49630 - DNA, 201 bp, Homo sapiens
ccaaatgacttgtcttcataatatattcagagtgaaaaaacataatggattcttccgagatattcaattagttcaataaaaagagaaaaataatttttcartaaagaaatttaactaaatgactaaaactgacagtgaaaaaccaacttcaaagtaattatgcatttcttttgagtttgcgctctaacgaaagttgatgat

SEQ ID NO: 49631 - DNA, 201 bp, Homo sapiens
ttcaaatgctcataacgccttctcatccattctaccaaatgacttgtcttcataatatattcagagtgaaaaaacataatggattcttccgagatattcarttagttcaataaaaagagaaaaataatttttcagtaaagaaatttaactaaatgactaaaactgacagtgaaaaaccaacttcaaagtaattatgcattt

SEQ ID NO: 49632 - DNA, 201 bp, Homo sapiens
aaaatatttttatttccttccttatctgtcatgtgatgttattgccagagtcaggctggaaagtaagccacattatgtagggttaaatgaaagccctcttwtgagactttttggcttgtagagcatgattccccagatgtcttagataggaatttgggcaagtgaagaaaaaaggtcagagtttagtcctcattatgcagg

SEQ ID NO: 49633 - DNA, 201 bp, Homo sapiens
aacttcagaaaaagacatcaccagcctggcctgggaataacacataggaaattgaagacagtagtatacttaagttcacaaaaggccaattcttatggccrtatttcaaatgctcataacgccttctcatccattctaccaaatgacttgtcttcataatatattcagagtgaaaaaacataatggattcttccgagatat

SEQ ID NO: 49634 - DNA, 201 bp, Homo sapiens
ttactaacttcagaaaaagacatcaccagcctggcctgggaataacacataggaaattgaagacagtagtatacttaagttcacaaaaggccaattcttayggccgtatttcaaatgctcataacgccttctcatccattctaccaaatgacttgtcttcataatatattcagagtgaaaaaacataatggattcttccga

SEQ ID NO: 49635 - DNA, 201 bp, Homo sapiens
cttcacatgcacaactttgggatgtgggaggaaaccagaggacccggggaaaacccacacaaacatggggagaatgtacaaactccacacacagggtggtstgggccaagagttagtgtttttttttttctcatcaacattataataaaacaacattgaagaaaacagcattatatgatgtctggatgtatttattgttca

SEQ ID NO: 49636 - DNA, 201 bp, Homo sapiens
cccacatgtttagaagttagacttctctgatccttaaaatggctaccatgagaacatggcccctgggctccctccagaagggagctgcaaagagggagtcmcattctagctccatttctgggtgttttgctcaaattgacctgttttccctattgaaagagaaaattccggccaggagtggtggcttatgagccaagatcg

SEQ ID NO: 49637 - DNA, 201 bp, Homo sapiens
gttaaaatgagagcctgtaagactcaagctatgtaataaaaattctggtggagaaagtataggttaatgcttgctctagagaaggaggcctgacactcacrgtgtccatttgagcctgtcctaaatctctctggacctcagcctcaccatacctacaatgaattggcctcagatcttctgctctgatcttgcaccaagcct

SEQ ID NO: 49638 - DNA, 201 bp, Homo sapiens
cttttttatggctgcatagtattccatgtgcatatgtgctttcactttaggagctcaactagcaactcccccatgcactccctcctccagtgtcagagcayactgcaggacccacccagtctttgaataggaaagcactggctgaaaagccccagaaagtggggatgtaccagtacaagtttcccacctgtgtatcccact

SEQ ID NO: 49639 - DNA, 201 bp, Homo sapiens
tcacaaccagatcccctgcagttttcagccttgccaacatctgaacatgtcaaagaaaaatgggcaggacagagtttgaaaggcaaagcctttattcaagsctacaataagggagagagattgaactaactctgctgaaacaaacaatgggacgatttttaagagctgggatgagctaatggaaaagtactggaagatgtt

SEQ ID NO: 49640 - DNA, 201 bp, Homo sapiens
ttacctaacttctccaaaatgccgactccagtattccattttcaaattaacttattctgattataaaagtaatgttcagtattgttagtaaaataaatttwaaaaaaaacgaacttgtaatttccccactcagagatagcttctgataacatattggtgcttttacttctatttttttctatccatatgagtataattaaa

SEQ ID NO: 49641 - DNA, 201 bp, Homo sapiens
tctcataggcagttatcactgctcaacttgaagaaatacaaggttaattattggagtttgaaatccagcagtggaatccatgtggtcctatcgtggtcatrtaatgtgctgaggctcttacaagttgtcagtgctgagtgggaacgacaaagccagaaacaagggcaagcagaggttgaatgccaggaagaccgtggcagg

SEQ ID NO: 49642 - DNA, 201 bp, Homo sapiens
taaaacgaaagttgaaattataaaataaataaataaatgtggtgcttatttttaaaataaatgaacaaaaaaaccccaaagagcttagctaggtgttaagyaccatccaatggacggtgccatccattatataatatagatatttacacacacactcaaacacgcatacatgtatgtatgtgtatatatatacacacacat

SEQ ID NO: 49643 - DNA, 201 bp, Homo sapiens
tctcacttataagtgggacctaaacagtgaatactcacggacataaagatggcaacaatagacagtggggactactagagtggggagggaaagaggggtaygagggttgaaaaactactagatgctgtgctagctaggtgacaggaccaatgatactcaaacctcagcgccacacaatatacctaggtaacaaacctgcac

SEQ ID NO: 49644 - DNA, 201 bp, Homo sapiens
tgtgctctcttgggagcatttaagatacactgcaaactacaattgcttccttaaaatgtacagtggacgtttgacatagtaaagatattttgaagatttgmaggccagaaacctgtttaagccaacatattacacacttttaagaaagaaaagctcttaataacatcctataagaaaatcttaaccattatagaagttact

SEQ ID NO: 49645 - DNA, 201 bp, Homo sapiens
cgttgtataattgatgtcatggccatattgtttaatcatcactcaccatgcacctattgtgtggcaggcactattctatccattagggcacaatagtgaasgaaaaacttgctgccatcagagaacttgtgttctgggctttcatgcacctgccttgcaggcgtcaggaatctgaatcacactcattccctccatcacttg

SEQ ID NO: 49646 - DNA, 201 bp, Homo sapiens
cacctgcagaatgaagataatgccatctgcctgctgggttgttagagggttggaaatcatgaatgcacaattcccagtactcctaagcatataagaaatgyttaagtgaactgacttgaactgagtcatggactgatcttctaagcatgtcattacagaatcatgagtgctgaggcaaactatgaaaaggcacttatgacc

SEQ ID NO: 49647 - DNA, 201 bp, Homo sapiens
accaagtatgaattccagcccactaacgtcacatctctatttgatcattagcgtatagacttttggtccttcataaattttactttataaagatattttaygttgtataattgatgtcatggccatattgtttaatcatcactcaccatgcacctattgtgtggcaggcactattctatccattagggcacaatagtgaac

SEQ ID NO: 49648 - DNA, 201 bp, Homo sapiens
aaaaagaaatcacattaccagtagctggcttagttctgcatgttactatgtgatcagtttccaaagttcttcgtcttggaagacaggcagccccaacctaygggaatctgctcaccctacaatggtgagcagacccactccacccatctttgccattcaagtctacagcatttgaacagatcagcccgttctgtgtcaaga

SEQ ID NO: 49649 - DNA, 201 bp, Homo sapiens
ttggaggggcagcacactgggtccactgagataatggagcctagtgccatctacacctcaggatgagttcagctccgcatcttagctgtgcaatgatagcygagagacttacactctctcagcctcaatttccccacctgcagaatgaagataatgccatctgcctgctgggttgttagagggttggaaatcatgaatgca

SEQ ID NO: 49650 - DNA, 201 bp, Homo sapiens
tctgacatgttatttccttatgctgagggtgtcttgttgagtttcatgggttttgtgcttccctggtgccttattaggcttataactcacagagctatgastttaaatgtcagggttgtcaccaaaacaatggagcaaaaagcaagttgttgacattctttggacgcaatttgcaatcccctttattttcctgtaacgttt

SEQ ID NO: 49651 - DNA, 201 bp, Homo sapiens
aactgtcctttctccacttgcccatctattcctaggaagcagatgtgcccagagcttgggctgtagaggcagaatgaacagatcagagaaggttctcgctytaggcctttctggatatgggaccacgagctagtcagtcaatctctctgagactcagtctcttctcctgtaaaatataatatgatgcttatatatttatag

SEQ ID NO: 49652 - DNA, 201 bp, Homo sapiens
ttgagaccaaacagaaaagtgtagcctcaagaaatattctttgtcatcctagtggttgctttagaatttgtagtatacatctttaacttatcacagttcgygttaaataatattatagcatttcatacatggtataagaaccttacagtaaaacactttcattttctcctttcccagcctttgcactactgctcctctggt

SEQ ID NO: 49653 - DNA, 201 bp, Homo sapiens
cagaaaggtcaaatgttagtcgccctgtcttatgtgggctgaaaactgtcacaggcgatttctcgtaagggttctggaatcccactggggacggccacagrcaggaaaggcatcgttggccgctgcttcttggctcactcactccacgctcactgctcagaattctctgagactggtcttcctgcctccttcttactggta

SEQ ID NO: 49654 - DNA, 201 bp, Homo sapiens
tttgagaccaaacagaaaagtgtagcctcaagaaatattctttgtcatcctagtggttgctttagaatttgtagtatacatctttaacttatcacagttcrcgttaaataatattatagcatttcatacatggtataagaaccttacagtaaaacactttcattttctcctttcccagcctttgcactactgctcctctgg

SEQ ID NO: 49655 - DNA, 201 bp, Homo sapiens
atcccagtgtcaataccactcctgcctacaggtaatcaccagaaaggtcaaatgttagtcgccctgtcttatgtgggctgaaaactgtcacaggcgatttmtcgtaagggttctggaatcccactggggacggccacaggcaggaaaggcatcgttggccgctgcttcttggctcactcactccacgctcactgctcagaa

SEQ ID NO: 49656 - DNA, 201 bp, Homo sapiens
agcattttggaaggctgaggcaggtggatcacttgaggtcaggagtttgagaccagcctggccaacatggtgaaaccctgtatctactaaaaataaaaatwaaaaaaaaatagccaggtgtggtggtgggtacctgtaatccaaactatttggaaggctgaggcaggagaataggaggattgactgaacccgggaggcaga

SEQ ID NO: 49657 - DNA, 201 bp, Homo sapiens
tggcattttatctttagagatgaatatcgtcatttgccttatatggtccagattttctgaaaggtcaaaatagtgccttcagagtacaggcactcttttayggaagacttcaatgaacacagaattgctgccctctcttaagaaaggataaaataaaaaaaactgttaaggaaaaacccaagcggtagagagaacattcgg

SEQ ID NO: 49658 - DNA, 201 bp, Homo sapiens
gaatcgtatttattgagcacctgctgtgtatcaacctcagtagaagacccaagagatatactggtgaatgggatagacatggtctatatttcagaggcctmctagtatacagttgaagacgggcattgaacacaggatcacagctatgctaataggggtgttactgcagggccatccaacctagaacaaggatcatattac

SEQ ID NO: 49659 - DNA, 201 bp, Homo sapiens
tgcactataaccagcaaagtggctcacgcttgtaatcccagcactttgggaggctgaggcaggtgggtcacttaaggtcagtagttcgataccagcctggycaacatggtgaaaccccttctctactaaaaatacaaaaattagccaggcgtggttgtgcatgcctgtagtcccagctactcaggaggctgaggcaggaga

SEQ ID NO: 49660 - DNA, 201 bp, Homo sapiens
ggcacaaaagcagctggattggttacactcggcatttgccttatttgaacgctatttgaacagttggccctttgattggctcaaactccgagactggcacragagtaggtgacagtctgtttacacctccattcagattatagttcactatgtacagagaaacctttaggcggaacttagcatatttaagaaggcagcttt

SEQ ID NO: 49661 - DNA, 201 bp, Homo sapiens
ttaaacttaaaagaaaatccttggctagattacatttcactgagtttagttgagcaaagaacaattggtgaattgggcaacctctcaagccaaagtaagcwgagagagactccagcgcaggcatgtagtggaagaagatttatggacagaaaaaggaaaatgatgtacagaaaatggaaatgaggcacaaaagcagctgga

SEQ ID NO: 49662 - DNA, 201 bp, Homo sapiens
acattgatcattagactaaatcatgaaaaccactcaaccaggactccgctttgattgtgtcatgaacgtaagtcagacatgacggtaatttacatcagctytgccatgttcctcagtgttctgtgcatctgattcttagaggtctcactgcatccagatactctgtacctgagatttatgcccacctatgcgaataggtgc

SEQ ID NO: 49663 - DNA, 201 bp, Homo sapiens
tatttcaaaatttgggccataaataatttctcagttttaccaactttcactgataactaattgattgcatctttaaagatttttgagttcttgggcccgaytgattgagagcaggggactttaaatctgtaagccagcagggaggtctttgggagatgtattttattctgttttatattaagtttgaaagacaagtcattt

SEQ ID NO: 49664 - DNA, 201 bp, Homo sapiens
ggtgaccatacacttttaccataccagataatcaagaaatattgggtctgccactccttaatgtaacgctggcatgtgccttgagaatccagcacaggcartttgctcctgaggaggaccaggggtaaagtttattctccctttttccttctcaactgtaattcacccctcaattactccctctcttgtattcccaaactg

SEQ ID NO: 49665 - DNA, 201 bp, Homo sapiens
ctgcctcagcctcccgagtaactgggactacaggcatgcgccaccaggcccggctaattttttatttttagtacagacggggtttctccatgttggtcagsctggtctcgaactcccgacgtcaggtgatctgcccacctcagcctcccaaaatgctgggattataagcatgagccaccgcacctggcaagatagagtctt

SEQ ID NO: 49666 - DNA, 201 bp, Homo sapiens
accttcttgggagccagatgttccactgaacactttgcatgcactgtgactatctaatgcaatccttgggacagatctgtgaaatagactctgttattagycccgttttaaagatgaggacactaagattcagatggtttaagtaacctgtccagtgtccacagctcctgtattagctgagagtcttgtgccattatatca

SEQ ID NO: 49667 - DNA, 201 bp, Homo sapiens
tgcatctgcctgaccttcttgggagccagatgttccactgaacactttgcatgcactgtgactatctaatgcaatccttgggacagatctgtgaaatagastctgttattagccccgttttaaagatgaggacactaagattcagatggtttaagtaacctgtccagtgtccacagctcctgtattagctgagagtcttgt

SEQ ID NO: 49668 - DNA, 201 bp, Homo sapiens
gtatgaaaagcataaagagaaaatttggttgccctcatgctcactcttatgccaagtatttattcaacaattaaatgaataagaatagggatttcaactaygttctatcctcctcctcctcctgcatctgcctgaccttcttgggagccagatgttccactgaacactttgcatgcactgtgactatctaatgcaatcctt

SEQ ID NO: 49669 - DNA, 201 bp, Homo sapiens
cctaggttgcagatgacttgaggaggaaaagacacgttgtaaccaacagaatattcaaggtactttctttaaacttaaaagaaaatccttggctagattasatttcactgagtttagttgagcaaagaacaattggtgaattgggcaacctctcaagccaaagtaagctgagagagactccagcgcaggcatgtagtggaa

SEQ ID NO: 49670 - DNA, 201 bp, Homo sapiens
cttttattaaccttgccttctatggatggttattcatattcttcttattgttctctgttatgataactttgcctctgacacaaaatcaacctcactgtgaygcatactggatgtggaactgaagcaagggacaatttatctgagctcaagcttgctcatctgtaaaatgggataattataataacagaaaatatgtgcttt

SEQ ID NO: 49671 - DNA, 201 bp, Homo sapiens
taatgcctaggttgcagatgacttgaggaggaaaagacacgttgtaaccaacagaatattcaaggtactttctttaaacttaaaagaaaatccttggctarattacatttcactgagtttagttgagcaaagaacaattggtgaattgggcaacctctcaagccaaagtaagctgagagagactccagcgcaggcatgtag

SEQ ID NO: 49672 - DNA, 201 bp, Homo sapiens
caggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtgg

SEQ ID NO: 49673 - DNA, 201 bp, Homo sapiens
agtgccagaatatccactattcataagagcccaaagttggaaattatccagatgcccagcaaaagttgaataataaattgtgatacattcacaaaatggcrtctgtacaataataatgagtgaatgaactgcaactattcacaacatcatgggtgaatctcacaaacatagtgtgcagcaaaagaaggctgaaacaagaac

SEQ ID NO: 49674 - DNA, 201 bp, Homo sapiens
ccaaaaagtttgaaggaggacctatgaaaaatatccctggcctgggcttaagaagccttcaccctcattctcaactctgaggctaccagagcatgatcagytcatcatctcagtcaatcctcccagctcctctattagatccatatgactgccactttgtgaaagatacaaggaggacttggcaaaacaagggccccacct

SEQ ID NO: 49675 - DNA, 201 bp, Homo sapiens
gaattggatttcctggagcctttcagactaagatactccagactttcaatcaaaatcccagtagggccatgcccagcaacaggagtaagccagaagttgaytcagtcttgttcaacttgcaatgcggcctgacccttttcaagcccttactaagttgatgaagcaaggctccatctgatacagtttggctctgtgtcccca

SEQ ID NO: 49676 - DNA, 201 bp, Homo sapiens
gattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcag

SEQ ID NO: 49677 - DNA, 201 bp, Homo sapiens
gtctcatctatgttttctcaacattcagcatacacctgtatgaactgtctggctgtgtaactgtgaaagcttctcacagactgtgagtctcattttctacrtatacaaaatgaagaagataattcctacttataacgttgtgagaaatgagtgaagtgctgtaccctctagattctccatcaaaagccatattaaatgttc

SEQ ID NO: 49678 - DNA, 201 bp, Homo sapiens
acagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagc

SEQ ID NO: 49679 - DNA, 201 bp, Homo sapiens
ccaaagaaactagaaatgcggtatacttgaattgttaccagaagcgagagccttctttacatgtatgcagtaatcagttaagtgacactgtgtgcgtatayaccgtgtcccgaatattaagaagaacaaaaccaaaatttgcagattaagaaacagacaccaaatttagttggctttctaaaagtcgtatcattaggatag

SEQ ID NO: 49680 - DNA, 201 bp, Homo sapiens
atagagcttaaagacagggtgcttatccctcaaacctccctgtatcactaactttcttaatccagacttttgcctttgtttttttttttgtttgttttttktttttttttttttagaaggagtctcgctctgtcacccaggctggagtgcagtggcaggatcttggctcactgcaaactccacctcctggttctcgccatt

SEQ ID NO: 49681 - DNA, 201 bp, Homo sapiens
gaaaataagccaagattgtttaaaattctgtgtaaaatgaaaagtatccattactgatcagctaaagtaacaatggcagggttctgtagtatgtagaagtrtctgtatctgtggagaaatttctcagcaaagaatgtcaagaagcatggatgaaatatagcgtagcatggctggcatttctttgtgaaattttttgtgcaa

SEQ ID NO: 49682 - DNA, 201 bp, Homo sapiens
gtcagcctgcagtgggtaaatgtgttagaaaccatagcaggtatcttagttgatggggtcagagtctgcgcaagcataacataaacggaccagaggggaaraacctagataacatctgaaaggaagaaacaaatctttgtcaagagcttatactgaacatgagctagagaaatgcaatattcaggtttctggtccagaaat

SEQ ID NO: 49683 - DNA, 201 bp, Homo sapiens
tatacctcccctccacaaaaaagaaagatacatcctatagcagcatagaaaatggacgcggtgatggcaagatgtgaggagggaggcattaggcagctgcygcagaaatacaggtaagagaaaagagaggaccaagccaaggtagtgaagttagttggggaaaagtcagcctgcagtgggtaaatgtgttagaaaccatag

SEQ ID NO: 49684 - DNA, 201 bp, Homo sapiens
tgaggtgggcagatcgcttgaggtcaggagttcaagaccagcctggccaacatggcaaaaccccatctctactaaaaaaaaaatatacctcccctccacaraaaagaaagatacatcctatagcagcatagaaaatggacgcggtgatggcaagatgtgaggagggaggcattaggcagctgccgcagaaatacaggtaag

SEQ ID NO: 49685 - DNA, 201 bp, Homo sapiens
gagtacagtggtgtgatctcggctcaccataacctccgcctcccaggttcaagcaatcctcctgcctcaggctcccaaattgctgggattacaggcatgcrccaccacgcccagctaattttctatttttagtagagacggggtttcttcatgttggtcaggctggtctcgaactcccaacctcaggtgatctgcccgcct

SEQ ID NO: 49686 - DNA, 201 bp, Homo sapiens
tatgcattgtatgtgaaatagtaataatagccaacgcttaggaagtagttgccacatgcctgactctcctaaatgctctgcaaataggttagatttccagmaaatgaaaacaggttaggcagctcaatagaatattacataaccattaaagaggatggttataaagatgatgataatggcatggaaaaatcatatgaatga

SEQ ID NO: 49687 - DNA, 201 bp, Homo sapiens
tccagtcttcttaccttgacttacaagactgtccataattgggctgggctgactgcatgagtctcacctttcactgttctcccttaattccctgcctgccwggaagacgtatttcagcttctgcaatgctttgccttgctaaaaatatctcctcttagcaaacaagtttgcccagaagttatgaaagtaggagagggaaca

SEQ ID NO: 49688 - DNA, 201 bp, Homo sapiens
aggaaatagtgggtagagtggccaggacagggctcatggagtaggtgacttgtgaggaaaggtctgaggaaagtgaaagaactgctgtggaagacagaacmaaggccccaggattgttcacattctactccttggaacctgtgaatgtgttaccttatatggccaaatagactttgcaaatgtgattcaagttaaggattt

SEQ ID NO: 49689 - DNA, 201 bp, Homo sapiens
acctgtggtttacaatagccgccagagcactgggggctcttgcgatctcatgagaccaaactccaggtctaggcacacctggtttgggacaggcctgcttyagcattgaaaacaggatctttgcccaacaggaaggttggagaatgaggcatgcatctaagaaaaaaatgcaagcaaaataaaaattcccacatattgcct

SEQ ID NO: 49690 - DNA, 201 bp, Homo sapiens
atcaattgaacctgggaggcagaggttgcagtaagccgagatcgtgcccctgcactccagcctgggagagagagtgagatttcatctcaataaggaaatastgggtagagtggccaggacagggctcatggagtaggtgacttgtgaggaaaggtctgaggaaagtgaaagaactgctgtggaagacagaacaaaggcccc

SEQ ID NO: 49691 - DNA, 201 bp, Homo sapiens
ttcattcaacaattatttataagggacttaatatgtgcccagcactgttctaggcactacagatacagcattgaaccaccccaattaagcttgcattctaytggggagaatgaaaataaaattaaaattaaaatgagatatatagtaaattaaattagaaatgcagtagggtttctttttaagtggaggtggtcctttctc

SEQ ID NO: 49692 - DNA, 201 bp, Homo sapiens
gcaatagagcttaaagacagggtgcttatccctcaaacctccctgtatcactaactttcttaatccagacttttgcctttgtttttttttttgtttgtttkttttttttttttttttagaaggagtctcgctctgtcacccaggctggagtgcagtggcaggatcttggctcactgcaaactccacctcctggttctcgcc

SEQ ID NO: 49693 - DNA, 201 bp, Homo sapiens
gataaacacaccaattgaaaacagattggctgaattttaaagcaatagatatatgtttcttaaattagatagaccttgaatggaagggtacagaaaaatasaaaatgaaaaaaagtaagaaaatatatcctgtaaatattaaccaagagaaagttgatagagctatgctattatcagaggaaatagactttaaggagagaa

SEQ ID NO: 49694 - DNA, 201 bp, Homo sapiens
tataggagttaaaaaggtatcataaccttaatattaggtctcgggaggtgtcactaggactctgttatcctttcttcccttctttcttttttggctttctrtatgtcttcattttcagacagcctctctcctggggtatcagaagacacactcacattaggataatgcagataagatcaattcacagtaagaagatttatc

SEQ ID NO: 49695 - DNA, 201 bp, Homo sapiens
gaccctaaaggcaaaaaaaaaaaaaaaaaaaaaagagctgggaaagttgaattttgaggagaaggcaagaatactttattttccttctaccctaatgacascttctctttggactcatcctcctgtgagttggcaaggggaatggggagcagcttaagcagcagctgccaccatgaccattattcccaagcaacttgccca

SEQ ID NO: 49696 - DNA, 201 bp, Homo sapiens
ccagaagacagagactgcagtgagccaagatcgcaccattgcactccagcctgggtgacagggcgagactctatctcaaaaaaaaaaaaaaaaaaaaaaaraaaagaaagaaattaaaccttaaatagcaaaatagaaaagacagatcatcagcaatgattaataaaaaagctattttataaagcggtgattgggaaagta

SEQ ID NO: 49697 - DNA, 201 bp, Homo sapiens
ctcatgcctgtagtcccagaacgttgggaggctgaggtgggtggattacaaggccaggagtttgagaccagcctggccaatatggtgaaaccccatctctrctaaagatacaaaaatgagctgggcatggtggcacacacatgtagtcccaggtactcaggaggctgaggcaggagaatctcttgaacctaggaggcagag

SEQ ID NO: 49698 - DNA, 201 bp, Homo sapiens
ttgctgatcccctgttctactactcttccctattctggctgagttcctataagacagagatcagctcttagattccccgtgtatcatatccctgacatgcygcactgtgctattgatctggtggccgttcaataaaaagtcattgagtgaacaaatagaaagcgagaaagagggaaggagaaagagtgagatgaaataatg

SEQ ID NO: 49699 - DNA, 201 bp, Homo sapiens
gggaggctgaggcagaattgcttgaacccagaagacagagactgcagtgagccaagatcgcaccattgcactccagcctgggtgacagggcgagactctayctcaaaaaaaaaaaaaaaaaaaaaaaaaaaagaaagaaattaaaccttaaatagcaaaatagaaaagacagatcatcagcaatgattaataaaaaagcta

SEQ ID NO: 49700 - DNA, 201 bp, Homo sapiens
gagttctcagtcctggtcctcgtatgccggctactcacacaaaccattaggagacaagtctaagaagtgagcaatccatgtgacacacaataagtagagaktgcttcaaaataaaggtgagccttggggttagccttgaaagacgggtaggattcggatgagtggcattacccagaaatccaaggcagaggaatcaaaact

SEQ ID NO: 49701 - DNA, 201 bp, Homo sapiens
gtctgttacccctaagagacacagccctcttttctgaggcgtctttctttccttgatttatttggactatggtttctttggccaaccatttaatttttttkttgttgttaactttgtccttgttaacattaattctctcatgtcatgtggaaatgagaataattcagatattgtaagagaaggaaaatggttagataaatt

SEQ ID NO: 49702 - DNA, 201 bp, Homo sapiens
ctccctattattcctaaaagccagctgtttatggctaaagattcagttttgagtccttccatatcaagatgaatatttataggtgcccattgttatactcmacaagggtgaactaagagttctcagtcctggtcctcgtatgccggctactcacacaaaccattaggagacaagtctaagaagtgagcaatccatgtgaca

SEQ ID NO: 49703 - DNA, 201 bp, Homo sapiens
aaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttc

SEQ ID NO: 49704 - DNA, 201 bp, Homo sapiens
gaactctataatggtactacaatagaaaaaaaatttccaaagttcaattggaattttttcccagtaacttaataataaggctccaatttcaggaaaatagyttcagcatgagtgaaatcacactgtttgttatgcagcatcaaagctgtcctccaacacagggcagaggccagtgctccctggagttgaactccaacaatc

SEQ ID NO: 49705 - DNA, 201 bp, Homo sapiens
taaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtcttt

SEQ ID NO: 49706 - DNA, 201 bp, Homo sapiens
gtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctt

SEQ ID NO: 49707 - DNA, 201 bp, Homo sapiens
ttcgttcaaaagatggtaatgcactatccatatgccagcccctgattagatgctgggggcgcagcagtaaacaaaaagaaagctgtcctcatggagctgaygtgcagaaaggaggcaaagttcaaagtgccacgattgttctctgctcctttgagatcagactgtagggcacaagggcagaaggagggcaacctcttagga

SEQ ID NO: 49708 - DNA, 201 bp, Homo sapiens
cccagcagagcattggcagtccttgaaatgctcttccgtttgctgtttaagacaccatactgtccttgttctcccactctttctgtatagaaacccatatrttttcttcctctagttcttcttattattcctcctgccattggaagtgcctgtccatttcctgtcttgattttcctttgctgttttctaccatcctcaaca

SEQ ID NO: 49709 - DNA, 201 bp, Homo sapiens
tgaaagtaagtcccagaggacatcactgaccctgaccattgaattgttcttgtagcttttatcctattatgacacgctgccaaggaaaggcatcaggtacmctcagttagtggctgcacaaccacaaagcaattgctgttcgttcaaaagatggtaatgcactatccatatgccagcccctgattagatgctgggggcgca

SEQ ID NO: 49710 - DNA, 201 bp, Homo sapiens
gctacaaatatacttttacatttttaaatttcttctgatacacccaggggtgttcttgggaagaatgtaagtgtgtgggaacagcaaagtaaatgtttaamtatacacatgttgagttcagtaatatctccaagtcccagaatcctcagatctttttggaaagtgaataatgtctggtgagaggtcagagcaatgaactca

SEQ ID NO: 49711 - DNA, 201 bp, Homo sapiens
tgttctcgtgatagtgaataagtcccatgagatatgatggttttataaagggaaacccattttgcttggtttcactctctcgtctgccaccacgtaagacrtgcctttcaccttccgccatgattgcgaggcctccttagccacatggaactgtgagtctattaaaactctttcttttgtaaatcactcagtcttgagtat

SEQ ID NO: 49712 - DNA, 201 bp, Homo sapiens
atgatcacctagtttttgccagaccctgtgctaagtataagggataaagctttgaatcagataaaaaatgtgcctcctgctgtggagctttgatgatatcrgagagagaaaaaggcaaacatgatataataaacccttgagaacacaggaaaacggcacatgacaagacgatggttaagtatcatgaaggaaataacgcaa

SEQ ID NO: 49713 - DNA, 201 bp, Homo sapiens
agaagaacaaacacattctgagaacagccaggcctcaaccaaagaccagcaggagcaggtgcataaataccccaactccctcacccttcgaatgcgatgastctaaggcttatgttttaaactggcttccataactcaccagcaggattcagttctagttatccacattgacagctgatttgataacagccgttttgttgg

SEQ ID NO: 49714 - DNA, 201 bp, Homo sapiens
gtgtgataactgctacattgtgtaattattatcattattatttgagatggagtctctccctgttacccaggctggagtgcagtggcgcaatctcaactcamtgcaacctctgcctcctgggttcaagctattctcatgcctcagccttccgagtagctgggactacagaagtgcaccaccacgcctggctaatttttgtaa

SEQ ID NO: 49715 - DNA, 201 bp, Homo sapiens
agagtgcaggcacatttaaaatatttgttgaatgtacaaataaatgtttaaaaggtttcacatagactaggttgcaaaatccatagcagacactgtaggtrctccacctatatcctttccttttaccattctggggcatactggcctaatttacttgcagaagaacaaacacattctgagaacagccaggcctcaaccaaa

SEQ ID NO: 49716 - DNA, 201 bp, Homo sapiens
accttccacctcagacagttgtagaaattcaaaagtcccagcagttttctaaacctggcaggtcacttgaatcacatgggaggccattaaacacaccccaratattctaaatttggatttcaagggaagggcttgaaaggaagagcaaggaacctggataaaactctaaaaccttctttcccttgcaattgaattagccag

SEQ ID NO: 49717 - DNA, 201 bp, Homo sapiens
ctgcttcccaatgcgtggtccatggaccaagcagcttcagcatcacctgagcacttgtcagaaatgcagcacctaggcgccgcaccagacctgttgaatargaatctacattttcacaagattccaggtgatttgcatacacagtggcatttgagaagcattaatccaggggcttctttgcagtcagtgatggtgatttgc

SEQ ID NO: 49718 - DNA, 201 bp, Homo sapiens
gcagacactgtaggtgctccacctatatcctttccttttaccattctggggcatactggcctaatttacttgcagaagaacaaacacattctgagaacagycaggcctcaaccaaagaccagcaggagcaggtgcataaataccccaactccctcacccttcgaatgcgatgactctaaggcttatgttttaaactggctt

SEQ ID NO: 49719 - DNA, 201 bp, Homo sapiens
gccaacacacctggcccaatagttccaattttttatgtgtatatttttaaaaaattaagttgtgactttagcgtgaattgaaatttgtttgactatacttyataaacccttttatattgttttataattttttgcaaacataatttttaacaatgcataacttgtttatcacaagtcagacccagaatatttagctcttcc

SEQ ID NO: 49720 - DNA, 201 bp, Homo sapiens
tccaatggcttggagtctgaggctcagttttcccacttgcagaaggaaggaatgatgccaacttcgtaagttacatgagatgtgaaggcagtgatggaagkggagctggggctccttccccctctgttttaagcatttgattaaaacaagttaggatgggcgcagtggcttgtgtctgtaatcccagcactttgacaagcc

SEQ ID NO: 49721 - DNA, 201 bp, Homo sapiens
aaattgtcaaccatgtacacaaacagatctttaaaaaaaattgagacaaattaaagtgaaagacttcaaaatcagtttgtcacatttgatgctaaacgctrtattttctctgagaattttaaattgtgcaggtaatttctcaccacggtaagtcatgatttttcatacttgaacagtatcacttcatctaaggaattttcc

SEQ ID NO: 49722 - DNA, 201 bp, Homo sapiens
ctaggagtggaattgctggctcaaatgataattctatgttcaactctttgagaaaccacccaactgtcccctaggagtggaattgctggctcatatgatarttctatattcaactctttgagaagtcacccaactgtcttctacagcagctgaaccactttaattcccagcagagcattggcagtccttgaaatgctcttc

SEQ ID NO: 49723 - DNA, 201 bp, Homo sapiens
gacccgggcctccttctgcctactgtcgccataactctagttataacttgcttttgggtttatacctaggagtggaattgctggctcaaatgataattctwtgttcaactctttgagaaaccacccaactgtcccctaggagtggaattgctggctcatatgataattctatattcaactctttgagaagtcacccaactg

SEQ ID NO: 49724 - DNA, 201 bp, Homo sapiens
ccatcttgcctgtaaccttagcgccttccctgggatgatgggagctccatttgaccttggtgatgaacacagacagccctagctggcgtgagcaccgctgrttgataaggtgggtgtggagcttctgtccttctcagtggattgcgagaactttggctccatgtttcttcaccagggtatggggactcttggccatgagct

SEQ ID NO: 49725 - DNA, 201 bp, Homo sapiens
gctaggtttccacttagagcaagatctcttaaaaaaaaccctgcttattgaccacagcagccagacccgggcctccttctgcctactgtcgccataactckagttataacttgcttttgggtttatacctaggagtggaattgctggctcaaatgataattctatgttcaactctttgagaaaccacccaactgtccccta

SEQ ID NO: 49726 - DNA, 201 bp, Homo sapiens
tccagccagaaagtcttcagttgttcatgttgattactagcaaatgggaatagtgccaggttcataatgctgattttattacattactttctctgaactcyggtttaaataagtgcgtaaatatttggtacagggagataaacattgagtacacatggacataaagacaggaaaaatagacactgaagactccagaggtgg

SEQ ID NO: 49727 - DNA, 201 bp, Homo sapiens
ctgctaccaacctgtgtgcaaatgtatttgagtactaattttttatttgtaaatacagtgacaataatgccacaaaaacattgcatacttacaagatttawgagttacataatttacaatgattgagtgtgggcagctctattatctggatttcattaagatgatgctacaaaaatagtaattgttagtaataataatgct

SEQ ID NO: 49728 - DNA, 201 bp, Homo sapiens
ccattctcctgcctcatcctcccgagtagctgggactacaggtgcccaccaccacacccagctaattttttgtattttttagtagagaccgggtttcaccrtgttagccaggatggtgtcaatctcctgacctcgtgatccgcctgcctcggcctcccagagtgctgggattacaggcgtgaatgactggcctcttttact

SEQ ID NO: 49729 - DNA, 201 bp, Homo sapiens
atatctgtatattcaacaaatatttagtgtcgcatatgggctaagcagtgttcaagcagctggtgtcacagcagtgaacaaatttcttgccctcgcgtaamctacatcctaatgaatgtttctgttccatctgtaatagtttggctgtgtcctcacccaagtctcatcttgaattcccacatattatgggagggaccctgt

SEQ ID NO: 49730 - DNA, 201 bp, Homo sapiens
aagcatgttctcccttccccagctcctggctttatgtatcacctatttttatatataatataaatgaaatcatacaatacttgggcatttatgactggccwcttttttttttttttttttttttgagacagagtctcactctgtcgcccaggttggggttggagtgcagtggtgcgatctctattcactgcaagctccacc

SEQ ID NO: 49731 - DNA, 201 bp, Homo sapiens
tctgcaaagtctttgctctatgaagtaacattcccaagttccaggattaggaggtagatatctttttcccgtgaagactcggggttaacttgctccaagcscttcagttggagattttcaatcctgttggttaaatcaggttttaaacatccttagacccaaatctggccatacaaggcagagaaaatcaacttcatgcat

SEQ ID NO: 49732 - DNA, 201 bp, Homo sapiens
acataagacaactgtttttcttccagcagaaaaccaatttggcaaacacttatttttctttctctatcacacaaagaaagtcaattctctaagaaaaaggrtagaaaaagaaaagaaaagaaaacttttaaataatatcccatatatgttttgagaattttatacatcaatacattaaaacataggcaggaaaatttcaaa

SEQ ID NO: 49733 - DNA, 201 bp, Homo sapiens
gatgttgctggcggtccctactgaaaaggatgcatgcatgaagactcaaggcaacagtgacttgcacccatttctaacaatgacttgcacccatttctccygtatgggggtgcttgataagcactgagtggtgtaatttacaacagcttattggcttgatgccatcctatgaatccaccaaccatcatcttctctgaccct

SEQ ID NO: 49734 - DNA, 201 bp, Homo sapiens
tcgcagctccaaggtcagaccacctgggcccacgtcctgactctacgatttgcgtagctgttggtttgtgcctcagagtcctcatctgtaagtggggataytatacctactataataaattagtaatgccacggtaacaaagtattgcaaacatggaggctagaaatttattctcccacagttctggaggacagaagtcca

SEQ ID NO: 49735 - DNA, 201 bp, Homo sapiens
ttggttgagtggcagccagtgcggccatccacaggctttcccaagtgcatcgctgcagccatagttagctccccagcagctgctcggggctttcacatagrtggaatatagtgttgtcagaggtaaatttccagctagtatataggatagaacaagataatgtaataaaatgtacattttctaggctctctgatatgcttc

SEQ ID NO: 49736 - DNA, 201 bp, Homo sapiens
gtaatgattcttagatggtgattcagatgattagttattggaccttcgatgcattttttattttaattttgagattggccgtccccaacgcctctgatgtrtgactttcattactggagatgttgtttctgatgttgctggcggtccctactgaaaaggatgcatgcatgaagactcaaggcaacagtgacttgcacccat

SEQ ID NO: 49737 - DNA, 201 bp, Homo sapiens
tagctgggaagcagcagttttgagtgtgggttcagggtcgcagctccaaggtcagaccacctgggcccacgtcctgactctacgatttgcgtagctgttgstttgtgcctcagagtcctcatctgtaagtggggatattatacctactataataaattagtaatgccacggtaacaaagtattgcaaacatggaggctaga

SEQ ID NO: 49738 - DNA, 201 bp, Homo sapiens
tgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtatgtataacagatatatctaacatattatcatttcaacaagtaatcaaggccaggcacaatggct

SEQ ID NO: 49739 - DNA, 201 bp, Homo sapiens
gaagcagcagagggtgacagcaggccttggcaccagagatccagcctgcgaatcccaaccatgccccatattagccaatgatcttggcaaagttcacatawctctaggcctctcagttcctcatctgtaaaaggggaggaataatattatcaacctcccagggctggtgtgagggctgaaggcatagatgctggaagctcc

SEQ ID NO: 49740 - DNA, 201 bp, Homo sapiens
atgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtatgtataacagatatatctaacatattatcatttcaacaagtaatcaaggccaggcacaatggc

SEQ ID NO: 49741 - DNA, 201 bp, Homo sapiens
acccacttcatcaggttgtcatgagtcacaaaaataaatgtagtgatgctcttaaagggtttagcaccaagctgggcccaaggaagcattctgtgtgtctrttgaccaacttttacctatcctgacaccaaggagcttagagtttagtggagatggcagagccgtcagggcccgtgttaggctcccaaaggcatttttacc

SEQ ID NO: 49742 - DNA, 201 bp, Homo sapiens
ttgaggtcagagtggtcatcgggatccaagcctgctggatcttcctggccttaggaaacccagaggcttcatcctttggcaaggggaagcctatatacccygtaggcttaatgacggggagaagaatgtttgtaaaagatctcgctggctgctgaagagagaacatctggagttaactctccaatttcagactcccctgat

SEQ ID NO: 49743 - DNA, 201 bp, Homo sapiens
aatatatagcttgaaaattattgtacggatccaagaattgggcctagaattcaataataggctgttacatcttgacacatgcctaaattgttatgtttatrtggctcttagctccaggatactattcatatatagataaaaagacatccttcaattcattaatttaaatagataacagattactttaaggatcagaatcta

SEQ ID NO: 49744 - DNA, 201 bp, Homo sapiens
acatccagggctccttgcaggtaacacatctgtttgagataacttgggttcaaggaggacattaggttctgtctgtcttatgtggaaaatgggtctttaayttattatgttggctaagattccttttgttattgttgttgcaaatgacagaaatccaactcaaaaaatgtagatgaggggcagcgggaattaattgattca

SEQ ID NO: 49745 - DNA, 201 bp, Homo sapiens
ttttcttaagtataacattgctcagtaactatgtgggtgaagatctgaaagttctgcagcactgtttcatttataaaaataaaggtaacggtacttttgcscaagatttgtgtggaatctaaaaacttccccaagttagtaaggaaggcactgtgatagtatctactaatgaaaatgtgagcacagagatggttataaaat

SEQ ID NO: 49746 - DNA, 201 bp, Homo sapiens
gatgaacttcacaattccccttcagcatctgtgaagctgtgagttaaggatagatggcaacctaaaaacgaatgtacggcacgtcagtcatgtttcagagsaaactggatattggtgaattcataccagtgtggaaatccattgacaccacaaaggcaagcttttctcttacttagccatgaccaatggtcacagcatctc

SEQ ID NO: 49747 - DNA, 201 bp, Homo sapiens
gagcagagacagtacaactggcaatgtgagagttaccttcccgccagtgctgtctgtgtgatcttgagagcatcatatagcttctttatctgtagaatagmgaggttaaacagcctgcagtggcaaataagtggctcatgtgccaccctactgtcaccgtgctcgtggcagatattgctaataacccctggcttagcctga

SEQ ID NO: 49748 - DNA, 201 bp, Homo sapiens
acagctgggagcagagacagtacaactggcaatgtgagagttaccttcccgccagtgctgtctgtgtgatcttgagagcatcatatagcttctttatctgyagaatagagaggttaaacagcctgcagtggcaaataagtggctcatgtgccaccctactgtcaccgtgctcgtggcagatattgctaataacccctggct

SEQ ID NO: 49749 - DNA, 201 bp, Homo sapiens
ttccacaagcacatgcatgcagatccctgcactcccacacatatgcatacactttataagtgtcacaaactgccattcaggcttcccgattgtgccattcrgagactttttgctactactgactcctgccttcttcaccaggagctcagggactccaccttcgtgagaaaaggagggcaagacacacagcaggattccagc

SEQ ID NO: 49750 - DNA, 201 bp, Homo sapiens
ttttgttttgtttcccattgaccttcagtgacttcagtatatctatgtgtgtatatgtatatatgtatatgtaattgtttacggttctgtatatatatacrgtgtatatgtatgtctatatgtatacatttgcatttaacaggtcataggtatctcagagataagctgcccaacctactcatggtccttctgttgttttgt

SEQ ID NO: 49751 - DNA, 201 bp, Homo sapiens
tgtatccttcagcaggaatataaaaataccctgtatctcctctcctttcgtagtttttattttctacgtttctcatagtctttcctatcctactatatatrtgtgtgtgtgtatatatatatatatatgtgtgtgtgtgtgtatatatatgtgtgtatatatatgccatatatagagatagatccatcttccatctattac

SEQ ID NO: 49752 - DNA, 201 bp, Homo sapiens
tctttgccgctttaaagggaaaactgctatccctcttattggctgtacaattctgttttctctgtttattttgagttgttggaaattcaggtacatccagsttttcccaaatacacctattattaccccaaagagtaggaagccgatcttatctagattcactcagcaaatctagaatctcccaagagactccaaatttag

SEQ ID NO: 49753 - DNA, 201 bp, Homo sapiens
tacctggtttccccaggatgttgccccatgtgccttttttctgtgctgttttccctgcgtattttccctgtgataagttttaaccattgaatatgacaatrtgctgtgttctgtgggccttcctggcaaatcactgaacctgggagtggtcttcgggacccccagcacacaaacccacctaactaagccccctttgacagc

SEQ ID NO: 49754 - DNA, 201 bp, Homo sapiens
tcagaggaaaggaaatggatggtggataggcaagaaaatgtggcccactagaattctatatggtgctgcatattgtgctgtatacatatatggtgcatgcrtatgtgtacatatgtgtacatgtatacattacatgcacatataccatatgtgtgtatatggtgctgtaggtatatacatgcgcatgtatacaccatatac

SEQ ID NO: 49755 - DNA, 201 bp, Homo sapiens
tgtggggagggctcccactctcttagctgataagagtgactcactgcacctaaactgcttgcgcgaacaaatgtggtttatgctgaatatctgttttcccyctgggagtcaagaattttgctaatgccatgtggagggtgtctacgtgaccagccccccaaaaaaaaccctgaatgttgagtcttcggtgagcttccctga

SEQ ID NO: 49756 - DNA, 201 bp, Homo sapiens
tgctaggatctatgtagctgttgttaccaaaagatgtacacaagaaagttcctagcaacaatatttggagccccaaagtggaaatagtccagataccagtygagagtaggatagataaagagactcaatacagccacataatggaatactctatgatgattaagataaagataaatatagtaacctggatactatacagtg

SEQ ID NO: 49757 - DNA, 201 bp, Homo sapiens
atgtggggagggctcccactctcttagctgataagagtgactcactgcacctaaactgcttgcgcgaacaaatgtggtttatgctgaatatctgttttccycctgggagtcaagaattttgctaatgccatgtggagggtgtctacgtgaccagccccccaaaaaaaaccctgaatgttgagtcttcggtgagcttccctg

SEQ ID NO: 49758 - DNA, 201 bp, Homo sapiens
aatcgcttgaacccaggaggcggaggttgcggtgagcccagattgcaccactgcactccagccttggcaacaaagggagactccgtctgaaaacaaaaagkgggggtttaggagaaataggaatttagtgatttctaaagataagtagaatttgttcttattcaccatttccttgtcctgatcatggactatgcaaaaaag

SEQ ID NO: 49759 - DNA, 201 bp, Homo sapiens
tgtcttcccaacaccaagctcggtgcctggcatgaaacagacacccagcaaatgtttattccaaatgagcgagtgaacagtacgtcacattaaaaacgtgygtgtttatgtatacatcgatacataggctggaagcctctaggcaaaaatgttaatagtgcttatctctggaagtggattagggtgattttaatttttttc

SEQ ID NO: 49760 - DNA, 201 bp, Homo sapiens
tctcacgggctgaccccacaagcctgtgagccgtaagcggtgtgattcgctaacagttgaatggcactggctatgtgtgtatgtgtatgtgtgtgcgtgtrtgtgtgtgtgtgtgtgtgtgtgtgtgtgtgtgtgttgtgaagatacatttagtttgagtccctatgaagcgaggagaaaaggtcttgacgaacaacagtt

SEQ ID NO: 49761 - DNA, 201 bp, Homo sapiens
ataaccatttgtgtaattactaatttatatcctgtctccctgctggagtgtaagttccaaaaactggagggaatacactgctgtcttcccaacaccaagckcggtgcctggcatgaaacagacacccagcaaatgtttattccaaatgagcgagtgaacagtacgtcacattaaaaacgtgtgtgtttatgtatacatcga

SEQ ID NO: 49762 - DNA, 201 bp, Homo sapiens
atggcctcagggagctagcttccaagcatggcagaaggcaaagtgggagcaggtgtcttacagggcaggagcaggaccaagagagagatgggggaggtgcyatacagtttcaaacaaccagatctcctgagaactctatcacgagaatagcactaggagggtggtgctaaaccactaatgaggaaaccccccgccatgatc

SEQ ID NO: 49763 - DNA, 201 bp, Homo sapiens
acactatgtcttcaataatatacttatcctgctgttgaccccgtcagggttcccacttcttatgtcagtggtagaacttttgagggagacagagaattacscatttcattaggttttgcaaatgtattgtacaattgtgcataacattttctatttaaaaatctcatatctattgttatagccctatctcatatctcattt

SEQ ID NO: 49764 - DNA, 201 bp, Homo sapiens
gtggtgaggaggttttcagagaagatgtgtgcagtccctggcaagtagctggtgcccaggaaatgtcagttccattgtttgccagggaaggctcggtgcaygtggggctcacacacaaaggaagaggttagagagtccgcagaaaagggtgggagctcaaaacagtggttcttaggcgtttgtctgcaggcacgctggtaa

SEQ ID NO: 49765 - DNA, 201 bp, Homo sapiens
tcagggccatctcctgtaacagccatttctatagccgaaacaataagggataaattaggctggtcaatttgtcctttccctttcttgggtaaaaagaaaaygacttaactaaatcttttttctttaggatgaaaagagattttaaaaaacattctagtagcaaataactgtcctaaagtaggtaaaatgggaattgatttt

SEQ ID NO: 49766 - DNA, 201 bp, Homo sapiens
atttttacaacatcccacggcagtacatgccaaacttcaccttgtgctcagcttatgccccgcatttataaagagattgtctttcctaaccattcgagggytttgtccatttcccaaaggacctctccccagtcctttgccagtcaaatcactctttcgaagcagttgtaaatccactgtcctttctcttcttcaatcatt

SEQ ID NO: 49767 - DNA, 201 bp, Homo sapiens
cacctcccattcagggccatctcctgtaacagccatttctatagccgaaacaataagggataaattaggctggtcaatttgtcctttccctttcttgggtraaaagaaaacgacttaactaaatcttttttctttaggatgaaaagagattttaaaaaacattctagtagcaaataactgtcctaaagtaggtaaaatggg

SEQ ID NO: 49768 - DNA, 201 bp, Homo sapiens
tgaacacagatgaaccaagaattgctttgcttttgacataatttttacaacatcccacggcagtacatgccaaacttcaccttgtgctcagcttatgcccygcatttataaagagattgtctttcctaaccattcgagggttttgtccatttcccaaaggacctctccccagtcctttgccagtcaaatcactctttcgaa

SEQ ID NO: 49769 - DNA, 201 bp, Homo sapiens
ggaaggaacaatttctgtggttattcaaaaaaaaaaaaaacataagcgtcagttctgtgggacaatttgatcactttattttggagaaaaaaatgatgaayagaagtttgtttataagtttaaccccaataataggctagtctcacagtgaacacagatgaaccaagaattgctttgcttttgacataatttttacaacat

SEQ ID NO: 49770 - DNA, 201 bp, Homo sapiens
ctgaagagtgataatgaaccagccaaggggagaggtgagggggagaaaccaacagctaatgcaaaggctgggacgatgggagagcctggctagctttggastggggaacagggtgagttgatggtgggaggtgagcagggatcagtccccaaagccacaaaggttttgaagcctgaaagggacatgacgtacattttttaa

SEQ ID NO: 49771 - DNA, 201 bp, Homo sapiens
tgttactgtaaagcttgccttctgtaaaatgtcttaagcataagagctgtaaaggaaaatactcatggattatattgtgatttgaaatcaggatgtaatamgatagtgacagcttaaagattcttctaaaactagatatgaaatttgaatgtggcacctgtctataatttgtaaagcactttggctttttctcagctacat

SEQ ID NO: 49772 - DNA, 201 bp, Homo sapiens
gatagtgacagcttaaagattcttctaaaactagatatgaaatttgaatgtggcacctgtctataatttgtaaagcactttggctttttctcagctacatrgtgatgatgagttcttctcaacaagtgactaagctctaggggaatcagtttctcaatttgcatgagatacgggagcttcctaagacatgagactttcagt

SEQ ID NO: 49773 - DNA, 201 bp, Homo sapiens
ctaagttctttgagaaatctccaaactgctttggacaggggctgaactgatttacattcgcaccaacagtgtataagagttcccttttctctgtaacctgrgcagcatctgttatttttttgactttttaataatagctattctgactggtgtgagatggtatctcattgtggttttgatttgcatttctctgaggattag

SEQ ID NO: 49774 - DNA, 201 bp, Homo sapiens
tcaacaagtgactaagctctaggggaatcagtttctcaatttgcatgagatacgggagcttcctaagacatgagactttcagttttaaaaccaggatagtsttgagagagctgcccttgtttttcggagacatgcaggcttcccaagatgtgagactttcagtgctaatcccaggaaaagtcctaaacaaaaggcaacgag

SEQ ID NO: 49775 - DNA, 201 bp, Homo sapiens
cctgaataccaatttcttaatttgcaaagagaaatgatgtgacaaggaccaggaaactcaaagtccatatggtcagcattttctgtctctgtataaagccwatctattaatttaaagaacagaatgattatcacatgcattgaaatacacaaagtccaaacgatcagcaaattctcgcccggtgtgaagtcagtcttttaa

SEQ ID NO: 49776 - DNA, 201 bp, Homo sapiens
catcttccagtgcattcaggcactattcttggtttatttgttaaaataactgttgcactgggccaatccattacatttatctttaataaccaactctaggsgtttgttcggtcatcactttccctgtcaaggggcacaaatatcttctctcatccgtttcctagggggaagtatcttcttttcttgtcttgataagacagt

SEQ ID NO: 49777 - DNA, 201 bp, Homo sapiens
atcttctctcatccgtttcctagggggaagtatcttcttttcttgtcttgataagacagttaccaaaggaagaaagaggaaagccttatcctttgaaagayggcattaattcatgtgcatttggcagtgggagaggatattgcagtctggggtcagctatgacttaagactttctataagactggatctgaacaagccata

SEQ ID NO: 49778 - DNA, 201 bp, Homo sapiens
atgagttaacacacataacgcttaggatggtggtggacgtacaaaacactcaataagaatttgcttttgttattattacttgttcacatccatgcagcatktgtgcctgcatgctcacacactctagtcttacgcagcttattcaccaacattggttcgggatgacatttgactgttttcaaaagtcaaatccacttttca

SEQ ID NO: 49779 - DNA, 201 bp, Homo sapiens
ttactttctgataccataaatctgatctgtgaatagaagagatgggaggtacaggagatccagggttttcaccagagattccaggagccaccttgacttamagcagaacaaccaaaggcaaagccaaggagagtgttttcaaagggctcagtgatcaggagagtgaagcacacagcatgcattaagaaatcagaaattcag

SEQ ID NO: 49780 - DNA, 201 bp, Homo sapiens
agatgcccaagggggccatgttggggcaactgtcctttctccacttgcccatctattcctaggaagcagatgtgcccagagcttgggctgtagaggcagamtgaacagatcagagaaggttctcgctctaggcctttctggatatgggaccacgagctagtcagtcaatctctctgagactcagtctcttctcctgtaaaa

SEQ ID NO: 49781 - DNA, 201 bp, Homo sapiens
ttcaccagagattccaggagccaccttgacttacagcagaacaaccaaaggcaaagccaaggagagtgttttcaaagggctcagtgatcaggagagtgaarcacacagcatgcattaagaaatcagaaattcagaaagagacacttacaaatacctagttattcactgggacaataagggatgtaaaattatggtactgat

SEQ ID NO: 49782 - DNA, 201 bp, Homo sapiens
ctgttagctatttgatttagaaagtattgagtgccggtgatgtgccaggtcctgaaactgcagttgttctcagtgtgacctcacttggtacctctgatgaycccaaaggggtttgtgagatgcccaagggggccatgttggggcaactgtcctttctccacttgcccatctattcctaggaagcagatgtgcccagagctt

SEQ ID NO: 49783 - DNA, 201 bp, Homo sapiens
gacttgggatgagtcttttacatcttttaacttcaggaaaacagccatggtggttctgccagcaagtcgttgaatggattaagtgagataatcgtacaatrtgtttagcactgtgcctggcatgtaataaatactcaataaatggcagtattttctatggcagacttggtgaatccaggactaggatcccaggcaaatctt

SEQ ID NO: 49784 - DNA, 201 bp, Homo sapiens
gtttacacatgccataaggattatagtacctttcaggaggatgcccactctatggataaagatgtcgaggattaaagaatataggtggtatattagtccaytctcatgctactaataaagacatacctgggacagggtaatttataaagaaaagaggtgtaattgactcacagttcagcatggctggggaggcctcaggaa

SEQ ID NO: 49785 - DNA, 201 bp, Homo sapiens
tgagcagggctctgtaatttcactcctttaatatcgtttttccttcacaactgttcacatgaagtacgtagggcttcaccaaaacaagtgaagggattcarcaatgggcaagcctgaatcagaatcatcagccccacccctttaaccctagcagtgatgcctgtagtaaccatttccatggcaacagcctgagactagcaa

SEQ ID NO: 49786 - DNA, 201 bp, Homo sapiens
ccaggtggggtgttttcactaccccccgactccaccccgccctcccagggtgttctaagattatctcaaagaatgatgttatgcaatttattccaataaawctccatgtacagtatcttatatgtgtatattttttgccttccagaagttatttcaaatccgtgagaaactatgtagggaagtcattcataggttcagaag

SEQ ID NO: 49787 - DNA, 201 bp, Homo sapiens
gatctgtgcatatctgtctgggggagggctacaacttccagggtgactgattcagagcctgtaattctgattcatatgcatccttgcacacatgtacaagyggaatctgaccatccactctgaaagggccccacaacttatgtgcagacacatttgcaaagcctctacaaatacatgcaaactctaggacaatttacccat

SEQ ID NO: 49788 - DNA, 201 bp, Homo sapiens
acatatggcacataattttatgtgcttgacttttatgactgaaagtgctataggtttgtttacaccagcatcaccacaaacacatgagtaatgcattgcaytctgacgttatgacagctacctcactaggcaataggactttttcagctccgttatcatcttacgggattgctatcatatatgtgttcctctgtagatcag

SEQ ID NO: 49789 - DNA, 201 bp, Homo sapiens
atagcctattacacacctaggtgatctcttacaacctatggctcctcggctactaacatatatagcacggtgctgtactgagtgctataggcaattgtaayacaatggcaagtggttgtgtatctaaacatatctaaacacagaaaaggtataataaaaatatagtctaaaaggtaaaattggcacacctgtatagggcac

SEQ ID NO: 49790 - DNA, 201 bp, Homo sapiens
gttccctcaacaaagaattatctcattttgtgcttgactctcaagcattcatgtaggtgaaaaacttctttagaattctctgagccaagaacctagctctwtgtataaacattttttgtatgattttaatctgcactgaatatattcgtttcagtctcatattcatctggagacccctccagagcttgaggtcttgagaag

SEQ ID NO: 49791 - DNA, 201 bp, Homo sapiens
acatcattcaatgctggaattgcttccacaatattcctgatgaagtcatataggttccacttgaaagtacccagtgacaagcacattatttcacccagaargaactagatcttccaaatggtaacctgaattgctttaggcccctccagtatggtcatgcattgtttaaccatagggatatgctctgagaatgcaccactg

SEQ ID NO: 49792 - DNA, 201 bp, Homo sapiens
atgaccttattttgaattatggtggtactttaaattttatgtccctgaagggttaagctctatgttggctttacctgaactctctcatcctcacccaccascaagatgaaggtagggtggccactgacaggtgacgttcgtgaggtgcatggcttttctgaagataagcagtaattgaaggaggagaatcagatttaaagc

SEQ ID NO: 49793 - DNA, 201 bp, Homo sapiens
tcatctgtgatatgggtgcatggaggaggttaaataacagctccaatcttaaagcctccttagcgccgtgcctcacgagctgtaagtactaaatgaatgcyggctattatatataacttatattgtatattatttatgattgttcctaaaattatcactaataagtgcttcacagcaatgagctaagattctgagtgctat

SEQ ID NO: 49794 - DNA, 201 bp, Homo sapiens
tataaaaatattgaatatctgtttcaaacacagacattttctcttctgcttcctctctgatattttctatactgtacaccctgtgttgtatatcctaaccwgtctgctacatacactatttagtataactccaatattctatctttaaaattttcatatatttagggggcacaactgcaggtttttacatacatacattgc

SEQ ID NO: 49795 - DNA, 201 bp, Homo sapiens
taacacccccgattattgtgacactcaaaaatcgccccctcgcacttcgaaagcacacccctatagacactgatcttctgttaaccctgccttgaatgacwtcggtagcctgaattcccatcctggccccactgcctcatagcttcgtggccctgggcaagcccacaacccccaaacctcagtttcctcatctgtgatatg

SEQ ID NO: 49796 - DNA, 201 bp, Homo sapiens
tcagcagcagcagaagagttggcccttaaatctacgaagaacattgccctgtgcatctgcatgcagacagggtctgataacatcaaagctgggagtctctscaacgctttaactaatgggatctgagctcggctgtttatttatagtcattcagtgataagaaagtcaacttggttggaaggagcttctgtcctaggcttg

SEQ ID NO: 49797 - DNA, 201 bp, Homo sapiens
gttgtatttgaaatggtgctgaattcagaatcccatggaaatcttcactatgacaagaattaaccagcccagagccacatggagaaaagatgtgtggccaygatctcttgaccgaatccagcatcagaatccaccagacaaaaccagcatcaggacattggccacaaagggataggcgtcccaggatgctggaatgttggg

SEQ ID NO: 49798 - DNA, 201 bp, Homo sapiens
gtgttttcaccatgtcctcctgaggccaccccagaagtgggagttccgtggagatgtgctttgatctgcaaattgactgtcaattctggagaagagatcaytggggcacgtagatgaccttgccttgtagggaatgtgtggtgagggggaggtgagaggttattttgcatttcaaaaagggctaggtaggaagcaggctga

SEQ ID NO: 49799 - DNA, 201 bp, Homo sapiens
gggggagaaaccaacagctaatgcaaaggctgggacgatgggagagcctggctagctttggactggggaacagggtgagttgatggtgggaggtgagcagkgatcagtccccaaagccacaaaggttttgaagcctgaaagggacatgacgtacattttttaaatctcactctcctgttctgtgagcaacagaatagagga

SEQ ID NO: 49800 - DNA, 201 bp, Homo sapiens
gaagtctttgcttcagcaatttttcctgcctctaggatgagtactgcaaagttgcctccaggaggcatcttattttccaagctgccatggatgactgacckttttaagcgtccttcattcttcagatgtgctaataccatcaattaggtagtagagtttcacttccctaggagccattttgtctttgctacatttatcttt

SEQ ID NO: 49801 - DNA, 201 bp, Homo sapiens
aaaaatatgccccacagctctgcaagaagaattcagcaggcagttggcataaaaaggttgggaatggtttacatctttgagcttcagtattttaagtctgsaagttcatggagtgcaagggctgtggacaccctgcttgccaatttttctgccttaaccgttccctgcccccttgttgttcaatttctggccaatgtctac

SEQ ID NO: 49802 - DNA, 201 bp, Homo sapiens
caaacatgactaatataatccaagttttctcaggaaggaaagcgctagtgtgactggacaatgctgagacgcccaagaagatgattgaccttcaattacaytgaagggaatgactgaactatttatctgtgagggattgtaaatcaggagccaagggaaagccttggaaattcaaatgtaaaaacctagttcagcaaagga

SEQ ID NO: 49803 - DNA, 201 bp, Homo sapiens
catgatccccctttctcggataaggagactgggaatcaaggaggttaaatagtctgcccagagatgctccccttcctattaagagcccagttgtaaacctrtgctcctgactaccatgtagctcttccctgagagctcctccaagccttggttaaagggccagaccctttgctctctgagcaggaggagagcaacgtctgc

SEQ ID NO: 49804 - DNA, 201 bp, Homo sapiens
ccaagccttggttaaagggccagaccctttgctctctgagcaggaggagagcaacgtctgccctcactgacccattaatagacacctgtcagtgaggaagrgaggcttgttcacttcagggagctgtggtcgcttcccctgtgccactggaaaactaataattcatgaagttggctttcaggtacgagcaagctggactga

SEQ ID NO: 49805 - DNA, 201 bp, Homo sapiens
cacttcagggagctgtggtcgcttcccctgtgccactggaaaactaataattcatgaagttggctttcaggtacgagcaagctggactgaatagttgtttsaagtcataaacatagaaaagtaagttgataggagaagactatgtggagaaaatttaaccatgttaaatatttgaataaacatttaaaaatacatagcata

SEQ ID NO: 49806 - DNA, 201 bp, Homo sapiens
ggagaagactatgtggagaaaatttaaccatgttaaatatttgaataaacatttaaaaatacatagcatatataggtgcatatataataaatttgagacartaggcatgacagagttctgaaatagtttataagtatgtgagttgtaaatatcccatttatattatgcatagattataagtaaaatacacagaattgattc

SEQ ID NO: 49807 - DNA, 201 bp, Homo sapiens
gtattttactagagacggggtttcattatgttggccaggatggtctctatctcctgaccttgtgatccacccgtctcggcatcccaaagtgttaggattayaggtgtgagccacggtgccctgccaaaggaaaacatcttattcaaaatcatgagagagaaactgaccatgaggctgagcgaatgtcagtgtaggttggga

SEQ ID NO: 49808 - DNA, 201 bp, Homo sapiens
aatatataaaattaatttaatagtatattttatttaacccagtgcatgcaaatatgattatttcaacatttagtcaagtcgaaaattgttccatctttttkgtacttagtttctgaaattgtgcatgtattttacccttaaagctaatctcaatttgggtgctaaaccttcagtggaaatccttgctctgtattcagttta

SEQ ID NO: 49809 - DNA, 201 bp, Homo sapiens
aaccaggggaggaggactttcggcagcttttcccttctctctctgtctgcttcttaatatcacaaccatcttctcaaaaacaaacacaagtactgattgcytacgaagccctctggccgtgatttctctgacaatctcagaattcacctaagacttccctctgtaccatctcatgctatcttcatcttcatctcatgaagg

SEQ ID NO: 49810 - DNA, 201 bp, Homo sapiens
taatttaatagtatattttatttaacccagtgcatgcaaatatgattatttcaacatttagtcaagtcgaaaattgttccatctttttggtacttagtttytgaaattgtgcatgtattttacccttaaagctaatctcaatttgggtgctaaaccttcagtggaaatccttgctctgtattcagtttataaaagatgcgg

SEQ ID NO: 49811 - DNA, 201 bp, Homo sapiens
aaccatcttctcaaaaacaaacacaagtactgattgcttacgaagccctctggccgtgatttctctgacaatctcagaattcacctaagacttccctctgyaccatctcatgctatcttcatcttcatctcatgaaggttcatattgcagcttctcatgcacatctcatgtccccaggccaaggggctgggcatgagatcc

SEQ ID NO: 49812 - DNA, 201 bp, Homo sapiens
acaacctgctcggatccccttccacaccgtggaagctttgttctttcgctcttcacagtaaatactgctgctggcagagaggggtgaagcaataatgaccrcagtgacagagaagaggtgagtgtgcttggtgaccccttcccacgcagggagctgtttccagagcacttctcttctgggaggcctgtgaattttgttatt

SEQ ID NO: 49813 - DNA, 201 bp, Homo sapiens
cagtgtcatccccttggcgaccgagttcttgctcagctatttcacatgagatcaggatgtttataaaagaatgtgacacagaaacagaaaaccaaataccrcatgttctaacttataagtgggagctaaacaatgagaacacatggacacaaggcgggcttttcagagggtagagggtaggagaagggagaggatcaggaa

SEQ ID NO: 49814 - DNA, 201 bp, Homo sapiens
gcctacatgtgagcaccaaagggaacacatttagtaaactctgccaaaggagcacagttcttgtaaagctgatgaggtttgtgattaatccttttttttgktttttttttttttttttgagaaggagtttttgctcttgttgcccaggctggagtgcaatggtggaatctcggctcgccacaatctccacctcccaggttc

SEQ ID NO: 49815 - DNA, 201 bp, Homo sapiens
ctcctgtcctgaagtgtaagagaataaagtcacatggttaagtcactaaggacatggcagtttgttacagcagcaataggaaatggatgtaaccttttttrtatggtttgtgggcttgaaagagatgacgtgttaaatacagtagcttttgaccttgaaagagacgatgtgtgaaatacattagttttgggggcttgaaag

SEQ ID NO: 49816 - DNA, 201 bp, Homo sapiens
tttcatatgctcattagccatttgtataacttctttggagaattgtctattcaggccccttgcccattttttaatcagtttatttggatttttgttggatkaagttggggaagttctttatatttttctggattttaaccccttatccgatatatgtcttgcaaagattttctcctatttagtaagttgcgttttcattct

SEQ ID NO: 49817 - DNA, 201 bp, Homo sapiens
aacgcgctctaattttctttctttttttttttttttttgagatggagtctcaccgtgtcacccaggctggagtacagtggcgcgatctcagctcactgcarcttccatctcccaggttcaagtgattctcctgcctcatcctcccgagtagctgggattacaggcaggtgccaccacacctagctaatttttgtatttttg

SEQ ID NO: 49818 - DNA, 201 bp, Homo sapiens
tttctggattttaaccccttatccgatatatgtcttgcaaagattttctcctatttagtaagttgcgttttcattctgttgattgtttcctttgatgagcrtaagtttttaagtttgatgtagtttcatttgcctagttttgcttttgttgtctgtgctttttgtgtcatatataagaaatcattgtaaaatccaatgtcc

SEQ ID NO: 49819 - DNA, 201 bp, Homo sapiens
ccaacagaatcttcatagatgttaaatatcagttttgtgtaaatacaacgcgctctaattttctttctttttttttttttttttgagatggagtctcaccrtgtcacccaggctggagtacagtggcgcgatctcagctcactgcaacttccatctcccaggttcaagtgattctcctgcctcatcctcccgagtagctgg

SEQ ID NO: 49820 - DNA, 201 bp, Homo sapiens
caatgtcctgaagctttcccattatgttttccactagcagttgtatagttgtaggtctcacatttaggtctttaatccattttgagctgatttttgtatayggcatgaggtaagggtctaacttcagttttgcttgtggatattcagttttccaaacaccatttggggctgctcatttcccattgtgtagtcctggcacct

SEQ ID NO: 49821 - DNA, 201 bp, Homo sapiens
tctggacacccgtgaggacagaaatatcacccatttgtgggtatgaaaacacaagaaagcaattcatgacactctatgcaaggttcattattgatgacacrgtgtgctttgtcattactttggacacatttagacatacattgtcatcatgaactgaggcctatgtttgctctaggatgaagcccattcaccagtccttta

SEQ ID NO: 49822 - DNA, 201 bp, Homo sapiens
caactgcccaggtttcttagcgatcagtcatcttgatcaaagtaagaagcagccagtgtccaaggcaaaatctgtgtggtcgtgttgagagaaccaggcayattcgccacaagatacctgtgccttctgccattaagcaggtctgacaacgtgaaagctggctgagctgagggagttgatgagctgtcaacctcaggggct

SEQ ID NO: 49823 - DNA, 201 bp, Homo sapiens
ggtaggatggggatgggattcagggagctgaccactctggacacccgtgaggacagaaatatcacccatttgtgggtatgaaaacacaagaaagcaattcrtgacactctatgcaaggttcattattgatgacacggtgtgctttgtcattactttggacacatttagacatacattgtcatcatgaactgaggcctatgt

SEQ ID NO: 49824 - DNA, 201 bp, Homo sapiens
ctgctccatcctccaggtttgaactacggctggttgcaaggagtgtatttgtgcttgcattagaaaattaggaacgcctgcagaaaatggctttcccacasataaaagactattaagtctcttaaatgctggaaaatgtcttcatgagcatattcagtgatttggcacttactccacatgagaacgtccctaccatgatgt

SEQ ID NO: 49825 - DNA, 201 bp, Homo sapiens
tgatgagctggtgagctgggaggacaccagaggtaggatggggatgggattcagggagctgaccactctggacacccgtgaggacagaaatatcacccatktgtgggtatgaaaacacaagaaagcaattcatgacactctatgcaaggttcattattgatgacacggtgtgctttgtcattactttggacacatttagac

SEQ ID NO: 49826 - DNA, 201 bp, Homo sapiens
agctgtccccctgcagtataggtagctccttttagccaggggctggagatttgttctctctgggaaaatgttaaagctgtgattatctagttatacctgartaaatggatcaaaggacctctccagccaagcacagacctccttgaaaaggtagtctccagcagcaaccctggggaggtttatagcaaagtgtttttagag

SEQ ID NO: 49827 - DNA, 201 bp, Homo sapiens
cattactgcattgtttgaaaaccactacgttgtaaattgcataaatgtgtatcaatgggtgaatggctaataaaaactttaaaaataaatataaaactgcmattcaaaggaatgaacgaaatattatataaatatataacccaataatttctataaagattatatgtgtgtgtatatagatatatgtattatatatgtgtg

SEQ ID NO: 49828 - DNA, 201 bp, Homo sapiens
tgaatatagtgattccagttctgtcacaaactccttcaagagcaggagctgcagaaaccacacacacacacacacacacacacacacacacacacacacarctcaccagcacctctggctctcacctgaatgagggacaaagcaaacgtgtgtttcctggcttgttgggagtggatactctggaatcccattgggtgacac

SEQ ID NO: 49829 - DNA, 201 bp, Homo sapiens
gttgtgtgcagagaaatatgttggaggactctgggaacttgaagataagtaagacaaaatcagatctttaatggagctgagggtggcatggtaaaaacagkcttgtatgttgtatatttagcaaactgtgttaagtcctagaagagagatgggtaaatatcccaggaaaacactgagagcaaagtaagctgatggggtgag

SEQ ID NO: 49830 - DNA, 201 bp, Homo sapiens
ttttgaagctagcttggaaagacacaaagtgtcctgctttaagtgtgctgcttcatctttggagcaaaaagcagacatgtttataaggttaaaggggaagwgagcaagggcaggaagtccccctgctagcctggtgtcttatctaccaaacagctgagttggcatacagttgagttggtgccttcctgggcagaaataagt

SEQ ID NO: 49831 - DNA, 201 bp, Homo sapiens
tggaacaatgaatatagtgattccagttctgtcacaaactccttcaagagcaggagctgcagaaaccacacacacacacacacacacacacacacacacasacacacagctcaccagcacctctggctctcacctgaatgagggacaaagcaaacgtgtgtttcctggcttgttgggagtggatactctggaatcccattg

SEQ ID NO: 49832 - DNA, 201 bp, Homo sapiens
ctatcagtggctatggaatcaaatatttgtagattaaaaattgtactcattctgctgacatcttatgagtatctgttgtgtgcagagaaatatgttggagractctgggaacttgaagataagtaagacaaaatcagatctttaatggagctgagggtggcatggtaaaaacaggcttgtatgttgtatatttagcaaact

SEQ ID NO: 49833 - DNA, 201 bp, Homo sapiens
gctccacgtaactgctgggcttccctcgggggctctgtgcatttccccctcagtgtttttgatgaaataaatccatggttcggagtgttgtttcctctgcyttctcctctcttatgtgctatagtttctcaagagattctggattacatcaaccccttctaagaagctgtcctcatccacctgattcttccacagtcttgt

SEQ ID NO: 49834 - DNA, 201 bp, Homo sapiens
attccctgctcctgacatcatcccacaggcgtggggccttggagttgtccttgaccttctgtaagaaccatcagctccacgtaactgctgggcttccctcrggggctctgtgcatttccccctcagtgtttttgatgaaataaatccatggttcggagtgttgtttcctctgctttctcctctcttatgtgctatagtttc

SEQ ID NO: 49835 - DNA, 201 bp, Homo sapiens
aaggtccctctctatgtccctggtatgggcaccctgttctgagtcccagctctgcagacctctgccccaccacacactgttttctccccaagggttagatwaggaaggatttgaatttagacagagccactactctcaaaatagaagcaaacttatggaaatacaaacatatatgattacatttacaggaagagccataca

SEQ ID NO: 49836 - DNA, 201 bp, Homo sapiens
caccatgttggccaggctggtcttgaactcatgacttcaggcgatccgcccacctcggcctcccaaagccctgggattacaggtgtgagccactgcacccrgcccaattctgttaatcattttaaaaagcagttgtatcagtggtcgtaaggcaagagaaaggttaggatataacaccatgatgggtcaagcaacactatc

SEQ ID NO: 49837 - DNA, 201 bp, Homo sapiens
agtgggcgtgctcctcctccatagaggagttattaaagccacagagttaaagtaaaatggcccgagagcaagacaatgaatatcagagagggtcacaggayatcaagtggacttgtgaccttgggagtgtaagcacctacagtggacagaggggagtttgtgagcaattttgggataggagccatgacattaatacttctt

SEQ ID NO: 49838 - DNA, 201 bp, Homo sapiens
tcacaacatcatgggtgaatctcacaaacatagtgtgcagcaaaagaaggctgaaacaagaacacacatgctaaatgactgcatttatataaagctcaaasccaggcgaaattaatcctagccagcagatcaccttgtggatgggtttcttgatctggtagtactagactacatgggtgtgttcagattgtgaaaattctt

SEQ ID NO: 49839 - DNA, 201 bp, Homo sapiens
cagtttttctggacatcagaaatcctggagacatcaggtccactttccacatgtgcactatcggtggtgtgaggtgtgatgctccagtggatccagggtckgctgtcccctttagatgggacatgtgctcccacctcgattacgtttccacgtgcatgggcccctctggtcctgccctttcctgagtttgaggtccaccct

SEQ ID NO: 49840 - DNA, 201 bp, Homo sapiens
cttttttagtctagttttaaaaaaaaaataacagaaggagctgctgctacagcaaacatcttcctcaatggtgaaatagtaaaaactttttttgtgacctsagtcccagccagagcgagaaggcaaacaaaagaaatactaggcttaggaattaaaagtaagaaatctctttattcataaatgatatgcctaaaataatct

SEQ ID NO: 49841 - DNA, 201 bp, Homo sapiens
gagttacttcacttagaataacagtctgcaattccatccaagtttctgtgaataccattatttcattcttttttatggctgagtagtagtattccatgttwtatatatatatatatatatatatatatatatatatatatatatatatatatactaggtttttttaatctgttcattgattgatgggcacttggcctggtt

SEQ ID NO: 49842 - DNA, 201 bp, Homo sapiens
aaatcagactacagaggatccagatatttgaattagcacacaagaacattaaaataaacatgattagtatgttcaaggagacagaataaaagatagattcmagcagagagaattacacaagagatctgaaatctttaagaaggaatcagatagatattccagaactgaaatacatattatcatattaaaaactcagtaagt

SEQ ID NO: 49843 - DNA, 201 bp, Homo sapiens
catatgcccaagagggagcctgagaatctttgcagaagttgaagttgaaacagaagtttactaagatgctgaaacttaaagaatgaaaaccatcaactagmagagagtaggggattcgggaagcctccaaagaattcacaagaacattcagatgaagggaaagagggcaccaggtcacactgggttggttgccgagggaaa

SEQ ID NO: 49844 - DNA, 201 bp, Homo sapiens
agaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataat

SEQ ID NO: 49845 - DNA, 201 bp, Homo sapiens
agtcccagctactcgggaggctgaggcaggagaatggcgtgaacccgggaggcggagcttgcagtgagccgagatgacgccactgcactccagcctgggckacagagcgggactccgtctcaaaaaaaaaagaaaaaaatagaaatggcaaggaataaaatttgccttcaatgtgcttatggtcttgggaggagtagagta

SEQ ID NO: 49846 - DNA, 201 bp, Homo sapiens
ctggtccgtggaaaatggtcaataaatatctgttggctggataaattaatccctaaatgtatgtattaggttgttgcaaaaaaaaaaaaaaaaaaaaaaaattagccgggcgtggtgtcgggtgcctgtagtcccagctactcgggaggctgaggcaggagaatggcgtgaacccgggaggcggagcttgcagtgagccga

SEQ ID NO: 49847 - DNA, 201 bp, Homo sapiens
ctgtaattttacatcctgaaaaaaggttaaatttaaggcaatgtacaaagacaaagaatgactttgagcaaatgcattaattaggtttgagatgttcagartttaatgttgactaaattggttaatctgaagtcttttgggagtggtgacagttatcctgtccttactgtaatcaatgtgcttgatttggtggaaatttta

SEQ ID NO: 49848 - DNA, 201 bp, Homo sapiens
cctggtccgtggaaaatggtcaataaatatctgttggctggataaattaatccctaaatgtatgtattaggttgttgcaaaaaaaaaaaaaaaaaaaaaaaattagccgggcgtggtgtcgggtgcctgtagtcccagctactcgggaggctgaggcaggagaatggcgtgaacccgggaggcggagcttgcagtgagccg

SEQ ID NO: 49849 - DNA, 201 bp, Homo sapiens
gcctggtccgtggaaaatggtcaataaatatctgttggctggataaattaatccctaaatgtatgtattaggttgttgcaaaaaaaaaaaaaaaaaaaaaaaattagccgggcgtggtgtcgggtgcctgtagtcccagctactcgggaggctgaggcaggagaatggcgtgaacccgggaggcggagcttgcagtgagcc

SEQ ID NO: 49850 - DNA, 201 bp, Homo sapiens
accttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccacctt

SEQ ID NO: 49851 - DNA, 201 bp, Homo sapiens
aaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccacct

SEQ ID NO: 49852 - DNA, 201 bp, Homo sapiens
caaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccacc

SEQ ID NO: 49853 - DNA, 201 bp, Homo sapiens
ctttcagagccttagcttatcttgtttcctgtttgaactttattacataaattttcctttaaaactgtcacacacacacacacacacacacacacacacamttttatggggccttggggccaaagatggaatgaaactatcatttatcacatgattttgataggaagctgttgttaggattgagatgcttgcttctgatga

SEQ ID NO: 49854 - DNA, 201 bp, Homo sapiens
ataaaaatgtttttgaagctgtaattttacatcctgaaaaaaggttaaatttaaggcaatgtacaaagacaaagaatgactttgagcaaatgcattaattwggtttgagatgttcagaatttaatgttgactaaattggttaatctgaagtcttttgggagtggtgacagttatcctgtccttactgtaatcaatgtgctt

SEQ ID NO: 49855 - DNA, 201 bp, Homo sapiens
aggacagaggtcggaaaacttttactgtaaagggccaaataatacatactttcagctttgcaggccagctggcctgtgttgtgactactacacaaaagtartaagagtctaatttggcccaggagtttgctgattcctggtctaaatgagagtaaagaatgggaaagggaatggtgtgggaggaataggcattttcattca

SEQ ID NO: 49856 - DNA, 201 bp, Homo sapiens
attcctttcatgatcagaagtacagagtaagtatatgaatgatgcgtgaattaatgaacaaacttctccctgttgccacattccaggaatagcccatggayttgcaaagagaggcaaaaaatggcatctaccagctgcttcctcttcttaggagtctccaacagagcctaataacatggggaagcattactaaattatgac

SEQ ID NO: 49857 - DNA, 201 bp, Homo sapiens
acttgttttcctgcaactagacagtctcatctagggtgatgggagacagtgacagatcatcaggcattagattttctgaaggagcatgcaacctagatccrttacatgtgtggttcacaaagcacctataagactctaatgttattgctggtctaacagaggtggagctcaggtggtaatgcaagtgctggggagcagcta

SEQ ID NO: 49858 - DNA, 201 bp, Homo sapiens
ccattggattagctggtctacaagattcctttcatgatcagaagtacagagtaagtatatgaatgatgcgtgaattaatgaacaaacttctccctgttgcsacattccaggaatagcccatggatttgcaaagagaggcaaaaaatggcatctaccagctgcttcctcttcttaggagtctccaacagagcctaataacat

SEQ ID NO: 49859 - DNA, 201 bp, Homo sapiens
tgttcaaattccttttaattcaggatggtcaaatgtttgtatgaacatttggggaaacatcttaactgtctaccaggcagttagattttaaagaaaagacrtgtattcatatactccgacccaggggaagatatgtggcattctgcttaacataatcagttccttgctttccacaccaatttgtgcttgatttgtttcttt

SEQ ID NO: 49860 - DNA, 201 bp, Homo sapiens
atgtgcactcaacagaagtatctaggcttgtctaagggaagaaaggaattgtttcctaacaagattttaagtaactcctgtttctgtagatcctgagagtgagtcctagaagcagtatgtcttaaaccctaagtggttgggtcccacaagctatttccctcgtcatgattgcactcagcagtgggtcctcacagaactgag

SEQ ID NO: 49861 - DNA, 201 bp, Homo sapiens
catgccacataggtttggtgaagaacgtttttgatgtctgttacccacatggagggtttctgcctgtctattttgggtagaagatacttagaacaaaagtmgtcttgaagggaggagaatatcaagaaataaatcatgtctgtgttcctataaaaccaataacaaacttggtaaacatgcatctgaaaaataactagaagt

SEQ ID NO: 49862 - DNA, 201 bp, Homo sapiens
aaaagacatgtattcatatactccgacccaggggaagatatgtggcattctgcttaacataatcagttccttgctttccacaccaatttgtgcttgatttrtttcttttcttctagaacttttcagagtgagaacctttagcagaaaaaaaaagcttaacaagatagacattttagttcaatagaagaatttttctggtgt

SEQ ID NO: 49863 - DNA, 201 bp, Homo sapiens
gtggcagcactttgtacgagtttgaattgggcacattcgaaatgattcattatagaaatataaataaaattttatttgtgcacagaattagaaacagtgtrctctccaaattttaaatatttgtcacaaatttgcaatttcagagtggttgtcaggattctctctctcactctttctcagttttaatgagatatcattcat

SEQ ID NO: 49864 - DNA, 201 bp, Homo sapiens
cagggatttctttaacagtcttcacacccagaactgagaaccaacctcccacctggctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgag

SEQ ID NO: 49865 - DNA, 201 bp, Homo sapiens
aggggactaccatattggttcaaacaagagacagcaattaggtggtagagatggggagaaggtgccacttcgagggctgtttaggagagaaaatcaacagyagcactagtgataaattgagcagaagaggtaatggagggtcaggtggccaggataacaccagcatttcttgactggtgcaatcgaaattgaaatggggat

SEQ ID NO: 49866 - DNA, 201 bp, Homo sapiens
actgagtgatcttttattttttaaatttgaactagtgtctaaaaatccaaattcccaccttttcttaaaaaatcaaaagatggctggacgcggtggctcayacctgtaatcccagcactttgggaggccgagtcgggtggatcacgaggtcaggagatcgagaccatcctgactaacatggtgaaacctcatctctactaa

SEQ ID NO: 49867 - DNA, 201 bp, Homo sapiens
tcacttataaaggaaaattagaaactacagtcctagttaagtaggagtgcaaaagaacttgtgaaatggggtcgggtaagaatctagtgacttctctggakttgcaagcagagggtgcctgatgcagacactgagctggacatgaagcatgttctctgaagattattgtctgtcttccttctaaacccatggctctgcgta

SEQ ID NO: 49868 - DNA, 201 bp, Homo sapiens
aatttgtgcttgatttgtttcttttcttctagaacttttcagagtgagaacctttagcagaaaaaaaaagcttaacaagatagacattttagttcaatagmagaatttttctggtgtgaaaaagtaaattacaaaaaggactttggttctgaaagataattaataaaaaccttcccatgtgatgacaaatctgacatcttg

SEQ ID NO: 49869 - DNA, 201 bp, Homo sapiens
ggaaacaacaggtgctggagaggatgtggagaaataggaacgcttttacactgttggtgggactgtaaagtagttcaaccattgtggaagtcagtgtggcrtttcctcagggatctagaactggaagtaccatttgacccagccatcccattactgggtatatacccaaaggactataaatcatgctgctataaagacaca

SEQ ID NO: 49870 - DNA, 201 bp, Homo sapiens
aacaagatagacattttagttcaatagaagaatttttctggtgtgaaaaagtaaattacaaaaaggactttggttctgaaagataattaataaaaaccttyccatgtgatgacaaatctgacatcttgtctaatgtctggcagagaagaaagtgttgagagctgcacagttggaataaaatgttccactttacagcaaggc

SEQ ID NO: 49871 - DNA, 201 bp, Homo sapiens
gtttcaccaagttgcccaggtgggtcttgaacgcctgacctcaagtgatctccctgcctcggcctcccaaagtactgagattacaggcatgagccactagwttttttactgtatctagcaagggccattgcaggatatcaagtctgggaatgacacagtttctcatttcagaaccattgaattggatacagcctgagtagt

SEQ ID NO: 49872 - DNA, 201 bp, Homo sapiens
ccaagtatagtacccaagctattttattattcagaagactggctcttttcaaagaagtgtcaaaagtttggtttggggaattcttgtgttttctttcttgmtgcagttttccacttttctttagtgtgtcaccatctttatctcctatgatactagtttataataggcttctaacatggatgccttcctcttggaagtggg

SEQ ID NO: 49873 - DNA, 201 bp, Homo sapiens
gtttaaagtggcagcagggcaaaggagcatttgtagcttcagaaatgtagtgatcattctacagtcttttgaaaagataaacctgacaggaatttctagcsaaaatgaaaattggtgacggttgagcagctgcaaagcaaaagtgaaaaagtccttgagttgtcctagcacagaacgtgctcaccagcgccgttggatcct

SEQ ID NO: 49874 - DNA, 201 bp, Homo sapiens
cttaaaagaaaaggtagagattgaagacgttatcttttaaaagatactcacagcacatttaattgataggggatcagtaacaagattatataaagaacttytaaactcaataagatagcaaaaaaaagtaaaaaataactaagagataaaaacagtcatttcacagaataagaaaaatgactaatgtataaaaaactgttc

SEQ ID NO: 49875 - DNA, 201 bp, Homo sapiens
cgtgaatccagaagaaatattgactttcaagtcttactatcaaagaaatacattttgtaaggctacagcttctaaagattgtgattcctctgatggatcargacaaaatgagtcaaaaacctgctgaaaaggattcaccattctagatgcccactaagaacatttgtgattcatgggggggtggttaaaatgtcaaaaata

SEQ ID NO: 49876 - DNA, 201 bp, Homo sapiens
ggaaagcccccaacaaatactgacctgactttctcctaaaagattgccataaacacttttggttatctcttaatgtacttggttcataactgcttagtcarttatttttattagcataacattccttttaagcataatgatattgggaaaacagaaatgatacaagcgtaatttcttggctatgactgtttatgttttgag

SEQ ID NO: 49877 - DNA, 201 bp, Homo sapiens
agaaataatttacaatgtagtcaggacctaatgataccttacagctgtttctcatctttgagactcattgagtctcatctatgttttctcaacattcagcrtacacctgtatgaactgtctggctgtgtaactgtgaaagcttctcacagactgtgagtctcattttctacgtatacaaaatgaagaagataattcctact

SEQ ID NO: 49878 - DNA, 201 bp, Homo sapiens
ctgcattgaaggggttaagaagtaaggaaatgatttaaatagacttaccaccaccactggtcacccgtcttaaaaaaaaaaaaaaaaaaaaacaaaaaacmccttatagtaaccttttttttttttttttttttttttttttttggtttgtgctggatgcggtggctcacgcctgtaatcccagctctttgggagggcgag

SEQ ID NO: 49879 - DNA, 201 bp, Homo sapiens
tcagtgatggtgatttgccaatcattagcatttcagaaaccccaggccgaaaccatacatttatccttagctaggtcggtatcaagtttctctgctttcakccagaatcctaacaattcagcttggttgattatctaagaagcttctatttgataattatatatctttcattttttttaaagtgctgggggttgggagatc

SEQ ID NO: 49880 - DNA, 201 bp, Homo sapiens
tcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagt

SEQ ID NO: 49881 - DNA, 201 bp, Homo sapiens
ccctcccccatcaaacttttttattgggtatagaaaaacatgaggaaggtcaggtgctgtggctcaggtctgtaatcccagcactttgggaggctgaggtrggggggcagattacaggaggtcaggagttcaagaccagcatggccaacgtggtgaaaccccatctctacaaaaaatacagaaattttctaggcatggtgg

SEQ ID NO: 49882 - DNA, 201 bp, Homo sapiens
tggttttgtttatactcaaagtcattgtggggacctctattttcaccttttttggcctaggttgtcccagtacttctctcattctgtgattgatgtcatasgtgacaagtgtgatgggtcacttcactggcctctccaggcggtttattctttagctgacttcaccttgctctggccttatgtaaaggtccctgccctctg

SEQ ID NO: 49883 - DNA, 201 bp, Homo sapiens
ttttctcactttgaaatggggataataatttcctttctgatcatatgtaaggatttatgacaatgtctatcatacagttagcctgtaaatgatacgttctrttttatgtaaccattaaaacaatttctttgtgggctgtactttcatccagctggatggattttaaccaagtgatcccacctctatagccagcacccagat

SEQ ID NO: 49884 - DNA, 201 bp, Homo sapiens
tatttttatgttaaaaagctatgagtttatttttttagtaatttggtaatctttttaggttttgtagaaatataaaggatcctgaaaccaaaaaatttgasaagtttgtttgctattgggcaacaaactaaataaatgtatttaaaaagtagatttcctatctttattcagtgaaatgctatatcaagtagttgatcccat

SEQ ID NO: 49885 - DNA, 201 bp, Homo sapiens
ttccacagtttagatctcagactagtgcaaaagtctgcatggggctccagccttgtaagggtctcatcttgttttatttggaggctctgacatagtggaastctgggtgccaaagggatagttcagaacaggaatcttctgacctggatagggcaatcaaattcttgattgtgttagtgcatcaggatccttgtcagataa

SEQ ID NO: 49886 - DNA, 201 bp, Homo sapiens
tgtaaaaatggtccctactaggggaaatgctagatgagatgctaaaactcatctgtctaaaaacaagagacaagctctttcttggattttttctttttctytttctttctttctttctttctttctttctttctttctttctttctttctttctttctttcttttttgcagctgatcagtgctcctcatgcattttgaagc

SEQ ID NO: 49887 - DNA, 201 bp, Homo sapiens
gcacaatataagaagaaagactattaccagctaacatttattgagtatttactaggctatcagcactggtctaagcactttacaggttaaattcatgtatyttctacaatgatcttaagcagaatttccttcattttcttatttccaaaattatactacctaatatagaaggtgatgatgaattttgagagataatgtacc

SEQ ID NO: 49888 - DNA, 201 bp, Homo sapiens
tcttctgcaaggggtctacatttaagtcaatagtagcacaatataagaagaaagactattaccagctaacatttattgagtatttactaggctatcagcastggtctaagcactttacaggttaaattcatgtatcttctacaatgatcttaagcagaatttccttcattttcttatttccaaaattatactacctaatat

SEQ ID NO: 49889 - DNA, 201 bp, Homo sapiens
tgaacctgagaggcggaggttgtggtgagctgagattgtgccattgcacttcagcctgagcaacaagagggaaacaccatctcaaaaaaaaaaaaaaaaaacttcaagcaagggaggccatgctatcaaagtatattttcctcctcttctgcaaggggtctacatttaagtcaatagtagcacaatataagaagaaagact

SEQ ID NO: 49890 - DNA, 201 bp, Homo sapiens
cgtatgtgtgagccaccttggaagtagaccttctagcccccatcaagcttttagataactgtagcctcaccaacatcctgactgaactacacagctgagcrgcttccatatctccaagccacaaacactgtgtgcaatcataaatgtttttagttgctttaaagcactaagtttggggtaattttattcagcattagataa

SEQ ID NO: 49891 - DNA, 201 bp, Homo sapiens
tattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggcccccccccccgcccc

SEQ ID NO: 49892 - DNA, 201 bp, Homo sapiens
gtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggcccccccccccgccc

SEQ ID NO: 49893 - DNA, 201 bp, Homo sapiens
ttgggcaacaagagcgaaactgtataaaaagagagagagagagagagagaaaagaaggaaggaaggaaggaaagaaagagaaagaaaaagagagagagggwgggagggagcgagggaaggaaaaattgaaaaccctgaggtaggcaccttaattctacccatttttcaccttaattctaaccattttccagataacaagca

SEQ ID NO: 49894 - DNA, 201 bp, Homo sapiens
tcaccagcaaagttaaactttgccatgtgttttttgaccatattcatttctgtttcttaaaattatcaacttagaatatttgtgcaattttttttttttttacatgtggagcttgttcttaatgattctgccagggcttaaaatttttactttctaatgagaaagttttggaatttactcttttccaatttatgaaaattg

SEQ ID NO: 49895 - DNA, 201 bp, Homo sapiens
tgggagaatcacttgaacctgggagacagaggttgtggtgagccaagatcatgtcattgcactccagcttgggcaacaagagcgaaactgtataaaaagaragagagagagagagagaaaagaaggaaggaaggaaggaaagaaagagaaagaaaaagagagagagggagggagggagcgagggaaggaaaaattgaaaac

SEQ ID NO: 49896 - DNA, 201 bp, Homo sapiens
atcaccagcaaagttaaactttgccatgtgttttttgaccatattcatttctgtttcttaaaattatcaacttagaatatttgtgcaattttttttttttttacatgtggagcttgttcttaatgattctgccagggcttaaaatttttactttctaatgagaaagttttggaatttactcttttccaatttatgaaaatt

SEQ ID NO: 49897 - DNA, 201 bp, Homo sapiens
cacgagggcagacagagaggtcagtgtccaacaccgtgggaggaccacaggctcacctccctcagtggggtcagcatctcataaattagtcatgctggagycctctccaggagttcctggtgggagctaaagggaaggtgaactcctttcttttaaacactgctatcatgtgaagatccactgccaggaactaggagggca

SEQ ID NO: 49898 - DNA, 201 bp, Homo sapiens
tggggttggagcccccacacagagtccccactggggcactgcttagtggagctgtgagaagagggtcaccatcctccataccccaaaatggtagctccacygacagcttgcaccatgcacctggaaaagccacagacactcaaagctagccatgaaagcagccgggaggggggttgtaccctgcaaagccacaggggtgga

SEQ ID NO: 49899 - DNA, 201 bp, Homo sapiens
ctactacttacagtaagttatgtgggcccttgttatgaattaatgagagcaacagagaaataacttcagggaaagggtacatctttaaataatttacccaygtgggtaggtaggaaaactggatctgtggtcatgcgtagtgtgcgggtatccgaagctgggtgtccacagtcacatcgggtcctctgtatctgtggcacg

SEQ ID NO: 49900 - DNA, 201 bp, Homo sapiens
tcttgtagctctccatccacccacccatctatatacacctcccacccccccacccactcattcattcatccacctacccatccatccatccacccatccayccatccatccacccatccatctatccattcatccatccatccatccatccatccagccatccatccattcacttatcctgccttgcatcctaccttctat

SEQ ID NO: 49901 - DNA, 201 bp, Homo sapiens
aaccatgctggaaaaagtatgtagagggactaagggtgtttttattttctttggcttttttccttccttccctcccttcctatcacccttccttctttccrttctccctttttccctctctctctccctttcttccttccttttagaaaaaacaaacctaacagtatgtatgtctaatacatacaaaatctggtatttaat

SEQ ID NO: 49902 - DNA, 201 bp, Homo sapiens
aagaggctgcacagaagtgagcttaaacccttaagcaaggattggagaaggaggagggtgatttcaaaaaacactgaaattagtagctttctttttttttktttgtctgttttgttttaagactgagtcttgctctgtcacccaggctggagtgcaagggcgcgattttggctcactgcaacttctgcctcccaggttcaa

SEQ ID NO: 49903 - DNA, 201 bp, Homo sapiens
atatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattat

SEQ ID NO: 49904 - DNA, 201 bp, Homo sapiens
ccagaaagtagacaattaagggggttacatcacacattgccctctgtaaatccaatttctgaacatcaaagcctcactccgtgacatctctttgaagaacraaggcactgcaggaccctgctcacggttcagctactcgggactggaaatgagtgttttaaatggagaccagagccgctgtgcacctgcttgttaaaatac

SEQ ID NO: 49905 - DNA, 201 bp, Homo sapiens
aatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagatta

SEQ ID NO: 49906 - DNA, 201 bp, Homo sapiens
aaaacccttctttgcctgggagctatccaaacacggacttgaggttagagtcagcccacagcgttccttggctgaaccccgctctgctccatttactcctyctgctggaggatcctgtcatttgaatacggtgcagtggattcccttatcagcagacacattcgaatcatttactatgaccaacgctactacagtaagaga

SEQ ID NO: 49907 - DNA, 201 bp, Homo sapiens
aatatatataaattatgcaaattatatttgtgaatatataatagatttatctaaatatatgttatatttagctatagaaatatatattatatatttagatrttatagaaatatataatatatattataacatcagtatgtatcattatatatagatccatacagattatatattaatatataatagattatattaatagat

SEQ ID NO: 49908 - DNA, 201 bp, Homo sapiens
ctgattatatatgagtatataacatatttacatgatatataatatataagtatataaaatatgaatatatattatataatttataaatatatataaattawgcaaattatatttgtgaatatataatagatttatctaaatatatgttatatttagctatagaaatatatattatatatttagatattatagaaatatata

SEQ ID NO: 49909 - DNA, 201 bp, Homo sapiens
atataataatataaccagtatgtatcattatatataatatatagatacatactgattatatatgagtatataacatatttacatgatatataatatataartatataaaatatgaatatatattatataatttataaatatatataaattatgcaaattatatttgtgaatatataatagatttatctaaatatatgttat

SEQ ID NO: 49910 - DNA, 201 bp, Homo sapiens
ctttgtcttttcatttttgtatttatcagaatcaatatatttcaaacagaacttgatttgtgagaaccatttttctggctctcctctcctctcttcctctrtcttccttttattttttttccaagtgattatcccaaatggcatctatgttaacatgcttggaaatgcgaagcgaccctgagtatggaaattaatagagtt

SEQ ID NO: 49911 - DNA, 201 bp, Homo sapiens
ccttcttcattgagatctgaaagtagttccctatggaagtgattcatggtgttgtgaaatcctacgaaattgtaaacagcctggtgggcaggaatcccgasgtctcattcaggccccctgcaaattctgagttcctagcctgaggaaagcccccaacaaatactgacctgactttctcctaaaagattgccataaacactt

SEQ ID NO: 49912 - DNA, 201 bp, Homo sapiens
tgttgttgttttgtttgtttgtttgttgttttcagttagaagcagtgtcattcatacaaatgaaataccaaacaggacccccatggcagaggcaacttctyattttatctcttgctcctcagcgcttttgagtctctccctgcatcacttccctgccctacacctgccaggtctgtgggtcctctttcatgtttgtagttc

SEQ ID NO: 49913 - DNA, 201 bp, Homo sapiens
cttattacatgcattattttatctgcaccagaaatcaagtatgtatgtctgtgtgtgaatttgctggtaaaaggatgaagtaatgttaaagaaaaaaattwaaaaattatctacccacacatacctggtttcattttgctcactgccttcaaattctatccatatttgtaggtcatgtatgatgatgctcatgttattttg

SEQ ID NO: 49914 - DNA, 201 bp, Homo sapiens
atttctagaagtagtagcagtgctttgctttattccacttgcaagtagcggttcaattgaataaacttttatacctaaccaaccaatattttaagccagtytcactctcccctctctctcattctcagtttattttgcgtatttcttataatgcaaaacaaaaaccttctgtctctgaaaaacgtgattaatcaagaaacc

SEQ ID NO: 49915 - DNA, 201 bp, Homo sapiens
ttatctcttgctcctcagcgcttttgagtctctccctgcatcacttccctgccctacacctgccaggtctgtgggtcctctttcatgtttgtagttctccmatactcttcaggcccagtgatccttttcagactcttgtcctctagaaaagcaattcagatctcgcccaaggcttacttctcggtttctggctataattgc

SEQ ID NO: 49916 - DNA, 201 bp, Homo sapiens
tgtagtgagtcctcaaataatttttattaaattaactttaagaaaatcccacttaacagcccttcactgtttttagagaccattccaaaggtcttgacttstgttgatattattgtcctctgaaaagtctgagtcaaactctgattagttttgtaacataaaataccattggattgtctgtttgcataattggttttctga

SEQ ID NO: 49917 - DNA, 201 bp, Homo sapiens
tgcatagattccatttcctgaatcattgtataccaaagatccaggaaatggttagggatgttttagtctcatataaatataggtcagtgttgtacacagtragaaaactagattagtagcatcatcttgtgccctactcatgacatttgcacttcatatttttcctttatctttgcaatatttaagagctttggttaccaa

SEQ ID NO: 49918 - DNA, 201 bp, Homo sapiens
aaatataggtcagtgttgtacacagtaagaaaactagattagtagcatcatcttgtgccctactcatgacatttgcacttcatatttttcctttatctttrcaatatttaagagctttggttaccaatcattgtgaacttttgtgttgcagggggtgtaaacacagcataatcaatcaattgatgtctacactcttcactt

SEQ ID NO: 49919 - DNA, 201 bp, Homo sapiens
tcaatgttagtcctcttctttttaaaaaaaaaaaaaaaaaaaacaagtaatcagtttaatgtactctgatattgtttaccactgggattcttgttcatcawttaaggctacagagtccaccagcctagagtccatggagtcagaccaactgtcagctgtaatatgccggagatggagagaaaggacagatggccagagctc

SEQ ID NO: 49920 - DNA, 201 bp, Homo sapiens
acactcttcacttttctttaaagttgtctgaaagtgctgtctctttgcctgacagacatagtatatctacccctaccctagacttgtgttcatccaattgkgtgttcagcttttagcaggttatggggaatgtttattctgtggatggcttcctgctatctttgttcagacagtaatatttccttttatcctttttcatct

SEQ ID NO: 49921 - DNA, 201 bp, Homo sapiens
acaccaaatcaatgttagtcctcttctttttaaaaaaaaaaaaaaaaaaaacaagtaatcagtttaatgtactctgatattgtttaccactgggattcttsttcatcaattaaggctacagagtccaccagcctagagtccatggagtcagaccaactgtcagctgtaatatgccggagatggagagaaaggacagatggc

SEQ ID NO: 49922 - DNA, 201 bp, Homo sapiens
gtgtcctaactgttctgatggagctaagcccagagaagcccctgtccagcctggggggtagtcatggagagctgcctgagagaggggacatctcacctgcrtgatgaaggatatgtggattaaaggtagggcatgctagttctggtgttgagttagttggcagcttctgattggttagccttaagtttcgtttttctttaa

SEQ ID NO: 49923 - DNA, 201 bp, Homo sapiens
tgttactaatggtcacctccactccttttatttccctaatattttattcactgttatctctgatacatctttctctcagttgttctgaagccttttatttscttcacatctgaatcactctttattctactctcctttccactaactggacttgcttttgtcttaaaaacgccatttttcaacaatatgctgggaccaaaa

SEQ ID NO: 49924 - DNA, 201 bp, Homo sapiens
tgtgtagcttcatgtgtattaataaaaatatataagaaactcattaagctcctcaattcatggatgattttgccacaaatgaggcaagagtaaaaagtagyaatcaatgtaaagcaaagctactaagtaaatagcttagtaaagataatgaaacaaaaaaaatgtaagggagtccatgcaaaaacattcagcaagtgtgag

SEQ ID NO: 49925 - DNA, 201 bp, Homo sapiens
agacaatgttcagcaactgagagctggaccagatcttgtgcttggtcctggagactcatggatgaataatacatggtccttgtgttcagagggctcatgarttatttggaaggttagtcaagtacacagaagatcacagtagagtgtcctaactgttctgatggagctaagcccagagaagcccctgtccagcctgggggg

SEQ ID NO: 49926 - DNA, 201 bp, Homo sapiens
tttctctcagttgttctgaagccttttatttccttcacatctgaatcactctttattctactctcctttccactaactggacttgcttttgtcttaaaaaygccatttttcaacaatatgctgggaccaaaacatagcattcagctatttcttctaacgtaaccagtgggctcttcactgcatctttcagagagtgatgca

SEQ ID NO: 49927 - DNA, 201 bp, Homo sapiens
aatctagtatactgcatccacatttgcaggtttctacataaagatctactgggaatgactgatttccttacggagcgggggtggtcctatggggatgattkgcacctctctcagattgcccagcctccccctgctcttctgggagactgtcagggtgctgctctttggactacctttgaaatcttgacctgtgacaaggct

SEQ ID NO: 49928 - DNA, 201 bp, Homo sapiens
tcccatttgtcaatgaaaaatacaagaagaaaggagaagtcagcttagaaggcaaccactcagaaaggaggcatccatttaaggtctttgaattctgaaargaatctgtgaaaagtttgtgggaggtgttttctggaggcctggcacccatatctccctcaaattgcccagcatggtagatcttgcttttccccaaacacg

SEQ ID NO: 49929 - DNA, 201 bp, Homo sapiens
agcaaagaaaaatcactcaataaaaccactgttaatattttagcataatcttgatagtggaatgcctttattttttaaaaattgcattatgtatacactarttttagtcagaatttgtacttcttaacatgcatactataccattagtatatttttacattctctaaagtgtgtctgcaatgcagtgttctactttctgca

SEQ ID NO: 49930 - DNA, 201 bp, Homo sapiens
tacttaatgtgtgtttctttctcattaatcatcaatgctgagggatgttgcatgtcttagagtttaacagccacccatagctccccatttgtaataaactstagtcagtgtgtagtcactgcctgaacaagttacaatcttaaaataaaaaccttattgatttcttttttaactttgaaattaacacatgcctagaaaaat

SEQ ID NO: 49931 - DNA, 201 bp, Homo sapiens
aggagaccctgaaacttcttgaggaggaaactgacacgatgaaatatcaggtagacaatgttcagcaactgagagctggaccagatcttgtgcttggtccwggagactcatggatgaataatacatggtccttgtgttcagagggctcatgaattatttggaaggttagtcaagtacacagaagatcacagtagagtgtcc

SEQ ID NO: 49932 - DNA, 201 bp, Homo sapiens
aagtcacatcttcaaagccagatgattcatttgatagaacagggaaccaggagaccctgaaacttcttgaggaggaaactgacacgatgaaatatcaggtrgacaatgttcagcaactgagagctggaccagatcttgtgcttggtcctggagactcatggatgaataatacatggtccttgtgttcagagggctcatgaa

SEQ ID NO: 49933 - DNA, 201 bp, Homo sapiens
cacagcagataagggactgagctcatggtttgtggttgtctgtgtgattctctttaaggagggtctgaagtgtacagtgacacagctatcagtggctatgraatcaaatatttgtagattaaaaattgtactcattctgctgacatcttatgagtatctgttgtgtgcagagaaatatgttggaggactctgggaacttga

SEQ ID NO: 49934 - DNA, 201 bp, Homo sapiens
cttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatatt

SEQ ID NO: 49935 - DNA, 201 bp, Homo sapiens
acacacgcacacacacaaatacttctgcaaggacatctgcccagcaactgcctgtccaagtacagactgatgtcacccttattattgatctttgtagccarcaataactacttcaaagccattatgtaatcttcctcattttttccttcaaaaacatttgtctttctttacctccctgcacacacatacaaagttactgca

SEQ ID NO: 49936 - DNA, 201 bp, Homo sapiens
tttgttgttgttgtatttttttctcagatggagtatcgctctgtcgcccaggctggagtgctgaggcacggtcttggctcactgcaacctctgcctcttgrgttcaagccattttcctgcatcagcctcccaagtagttgggattacaggcacccaccaccacacttggctaatttttgtatttttagtagagatggggtt

SEQ ID NO: 49937 - DNA, 201 bp, Homo sapiens
cagtcctaacattccaagagttaaaattatccatgattgggatgtaatatctaaattgaaataaataaactgtttttatatgaaggattttttcctgattsaaataaaggaatctagtttcattgtaggcaacacaggaaatacaaaagttataaaattcacatctgtaatcccatcaaccagagaaaactcttagtaact

SEQ ID NO: 49938 - DNA, 201 bp, Homo sapiens
tctcctagtcaggcattaactaataggggaaatgcaaaatgttgataccgcagaatatagagacagaagagattcacactgaaagtgcaaattactttttytgcagtgaatagaaagtcacattactctaagaagctgcctaattatctgtaattatgcccaaaatagtcaagctagtttgctagccagttgaagaattgc

SEQ ID NO: 49939 - DNA, 201 bp, Homo sapiens
tctgatgagtaagcctacccccatctctgttccatggcccccttaagtcatttatctatctatctatctatctatctatctatctatctatctatctatctttgagacagcttctcactccatcatccaggctggtgtacagtggcatgatctcagctccctgcaaactccgcctcccgggttcaagtgattctcgtgtct

SEQ ID NO: 49940 - DNA, 201 bp, Homo sapiens
tatgtcagccatgtatacatctgctgttgtgaaagataattttaggtggcatagaggtgatcttttataattttaatagctatttattttgatgtacaackaagcaatacctggtacgtttccataatttaaatcatatcattgcttagaagtaagttaaatttcaaaaatcaatttaaagtatattgaaagtagattaat

SEQ ID NO: 49941 - DNA, 201 bp, Homo sapiens
ttattgttgttattatcattactcctactattactcctcctcttgctgctgctgctaaagtagcaaaactgtctggctcccggagcgccacctattgaccwtatagtttgccacctgtctcagttttgtgccatgcatgagctcatcctcaccaattattggcaagattatagaacaggacacagagtgattcaccttcag

SEQ ID NO: 49942 - DNA, 201 bp, Homo sapiens
ttctgatgagtaagcctacccccatctctgttccatggcccccttaagtcatttatctatctatctatctatctatctatctatctatctatctatctatctttgagacagcttctcactccatcatccaggctggtgtacagtggcatgatctcagctccctgcaaactccgcctcccgggttcaagtgattctcgtgtc

SEQ ID NO: 49943 - DNA, 201 bp, Homo sapiens
cgaatgtcagtgtaggttgggatatattattaacaggcatagactgagctcttacagtgagaacagccttgtgctggttacatatttcattacggggtggsctggtgtgctttgggaaggacaggcatgaaagggtgactcatacgtggcctatgggtcctatgaggaaatttacctcaaccaggggaggaggactttcgg

SEQ ID NO: 49944 - DNA, 201 bp, Homo sapiens
ttatgcagtttttattcctgacctgcctcaaggagcagatacggactggaaagcagcccctgttggataattgctgcttgtctcagagtttgagattctgycggggtttcttgagtcaccgagcatatggggcttcaggttggactgcccactccagtgcctgagaatttactgggaagttttaataaagtagagcagaaa

SEQ ID NO: 49945 - DNA, 201 bp, Homo sapiens
cttctgatgagtaagcctacccccatctctgttccatggcccccttaagtcatttatctatctatctatctatctatctatctatctatctatctatctatctttgagacagcttctcactccatcatccaggctggtgtacagtggcatgatctcagctccctgcaaactccgcctcccgggttcaagtgattctcgtgt

SEQ ID NO: 49946 - DNA, 201 bp, Homo sapiens
gagctcttacagtgagaacagccttgtgctggttacatatttcattacggggtgggctggtgtgctttgggaaggacaggcatgaaagggtgactcatacrtggcctatgggtcctatgaggaaatttacctcaaccaggggaggaggactttcggcagcttttcccttctctctctgtctgcttcttaatatcacaacca

SEQ ID NO: 49947 - DNA, 201 bp, Homo sapiens
gacctgcctcaaggagcagatacggactggaaagcagcccctgttggataattgctgcttgtctcagagtttgagattctgccggggtttcttgagtcacygagcatatggggcttcaggttggactgcccactccagtgcctgagaatttactgggaagttttaataaagtagagcagaaattttccagctgcatccgaa

SEQ ID NO: 49948 - DNA, 201 bp, Homo sapiens
tcttctgatgagtaagcctacccccatctctgttccatggcccccttaagtcatttatctatctatctatctatctatctatctatctatctatctatctatctttgagacagcttctcactccatcatccaggctggtgtacagtggcatgatctcagctccctgcaaactccgcctcccgggttcaagtgattctcgtg

SEQ ID NO: 49949 - DNA, 201 bp, Homo sapiens
ataaagtgacataaatatagatgaatacttgagggtaaactctagattccacttatgccaataatagttctctttagttgcacatctacataaaaagaccmccccccatactttgaccccaactgcttctcagcctaaccctctacatgcttaagcatatgccagtaactcacgatttgcaaaactttccagactcttcct

SEQ ID NO: 49950 - DNA, 201 bp, Homo sapiens
tttttcactgacagtaagcctaacctctcaggttagaaatctaagttgccttgcattcctccctctctcttccccaccaagctctgcatattccatctcargaataaatctctaacatttctcccttgtcttctttctctgaagccaatttgcatctcccaagtagtcttctgatgagtaagcctacccccatctctgttc

SEQ ID NO: 49951 - DNA, 201 bp, Homo sapiens
gttaaatcgaggaagcagtgaatgagttggaagctgccttccttaggctgttttacttccagaattctactttttcactgacagtaagcctaacctctcargttagaaatctaagttgccttgcattcctccctctctcttccccaccaagctctgcatattccatctcaggaataaatctctaacatttctcccttgtct

SEQ ID NO: 49952 - DNA, 201 bp, Homo sapiens
tctaatactctgacacctttagccagttacttctcagcctctgttttctcatttttagaatgagagtgagattacagtatcatctcctaacagtgttatcrttagtgggtgtttatcactcagcccagtcacttagtaagtgttccggaattgggagccagcctgccacatatcggttttatagtttaagctccctgcaag

SEQ ID NO: 49953 - DNA, 201 bp, Homo sapiens
cctcagccctatgggacacatgtctgttctgtcctcattctgatgggtccaatctggaggtgactgaatcctgaatgtcaggaggcagcagagggtggggycagttctagagaaggcacatcacctgtctctcctgcaggatggtctgtggccattggcgtaggccttcgttgacaagccaagcctctgacatctgaatag

SEQ ID NO: 49954 - DNA, 201 bp, Homo sapiens
gaatgccaagggaagtttctaggttcttggagatcaagttaatgcccctcataaggttgtttcacatgagccaaaatgtatattgatttttttttttttttgcctttattacacttccagaaagagagcatgatctcctggaatctgtttagggaataaaaatgtccgtacagaagaaaaaggttgttttttgaccttctg

SEQ ID NO: 49955 - DNA, 201 bp, Homo sapiens
ctttgataccatcagctcagacagattttttccagcaaatggaaaaatgtgtggtcattgagctcattaggagaaaccatacccttgacctccagcctctrttagcaggggatgagtgcagtctttggtgtccagaaagaagatcctcattggccacatagccaccattagaactgtactttttttttcttacccttgttc

SEQ ID NO: 49956 - DNA, 201 bp, Homo sapiens
agaatgccaagggaagtttctaggttcttggagatcaagttaatgcccctcataaggttgtttcacatgagccaaaatgtatattgatttttttttttttttgcctttattacacttccagaaagagagcatgatctcctggaatctgtttagggaataaaaatgtccgtacagaagaaaaaggttgttttttgaccttct

SEQ ID NO: 49957 - DNA, 201 bp, Homo sapiens
gatccaggagcccagaatgccaagggaagtttctaggttcttggagatcaagttaatgcccctcataaggttgtttcacatgagccaaaatgtatattgatttttttttttttttgcctttattacacttccagaaagagagcatgatctcctggaatctgtttagggaataaaaatgtccgtacagaagaaaaaggttgt

SEQ ID NO: 49958 - DNA, 201 bp, Homo sapiens
atgagtgcagtctttggtgtccagaaagaagatcctcattggccacatagccaccattagaactgtactttttttttcttacccttgttcattctttatgrgtcattcctcttaggccacccacatgcaaacatagacacataggtagagacagaaatcacagcatctgaatttacctacaatacaacttgcatcacatgt

SEQ ID NO: 49959 - DNA, 201 bp, Homo sapiens
taggaaagaacctgcattaacaagagcaggctaggctaggccatggtgtcaaacaactctagtgacttaacacagtgaaagtttatttctcactcagatcrtgcagatgcagtcgggctgctctcctgggtaactctcctcccagtggttgccctccatgcaagaacctgatggccgaggctacttccaacttggtcctac

SEQ ID NO: 49960 - DNA, 201 bp, Homo sapiens
agcctaaccatattaggaacatatgttggcatgcaagcttctgtgagtgtggacaagtatggcctccctggccttgataactgacagttactgtgtgctcyctagtgtgttgagggccacctcgaacctcacaacagctcttaggggaaaggtactctcatctgcccattttacaggtgaggacatttaaggctgagctag

SEQ ID NO: 49961 - DNA, 201 bp, Homo sapiens
ttagaatctggaaggatagagaatagagttttatagggactgggacacactggaaatttgaggaattttagttaggttaggaggcagttcctacatatagrtggaaggagaaataccaggagtcttgtcttgtctcagcctaacaagatgacttctgagaatatgatcaggcctgtttccggcctagcattggagtccagt

SEQ ID NO: 49962 - DNA, 201 bp, Homo sapiens
gtttttttgatgttggtggtgatacatcaaggaaatttgccggtgtgttttcccatcacttttatcaaccagggtgagatagagagaactgctgctgctgygtatttgttgcttttcatagccaagctcatcctgtctctgtattatagaagaattagctttttctattctggatggacccagggccagattgtccatgac

SEQ ID NO: 49963 - DNA, 201 bp, Homo sapiens
acgcttcttagatgcttgagactgtaaacccttatcaggaacataatgcgatgggatgtttctctctctttaggcaaaatttaaggatactggtggataawatttacttaatgattgctatgtggcaagtgttttgctaaatgctttacaaatatttattttctgtgagatggttcctgttcttccatctcaaagatgagg

SEQ ID NO: 49964 - DNA, 201 bp, Homo sapiens
tgataactgctacattgtgtaattattatcattattatttgagatggagtctctccctgttacccaggctggagtgcagtggcgcaatctcaactcactgyaacctctgcctcctgggttcaagctattctcatgcctcagccttccgagtagctgggactacagaagtgcaccaccacgcctggctaatttttgtaattt

SEQ ID NO: 49965 - DNA, 201 bp, Homo sapiens
aagaaagggctggaagggtcctggggagggagaataaagtggggttggttaatgggtacacaaatacagctagaatgaataaaatctagtattttgtagcrtaatagggtaacaaaaattaataatttattatatattttacatacccaataagatgaaattggaatgtccctaacacaaagaaatgataaaggtctgaag

SEQ ID NO: 49966 - DNA, 201 bp, Homo sapiens
gaagtgatgaatactcaattactctgatttgattattacacatagtatatctgtatcaaaacatcataggtcccctctaaaaatatacaactattatgtayccataaaaatttaaattactttttaaaatattaatctatgtaaagggttttgaatagtagctgacctataatggtccctgaaatattagctgtcagaaac

SEQ ID NO: 49967 - DNA, 201 bp, Homo sapiens
tccctccaagatggccaccagcaattccagtcttttattcttctagctaaaagagccagagcatctgttttcccagtgttccagcaaatatctcaaggctraccgtccttggaccaacttggtttacgtgcttatccctaagccagttattatatccaagaaaattctgtacttctcttagccaggcctggggaaatggag

SEQ ID NO: 49968 - DNA, 201 bp, Homo sapiens
catattccagcatagagcactccctaaccccactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttg

SEQ ID NO: 49969 - DNA, 201 bp, Homo sapiens
aagtccaactcctacttcaagaccgcattcaaataatgcctcctgtctgcagctttcctcagcttccccatggagaattgatggctccctttctttgagcrtattcattcattcattcattcattcaatgacaactatctaccaggagctgttctaagcattggggtgtggaggtgaacaagaaagcatagagccattgtt

SEQ ID NO: 49970 - DNA, 201 bp, Homo sapiens
gtgtagcttggcgcttggcacatcgtatgttttaagtaactataggttgaattaattaatattctttccacacagcaatttggcctgcataaaagacttcratattttcctgatgttgccagaggcttaatgtgtgacatttcgtatagcaaatgctcaataaatgttgggtgagtgaacatagctgtcactcctcattac

SEQ ID NO: 49971 - DNA, 201 bp, Homo sapiens
ttatatttataaatatatatatttataaatataaataaaaatttatatttttatatataaatataaatatatttatatatttatatttataaatgaaactrtataatttttatataaattaatattatacattcatatatttataactcatccatatatatatatatatatataaaaaccttctggcgccacccaagggcc

SEQ ID NO: 49972 - DNA, 201 bp, Homo sapiens
agacaaggttggaaggaataattgtccagttagaatgcataatctgtttttaaagacatattaaactggaataacccatgtacaagtatttatccagcttrgatacctggaagtggaattcctggttgaaaggtatattaatataaaattttgtaaaaaaatatatgttagataatgcttagtcatccttcgcaaatatca

SEQ ID NO: 49973 - DNA, 201 bp, Homo sapiens
aaaattatatatttatatatatgaataaaatatattttatattttatatttataaatatatatatttataaatataaataaaaatttatatttttatatawaaatataaatatatttatatatttatatttataaatgaaactgtataatttttatataaattaatattatacattcatatatttataactcatccatata

SEQ ID NO: 49974 - DNA, 201 bp, Homo sapiens
ttttataaaaattatatatttatatatatgaataaaatatattttatattttatatttataaatatatatatttataaatataaataaaaatttatatttwtatatataaatataaatatatttatatatttatatttataaatgaaactgtataatttttatataaattaatattatacattcatatatttataactcat

SEQ ID NO: 49975 - DNA, 201 bp, Homo sapiens
aagattagaggaggacttgggaagctctgcctcttgttgcttggattgtgcacaaatacatttatttctgggtatgtttaggttatttcttttcagatttmttttggtttacaccgtttcccaagcattagtcatcactgtcccctgaagcagtcacactatactcatctccgtagatgatcaatcagaatcttgagagtg

SEQ ID NO: 49976 - DNA, 201 bp, Homo sapiens
gaatgtccgcacatgtcactgagttattgatgaatcattgtttctattctgagctcagttcacgtagttcaatgtgctttggcttggctgtcactttaggrgatgatagttaacccaacggagtaaatctggccaattcccgagtgggggcagggggttgggctcaactaagggcaccaacaataaatgcctccttgctgg

SEQ ID NO: 49977 - DNA, 201 bp, Homo sapiens
attggaatatgagggagataggaagaaaaggaaaaggaaccatttgctcacactctggcagatctaaagaaggtttcattactgtagggcttctcagaacyttcagtaccctaagacagaagcttcttagacattatttgttctacaggaaaaaaaaagtgttgcaaagaatagctacatatagttattatctaatatagt

SEQ ID NO: 49978 - DNA, 201 bp, Homo sapiens
gtgtcttgttgatccaggtctcagcttagaaattacttcctccaggaagctgtctccaagtcctgttcagatatctgtccttatagagcgttttttatctyacttactatactttttgttgtcttacctatttactatatgcttatatagtaagcaactcttaggaattagacaaaagttcccatttctgtaagacagatt

SEQ ID NO: 49979 - DNA, 201 bp, Homo sapiens
ggtggccacaaaaccaccttgaggactagcaaaagagccatatggggtcttttctgtctgttcaccccaccttctaaaatccccacctctcacacctggtstctgatgacacttgtctcggatgtgactctgtgtctgccccacaagatgatgtcttcatctgccatttaacccaaccctttctgagttctgatcatgttc

SEQ ID NO: 49980 - DNA, 201 bp, Homo sapiens
ttgattctcacctgcctgtgtcttgttgatccaggtctcagcttagaaattacttcctccaggaagctgtctccaagtcctgttcagatatctgtccttayagagcgttttttatctcacttactatactttttgttgtcttacctatttactatatgcttatatagtaagcaactcttaggaattagacaaaagttccca

SEQ ID NO: 49981 - DNA, 201 bp, Homo sapiens
tatgctgctccccataagacccttcacttctctattgacatcattttcaccttcaactccacactcagatactgactcatacatatgattgattctcaccwgcctgtgtcttgttgatccaggtctcagcttagaaattacttcctccaggaagctgtctccaagtcctgttcagatatctgtccttatagagcgtttttt

SEQ ID NO: 49982 - DNA, 201 bp, Homo sapiens
ctccctatccctacccacttttctctcccttgctatcattatctctgtccccaatatatgcttctgcacatctcacattctggctttttcttatgctgctycccataagacccttcacttctctattgacatcattttcaccttcaactccacactcagatactgactcatacatatgattgattctcacctgcctgtgtc

SEQ ID NO: 49983 - DNA, 201 bp, Homo sapiens
aggcagttcctacatatagatggaaggagaaataccaggagtcttgtcttgtctcagcctaacaagatgacttctgagaatatgatcaggcctgtttccgscctagcattggagtccagtgatatccaagggcctttatcaggaaaactgcaacatatgaacacaacacagcctctgttttggagtccccagaagacagct

SEQ ID NO: 49984 - DNA, 201 bp, Homo sapiens
gaaagaaaggtgcctcaatacaagcagcatggcaaaggtacaatcctcccagtgtgaatggtggggggaacaaggggaactgaaaaacatgcatgaggacrttagctttgaatgggtttcttagagctgggggacaaaggaagagtcgcagatgatcagaaaggagatgtgaaatcttctgcttgctatgttgagtttgaa

SEQ ID NO: 49985 - DNA, 201 bp, Homo sapiens
ggaagagtcgcagatgatcagaaaggagatgtgaaatcttctgcttgctatgttgagtttgaaaaataaatgaaaaaatttcaggtaaaaacagcaaatcrtagcaaataaagatctcatattcaggaaaagggctaggcctgggtaacttcatgatataaatgttcaccattgctaaaacttaaaggactgacaatatca

SEQ ID NO: 49986 - DNA, 201 bp, Homo sapiens
tcaatgtcactaagatttaaacccctatcagcccatctccaaagcccatgcattttttctcccactatacaaatcaatattattgatatttatatgtgtgrtaagcttgcagaataaatagattttgaactttctttttaacacagaaaagcaaaatacagtgaagttttggtggaactttcattctcatcagggcatagg

SEQ ID NO: 49987 - DNA, 201 bp, Homo sapiens
aggatgggtgctggtttccaggggaatcaaccatgtatttttagaaggttggggctttcatcatccaccccacctccagggaggaaagggaggctgaagaytgagttgatcaccaacggtcagtgagatactcaatcgtgcctatgtaacaaagcctccatgataaccccaaaggacaggggttaaagggcttccaggttg

SEQ ID NO: 49988 - DNA, 201 bp, Homo sapiens
atcttttgctctaatgagttgacttgtgctgggctcctggatacccccaggatgggtgctggtttccaggggaatcaaccatgtatttttagaaggttggrgctttcatcatccaccccacctccagggaggaaagggaggctgaagactgagttgatcaccaacggtcagtgagatactcaatcgtgcctatgtaacaaa

SEQ ID NO: 49989 - DNA, 201 bp, Homo sapiens
ggagcactaggaagtcattaggatatttgcaataattgaagcttgcatcctatttgaaacttccccaaagaaaaaaatgagcgagaagagtggtcagcagkaagccttgaggagttccaaaatcagtggccagcagaggtggaggagcctaaaaatgagactttggagggagcagccacaaagataggagaaaagccaggt

SEQ ID NO: 49990 - DNA, 201 bp, Homo sapiens
gggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttac

SEQ ID NO: 49991 - DNA, 201 bp, Homo sapiens
agtaggataaataaggaccacaaataacatcatgtcagttcaggttgggttttgctgccaaatgagttataaaaacatgtttggtatgctgagtctcttgratttcagaattgcagattgcagtccttagaacattcccgtgaaaagttgcaaaccttagtcgtgctaagatgttgagttggcgtcttcacatcccggcca

SEQ ID NO: 49992 - DNA, 201 bp, Homo sapiens
gtatgctgagtctcttggatttcagaattgcagattgcagtccttagaacattcccgtgaaaagttgcaaaccttagtcgtgctaagatgttgagttggcstcttcacatcccggccacttctgggagcagcagagtgtggtggctcagcccacccctcaacccctctactacttgtgaacaccttggtaaatgatgtctt

SEQ ID NO: 49993 - DNA, 201 bp, Homo sapiens
atatcaatggttgaaagaatatgcatatattaattaataattccgacatacttcttttataaggtcccttatgaaagatagactattttccacatttactktgcattggaagtgacagatgaaattaatatgcttcataaattgccatcacagagggtcaattaacaagtgaactaaccttgtgaaagtcattttgaaaga

SEQ ID NO: 49994 - DNA, 201 bp, Homo sapiens
gctttgattatgcttccaaggttttgttcatttttggggcatgaccaaggtagttctagaatgagtgaggccaaagctgaaagtgtcacaaagtttttgcrtatgacaaaagttgcctgctttgcttttggatgctcaactcagacttcttgttttcatgatgtgcagttttgatcaggacattttagtgataggtatagc

SEQ ID NO: 49995 - DNA, 201 bp, Homo sapiens
cgtcaaacccctctccctctccagtagcattccccagtctgtgtcacctagacgaaaaggatctcagggtgggtggcaatgctccttcactgaaatctgcmgttatctctacccaaggcttacagtaaattttttgcaaattagaaagccctttgctctctcagtaaaccctggctttcaagatttttgttttagtaaagt

SEQ ID NO: 49996 - DNA, 201 bp, Homo sapiens
caaatttatttaatgtgtattagcctagaaaatcaaaggaggatgatcacgcaataacccagtaggtccagatgcttatacaactttcttcattggggaakgagagattgagtcaatgtgtctgtcaatttgaaggggagtaaataacttttagggggaatgaataagcccagtgctgagacaatggttagtaaataatgt

SEQ ID NO: 49997 - DNA, 201 bp, Homo sapiens
gaaatctgcagttatctctacccaaggcttacagtaaattttttgcaaattagaaagccctttgctctctcagtaaaccctggctttcaagatttttgttktagtaaagtctttagactaaatgttgaatctttcactctctttgctcctaatcatctctaagacagcaaatgcctctagcaaaaaagaggagacgtcaac

SEQ ID NO: 49998 - DNA, 201 bp, Homo sapiens
tctctgttacttgaggcttacaagaaggaaagaattccctctctaaacacactctaaacacacaggagttgagaacggggagatttattccagaacccctyctgtgcgttggggcttctggtagcttgcctttcttggtaacgattttctcagagactgggtagattcgagtggagcctggggcatggttgttggtccaat

SEQ ID NO: 49999 - DNA, 201 bp, Homo sapiens
tctaaacacacaggagttgagaacggggagatttattccagaaccccttctgtgcgttggggcttctggtagcttgcctttcttggtaacgattttctcaragactgggtagattcgagtggagcctggggcatggttgttggtccaatggcgggggttggggagacacaagcagttggcagggaacttacaaatctccag

SEQ ID NO: 50000 - DNA, 201 bp, Homo sapiens
tcattctccacgagcacatgcccccgactcagggacaggggaatctaagcctgtgcattcacactccacaagatttcctctactggctttacagggcactrtcacgcgtctcccgggcgcaccttgctcccctcttcctgcaaggcagggggagaacgttcatccttgaacaaacaaagagcatcctcagccagtcaggcg

SEQ ID NO: 50001 - DNA, 201 bp, Homo sapiens
ttcagtttagggagtatgaaaatctcagattagaagagaagatggaggtcattccacccaaaccccctccccatgaatacctctgtcttttttttttttttctttttcattgtagatctaggcgagcttgcttcttcaggaagttaagccccattgttaggcatctctgaagtacaagcagtacatagtatttatggttgg

SEQ ID NO: 50002 - DNA, 201 bp, Homo sapiens
tctcccaggctggagtgcagtggtacaatctccgctcactgcaacctctgcctcccgggttcaagtgattctcctgcctcagccttccgagtagctgggamtacaggtgcacgccaccatgccaggctaatttttgtatttttaatagagacagggtttcaccatattggccaggttggtctcgaactcctgacctcgtga

SEQ ID NO: 50003 - DNA, 201 bp, Homo sapiens
tgccttcttccttaaatctaagtaatatccctgcagctattccaaaaggaacactataactggctatttgacataataaggatgaggaaattttggttgaycacattttaaatgggaaactgtatttagagagattttaaactgcaaaattaaaaatgcaaacgtgaaattatttttccattaagtcttctccttggggaa

SEQ ID NO: 50004 - DNA, 201 bp, Homo sapiens
ttgaaatatatttgaatgaataaaataatacatctagtaaaaatacattttcctatttttttctaaaagtatcttacacattttccatcaggctcaattgwgaaatccctccagattcctaattatcttcttcccaagataacaagatttctgtcctctcttcacaaagacataggacatgggctcagagacgtccaggca

SEQ ID NO: 50005 - DNA, 201 bp, Homo sapiens
tggatactgggctgcagccttgatgctgttttttctctggaaactatgcttgaaatatatttgaatgaataaaataatacatctagtaaaaatacattttyctatttttttctaaaagtatcttacacattttccatcaggctcaattgagaaatccctccagattcctaattatcttcttcccaagataacaagatttct

SEQ ID NO: 50006 - DNA, 201 bp, Homo sapiens
agtcccaaaccactgtctggcctcctctcctttccctccttctgaacaccctagattcctgccaaatataatgttattccacaaacctatgaggaccttgmctgccctctgtcctttgcacatgctcttcctccagcctttgcactctttccttccctcgtccacctgggagactcctgctgatcttttcagactcagctt

SEQ ID NO: 50007 - DNA, 201 bp, Homo sapiens
aacaataaatgcctccttgctggtagatgggaaggactgagaagacagaggagaaattgcttgcattctgctaacatctgcaacgtctgtaacagtgtctyttccagcagttgtaaaggatcctcactctccctttcctccctcagtcccagttcctcctccagagctcctcgtgatcatctcccaaagccactcacttgc

SEQ ID NO: 50008 - DNA, 201 bp, Homo sapiens
tgggctttcccagtgcccagtcatggctctcatcagtgtattctctaaaaccattgacttcttcgccttccctagcaatctgtgagtctgtagaagaaaakgccatatcaatctaactttgtattcctggttcttggcacatagtgggtgaactcacacagactagagataaatcagagatgaatgagtgcccccttgagt

SEQ ID NO: 50009 - DNA, 201 bp, Homo sapiens
ctgtcttccaagcaacagccccagaatgcctcctagatagtgaggctgccttcagttggcctgagattgttgctctgaccctggtgccacccttcctctcyaaccttgttacaaacaattcagaagggaggattgtgaaatccttcctgctgctctttctgtcttctgccaatcagagaagactggacatgagatccaaga

SEQ ID NO: 50010 - DNA, 201 bp, Homo sapiens
ccggaggtcgtgtcttcgtttaacaaatagaccacatgttgacaagcaaaaaacggctttctttgtctggcaagaaaagccactgcctcgcttcagacaaygcttttttttgttggtgtctccgctgacaaccctgttcaaagagagccacaaggaatgaaagtgaaagcagaaaaagccaacttcggtgtaattaagaga

SEQ ID NO: 50011 - DNA, 201 bp, Homo sapiens
  misc_feature (1)...(201): n = A,T,C or G, or insertion/deletion polymorphism (see Tables 1-2)
ctattcctacacatgaccatcttgtgctcatgcattttccacttgccaatgtctcagaaaccttcttcatgtccttcatcaacacgtggtatggcagaccrttgctatggccaacactgagtttcagggcttctaatgtgggatctactgcctctgcagggacccannnnnnnnnnnnnnnnnnnngggggccacgcccga

SEQ ID NO: 50012 - DNA, 201 bp, Homo sapiens
gtctgtaagagcgtgaccaccagtcttatttaccttgttatctgtaatttcctctttccctcaggcctttgcgtaatattttctctgcatggaaggggagrataagaaagaagacctaaaaactgaatttttaaaatacaaacagaaaaaaagctccctgtattttcccaaattctgcataaataaaataatatgctccat

SEQ ID NO: 50013 - DNA, 201 bp, Homo sapiens
catttggaatagagacatgagtaggttctaccttcagccttggggtgggaccaggttacgaagggatgttattctttgatggatgagcagactacaaaaarctgtgccaccctttgtctctatgtattcacactgcttcccctagcacctcttctttatctcctaacaatcattgtgccaacagactgcctttagaaactg

SEQ ID NO: 50014 - DNA, 201 bp, Homo sapiens
taaagacaattgaaaaccaaaaaccaaaacaactgcaaagggaaatcttaaagtattttcaataatactgcttttggaggtagtgttgatatatttattgwtatataaaatatagtataatattgtgtgtattgaaagataaatgtatatgttaatttggagaactagaatattgaagtatgggaggaagaagatgcagat

SEQ ID NO: 50015 - DNA, 201 bp, Homo sapiens
tttgagtatcatggaaatattaaaaagatattgggacacatgcatttggaatagagacatgagtaggttctaccttcagccttggggtgggaccaggttasgaagggatgttattctttgatggatgagcagactacaaaaagctgtgccaccctttgtctctatgtattcacactgcttcccctagcacctcttctttat

SEQ ID NO: 50016 - DNA, 201 bp, Homo sapiens
caattacattcctgtgactcctttcagggccgtgaagatgttccttggacccaggcaaaggcagaactgctgacagctttggctgctccatgtcacctcayttgtgaatggcgacagaaaagccagggtgatctgtagctgatcctctggtcagttccactggctcaaattaaaattttagagaatcggtctctggtatat

SEQ ID NO: 50017 - DNA, 201 bp, Homo sapiens
ttaataaggatgagaatgccagaagggcccaggtttagggaagatgaccatgagtttggttagggcctgttgagtttgaagtgccttttgagtatcatggwaatattaaaaagatattgggacacatgcatttggaatagagacatgagtaggttctaccttcagccttggggtgggaccaggttacgaagggatgttatt

SEQ ID NO: 50018 - DNA, 201 bp, Homo sapiens
acacatatttatttgttgatgttttatggaaaatctatttggtgcgtgaattctgttgttttcttgtgaagttcattgtttcaaatctccccatcttccartgcattcaggcactattcttggtttatttgttaaaataactgttgcactgggccaatccattacatttatctttaataaccaactctaggggtttgttcg

SEQ ID NO: 50019 - DNA, 201 bp, Homo sapiens
cactgggccaatccattacatttatctttaataaccaactctaggggtttgttcggtcatcactttccctgtcaaggggcacaaatatcttctctcatccrtttcctagggggaagtatcttcttttcttgtcttgataagacagttaccaaaggaagaaagaggaaagccttatcctttgaaagatggcattaattcatg

SEQ ID NO: 50020 - DNA, 201 bp, Homo sapiens
gagtctataaattggactgttttaggtacctcatctaagttgatctggtacagacactatgggacacactatggagtttcctcaaaaaattaaaaatagasctaccatgtgatccagcagtttcccttctgggtatttaaaagaattgatatcaggatcttgaggacgtattagggctcctgtgttcaccacagcagtact

SEQ ID NO: 50021 - DNA, 201 bp, Homo sapiens
tagcagtattccaaatgagttgccatggtgtcttgtattccagtgaggagatggaaaggtgtatatggaattggaaatggttagtagataaactctatgasaattgggtatgtatagacattggggtgaaggaagtgtcaggagtgacttatagggttatggcttacaccactcaacttaataaggatgagaatgccagaa

SEQ ID NO: 50022 - DNA, 201 bp, Homo sapiens
gactctgtccattaaagacaattgaaaaccaaaaaccaaaacaactgcaaagggaaatcttaaagtattttcaataatactgcttttggaggtagtgttgrtatatttattgatatataaaatatagtataatattgtgtgtattgaaagataaatgtatatgttaatttggagaactagaatattgaagtatgggaggaa

SEQ ID NO: 50023 - DNA, 201 bp, Homo sapiens
taaatgaaaaacctgatttcttggcaaacaacctaattgatgggagctaaagtagttgactcttatttacttccactttattctttaacattacaaataayagactccctgaattgaaagcaaaattaaatgtgattttatcaaacctttattcttctttttgaaatcctgcttttctatgtcttatccatagaatttcca

SEQ ID NO: 50024 - DNA, 201 bp, Homo sapiens
ctgtgggttttgcgtgtgaagagcataagaggggagagagaggaaatgagagaagctggaccatgcagagccttgtaggtgatgggaaggattttgctttyatcctaagaagagtgagaagccattaataggattcggggtgattgtgagtcagggggaaatggggggaggtatcaggacatggaggtctttgcaattatt

SEQ ID NO: 50025 - DNA, 201 bp, Homo sapiens
taaaatttatactaatgagacgattcgaggcagataactgaatttcccaggcttgaagttggcctatgccccttggtgaattcagccttagggtgagctcygtggggccttgcaagtctggctctagatgcaagagatctgccctatccacattccttctttccataattggttagagccttgaccattcaaacctgggct

SEQ ID NO: 50026 - DNA, 201 bp, Homo sapiens
ctgatttcttggcaaacaacctaattgatgggagctaaagtagttgactcttatttacttccactttattctttaacattacaaataatagactccctgarttgaaagcaaaattaaatgtgattttatcaaacctttattcttctttttgaaatcctgcttttctatgtcttatccatagaatttccaagtctctgcttg

SEQ ID NO: 50027 - DNA, 201 bp, Homo sapiens
cagaaggaggagatgagaggatctgtcagccagggagaggtacagctaccagaaaagcactggacagtttcctctaatccttgggaactttaatcgtctcstcaataattctcattttgagaggatctcaaagtggagggatccattagtaagttccactttggcctggaatgagagatgccgaaaatgacaagggtgctt

SEQ ID NO: 50028 - DNA, 201 bp, Homo sapiens
aaagagttaaggaatgaagtaaaacttgctagggttaaaatcccagctagtccattccttacctttcttacctgaaaaatgaaagtggggatcgtccttasctcatgttgttgtgagtactacgtgatgtaacacacagagaatgcttaacagagttctcagtgtagagtaagctaacaaagttgacagctgttggcctca

SEQ ID NO: 50029 - DNA, 201 bp, Homo sapiens
agatttttaaaaaagtttattctgctttcttgtctactttaatctacacaccagttcttttttttttatactttaagttttagggtacatgtgcacattgygcaggttagttacatatgtatgcatgtgccacactggtgtgctgcacccactaactcgtcatctagcattaggtatatctcccaatgccatccctccccc

SEQ ID NO: 50030 - DNA, 201 bp, Homo sapiens
aggtgcccgccatcacgcccagctaatttttttgtatttttagtagagatggggtttcatcatgttagccaggatggtctcagtctcctgacctcgtgatcttcctgcctcggcctcccaaagtgctgggattacaggcatgagccaccgtgccctgccacactgctgtgcaattctaaagaattctgggagtgctgtcag

SEQ ID NO: 50031 - DNA, 201 bp, Homo sapiens
cttattttggatgcttgcttggattgtttatcaggccatgaaaaaaaaaaaaaagatgaattccccagaacattataaggaaatctagggaaagacagcastaccttaccttaaactttctggctcatgtcacaaatcagtaggtttggactcctcatgcttgcagcacatacactcttgctatcctcattctctctagga

SEQ ID NO: 50032 - DNA, 201 bp, Homo sapiens
tgctttcttgtctactttaatctacacaccagttcttttttttttatactttaagttttagggtacatgtgcacattgtgcaggttagttacatatgtatrcatgtgccacactggtgtgctgcacccactaactcgtcatctagcattaggtatatctcccaatgccatccctcccccctccccccacctcacaacagtc

SEQ ID NO: 50033 - DNA, 201 bp, Homo sapiens
gcatattccatagatgaagaataattactggaaagaatgcagagccattggggactttctaaatagaggaatgatgagataagatatttgtttgggaaatygctctgaagaagatggaatgaaggagagagggacttctggaaggctgtggatctattttcattttaataagcatggggggagaagggtaggagagaggat

SEQ ID NO: 50034 - DNA, 201 bp, Homo sapiens
tactgagaatgatgatttccagtttcatccatgtccctacaaaggacgtgaactcatcattttttatggctgcatagtattccatggtgtatatgtgccayattttcttaatccagtctatcattgttggacatttgggttggttccgagtctttgctattgtgaataatgccgcaataaacatacgtacacaccagttct

SEQ ID NO: 50035 - DNA, 201 bp, Homo sapiens
ttccttgttaacgggtgtatttccagcacttcttacaacactgccaggcatattgcagattgagatagtctgagtcttctgagaactaggattaggattttttttttttttttttgaaacaaggtcttcctctgtctcccaggctggagtgcagtggcgctatcacagcttattgcagtcttggcctcctggactcaagta

SEQ ID NO: 50036 - DNA, 201 bp, Homo sapiens
tttccttgttaacgggtgtatttccagcacttcttacaacactgccaggcatattgcagattgagatagtctgagtcttctgagaactaggattaggattttttttttttttttttgaaacaaggtcttcctctgtctcccaggctggagtgcagtggcgctatcacagcttattgcagtcttggcctcctggactcaagt

SEQ ID NO: 50037 - DNA, 201 bp, Homo sapiens
tttattatatacctagtccaagacattcttcctaaccaaaaagggatggacataataagacatgtaagaatctgggtcagaggtagcaggaacaggtaacyaccagtgcccaaccactcaaatgcataaaagcagacatcaaagtggccgacccacgtgtgctaccatttatatgacattgagaagaggctgcacagaagt

SEQ ID NO: 50038 - DNA, 201 bp, Homo sapiens
atcacagggactctgaagccaggatggctgttcacaatggtcctgagttggggcaagggagccaagcctgtataactccattacaatctgtttttggatgygggctgtgggaaggagccatgaccttagaggaaaagactgtctttagccaaggtaacccatagaggactgacaggtgaaggctgtctgcagaacctggga

SEQ ID NO: 50039 - DNA, 201 bp, Homo sapiens
ttttccttgttaacgggtgtatttccagcacttcttacaacactgccaggcatattgcagattgagatagtctgagtcttctgagaactaggattaggattttttttttttttttttgaaacaaggtcttcctctgtctcccaggctggagtgcagtggcgctatcacagcttattgcagtcttggcctcctggactcaag

SEQ ID NO: 50040 - DNA, 201 bp, Homo sapiens
aaaaacacacttggtctggtcatgtgtaaaaggcataagattttctaatattgttcatttaaatgttagagatgcctgccaaatgtcatgatttacgtttyattatatacctagtccaagacattcttcctaaccaaaaagggatggacataataagacatgtaagaatctgggtcagaggtagcaggaacaggtaaccac

SEQ ID NO: 50041 - DNA, 201 bp, Homo sapiens
attttccttgttaacgggtgtatttccagcacttcttacaacactgccaggcatattgcagattgagatagtctgagtcttctgagaactaggattaggattttttttttttttttttgaaacaaggtcttcctctgtctcccaggctggagtgcagtggcgctatcacagcttattgcagtcttggcctcctggactcaa

SEQ ID NO: 50042 - DNA, 201 bp, Homo sapiens
aaactctggatctccttgtgtagctggaaagtattcagttgacactccaatggtttgctgtacaaagacagtagtttcagcccccaaaaaacagttaaaarcaggtgttaccacttaccttcaaaaacacacttggtctggtcatgtgtaaaaggcataagattttctaatattgttcatttaaatgttagagatgcctgc

SEQ ID NO: 50043 - DNA, 201 bp, Homo sapiens
atgcaaatcttggctctccaacttaatgcctgttcatgagcaagttatttaacctcctagtacctcagtttcctcctctgtaaaatgggcttgattatcakacccccatcataggtgtttttttttgggtgtatgagatgaattattatgactacaacacttaaaaccaataatgaagtgccatgtagatgttcattaggt

SEQ ID NO: 50044 - DNA, 201 bp, Homo sapiens
ggaactcaagaataacagagtttggataaatcggagagcagtacttcctatgtgattgcaaagagataaaaattctatgtgtgtgtagtgggaatgcatayacacacgtacatgtatgtttgtgtgcacgcacgtgtgtgtacccagaaagtagacaattaagggggttacatcacacattgccctctgtaaatccaattt

SEQ ID NO: 50045 - DNA, 201 bp, Homo sapiens
accaataatgaagtgccatgtagatgttcattaggtgaataaatacaaatattgttgattgaatgcatgtctgcatgcacgctgtttctttccttatgctstttctttccaacataatacagatgtattctactagctgacagacttttaaagtagaggccacttttaaaagcctgggctcccacgagaaggaaatctgca

SEQ ID NO: 50046 - DNA, 201 bp, Homo sapiens
gcctgtggttgactgcaccaacgtgacctcaaggagcaggttgtggtggttccctgaagaaagcaatgcccccagatcaaagctacatttcccatctactscagatcctattcaaacagaaccagttcccttgagcctggccatgatttgcatgtgaaaagctggtgtgttgcagccagtctgcaccagctttgggagagc

SEQ ID NO: 50047 - DNA, 201 bp, Homo sapiens
aactggaactcaagaataacagagtttggataaatcggagagcagtacttcctatgtgattgcaaagagataaaaattctatgtgtgtgtagtgggaatgmatatacacacgtacatgtatgtttgtgtgcacgcacgtgtgtgtacccagaaagtagacaattaagggggttacatcacacattgccctctgtaaatcca

SEQ ID NO: 50048 - DNA, 201 bp, Homo sapiens
tttctttccttatgctctttctttccaacataatacagatgtattctactagctgacagacttttaaagtagaggccacttttaaaagcctgggctcccaygagaaggaaatctgcaggtataagatgggtttgtcagtcagcagaggcatgctattgagaaaaggaggcaacctggggagggggtgttagaagagagctt

SEQ ID NO: 50049 - DNA, 201 bp, Homo sapiens
ttgcatgtacacccaataacacgggtttatgtaatgtacatgggtaaatgtacatcttccaagggagaaagggtgctctgtgtttccagcatgatggaacycagtttcatgatggattggcatattccatagatgaagaataattactggaaagaatgcagagccattggggactttctaaatagaggaatgatgagataa

SEQ ID NO: 50050 - DNA, 201 bp, Homo sapiens
gatccaaacacctcccaccaggccccacctccaacactgggggttacaattcaacatgagatttggtggggacacatatccaaaccgtatcagatgctccygagccatgacttagatttgaattgctgcagacacgtgtctctggtggcttcctgtgtgccataccctaagctggcgtgggtggccttcccttcctgaaca

SEQ ID NO: 50051 - DNA, 201 bp, Homo sapiens
gagacttttcgtggtgtacctgctgtcataaaagactaaaggaaagagaagtgctaggataagaatctttatagtcttcaacctccaaccttccatagtaygctgcagacctcctcagacttgacttggtttaatgatgaccttgggttttttttcaaatccttggccaccattgactttgatgtcttcttccatgcatct

SEQ ID NO: 50052 - DNA, 201 bp, Homo sapiens
tttatgacaggcagggttaatgatttcataatggtgaacttttgccaatctcactactatttgaatatttcacaacttgttcaaattgttaagtacaacarcagattgcatgtacacccaataacacgggtttatgtaatgtacatgggtaaatgtacatcttccaagggagaaagggtgctctgtgtttccagcatgatg

SEQ ID NO: 50053 - DNA, 201 bp, Homo sapiens
agataagtcagatcagattgttcctggatcactgcctttccggaaagcctctggtggcctcgtgcactctgtagaattggtacaggtcccttgtgatgctwctcaaggccctccaggagcccatgccatcctcagtgccctcagctctggaggagcagctccaccacggcaccccatgactttgcatgtagagccacatgg

SEQ ID NO: 50054 - DNA, 201 bp, Homo sapiens; identical to SEQ ID NO: 10487

SEQ ID NO: 50055 - DNA, 201 bp, Homo sapiens
tccaccagccccgctaaagagtatcggctcgcacttcttcatgactcactgctcagcttcctttaagctggttttttccccgttaacagaaacctcttccmaaagtgtcaccagtaacattctccttacaaaatccggttacttctcttcacttcttatcctcgtaggggtcatgacacatttaattatgggtcattgact

SEQ ID NO: 50056 - DNA, 201 bp, Homo sapiens; identical to SEQ ID NO: 10488

SEQ ID NO: 50057 - DNA, 201 bp, Homo sapiens
ggcccatttctataataaggtcctgctcccaagcttcctcctttctctccatccttatccctcccccttccctgcctggcatggtcttgtagctggaagaygaggcctcagctctggggtctcatttctgcttcacaaacctccatcagcacagactgtccccatgtggagcccagccccctgctgttatctctgaaaaag

SEQ ID NO: 50058 - DNA, 201 bp, Homo sapiens
gagagtaacctcctgatgttgccatggcatttgtaaactgtcatggtgctggtgggagtgcagtagtgaggaccacgagaggtcacccttgtcaccatgtwgattttggtgggttttggccagcttctgtactgcaacctgttttatcagaaaggtctttatgtcctgtatcttatgctgacctcctatctcatcctgtga

SEQ ID NO: 50059 - DNA, 201 bp, Homo sapiens
ctcagcaggtataaatatgaagcccaatagatgggcaaaagaatttctgaaacacaggatgggggtgatacgaaaatgacttggttgatgaggtattcacrctcctggacctgtgccaactccctctctgcaggttcctgcccttattgctaccctgtaattattcatctttaatttattgctcttcaccttgagcaccac

SEQ ID NO: 50060 - DNA, 201 bp, Homo sapiens
cctcctgggttcaggccattctcctgcctcatcctcccgagtagctgggactacaggtgcccaccaccacacccagctaattttttgtattttttagtagwgaccgggtttcaccgtgttagccaggatggtgtcaatctcctgacctcgtgatccgcctgcctcggcctcccagagtgctgggattacaggcgtgaatga

SEQ ID NO: 50061 - DNA, 201 bp, Homo sapiens
caatgattgagtgtgggcagctctattatctggatttcattaagatgatgctacaaaaatagtaattgttagtaataataatgctacaaaaacgttgtatrcttgcaagatttacaaattacataatttatgatgattgaatgggggtggctctcttatctggatttcattaagatactcaggattctttacaaacatgct

SEQ ID NO: 50062 - DNA, 201 bp, Homo sapiens
gatgatgctacaaaaatagtaattgttagtaataataatgctacaaaaacgttgtatacttgcaagatttacaaattacataatttatgatgattgaatgkgggtggctctcttatctggatttcattaagatactcaggattctttacaaacatgctaggtttccacttagagcaagatctcttaaaaaaaaccctgctt

SEQ ID NO: 50063 - DNA, 201 bp, Homo sapiens
tatccaacctagcagctttaaagatctcttcttcagcatgtctccaaatttatagcttcatttctgacctcaggtccgtcgtgtctacagcgcatctccasccgtacatttcacttgcctctcggggttaactgtgtgtttctgaacgctcatactggggttaactgtgtgtgtctgaacacctgtacctcattacctcat

SEQ ID NO: 50064 - DNA, 201 bp, Homo sapiens
atggtttctttggccaaccatttaattttttttttgttgttaactttgtccttgttaacattaattctctcatgtcatgtggaaatgagaataattcagawattgtaagagaaggaaaatggttagataaattagaagcatgaataattgatagagaaataattcaagcagctaactatatcatgcattctctgcttactt

SEQ ID NO: 50065 - DNA, 201 bp, Homo sapiens
gaaattgtctttataatattggcataaggctatttttaaaatttatactaatgagacgattcgaggcagataactgaatttcccaggcttgaagttggccyatgccccttggtgaattcagccttagggtgagctctgtggggccttgcaagtctggctctagatgcaagagatctgccctatccacattccttctttcca

SEQ ID NO: 50066 - DNA, 201 bp, Homo sapiens
agctccttctagtgctgtgccaggcacagaactcataccatgtcatcctataatctaccccaatggtagttaatatacccctatcacagatgaggaaactraggccaggctcagaagtaggcttcaagtggaatgtctagcaagtggcagagtggggacctatgcctacttccacgcttgagatgttcttctggggcatgg

SEQ ID NO: 50067 - DNA, 201 bp, Homo sapiens
ttcttctcactgaccctggataggtctaggctactctcagcttacctaccatgtctttgtaagatgtgtagtccatggtgcttgaatagcaccacaaagaygtggagaggtaaaagacataagatgatctcaattttgaataattctccttgaggggcaattatatatttttggaaagttcattcttatttattgggcctt

SEQ ID NO: 50068 - DNA, 201 bp, Homo sapiens
taccatgtcatcctataatctaccccaatggtagttaatatacccctatcacagatgaggaaactgaggccaggctcagaagtaggcttcaagtggaatgyctagcaagtggcagagtggggacctatgcctacttccacgcttgagatgttcttctggggcatggagaacagtggcaaggatcccctcctctcctcacca

SEQ ID NO: 50069 - DNA, 201 bp, Homo sapiens
agagattcagaggttctccttttctctggtggtgctctatcagggacagataggtccctaagacttagcagcaaaagggactctccctgcagaagcatgtrcatgatgtgagtaggtgtgcccacagcccagggttcatactctggggcttcatgcccttttcctattctttgtctccaaccgcatcttataagaagtgca

SEQ ID NO: 50070 - DNA, 201 bp, Homo sapiens
aataagcagagatagaatgggtgaggacctaggacagcggctcattaggcagaacccgtcctttctctttgctaaagttagggaggaaacaaatgcctgcygaacagaaggaggagatgagaggatctgtcagccagggagaggtacagctaccagaaaagcactggacagtttcctctaatccttgggaactttaatcgt

SEQ ID NO: 50071 - DNA, 201 bp, Homo sapiens
ctcaccacagctgctgtaaacagagtgggtgaaacgagcttcaagaaaagcttttagactgaacttgagaagagtgctggcctgggactggagccaccacrtgtcacttcactctgggtggagaaaggtgtagccggctctcaggctcatgcagatgtcatgagcttccccaaagggccccaagaaaattctagaaggcag

SEQ ID NO: 50072 - DNA, 201 bp, Homo sapiens
tctttaagcgtgtaagtgatgacgctcaaatctatcagaatactaaccctgaaatcaggtctgagtttacagccattatatctttctttggatttggtttwatgtttttacccttgatttatgtacgtacttcccttagcatcccatatctcaagcaacataaaggtattaaagtgatgggatttagcaaatatgttatgg

SEQ ID NO: 50073 - DNA, 201 bp, Homo sapiens
catgcattcaccatcatagaaactttgaattatgtgaggtagtagatgatgaaacaaacattacatactaggaaagggacgcctctcccttttttttttttaaagaggggtgttttctgcttggttttgtccattataaactgttagattaaccatttgtacagccaatgaaatagctttaagggaggcactcaggagctt

SEQ ID NO: 50074 - DNA, 201 bp, Homo sapiens
tcatctgttatgcaattgaactggaaacagctcagacttaaaaggcatctccaagtttttctcagccaacaagacttaggccactttgttttctcagattkttcagccttgtccaatttttggctaaaaatcctttttgaaaacttcagcagccatattattttcttctccagtcatcaacttataacgtaaagacaaagc

SEQ ID NO: 50075 - DNA, 201 bp, Homo sapiens
aggccaagcatgctccagtggccgcagaaagtcctcagcagaatcccagggtcttctaagaagaagacgtggagatcgtgagaatagtgagtgctcacagkatgtagcggggacaacaacagtgtctcccacaaccagcattacagataaccaggagtcgaccctgatgaagctggtggctttctcagctttacagaatgc

SEQ ID NO: 50076 - DNA, 201 bp, Homo sapiens
tgcagggtcatttgacttggagaggagggagtggtaagatcacattatcattaagaattcgctcagggcatgtaaagatggctgagcagcttctttaagcrtgtaagtgatgacgctcaaatctatcagaatactaaccctgaaatcaggtctgagtttacagccattatatctttctttggatttggttttatgttttta

SEQ ID NO: 50077 - DNA, 201 bp, Homo sapiens
gaaacagctcagacttaaaaggcatctccaagtttttctcagccaacaagacttaggccactttgttttctcagatttttcagccttgtccaatttttggmtaaaaatcctttttgaaaacttcagcagccatattattttcttctccagtcatcaacttataacgtaaagacaaagctgtggggaaaatctaaagttgcg

SEQ ID NO: 50078 - DNA, 201 bp, Homo sapiens
tagtattttactaatcaaatacataacagatatatacataaaccagaatgaaaacatattatagtgagaaatgtaattattgattgaactggatatttgtsttttcatgtcaacttattcattcagagcaggtgtgggaaaacaaattttagtcatgaaccgggttggaaagtattaaaaacgaggatttggtcatcttaa

SEQ ID NO: 50079 - DNA, 201 bp, Homo sapiens
gtgcattctatttatttgtgaagtgatgcaggaaactacagtaaggagtgcggatgtgaataagtggaaggcaatacagtgtgtgtgaatggtaatgtcamctccatgggcgggtggggctcagttccgttgaggatctctggaagactacatataggctggctcagagctgtgccccactggggcagctcactgggttat

SEQ ID NO: 50080 - DNA, 201 bp, Homo sapiens
gagaaaatcccatttgcacatttcctcttagttgggtggacttacccatatatacttgggtgacattcaggaggctactttgtgttttggctgtgtattckaatttttcttccggtactatatacagcaagagaaggggatgttgttcagctcttgttctacctagaacccaactgcacttttgcaagagatggatacaaa

SEQ ID NO: 50081 - DNA, 201 bp, Homo sapiens
tggccaggcttgtctcaaactcctgacttcaggtgatcaacctgtctcagcctcccaaagggctgggattacaagagtgagccactatgcctggccccctrtttgacatatttttaacggtgtaggcaaaatgatcttttttccaaacactgcaatcgtgtcatccccttcaaagccttctgtggctccccgttgccccaa

SEQ ID NO: 50082 - DNA, 201 bp, Homo sapiens
gtatattctttaatctatccatccattcatcctgggaagaaataatagtatctttaaaatgtagtgcattggttacaagcacaagatcttcagtgaatcaytttgtgcattcaaattctgtctgtatgtatcatgcactttctatgtaaccttgggcacgtttttatgcttctatggccttttcagtctttaaaaaatggg

SEQ ID NO: 50083 - DNA, 201 bp, Homo sapiens
gactcaaagctgatgctctcaacaccaatgtttcatctccagtgtaccacgaggtccttgtccacctacttctagatagagccaaactgtctaagccaaasggggtttgggtttctttcaccacccacctgtgcacatgattagtttgaaaaagtatgtcttaaagaaaaataaatgcagacaactaagtgagaacagtta

SEQ ID NO: 50084 - DNA, 201 bp, Homo sapiens
ggaatgtgattccttgactcagcccagtagccctgtgaatggatggctgaaacgagtctgacggctttttctcctggggccattttgtaagaaataaaagyaaaacagtgagatatttaaattcttcagggatattattttcgagtagataaagtgaagaacattttttattcatattagaagtgatagttggatgtgtgt

SEQ ID NO: 50085 - DNA, 201 bp, Homo sapiens
caaaaccatgtttaaccaagtgctgatgggcttgagtccattcccaagtgactcggaagttgcttacttccctacctttgagtgggtctcattttatctcygtgatgttttccttgtccttctaagtcatattcactctgctcattgaagaaaaatggttggtaattgtagtggataactactccattctgtatgccttct

SEQ ID NO: 50086 - DNA, 201 bp, Homo sapiens
gtaaattaagctcagagagggtagatgactggctcaaggtcacacagctaccagctggccaggtggcaagaccccggacagaggattgggagcatggtatwgtagccagcgtacctccttgtgtctatcattagccctgctttaatggactttttcagaagtgtttttgcttgtgttttacaagtggaatgtgattccttg

SEQ ID NO: 50087 - DNA, 201 bp, Homo sapiens
caaccatatctgtgtaggtttctcaccctagaagcctccttttaaatagggcaaagaagctacctaaagatttctctttaatatagggaggaaaccacttycgaacttgtgcccaaagatttatcttcaccaatggtctaggacagaggtcggaaaacttttactgtaaagggccaaataatacatactttcagctttgca

SEQ ID NO: 50088 - DNA, 201 bp, Homo sapiens
tactctctctgagtttggaggaccttgttttcctcatggcacacacgaggagtaaattaagctcagagagggtagatgactggctcaaggtcacacagctmccagctggccaggtggcaagaccccggacagaggattgggagcatggtattgtagccagcgtacctccttgtgtctatcattagccctgctttaatggac

SEQ ID NO: 50089 - DNA, 201 bp, Homo sapiens
aagtaataagagtctaatttggcccaggagtttgctgattcctggtctaaatgagagtaaagaatgggaaagggaatggtgtgggaggaataggcattttmattcattgttgttaatgagaaagagtcttcaaacaccagcatgcccctgtgggttggattaggttagaaaatccttggaggactgccttttccaccccag

SEQ ID NO: 50090 - DNA, 201 bp, Homo sapiens
gtcagatgcatgttgttgttgcatatcgtttgttcattctcctccttgctgctgtgcaatataccattacgggaactaaccacattcaattctattttaaytgttagtatttacaatggctccctaactgggatctcttttcaaacaattcactcttcagtccctgatatgatttggtgctgtatccccacccacatctca

SEQ ID NO: 50091 - DNA, 201 bp, Homo sapiens
accaaccacgggccagtcgaatgtagtactcggattgaccaggcacctgaagtctaagacagcttccatcagtttcctgataactggcatttactgagcaytttgtctgcactagatcctgtgtgtcatgcacactgacttatttaaccttctggacaacaacgtaaaataagctttagtacaaagagaagttctataact

SEQ ID NO: 50092 - DNA, 201 bp, Homo sapiens
ctccccagagggaaccactcttctgacacttaactgtacaaattagattggcctgtttggggactttctactgatggacccatgctgtgtatactcttttstgtcaccttctttcagtcatcatggttagtcagatgcatgttgttgttgcatatcgtttgttcattctcctccttgctgctgtgcaatataccattacgg

SEQ ID NO: 50093 - DNA, 201 bp, Homo sapiens
tggacaaaaaacttaattttcggggacgctgattctttttctctgtaaggagaagttattggtctgatgcacacagtggaatcaaacggcaatttacttgkaatgaaaacctctctctcccggtgtccttatagcaaccccagggacagactccagttggctctatctgtgcctcatgtccatcctttgaaccaaccacgg

SEQ ID NO: 50094 - DNA, 201 bp, Homo sapiens
aaacaatttctttgtgggctgtactttcatccagctggatggattttaaccaagtgatcccacctctatagccagcacccagattaagaagcagaacaagwctcttcctcttatagccccttctaatcaccagcttctccccagagggaaccactcttctgacacttaactgtacaaattagattggcctgtttggggact

SEQ ID NO: 50095 - DNA, 201 bp, Homo sapiens
gtaaatggaaaaccagcactttgctaacacgttttaaatttaaattattgcatgtactgccttgcgtgttagctctcagtaattatttttcatcctcttargtttcttccagctttaaggctttattattttaagttataaagtaatcggccaccctgtatgactgtgaggtccttcaagagagaaggtactctttgctct

SEQ ID NO: 50096 - DNA, 201 bp, Homo sapiens
gtggagatgtgcattgtttgtggaaagatagaaccttcctcagtcagaaagcattttgccattagcagcaggcagtgatgctgacaatttgcagttggtgrccaggttttaaacagtagtttgggcaagaaagggtatccagcaaatcaatttgcaatagctgatccctgtcattaagggagtcaattcttgatactgtaa

SEQ ID NO: 50097 - DNA, 201 bp, Homo sapiens
agaactagcaaatggagactctaggtcaccttacctctccttttcttggaggaatggtggaaagagaagaacaactgaaaggcttcagcacaatcgctctrtaggacccaggagagagaagagtagcctggaatcaacagtggtgggagaggctggagggcctcaggaaattcaaggcaaaagagtagttagctctaatga

SEQ ID NO: 50098 - DNA, 201 bp, Homo sapiens
ttaaaccttaaatagcaaaatagaaaagacagatcatcagcaatgattaataaaaaagctattttataaagcggtgattgggaaagtaaaataggttgtayagattgggccaaagcctaaagatattctggtgattctttccacgatagaagaccgtgaaagaggcaatgcagtgagaccataagccttgtggtttgggac

SEQ ID NO: 50099 - DNA, 201 bp, Homo sapiens
acacattcttttcgaaggcctaactttttctgttggtgaaatgggaataaaaatagtacgaatttccaggagttaaattagagttgaatgagataattcaygtgaggctcttagaaagatgcctggaacatagtaagaattaaataatatcatctaataaagtgagaatgaccacagaatatgtctttatatggtattcat

SEQ ID NO: 50100 - DNA, 201 bp, Homo sapiens
ataaccttaatattaggtctcgggaggtgtcactaggactctgttatcctttcttcccttctttcttttttggctttctgtatgtcttcattttcagacarcctctctcctggggtatcagaagacacactcacattaggataatgcagataagatcaattcacagtaagaagatttatcaaggtaaagtgaagtatagga

SEQ ID NO: 50101 - DNA, 201 bp, Homo sapiens
ttcaataaaagtaaaaacctgtgctcatcaaaatacatcattgagaaagtgaaaaggcaggctatacagtggaaaaaaaatctttgtaatatatgggtctrttacaggacatttatctaggacatgttaacaactcctacaaaaatataacaaaagggcagagaacccaactaacaatggaggaaatatttaacaggcttt

SEQ ID NO: 50102 - DNA, 201 bp, Homo sapiens
gagaaagtgaaaaggcaggctatacagtggaaaaaaaatctttgtaatatatgggtctattacaggacatttatctaggacatgttaacaactcctacaamaatataacaaaagggcagagaacccaactaacaatggaggaaatatttaacaggcttttaacaaaagaggatatctacatgaccactaaacatattaaaa

SEQ ID NO: 50103 - DNA, 201 bp, Homo sapiens
ctgggttcttctttcccagtcattttcctgtcttaaccttggggtgaaggacaatgttcttgacctagaatggcctaggcagagtctgataagattgttgyggatgcaaagggaacagggttgtggttgctgagcattgcatccagtgcgtaccttgttcccttgctgcactctcatcatgtttggattcagatgaacttt

SEQ ID NO: 50104 - DNA, 201 bp, Homo sapiens
tattttttcataagatgatgttggaaaagtttcaaaggaaaggcttctagtgtttgatgagcacctgctgtgtaacgggcacaggttaggcaattttatamaagataaagatgtttgtacccacttaatggataagaaaattgaggcacaaaggggttaagcagtcttcccaaacttacccagttattcattttaactgct

SEQ ID NO: 50105 - DNA, 201 bp, Homo sapiens
accttgttcccttgctgcactctcatcatgtttggattcagatgaactttgatgttctgtgtgaggtggacgttagcactgtatctgtactgagttaggcraggcggtcccggcaaagtaattacaaggaaatgctgtattttagattgtttgagttttccaatagagacatatcaatcttgcttgggaatactttgactt

SEQ ID NO: 50106 - DNA, 201 bp, Homo sapiens
ctgggaaacatcaagccttacctagaatcatctttccaatctcgctcttctcttccatttagaaccaccttcaacatctccccagggtacattccctaaayagccccgattattcattattttatggaactaccagatactgaattcctgttctgggccatgcactctaggagctgtgatttcaacagtgaaggaggacag

SEQ ID NO: 50107 - DNA, 201 bp, Homo sapiens
aggaaggagaggtgtaaacagagctcgtgaacacaaatgaaaaggcaagtgataggtacacaaggacatcaccaagaagaaggctctttttctgcccttgmagtataaaaatagttatttattttttcataagatgatgttggaaaagtttcaaaggaaaggcttctagtgtttgatgagcacctgctgtgtaacgggcac

SEQ ID NO: 50108 - DNA, 201 bp, Homo sapiens
ttttaaaaaaacgtactctctctagaggctggagagggaggatcgcttgagcctgagagttcaaggctgaagtgagttatgacggtaccagtgcctcaagsctgggtgacagagtgagaccctgaatctaattaaaaaaaaaaaattatacaatgaataatgacccaagtactgtgttgtcttcatgccatggacacctta

SEQ ID NO: 50109 - DNA, 201 bp, Homo sapiens
tgaataatgacccaagtactgtgttgtcttcatgccatggacaccttaatgctttcttcaaagcagtatgaggttgttaatctgagaatgaatctgttagmcttccctgaactcataaagtttgcttcctctttgaaagaacttagtgccttttaatgcctatgcagccgtgatgtgccaagtaatatgttccatgtgtaa

SEQ ID NO: 50110 - DNA, 201 bp, Homo sapiens
gcagaggttttcaaggtctgctgtgaatgtatgatttagaccacagctcagttgtgacatttaatccatagagataaatcatcacctgccattggtagggytctttatggataaacaggcctaaaatagttacctgtaaaactccatcagagtctccatcagaaatcaccaccatttttttttaatgtaggagactgggat

SEQ ID NO: 50111 - DNA, 201 bp, Homo sapiens
ccacaatgctttcagagctgaatccttataggaggcaagtcagagatgaaataagaaggactgacaggaaggagaggtgtaaacagagctcgtgaacacamatgaaaaggcaagtgataggtacacaaggacatcaccaagaagaaggctctttttctgcccttgcagtataaaaatagttatttattttttcataagatg

SEQ ID NO: 50112 - DNA, 201 bp, Homo sapiens
ggataaacaggcctaaaatagttacctgtaaaactccatcagagtctccatcagaaatcaccaccatttttttttaatgtaggagactgggatggtgaaastctttcttgattttggtgcttgagaacaaattaaatcaaagtcaaaacaactaactttcccttggctgtccttgaggcatgcttggtactgttttgtttg

SEQ ID NO: 50113 - DNA, 201 bp, Homo sapiens
atctaattttcattgagcttacaaggcacatggcaggtgggaggcactctggcatccactgagatgttagtgaacccatctggtcttcatttgtttccttmcaagctcaagggtgattgagtttgccagccttctctccactgttttagtcttttcccaaagcatataaggactcttctcttgcttccttgctgaactggg

SEQ ID NO: 50114 - DNA, 201 bp, Homo sapiens
aactctttcttgattttggtgcttgagaacaaattaaatcaaagtcaaaacaactaactttcccttggctgtccttgaggcatgcttggtactgttttgtktgggtttttttttcccagtagtaggctggagttcttatggatttgattctgacatcagcctcccaggagaggccatggtgtataatggttaaaagcacag

SEQ ID NO: 50115 - DNA, 201 bp, Homo sapiens
atgtcattctgtgagtcagagtcaaagtcaaaaagactttgtaaaaatctactttggagactaggtgtgggtgtctgatttagaacccttctcatagtctrgtgatttctaatggtgcttttgccgaaggaattcttaggagcatccaagttccatcttaaagacatggctttgccagtctgttgtgggtgtgctatacca

SEQ ID NO: 50116 - DNA, 201 bp, Homo sapiens
ttataaatatgaaatgaattaatatccataaagcgtttagaacagggaacgtactcagcttaataatgtacatattcgattaataagataaaggctggccrggtacggtggctcatgcctgtaatctcagcgctttgagaggtcgagtcaggtggatcacctgagatcaggagatcgagaccatcctggctaacacagtga

SEQ ID NO: 50117 - DNA, 201 bp, Homo sapiens
tctgggtaggtgacatgtggggagaggattaaaagaaaggagggccagtggctcacgcctgtaatcccagcgctttgggaggccaaggtgggcagatcacstgaggtcaggagttcgagacgagtctggccaacgtggtgaaacctcatctctattaaaaatacaaaaattagctgggcgtggtggtgcacacctgtagtc

SEQ ID NO: 50118 - DNA, 201 bp, Homo sapiens
atacatttgagatggcacagacaatagcacctagggcagggcccggtcacagttgtctcttcataacattctaagtcgaggtatgtttattcattgaccarctccctggagtcttcatttctagtacagctgctaaattcagtcattcattagtcatgttttaaggacaatggataggagacattatttaaaaagcaataa

SEQ ID NO: 50119 - DNA, 201 bp, Homo sapiens
aggctgccattttcatataagcttcatgaaatctgggagaataaaggcaaaaggtttgatctggctgtgacagggaatattgtgaagctgctggactgggsctgtgggttgcctgtgactgtcatcaagttcttcttctctggaggcttcaaattcctcctctgtcaaatgaagggactggactagaaacagaatggcaag

SEQ ID NO: 50120 - DNA, 201 bp, Homo sapiens
agtcttcatttctagtacagctgctaaattcagtcattcattagtcatgttttaaggacaatggataggagacattatttaaaaagcaataatacaaaatrccaagagctattcagctcttttatactagagcctgtatatagtacgttctttcccacaaatccctgtttttaaatattttctccatttcacaattataat

SEQ ID NO: 50121 - DNA, 201 bp, Homo sapiens
acctgtttctacaagagcaacctacttttttgttttgttttaatcaagggagtgtcaagcaattgcttatttcataaacagggctgtgctgctatttttamacagtgtgaagtccacaggtctgaataatttcttcttgctccaagagttcctaggtcctgtgttcagattttgagagccttcatgtctcaggtcccaata

SEQ ID NO: 50122 - DNA, 201 bp, Homo sapiens
ttcatgaaatctgggagaataaaggcaaaaggtttgatctggctgtgacagggaatattgtgaagctgctggactgggcctgtgggttgcctgtgactgtsatcaagttcttcttctctggaggcttcaaattcctcctctgtcaaatgaagggactggactagaaacagaatggcaagtacagggcaaatgccccagtgc

SEQ ID NO: 50123 - DNA, 201 bp, Homo sapiens
tatttaaaaagcaataatacaaaataccaagagctattcagctcttttatactagagcctgtatatagtacgttctttcccacaaatccctgtttttaaayattttctccatttcacaattataatcccccaaatgacagaatggttgtctgacaatatttcttctgatgttgaacatattttgtacgtttgagactgtgc

SEQ ID NO: 50124 - DNA, 201 bp, Homo sapiens
tagctgcccctaagtgtagttaagccccgtgaaatgtaaacttcgcaagtaaatggaccattgccatttgcctctgtcttctagatgcaattgttttctayagtctgtcttgtggccggttataaaatgtctgtcttgagcaagctggggaggagggtggatagctttcgatttgcccaagtttgttaatgtttcattgct

SEQ ID NO: 50125 - DNA, 201 bp, Homo sapiens
accagcagtctaaaacattacaggatattagactgaaaagacagtggtatttgcatccttttgaacattcgcctggatttgcataatggagatgtcacttrtattgcaggagaaaaatcaagttacctgggctcccattaactgcctgctcgctacagttcccgtaaggggttggaacaccacctttttgaaatagaaaat

SEQ ID NO: 50126 - DNA, 201 bp, Homo sapiens
cctacaataactattgggaatgttaatcatttcaaatggaggaattattagaggcagcacatttatcatgcatatcctcatcactagcttagagcacctgrcatagtttttaaaggaaagggagaaaaaaaagaaacactataataatgagaaaatatgcaagatttgaagtcaggaaaatgtgggtttaaactgcagctt

SEQ ID NO: 50127 - DNA, 201 bp, Homo sapiens
tcacaaatgagaagagtggacagtgggtacagggtagggatgatgagacctggaattgatgacctcagcagagaaggggaggaaggataagaagcaaatawcagtgacatatgtgtaagttaaaaagatggaggtagagctagtttccaagatggcttaaaaatacacatgggtgccggtttgacctcaaaatagaaatta

SEQ ID NO: 50128 - DNA, 201 bp, Homo sapiens
ctgtcttgagcaagctggggaggagggtggatagctttcgatttgcccaagtttgttaatgtttcattgcttggggtgttttaagatcctgtgcctttaakagatttcctgaactaacagtttgccttatttacttccctgggctataatcattattgtggctgaccatgttgataagctactctgtgaagccttctctaa

SEQ ID NO: 50129 - DNA, 201 bp, Homo sapiens
aaggagacggaaggtggaggatatgagaggctgatcaaggtcgcaggagcaagtgcagggcagagacagggtggcagctccctgtgccttctggaagccawcccccaagctgaaggagccacacagagccagctgtccaggcaggacctctctgcggtgacattcacatggcagagttaccaagaagaaagcttgtgtccc

SEQ ID NO: 50130 - DNA, 201 bp, Homo sapiens
tctttccttggtaccatggatgtgtttgatatggtgccagctgcaaagtagtggaggcttcttcagtgtgggttcttgagctgtcatatagcataaagccrccacccaccattctgaattcacagcatgagcaagagataaacaaacctttgttgagttaaggctctgggattttgttttattttgttcagtttttaattt

SEQ ID NO: 50131 - DNA, 201 bp, Homo sapiens
ctggggaggagggtggatagctttcgatttgcccaagtttgttaatgtttcattgcttggggtgttttaagatcctgtgcctttaatagatttcctgaacyaacagtttgccttatttacttccctgggctataatcattattgtggctgaccatgttgataagctactctgtgaagccttctctaatgaatgagagtcac

SEQ ID NO: 50132 - DNA, 201 bp, Homo sapiens
atttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgc

SEQ ID NO: 50133 - DNA, 201 bp, Homo sapiens
tcttgtggtcaaaacctgcaccccaggtaacataaaataaaaataacaatggctataattgtgaaccgcccgctaacctcctcttgtagtgctccaggccrgacgctcatcaccttgttttgttgtctttgccatcagcattatagtagagccattggcactcacccatgtccagccccgttcctcctgggcacacagaaa

SEQ ID NO: 50134 - DNA, 201 bp, Homo sapiens
ggggaggagggtggatagctttcgatttgcccaagtttgttaatgtttcattgcttggggtgttttaagatcctgtgcctttaatagatttcctgaactarcagtttgccttatttacttccctgggctataatcattattgtggctgaccatgttgataagctactctgtgaagccttctctaatgaatgagagtcactc

SEQ ID NO: 50135 - DNA, 201 bp, Homo sapiens
cttccactgggatgtccatcttgtggtcaaaacctgcaccccaggtaacataaaataaaaataacaatggctataattgtgaaccgcccgctaacctcctsttgtagtgctccaggccagacgctcatcaccttgttttgttgtctttgccatcagcattatagtagagccattggcactcacccatgtccagccccgttc

SEQ ID NO: 50136 - DNA, 201 bp, Homo sapiens
aacttttgctctgtagcccaggctagagtgcaatggcatgatcttggctcactgcaacctccgcctcccaggttcaagcaattatcctgcctcagcctccygaatagctgagattatatgcatgcaccaccacgcccagctaatttttgtatctttagtggagacagcattttaccgtgttggccaggctggtcttgaact

SEQ ID NO: 50137 - DNA, 201 bp, Homo sapiens
ttccctaccaagttttaaaggttgaacaaagcaaggtgttgaaagagcaccctgagtctgacagtcagaggggaatcagggcaggaagtatctactgaagwggtcctcaaatttcaggttgcctaaacagttactgaatgagcttgtcaaaatgcataaagaaggccctacaccactaccactaccaccaccctctgacac

SEQ ID NO: 50138 - DNA, 201 bp, Homo sapiens
ggtaggcacttgaagcccagaaaggctaaaagactaggacattaagtcatagaggagggtttttttttttttttttagttttgttgttggtcgtgatggtrttattcaattcttttattatctcagaactcatgtcatactgccccagcctctgtatcagcattatgtagcaatgatgttactgagcctgatctctgtaag

SEQ ID NO: 50139 - DNA, 201 bp, Homo sapiens
tacactgaagttcagagttgttgagtggtttacccaagaatacgtagcaagtaaatgatagagctgaaaattcaatctgtctttctctagtgctaagcctyagtttccctaccaagttttaaaggttgaacaaagcaaggtgttgaaagagcaccctgagtctgacagtcagaggggaatcagggcaggaagtatctactg

SEQ ID NO: 50140 - DNA, 201 bp, Homo sapiens
catttttgaaactcaaaattaatgcatagaagtccatgagaagtaaaatgttaaagacaggatcaaaatcaatgcagaaaatccataatgagcaaaatatsaacatgttttaaaaagagggcatcagtattactgatttctttcgtttgactcaggctccagtacagcttatgttggcactgtgatgtatcctgtctgtat

SEQ ID NO: 50141 - DNA, 201 bp, Homo sapiens
gggtagtgaagaggtcctctaagaaagaagcagatttcgtggaacccaggatttcccatcctctttttatctgcactgcattttaggagcttttaaatttstgttctggagttgggcatctcttcaaggttaagactcaagggctgtttgtattcctcttggatttgcctacatttagcaaagcagaaactcaacacattg

SEQ ID NO: 50142 - DNA, 201 bp, Homo sapiens
aactgcttctcagacgtggcatttacatgcctggtgcttccttagctcatcatataaccaagtactggaatctgttttacagataataagaaacattcacrtgttccatcttttacatatgtgaggaccaggcactgactagaaaattttcatcaccattgtcctcatcatcaccatcattagcatcttgtcgtcatcatt

SEQ ID NO: 50143 - DNA, 201 bp, Homo sapiens
tttggcgggaaaatagctttagtcacaggcaggttgttttgcttcctaaagcgtaaagttggaaatgtgataatttcgtcaagtagttgatttagttgtaycaagcttaactaattaacaccaattccatgcttgattcttttctccattaactgaacaaaagccattgctaatgaggctatgtatacaaagccagctgac

SEQ ID NO: 50144 - DNA, 201 bp, Homo sapiens
ctatctatctatctatctagatatatacctcatattcttgtgagtggactgaggctcatgccatgtggaaagtgaagcaagggctggatatttgattcctmcttgtccccctgccatgcccgtgctcctatgtgtattataacctgtaccccatagatggttcttgagattactcctcctttcatctggaagataatgttc

SEQ ID NO: 50145 - DNA, 201 bp, Homo sapiens
tttataaagaattaaaggaaaataggttaaacatgaactgcttctcagacgtggcatttacatgcctggtgcttccttagctcatcatataaccaagtacyggaatctgttttacagataataagaaacattcacgtgttccatcttttacatatgtgaggaccaggcactgactagaaaattttcatcaccattgtcctc

SEQ ID NO: 50146 - DNA, 201 bp, Homo sapiens
tcctaaaacataaattttaacattccttgcttctccttgatgatcattcccacatagaaatggaactgcattaataatgattgttgaaaaaatgaataaaygattgttgaatgaataaccgaatgaatgccaccagggaaaattattgtctccatttcattttagggcctgaactttaggagaataaagttatcctaaaga

SEQ ID NO: 50147 - DNA, 201 bp, Homo sapiens
cctactaattacattaatcaacaacaaacaacaactctaaaagattccccgagatgagagtttcagaagcctgagacgctatgtcaaacaacccaccgtasttattcagggacactgcaactcaaaatgaggtagccatcgatccagagaacaaatgatcattattcatgtaactctcttctttgcttaagaatccatctt

SEQ ID NO: 50148 - DNA, 201 bp, Homo sapiens
ttatccacattcttgtcttacccatccgtctctgtcactctcctgatatacctcttccctactaattacattaatcaacaacaaacaacaactctaaaagwttccccgagatgagagtttcagaagcctgagacgctatgtcaaacaacccaccgtagttattcagggacactgcaactcaaaatgaggtagccatcgatc

SEQ ID NO: 50149 - DNA, 201 bp, Homo sapiens
tgctgcttccaatttcagactccctagctttgcctattggctgactgtaaccataaagataactgattcctgtaccaagcctaataagatcaattaaattmcttgtaaaaatggtccctactaggggaaatgctagatgagatgctaaaactcatctgtctaaaaacaagagacaagctctttcttggattttttcttttt

SEQ ID NO: 50150 - DNA, 201 bp, Homo sapiens
agctctagagagctggaaccaatttatgctccttctgacattcacagggaatgctctgtataaatcttggtctcttcttcctttttaaggtcacatagcamctggatttaaactccaaagctaccccaattttagctggagggaccatattccaagctgcaaatattgtacccacccagcaaatttcctgggatgtgcttc

SEQ ID NO: 50151 - DNA, 201 bp, Homo sapiens
agactccctagctttgcctattggctgactgtaaccataaagataactgattcctgtaccaagcctaataagatcaattaaattccttgtaaaaatggtcyctactaggggaaatgctagatgagatgctaaaactcatctgtctaaaaacaagagacaagctctttcttggattttttctttttctctttctttctttct

SEQ ID NO: 50152 - DNA, 201 bp, Homo sapiens
agcttcttccaatagctatgtgatcttggaaagttacttctccagtctgaacctccatttcttcaactttaaaatcagagtaataatagtaatacctataytctaatgttttattggaaagaacggtgtctggcacatagcaattaacccaagcaatttacatagcaattactcgtgaaaaagaagctattaatactattt

SEQ ID NO: 50153 - DNA, 201 bp, Homo sapiens
atcagagtaataatagtaatacctatattctaatgttttattggaaagaacggtgtctggcacatagcaattaacccaagcaatttacatagcaattactygtgaaaaagaagctattaatactatttattgttattttcccactgctgttgcccttcagccaaagagcaccaggaacacatccgtaattaagaagttggg

SEQ ID NO: 50154 - DNA, 201 bp, Homo sapiens
agggatggacaggtggtaggtgttcaatatttgcctcatggatattgggaattactatatttattgttctgtgtcccaaagaacaaatgaagcccccacayccttcctgtttattgacttaaagtattgtctttgaatgttgaaaaaagtttttagaaaatgctgaacttacagggaaattcaccaaagtaatagtaatat

SEQ ID NO: 50155 - DNA, 201 bp, Homo sapiens
gggtcacaaaactgaaccatttctctgaattggttgctattcggaagcatgggtagttctatgaccagtgctaaatctcatctttaggtaggacagcctarggtgaggctacagccgtaattggcaaagaagcagctattgttttagccaggaaaggcgatggcttcggcaatgttcaggtctgtctgtgttcatgcataa

SEQ ID NO: 50156 - DNA, 201 bp, Homo sapiens
atgaccagtgctaaatctcatctttaggtaggacagcctagggtgaggctacagccgtaattggcaaagaagcagctattgttttagccaggaaaggcgayggcttcggcaatgttcaggtctgtctgtgttcatgcataattacggaatggccttctttatggtctgattgactgtggtcatagagtggccttatctgat

SEQ ID NO: 50157 - DNA, 201 bp, Homo sapiens
tcatctttaggtaggacagcctagggtgaggctacagccgtaattggcaaagaagcagctattgttttagccaggaaaggcgatggcttcggcaatgttcrggtctgtctgtgttcatgcataattacggaatggccttctttatggtctgattgactgtggtcatagagtggccttatctgatgttggtattctctgaaa

SEQ ID NO: 50158 - DNA, 201 bp, Homo sapiens
tccaaattctatgtaaaaaattctatgtaggtcaacaaaacttagtaacttgggtgtcaaatgtaaagaagaaaagataggctcaaaggagagagtagggytgatgtggtagagggtggacccacggtgtctgtgcaggccagggtagggaggctggctttcattttaaatgacatctgaaaagtttgtcattttaaaaag

SEQ ID NO: 50159 - DNA, 201 bp, Homo sapiens
tatatgaggtatctaaaatagtcagactaatagaagcagagtagaatggtgatttgggggagcagaaaggggaaatttattgctcagtgggtataaagcakcaattatatgggaagaaaaagttctagagatgttttgtacaacttagtgcttttaggtaacaaaactgtaatgtgcacttaaaaatgtgttcagaggctg

SEQ ID NO: 50160 - DNA, 201 bp, Homo sapiens
tctgtctcaaaaaaaaaaaaagtcaaggaagatcaaatactcaaggctcctagtgatcatcaattagacatccgagttcttctgggaggtcctgtttgccrgtggtcatcctgtcatttccatcagtgatgtctggaaggtttgataccaagaagttacctcctttcaaagtggcttcttcttccagctactaggtttgac

SEQ ID NO: 50161 - DNA, 201 bp, Homo sapiens
ggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtcca

SEQ ID NO: 50162 - DNA, 201 bp, Homo sapiens
aacatgccgattttttactccaaaaagaactgagtgtgcaaagcaaaccaagaaagaaatgtggactgggccaactaatgggtttctaatcattgttaatstacaagtgtgatcagtttattataaagtgttaatttttcctgtgggtaatacttggagaaatacagtataccactcatttccaaagtgatgaaatggctt

SEQ ID NO: 50163 - DNA, 201 bp, Homo sapiens
agctgcaatgtgtattgtgtcaatcacacaagaagttttgttctccctattattcctaaaagccagctgtttatggctaaagattcagttttgagtccttycatatcaagatgaatatttataggtgcccattgttatactcaacaagggtgaactaagagttctcagtcctggtcctcgtatgccggctactcacacaaa

SEQ ID NO: 50164 - DNA, 201 bp, Homo sapiens
aatcattatgctttgagttatattgacattccatagacagatgtcatttcatgatttttaagcagtcaattttcaattactgcataatattcttccatttrgagatacatattttagttcagtattattgtggcacacttattttctatatttcctttttttctggagacagagtctcagtctgttgcccaagctggagtg

SEQ ID NO: 50165 - DNA, 201 bp, Homo sapiens
tgacaatgattatttagaatctctgagcagctcagactcagttttttttgtaatgccagcatataggtcaaatgtgaattccttacaattttttctgaatkggaagtttagggaacgactccaatgttcctgtagtcgctgtaagtcgtttaggtgtgctataggatgaaaagaagaataatgaaactgtggtatatgcat

SEQ ID NO: 50166 - DNA, 201 bp, Homo sapiens
cttgtgcccccaacactgtggaatgggaactgaatcagtcgtggggaggaggggtctctgcaaacgtggcaggtcacagaagatggacagcaagggccagscacggtggcttatgcctgtagtcccagagcttcaggaggccaaggcaggcagatctcttgagttgaggtcaggagttcgagaccagcctggccaacatgg

SEQ ID NO: 50167 - DNA, 201 bp, Homo sapiens
ctttctgtttggcatgcaggaaagtgaacctctttagtttagaatatgggttggatatgcttgccaggtctgggctattccctgctgcctctgagcgaaarctcaggaagccagaacctgaatctcttcgaggaagttctacagctgacttttaatcattgggccatagcacaacacctattagctcgcttacgtctaggt

SEQ ID NO: 50168 - DNA, 201 bp, Homo sapiens
ggtggttctcaaactttggtgaatcagagccacctggaaaacatgttaaaaatggaaaggtcccatcatatcatcaacagccctgatcattctgatacacwcccaaattggagaaccagtggcacaaacaaatgcccaaccctcgtgggctattcacaaggcaaacaaaaatcaagctatgcttgggaggcagagatccac

SEQ ID NO: 50169 - DNA, 201 bp, Homo sapiens
gtcaatgatcagctattgagtaagcaaagtgaattaatgatctttatatgccatgtgtcatgtaattctatcctctcacttccaggagatttggaaggcakccaggagtccctctttcctctctgttgcctggctgacctccttcctttaaaacccttctcctcttttttgtatcataatgaccttattttgaattatggt

SEQ ID NO: 50170 - DNA, 201 bp, Homo sapiens
agctactcaggaggctgcggcaggagaattgcttgaacctgggaggtggaggctacagtgagttgagactgagccaccgcactccagcctgggcagcagaytgagacttcatctcaaaaaaaaaaaaaaaaaagcgggggagggagattaatcctggtgcccttctagaactaccacctggcctttcttaattgtccactt

SEQ ID NO: 50171 - DNA, 201 bp, Homo sapiens
tcaggaagccagaacctgaatctcttcgaggaagttctacagctgacttttaatcattgggccatagcacaacacctattagctcgcttacgtctaggtcrgtagaacctcctctggacctcagctactcttcccactctgcatctcgagacacttgccttctttccatgtgacttatcgctaagctcctgactgcatgaa

SEQ ID NO: 50172 - DNA, 201 bp, Homo sapiens
ttttcaaggtcttcttacatttgtaacatttgttgtcctacatagtcttcatacaaactataaattgagcatgagagacattcttttttttttttttttttccaagactaacttttgctctgtagcccaggctagagtgcaatggcatgatcttggctcactgcaacctccgcctcccaggttcaagcaattatcctgcct

SEQ ID NO: 50173 - DNA, 201 bp, Homo sapiens
cccggttaatttttgtatttttagtagagatggggtttcactatgttggccgggctggtctcaaatccctgacctcatgatccgccctcctcagccttccraagtgctgggattataggcatgagccaccgcacccgccctggcctctttaatgattgtttacttgggtaggtaaagtcttccagtccttttcattctctc

SEQ ID NO: 50174 - DNA, 201 bp, Homo sapiens
gtacagcagaatccccaggaggatttgtttaagtactcattgctaggcgtactaccctggtttctaactcagttaggtatattaatttcctagggctgccrtaacaaatcactgtaatgttgatgtttaaagcaacagaaacttattctctagcttctggaagccagaagccaaaatcaaggtgttgccaaggcatgctcc

SEQ ID NO: 50175 - DNA, 201 bp, Homo sapiens
ccactctgcatctcgagacacttgccttctttccatgtgacttatcgctaagctcctgactgcatgaacctccttccttccactggtccaagtgacatcaytcccccgtcctcactcccaataccaccacttcagtaacctcccacatgttttcctgctctactttaatccagtctacacagagagagcagccagccacta

SEQ ID NO: 50176 - DNA, 201 bp, Homo sapiens
acatgacagagtgggctctgtctatgttgtacttaatattattgtagaaagaaaaattgagtatatcttgtgaaaaatagttccatttgaaagtccatttstttcaaattcaaagaaagaaaacaactaaaatacgtaagtctaaagggcatggttgatttaggattttcgagtgggaagactattaaaagagatgcttgc

SEQ ID NO: 50177 - DNA, 201 bp, Homo sapiens
tagatgaaaggtctttagacgaccttagatcatcaggatagacccattttcaccataaaagtccttataagaaggaggcagggccaagcgcggtggctcaygcctgtaattccagcactttgggaggctgaggttggtggatcacttgaggccaggagttcaagaccagactggccaatgtggtgaaacctatctctacta

SEQ ID NO: 50178 - DNA, 201 bp, Homo sapiens
tcatagaaagctctcttggacagccctattctagatgctttattctcaaacatgccacaggataacacataagatattggcatggataccattctatttgrtttgggacagaagaaataaggaaaaatgtttctgaaacagggagtccattttagattattttatatgaagttatcaatagtttattaatatattgattaa

SEQ ID NO: 50179 - DNA, 201 bp, Homo sapiens
tgagggcaggaatgtgtgtcttctttgttcagtgaagactcccaaacacccagaatcgagcctggcatgtagcaggtgttcagtggcttcattgaatcaaygaatcatgtttaaatttgtaacaaaatgactctggctgctactatgcagaggacaggttgtagagagaaagtggcaggggggaaaacagaggaggagtca

SEQ ID NO: 50180 - DNA, 201 bp, Homo sapiens
ttatggtctgccactcatccacaaccaccagcatttgtcttgacaaaccaccaacatttccctcccccgccttgactgtgcatggatttgcatatttatakagttaaagaatcacccaccatggttctctttcttatccacattcttgtcttacccatccgtctctgtcactctcctgatatacctcttccctactaatta

SEQ ID NO: 50181 - DNA, 201 bp, Homo sapiens
tctcatcttgagattcttcattacatctgcaaagacacacccccacttattttccaaataagattcatgcacaggttccagggataaggacatagaggtaycttttagggagccaccattcaattcatggcagtagacctggaatatggggcctgagattatgcttttttgtacttctaacatgttcacagttgatgctaa

SEQ ID NO: 50182 - DNA, 201 bp, Homo sapiens
ggggtgttttctgcttggttttgtccattataaactgttagattaaccatttgtacagccaatgaaatagctttaagggaggcactcaggagcttgaacaygtccacagaaattccaaggtctctccagtatcaacttgcagtacgtcaagccagtacacatgggagagccttgaaggggtacaagatcaggctcccctct

SEQ ID NO: 50183 - DNA, 201 bp, Homo sapiens
gctgagatgagctcttttcactaagcatgatgcccctgagattcatccaagtactcacatcaaccgatagctggttccttttgattgctgagtgatattcsatggtatggtatgccagagttcgttgaaccattcacccactgaaggacatttgactttgttgctagattgaagctactgcagatagagccaccctgaata

SEQ ID NO: 50184 - DNA, 201 bp, Homo sapiens
aaattaagcattatgtcttttttttatggtctgccactcatccacaaccaccagcatttgtcttgacaaaccaccaacatttccctcccccgccttgactstgcatggatttgcatatttatagagttaaagaatcacccaccatggttctctttcttatccacattcttgtcttacccatccgtctctgtcactctcctg

SEQ ID NO: 50185 - DNA, 201 bp, Homo sapiens
taggagaactgagaatacaaggcaaaccacacctttctttgtccagcatgattaacggactgtggaagggccctaatttggagttccattcatgggatttrgttttatgacatcctccagtcccaggcttctggtatgacttgcagaggcattggttaacctggtggaaaatggattactactcaacgtgtttaccgatac

SEQ ID NO: 50186 - DNA, 201 bp, Homo sapiens
ggcatcacagagaagtgggacaagggtgtggaccaaagaaacagaccaaggagcgtgggcgaactggagggttcctgcccatgtcctgcccactttctgtyccaggtttcagaggagcaaagagccgttgcccaagaaataatggctcagccatctttaccctgtctcaaatgcaagtctctaaatttgttcctcctcctt

SEQ ID NO: 50187 - DNA, 201 bp, Homo sapiens
gcttgaacatgtccacagaaattccaaggtctctccagtatcaacttgcagtacgtcaagccagtacacatgggagagccttgaaggggtacaagatcagsctcccctctgctctttgaacacactgagcttgtggctgcctcaaagccttcgcaggcattatccctcttgcaaattttttcatgggtagtgcttcctgtc

SEQ ID NO: 50188 - DNA, 201 bp, Homo sapiens
gataaagttcaagcagtgcaaatactaaataagcaaattaagcattatgtcttttttttatggtctgccactcatccacaaccaccagcatttgtcttgasaaaccaccaacatttccctcccccgccttgactgtgcatggatttgcatatttatagagttaaagaatcacccaccatggttctctttcttatccacatt

SEQ ID NO: 50189 - DNA, 201 bp, Homo sapiens
ccagttattctcactcataatttctttctccttgggtttttgttttattttggaacggctttttaaccttcagaagtacattttgtctggaggaccagagyatcgatgtgatcctacctgtagattcttggcaagagagaaaatgttcttattaatgcagaaagtcctacccagaaggaagaaaacgtctcacctagaaaa

SEQ ID NO: 50190 - DNA, 201 bp, Homo sapiens
cctagataattctgatgggtttttttttttcttttttggaaaggatttaacagatattagagaaaacttagagggagtcttgggactccttgatggccacraaagggatgacttttaaagaaatcgatccagaaatgtctatgtggctgccctttctcttctcgttgtaaattttctcacagtgaacacaggtgttagaga

SEQ ID NO: 50191 - DNA, 201 bp, Homo sapiens
tctgctctttgaacacactgagcttgtggctgcctcaaagccttcgcaggcattatccctcttgcaaattttttcatgggtagtgcttcctgtcattcagktctcagatcaaacactacctctttaagagctcttcactgcctactttaaggcatcaccctgttttatgttgtttatataatatttcacaacctgacattc

SEQ ID NO: 50192 - DNA, 201 bp, Homo sapiens
actgcatatatattaataattcacaaatctgaatttcatcctttgcctctcatttggtttccaaatttattttcactcacaattcctacatagtcagacaycttcaacttcacgtttccattttgattctttgtcttgccttccatgtcttgtagcttatctatttttttctgtctcggtaaaagttcccatttgcccaca

SEQ ID NO: 50193 - DNA, 201 bp, Homo sapiens
atttaattaaatgagataatttgtataatgctctagtacagttttaggccatggtaaactccgaattaattctgttcttcactccttatttatagcattgytgagaaaattaggtgagattctgtatttagaagaagaaaagttcccacttaatgatggggctgctcaataaatgttggtcctcttctctagaaaccctga

SEQ ID NO: 50194 - DNA, 201 bp, Homo sapiens
aattctgatgggtttttttttttcttttttggaaaggatttaacagatattagagaaaacttagagggagtcttgggactccttgatggccacgaaagggrtgacttttaaagaaatcgatccagaaatgtctatgtggctgccctttctcttctcgttgtaaattttctcacagtgaacacaggtgttagagatcaagtg

SEQ ID NO: 50195 - DNA, 201 bp, Homo sapiens
agttaataagatggaattctccttttctttttcttattatattttccaaatcaagggcagtagattccagaactccaatgacgtcaggccactgtactttsaaaatgctgttctcagtcaggtttcttattatctgatcctggttcagtagattgtctcagaattgactttttagattaattttgattcttagttaaatta

SEQ ID NO: 50196 - DNA, 201 bp, Homo sapiens
aaggatttaacagatattagagaaaacttagagggagtcttgggactccttgatggccacgaaagggatgacttttaaagaaatcgatccagaaatgtctrtgtggctgccctttctcttctcgttgtaaattttctcacagtgaacacaggtgttagagatcaagtgtttggctttctggtgctctgatgcaggaagttt

SEQ ID NO: 50197 - DNA, 201 bp, Homo sapiens
agcctccagataaaaggcaccatgggcagctaacaagcccctaataggactacatcaagttttactcacctgctgccagggcttgacttctgcgtcttgaygacatgaaaccaggctttgacagcattcatttttgctgaaggaccctcccccagcctccttccataaatcctatgctcctttattccgtattcattcagc

SEQ ID NO: 50198 - DNA, 201 bp, Homo sapiens
ggtcccctcctagctctaagatcagcttctgcttatttcgttgttttgcttcatcatctttacattgcacaatccacgtgtagaaaatagcccttcccttycctttgtgcgccaaaatttacataaagcattgtgtggatagcacactttattgaaattctagaaagttgtatttggagattgtatcaactcccagtggaa

SEQ ID NO: 50199 - DNA, 201 bp, Homo sapiens
atttaattctcatttggaaaataagatgttcagacattgagttatattagaaggaagaaaaccacttctgtgggaacagtcaaatttatttcatttactaytagagaatgttaatttcaagaagcaatctttgaaagcaaccaaatttggcaaagacaagtagtcttccctgagaaatattggacagcaacagattatata

SEQ ID NO: 50200 - DNA, 201 bp, Homo sapiens
aaaccctgttctgtgccttgagaatgctcagtgatatccatgacatttctggaatttcacgggggtgggtgctcacctaccaaaggtcccctcctagctckaagatcagcttctgcttatttcgttgttttgcttcatcatctttacattgcacaatccacgtgtagaaaatagcccttccctttcctttgtgcgccaaaa

SEQ ID NO: 50201 - DNA, 201 bp, Homo sapiens
ttgtgctgcttcttctgtcttctctgtgcccctcttcccatcgtttccaaccaactcagccagtcactgctccctccagcagggaatatgcccctgtgaartgtacctatgggaggatagccatcattggctagacctggaaactagttattctaacccagttaataacaaacccagaacaactgaacccctaaaaggcgg

SEQ ID NO: 50202 - DNA, 201 bp, Homo sapiens
tgggattacaggtgtgcaccaccacgcccagctaatttttgcatttttagtagagatgggatttcgccatgttgcccaggctagtctcaaactcctgaccycaagtgatccgcccacctcagcctcccgagctgctgggattacaggcatgagccacagtgcctggcacgttaatctattttaaaaatctagttggactta

SEQ ID NO: 50203 - DNA, 201 bp, Homo sapiens
atcatgtgctaggtacgtattaggtaggatacccccataccctattctttgtctactgaaattattataatatttttgtgtatatcactaaacattcaaarcagtgggaataatgaagaaaggaagttacactggtttctaaaagccctatcatcagtagcaatttctcaaaagctcttcatgacatcctagagacatcaa

SEQ ID NO: 50204 - DNA, 201 bp, Homo sapiens
acagattcccaccccagtaagaattctgggatcactccaccccaaaagaatgagggttatgttgtccttagtgggaggtggtagttgtggattaggtcctrtcatttcacacactgaccatctctgcccagtaccctgaatgagtgctccatgacatcatcctctttgacctctggccaccttcccttctcctagccttgc

SEQ ID NO: 50205 - DNA, 201 bp, Homo sapiens
gcctggatttgcataatggagatgtcacttgtattgcaggagaaaaatcaagttacctgggctcccattaactgcctgctcgctacagttcccgtaagggrttggaacaccacctttttgaaatagaaaatgtgaaactcctacattcaccaagtgagtctttagtgaaacaggagtgaaaagaatcatgggctattgctt

SEQ ID NO: 50206 - DNA, 201 bp, Homo sapiens
caaacatatattttgtgctttgctcaaagccaggaatgacctggctcatgaaggggttcattagcaagatgcttgaaggaaaggaaaaatttgctagttgmtcgagaaaatataaatgatgaggctaaactcatatttgagatgttctagattttcctggtgagatttcaaggtccaacacaggattctaatattctcaga

SEQ ID NO: 50207 - DNA, 201 bp, Homo sapiens
tagaaaccgggctgcactgcaagaagtgagtggcaggtgagcaagcaaagcttcatctgtatttatagccactccccattccccacattactgcctgagcrctgcctgctgtcagatcagtagcagcatcagattctcataggagtgtgaaccctattgtaaattgcacatgcaagagatctaggttgcaccctccttatg

SEQ ID NO: 50208 - DNA, 201 bp, Homo sapiens
ggcaacaaaaacacactagagattacaaagccaacgtcactattatttttaaaaggctttatgaaaacattagtgctgagcctgggtgatttatggcacaratccatggaaagaacctttcctaagcccacatttcagctagggctttgcctgggagaaaaaaggaagcccttgcttctggaaggctcccctcaccgccgt

SEQ ID NO: 50209 - DNA, 201 bp, Homo sapiens
tgtctcacaacaaactggagttattcatagtgattgcattgttaaatccagacctatgataaatgttcagctaatgaacgaggcaaactgaggtgacccartcctccatccatgcccaacatgaccaaattctatgatttctgtaacctgtatatattcaggattatgggcgaacttacaccatcaccactcttattcctc

SEQ ID NO: 50210 - DNA, 201 bp, Homo sapiens
cattagtgctgagcctgggtgatttatggcacagatccatggaaagaacctttcctaagcccacatttcagctagggctttgcctgggagaaaaaaggaarcccttgcttctggaaggctcccctcaccgccgtctccatatgtgggaagttcagagctgaggtaaaatgaggaaggagaatcaagaccctggaaacatat

SEQ ID NO: 50211 - DNA, 201 bp, Homo sapiens
gagttgacaatcaatattagccatcacagcatccaaagtacttgggacagtcagtgtctcacaacaaactggagttattcatagtgattgcattgttaaayccagacctatgataaatgttcagctaatgaacgaggcaaactgaggtgacccagtcctccatccatgcccaacatgaccaaattctatgatttctgtaac

SEQ ID NO: 50212 - DNA, 201 bp, Homo sapiens
tgtggagaggtaaaagacataagatgatctcaattttgaataattctccttgaggggcaattatatatttttggaaagttcattcttatttattgggcctyctttatctcagaattcaggaaggggcagagtgttttcttcccaagttactgactttcttagcatgcgaggctcaaatgacaatgattatttagaatctct

SEQ ID NO: 50213 - DNA, 201 bp, Homo sapiens
agaaaaaaggaagcccttgcttctggaaggctcccctcaccgccgtctccatatgtgggaagttcagagctgaggtaaaatgaggaaggagaatcaagacmctggaaacatatgcccaagagggagcctgagaatctttgcagaagttgaagttgaaacagaagtttactaagatgctgaaacttaaagaatgaaaaccat

SEQ ID NO: 50214 - DNA, 201 bp, Homo sapiens
ccatataaatgggattcaacaacttcattttctggcctggccaacgaaaacactcacaaagtaaaaacaccatacttactctttctttctgagttaagaamttgtagcttgcctgattatagatcatggcaagtaattctgacatcagttaacgaacttgatgaagtcaggttgggaagtgacatcaaggggcttagagga

SEQ ID NO: 50215 - DNA, 201 bp, Homo sapiens
caagctgccaggaaagtgcactgtaagttaccaaggagcaaacttcagcgcttttccaacagtcacaaaggactctctgccaccatctgtgttgcatgtgygctttacctttgctgtcctccttactttgaaataaatcccacccactacggtgtcccatttcagaaactctaaaatacttacttgaatccctggaatgga

SEQ ID NO: 50216 - DNA, 201 bp, Homo sapiens
ttgcagggagtcactagaaggatcacatgagatgcagcttctacaagtgcatggggaatcagcacccactcagctgaatctgctgtagaaaggattggcaycagggttgcagatagcaagtgaagctcatgcacatgctcatgagtttgcaaactgttttaaacacttgtaaaaatctctcctgagccatttatttaagta

SEQ ID NO: 50217 - DNA, 201 bp, Homo sapiens
gtacatgacatacaaaattattccatgttacttcaatacttttacccagagccttgtaacaatcttcttgaactgttgaatctatacaggtgtagattggrtcaggagatagctttaaaagtttgttgttcacgttcgtgccaactcctggtgtcttagattttgttcccaaacactcattatgacaaaaggatttaagtg

SEQ ID NO: 50218 - DNA, 201 bp, Homo sapiens
tattacattgctaaggtaacctacttaaaactgtggtgcaatatgatgtttttcagttcatttgtctgtttcattaatgatggaatgtattttccagcacrcaaatcctatttatgatcaagacattgttgttctgtatatcaacttaaactcttacactgtgtaatttacctgctgtcaaatctcatttgaagagctgtt

SEQ ID NO: 50219 - DNA, 201 bp, Homo sapiens
cagattgagacttcatctcaaaaaaaaaaaaaaaaaagcgggggagggagattaatcctggtgcccttctagaactaccacctggcctttcttaattgtcyacttggagtgtttgccaagcgaagaaaagatgaacccatgactgtgacctacctggagggtagacattctggagagcttcccctccaacaatgtcccaaa

SEQ ID NO: 50220 - DNA, 201 bp, Homo sapiens
gctccatgcttcgttcctcacgcagaaatgtctttatctgccatataaatgggattcaacaacttcattttctggcctggccaacgaaaacactcacaaastaaaaacaccatacttactctttctttctgagttaagaaattgtagcttgcctgattatagatcatggcaagtaattctgacatcagttaacgaacttga

SEQ ID NO: 50221 - DNA, 201 bp, Homo sapiens
ccagttcaatgggtttcatagccagtctgaggcaaaagctggctatttacttccaaaaggacttctcctcaaggaagagaccccctagtgatacccaaatmataaatcagagttcttaacttgggatctatggaacagagatcagggagtgagtcttagaaggcccgttaacctcccagtatgtggaaaaatgcttcagat

SEQ ID NO: 50222 - DNA, 201 bp, Homo sapiens
tggtagaattagggatggttttaattttcccaatttttggtcagtgatattttcttaatgtttaaaaaggaacattaacagtttttatgataaatgaggaragtttctttacaacatttttttgcatgccattccttagagttgggcagcttttgcaagctgtgagaagcccagctcctgcttttcctgatacggtttatg

SEQ ID NO: 50223 - DNA, 201 bp, Homo sapiens
agggacagttcccatcaatggtataattttggaacctcaggaggaaggataaggaactgagggctaagtgtattcactgaggccctgagacagaagccagrgatggggaacaggaagagaaagtaaagccaatgaaaagaaagggaaggcatgctcagagaggtaggtgggaccgccagcctaaccaaaacaggggcgatt

SEQ ID NO: 50224 - DNA, 201 bp, Homo sapiens
taagcatttttttaaaggttacttttcctttatgtgtttacttggggttaaaattttgggattatgacaaaggccatattttgagattatgacaaaaaatwattcaaaaatgaattattgaatgaggaagttgggtctcattcagtaggttaggtctcctttaaaattgtatttttctcgtatgaagacccagttcaatgg

SEQ ID NO: 50225 - DNA, 201 bp, Homo sapiens
tctaccaagagtgcattattaatgacacattcaactgaaaaattgatcacacgctcttaggtattacatgggtcacatttgcaataattttggtttttacwgctgaaaggcaaatttaaggtaaaaatcaaatactttaaaagtatatatcttaatatgccttcctcttaacattcatctagtaaggggggagatgtagaa

SEQ ID NO: 50226 - DNA, 201 bp, Homo sapiens
cagccaaagacccatcattaaagagcacaaagacatccttggccagtatctttctggatgctgatgcttttctcctgaattgcatgtcaccttggagaackcagtgatggatgagagagatccagctttgacctggaaaactttcacattgcaagtttttttttctttttctttatagatttatagtcaatacttcagcct

SEQ ID NO: 50227 - DNA, 201 bp, Homo sapiens
ggtgctgttatcatttgcatctactgggtgaggagactgagacacaatggggctgtttcttgctctggacacttagctagtaggtggcggaagagggcctyagaccttagcagcatggctctggctctggagctctcctctttttttttttttttttttttttgagatagggtctcagtcctgtctcacaggctggagtgc

SEQ ID NO: 50228 - DNA, 201 bp, Homo sapiens
caaagtgctgggattacaggtgtgagctaccacacctggctgagatgagctcttttcactaagcatgatgcccctgagattcatccaagtactcacatcarccgatagctggttccttttgattgctgagtgatattcgatggtatggtatgccagagttcgttgaaccattcacccactgaaggacatttgactttgttg

SEQ ID NO: 50229 - DNA, 201 bp, Homo sapiens
tgtcttgtcaataagcatttttttaaaggttacttttcctttatgtgtttacttggggttaaaattttgggattatgacaaaggccatattttgagattaygacaaaaaataattcaaaaatgaattattgaatgaggaagttgggtctcattcagtaggttaggtctcctttaaaattgtatttttctcgtatgaagacc

SEQ ID NO: 50230 - DNA, 201 bp, Homo sapiens
gccagtatctttctggatgctgatgcttttctcctgaattgcatgtcaccttggagaactcagtgatggatgagagagatccagctttgacctggaaaacwttcacattgcaagtttttttttctttttctttatagatttatagtcaatacttcagcctttctatgacaagaagcttatatttttctggactagatgtaa

SEQ ID NO: 50231 - DNA, 201 bp, Homo sapiens
tactatgtgctaaaccctgggtttattcaagtctttcatcctcacaacagtatgctaagggaagctgttactgttactggtgctgttatcatttgcatctrctgggtgaggagactgagacacaatggggctgtttcttgctctggacacttagctagtaggtggcggaagagggcctcagaccttagcagcatggctctg

SEQ ID NO: 50232 - DNA, 201 bp, Homo sapiens
ttccaaagtacattcattcattcattcatccacctgcttgcccatcagacatgtatgtgcgctatgcctcctcttttccaggctctgtgataagctagagygcagggcagtgagtgaagtgaacagggtccctgacctcacgaagcatggctggggacaaccagccaaccagcacatcgatcctgaatgacccctcatgat

SEQ ID NO: 50233 - DNA, 201 bp, Homo sapiens
acagtctaactctctgagtgtcatgtcttcctgtggcccggggaagagagtgggaaggaaataaaatttcattgagcatctacataggaccaggccctgtragttcttggatattggtttcttcttataatgacttgagaattacatggaattatccccattatatgagaagacagagtctcacaggagttaaatcacttc

SEQ ID NO: 50234 - DNA, 201 bp, Homo sapiens
ttgcagtggatatcatcctctccagtttacaaatctagaaaacaagtacatcaaagcagttaagcattttcgtaggagccgcacactcagtaagctaataktagaactcaggtctgtctgatttcagagctctttccacactacctaaaatattcatgcaccagatgaaagctttcttttttcccctagactgtttcttaa

SEQ ID NO: 50235 - DNA, 201 bp, Homo sapiens
aatcaaatactttaaaagtatatatcttaatatgccttcctcttaacattcatctagtaaggggggagatgtagaattttgatataaattggccagccttrtgttgatttatctttaacacagatttcaactccttcacttcagttgccatgaactgcaaggcccttgttcagtctggcttttcatctctttcctgcccaa

SEQ ID NO: 50236 - DNA, 201 bp, Homo sapiens
agtatctttctggatgctgatgcttttctcctgaattgcatgtcaccttggagaactcagtgatggatgagagagatccagctttgacctggaaaactttsacattgcaagtttttttttctttttctttatagatttatagtcaatacttcagcctttctatgacaagaagcttatatttttctggactagatgtaacaa

SEQ ID NO: 50237 - DNA, 201 bp, Homo sapiens
tgggatttcaagcatctataccgagagatgccaacgaaaccagccaggagcaaaattaccagaattcttgaaccaggcagaaccagggcagatggcatctsaagcaccttcgcagaccagcgccggctgacccagccagaactggaactgggtacggtgtcaattccacttgtactcagcagtcagagaaccgtgtgacct

SEQ ID NO: 50238 - DNA, 201 bp, Homo sapiens
aagtcttaaatggaaattgattccctactccttctattttaactgtcaaaatcatagactgcattgtttccaactgaaaatccgctgacagctccccaccraccaccccgtgagccttcccagggctggcgttgatgatgctgctatcaatggggaatctacattgtgcacgggtatttatgatgagaaaatcatgtggca

SEQ ID NO: 50239 - DNA, 201 bp, Homo sapiens
actaccagatactgaattcctgttctgggccatgcactctaggagctgtgatttcaacagtgaaggaggacagggtggaccccaccatcgtggaatttacmttctaaagggcacagtttttctgttgagtcttcccaggaggtgtctttttatttcatacctttgaccttcagatccattcatgatactttggcttatggg

SEQ ID NO: 50240 - DNA, 201 bp, Homo sapiens
agcagctctcaaattttcgtgggcatcagaatcaccaaggatgtttgtaaatgtttttaaaagtcaattttcaagactccattaaatggagattttgatawatacaatcagagttaaatatgtgtatatataaaaaatatctttaagctagagtctcttatcagtgagactttgggctctacgtgcagagagactggttta

SEQ ID NO: 50241 - DNA, 201 bp, Homo sapiens
tcaccttggagaactcagtgatggatgagagagatccagctttgacctggaaaactttcacattgcaagtttttttttctttttctttatagatttatagkcaatacttcagcctttctatgacaagaagcttatatttttctggactagatgtaacaaacgactttccaagtgatcagtgacatcccaagttagggctgc

SEQ ID NO: 50242 - DNA, 201 bp, Homo sapiens
cacgtagccatgattattataatgacagcgtgtctgagtggagcccggatgaactggcaagcgatgaccacctgtggactgcagcgggaaggtccgcagcytggggctagaaccacaagggagcgtgatgcacacaggtgtgcttgcacccacggctgaggtttttcttcccaccggcacagggcgctgaggcagggattt

SEQ ID NO: 50243 - DNA, 201 bp, Homo sapiens
cttcaacatctccccagggtacattccctaaatagccccgattattcattattttatggaactaccagatactgaattcctgttctgggccatgcactctrggagctgtgatttcaacagtgaaggaggacagggtggaccccaccatcgtggaatttacattctaaagggcacagtttttctgttgagtcttcccaggag

SEQ ID NO: 50244 - DNA, 201 bp, Homo sapiens
tcaataaattggtctgatttaaaattagcctataaagacattttttaaaagcaaatgcttaacttcaatactacatgacaagagggtgatatacaaaaaawagttactatgtggttcttggcatcaagcagattaaagtctactttgaaataaagaccataataagtagttgaccccataaaaattaagcaataatgggaa

SEQ ID NO: 50245 - DNA, 201 bp, Homo sapiens
ggcttctcagctcttgcacagtagcctatgggttgggacggctaccggatggcccaactccaggatggggtcatagtgcggagctctgtgagtggtgcccyctagaggaaacttcctgaaggaatgaagcttcctgaactcatgcaatttggcaaccctgggttctccccaatgctttcaagacatagtaggttggagcaa

SEQ ID NO: 50246 - DNA, 201 bp, Homo sapiens
ctggaaaactttcacattgcaagtttttttttctttttctttatagatttatagtcaatacttcagcctttctatgacaagaagcttatatttttctggastagatgtaacaaacgactttccaagtgatcagtgacatcccaagttagggctgcattttgaaattgttctttagaatctctaacttcattgggaacagtg

SEQ ID NO: 50247 - DNA, 201 bp, Homo sapiens
cctccagctggtcttaaaatatctttatcatcccaaaaggaaactccagagccattaagtagcctctcccacttcttcctccctgaccccagtccctggcwaaaaacaacctcctttctgtctctgtggatttatccattctggaccttccatataaatgaactcattcaatctgtgacattttcgtgtctggagtttttc

SEQ ID NO: 50248 - DNA, 201 bp, Homo sapiens
ccaccttcaacatctccccagggtacattccctaaatagccccgattattcattattttatggaactaccagatactgaattcctgttctgggccatgcaytctaggagctgtgatttcaacagtgaaggaggacagggtggaccccaccatcgtggaatttacattctaaagggcacagtttttctgttgagtcttccca

SEQ ID NO: 50249 - DNA, 201 bp, Homo sapiens
cagctcttgcacagtagcctatgggttgggacggctaccggatggcccaactccaggatggggtcatagtgcggagctctgtgagtggtgccccctagagraaacttcctgaaggaatgaagcttcctgaactcatgcaatttggcaaccctgggttctccccaatgctttcaagacatagtaggttggagcaaaagtaat

SEQ ID NO: 50250 - DNA, 201 bp, Homo sapiens
ggtaatttcattcaaagatgtaaaggaagagatactataagggacatttctgttattttgtcaaatgctattatttactgaaaaataaaatttcaccctayatgcttgaccttcagggacttattttaagatcatatggcttttcctaaacagctgaattatttagtgagattgaactctcaaagactttaaaataaagcc

SEQ ID NO: 50251 - DNA, 201 bp, Homo sapiens
tggcacgtacctggccttgaaatgcactgaagcctatggggattactttaaaattcggtcctgtaagccagtctgttagtatcattgctcctactaatgayagaaattgctggtgttggccgggtgtggtggctcacaccagtaatccaagcactttggcagacggaggtgaagggatcacttgaggccaggagttcgagc

SEQ ID NO: 50252 - DNA, 201 bp, Homo sapiens
taaagatattgaaactgaagtttaaactcggtaaggaacttgctcaaggacaatacttcttaaattttgctatacattagaatcacctggaaagatttttwaaaatcttgacccagaggttgagtaatgtgctcaagggcacccacctgatgagtggcagaaccaggctttacaacccagtcactgagcaccagaaccatg

SEQ ID NO: 50253 - DNA, 201 bp, Homo sapiens
ttactgtgggtcgatgggtcaaacatgaggcaatttggggaaacagcctaaggtggctataccacagaggccagcagagcaggtaaccaggcacaagatgygatcgctgacgagagagctgctgtgacagagtaaggagtgcatggggaggagggaccactgaggtttgtctgcgtgtgggtaccccatgcgcagatcctc

SEQ ID NO: 50254 - DNA, 201 bp, Homo sapiens
tcaatttcctcaggcttctgggtcattaaggaggagctttatcacctggctgcagggtggaggaagccaagattctggaccgatagcctcccacagctgcrttagtattccacaaaggcgcaaccagaagatagcaaggaactttcacacttggctttaatttctctctgcacattttgttagcgataaagaccatcatgt

SEQ ID NO: 50255 - DNA, 201 bp, Homo sapiens
gcaaggggagacggagatgggaacagaagatttcccagatgaggggcgctccctggagctgagtcttggagccagatggacttgttcacaccagcatggastgaaataaggagaatcagaggacctgggctcataccctgtctctagaggctccaaaggagtccctgaggtaaaactgagattattctagagccacctgga

SEQ ID NO: 50256 - DNA, 201 bp, Homo sapiens
tatttcctctctatattgaaatattcagcaactaatttcctgtagcttcatagtaaatcatgctaatgacctcagaggtggaaaccaaggtggtgagactktctccctgctctaaggttattccattaaacaaagcagagaatacacatttatactcatttgatcaggaagcataaggaagcttataatgagaaagacatg

SEQ ID NO: 50257 - DNA, 201 bp, Homo sapiens
gacggaggtgaagggatcacttgaggccaggagttcgagccagcctggccaacgtggtgaaaccccgtctgtgcttaaaaaatacaaaaaattggccaaaygcagtggctcacacctataatcccagcactttgggaagccgaggtgggtggatcacctgaggtcaggagttcaagaccagcctggccaatatggccaaag

SEQ ID NO: 50258 - DNA, 201 bp, Homo sapiens
tcataaagatgccttcaaggagacactcttattatccccattttacagggagaaaaaaatgagcctacgttcagcaattttaagcaaattttctattgtckcatgactagtaaatagtggaataggccagttttgttttttcaccttgactgactgcaaatgtctcagtcatgattcctgaccatcttctaaccctctaag

SEQ ID NO: 50259 - DNA, 201 bp, Homo sapiens
ttataaataacaagaattgactgtacttgaatgtgcatgaagtatagaatcatagtggaacatttaagaaatatgtccttatcttgttactatggctacaygttactccaagatacagtagttctatggtaaggttggaattacattatttcctctctatattgaaatattcagcaactaatttcctgtagcttcatagta

SEQ ID NO: 50260 - DNA, 201 bp, Homo sapiens
gggcctttgctactgcaagtgccagaaacttaaatcaaagtggctgaagcaaaagaacactgcatgcctcatgtatgcgagaagtccatgaatagggctgscttcaggcctggctgggtgtataaattcagatggcaccctccaccaggacttcgtcttcatctctttgcttggcttttgtctgtgttggctccattcccc

SEQ ID NO: 50261 - DNA, 201 bp, Homo sapiens
agtacatggtaaactctcgcaccatattaactattgcagtatggtgttattattattatgaatatctaatacagttaatatctttgtacgtaggagttttrgcaggcaggtgtgaatggcacttttgaagatgcagagacagatttatccttatactcctaatatttatcctcaaagacactatttaactcattcaaaaat

SEQ ID NO: 50262 - DNA, 201 bp, Homo sapiens
tgaataacctaggatcatctccccatcctaaaatatttaattcaatcacatatgcacagacatttttttccaattcaggtagtatttacaggttgcagggstcaggatctgacatctttgggacccattatcagtctactaactatgttattaaatatagcttgcaaatatgttgtcgaggattttgtttttatattcctg

SEQ ID NO: 50263 - DNA, 201 bp, Homo sapiens
tgcacctgcacagtggaggtaataatagtgcctgcctcataggattttccagaggattgaataagataatctttgagagtattccagtacatggtaaactstcgcaccatattaactattgcagtatggtgttattattattatgaatatctaatacagttaatatctttgtacgtaggagttttagcaggcaggtgtgaa

SEQ ID NO: 50264 - DNA, 201 bp, Homo sapiens
ttagtgtatagaagtttcgaagaagcaaacatgagtgttgttgcccccatcctagaacacagactctagaatcaatcagatttagaccctaattctggccytgcccctcttcttgttgtatgtattaattaaggtaatgtatgctgctataacaggtatgccttcaaaactcaggatcttaacaagttggtacttatttcc

SEQ ID NO: 50265 - DNA, 201 bp, Homo sapiens
ggatggcatgactaaagtcaagcattagcatagtgcccaacactcaggaatctggcagaaagtcaaaagttacaccgatcagtgtcattattagtatgcawtttcattcttagtcttcttgggatttaattgtattacctaatttatgtaatgagactatattttcttttctgtcccatttctattaaacttagatacgtc

SEQ ID NO: 50266 - DNA, 201 bp, Homo sapiens
tctggctctgagcacagcaccctgacaccatcataagctgtaactacaaattcaatggaattagtatgaaggtaaggagccagcaggttctggtggctcaytgaggcattactgttcttgtttttgagatggagtctcactctgttgcccaggctggagtacagtggtacgatgtttgcttaatgcaacctcagcctccta

SEQ ID NO: 50267 - DNA, 201 bp, Homo sapiens
gacaatatttaaaatgaatggacatgacagtgttccagtaaaacgttatttccaaaaaaaaaaaagaaaaaaaaaggccagaagaccattgttttgcagayctcttgcatgaggcttttaaaggtattaaaacattttcgcacccctgtgcctgttttcctgaaagtttagagatcctgagttggaacactgatttgcatt

SEQ ID NO: 50268 - DNA, 201 bp, Homo sapiens
gaatatatagtgaaaattcctcctatgtgcctaaatcttcctcggtacccttccccagaacagccactgtgtcttcccagaaattgtgttaagaaacaaayatgtatatccttttgtgctgtgttttgtagaagtggaagctttctgtgcagccagttttgcattgtgttcctcaccaacaggatctgtcggacgccgtgt

SEQ ID NO: 50269 - DNA, 201 bp, Homo sapiens
cctgagtatcttcttcccactggtctctggggtcacagggggcaaagacctcacctcactcatcttggtctctggctctgagcacagcaccctgacaccawcataagctgtaactacaaattcaatggaattagtatgaaggtaaggagccagcaggttctggtggctcactgaggcattactgttcttgtttttgagatg

SEQ ID NO: 50270 - DNA, 201 bp, Homo sapiens
aatatatagtgaaaattcctcctatgtgcctaaatcttcctcggtacccttccccagaacagccactgtgtcttcccagaaattgtgttaagaaacaaacrtgtatatccttttgtgctgtgttttgtagaagtggaagctttctgtgcagccagttttgcattgtgttcctcaccaacaggatctgtcggacgccgtgta

SEQ ID NO: 50271 - DNA, 201 bp, Homo sapiens
tcaagtcatttctgatctggtgccttatcctgcagccacagcccctgccacttcctcctttcacgactatcttatcacagctgtcctgttatttgtgattstcccaacatccctcaggaacatttgccttccttgaagtcctttttcttcgggtcctttccagagtcagagtgggcttttcttgacatccttatgggaaag

SEQ ID NO: 50272 - DNA, 201 bp, Homo sapiens
aactatagagaacacagccaaagatccctgcctctcccaatcttctgggcctctttctttaggaaacaaacataaacctgcccaaactgaggttgtaccckttttacctgccctgttaccttcctagcatccatcttgctgtccttcattctgccaccctggggttcctatcaaactctgcttcctgtctcttatgactta

SEQ ID NO: 50273 - DNA, 201 bp, Homo sapiens
tatgtgtatgtcacgttaaccagaatggtattcaacaggcatccctaactgcagcagcagctggagaagtaagatttagttgcaaataccaataattcaarcacaattggagtttggttatcaaaggacaaaataggccatagatatttcaaaaaaaatggtatgttcaaagtattattttaaaaaggccagggatggggc

SEQ ID NO: 50274 - DNA, 201 bp, Homo sapiens
agaaactttgagcagttatatgtgtatgtcacgttaaccagaatggtattcaacaggcatccctaactgcagcagcagctggagaagtaagatttagttgsaaataccaataattcaagcacaattggagtttggttatcaaaggacaaaataggccatagatatttcaaaaaaaatggtatgttcaaagtattattttaa

SEQ ID NO: 50275 - DNA, 201 bp, Homo sapiens
gtcggcagatcacaaggtcaggagttcgagaccagcctgaccaatatggtgaaaccctgtctctactaaaatgacaaaaattagccgggagtggtggcacrcacctgtaattccagttattcgggaggctgaggcaggagaatcgcttgaacccaggaggcagaggttgcagtgagccgagatcgcgtcactgcaccctag

SEQ ID NO: 50276 - DNA, 201 bp, Homo sapiens
cagttttcctatggtaatcagaaaattgagtctttattggaacaaaaatggtctttgtctcctctgttatcttagagttccttccagaaagcattctaagrcctctttgacattagacatttttattaggttaaaaaaaaccccactgccttatgatgggaactttcttagtgtagttattttgatttcctagtattactg

SEQ ID NO: 50277 - DNA, 201 bp, Homo sapiens
tttggggaaagccctcatgcagcgacacggggcaatggtagttgtctgccttgtgaaggagtaagacccggggctatgactagggtatcagcagagcctgytccaagaatggttaagggtttggtttgggacatgtagagttcaagcaacctgggaggcacctaggtgatgtgactcagacctctgtcaatactggctgga

SEQ ID NO: 50278 - DNA, 201 bp, Homo sapiens
aatgatatggccctgtccagggaaggctgagtgccctttgtcctcagacagtgaattctggagttccaggtacatgagcatcagggtgtgatctagaaagsagcctgtggacctagttgggcgtattctcttggtcctggggattctttgtgccatggagaagagcatagtttgagggaggtcagaatgggaggccagaac

SEQ ID NO: 50279 - DNA, 201 bp, Homo sapiens
tggctttttttctaaatcctgacttgtgtccagttgcttaaccagatttagaagaagccatgtttacatggaatttctgaattacaagctgagaaatgttyccagaagatattttaaagcctccttaagaaggctagtgggccttatttcctgtgtgaaacaacttttatcaaaatgtatttgacactgggagtgtgggtg

SEQ ID NO: 50280 - DNA, 201 bp, Homo sapiens
agtggaaaaaaaggccacccttcattctttttttttttttttttcattcaacaaacatttattgatcttctaatgttttttcaagaatgcttttgggcctsggatacaaactaatggacccaacagatgagtcccttgccctattggcacttactggttcatgtcaggttcctgtgcctctcctggagaagcaggtgataa

SEQ ID NO: 50281 - DNA, 201 bp, Homo sapiens
cccatttatttatggggaatatgtgattattgtattttccctactgagattcaaagctatacaaaggaaaggactcttctgccttttttttttttttttttggtttttaactcattatgaaatccccactgctgagcacaatgctgaacacctttgaagtaattaataaataacgactaaattactgctgtgtagataagg

SEQ ID NO: 50282 - DNA, 201 bp, Homo sapiens
aaacagatgtggaacaagtttttaaagaaggaaccctatctcataagattgtcaggatcattaaacatcacgagtatgagcccacaggaaaccttcagtayatcgtgatcttcttgacggtggtgaagaaggacaaggaagaccaccaccataacacacgggtcttctttggaatggaggttccaggatctatggggaatt

SEQ ID NO: 50283 - DNA, 201 bp, Homo sapiens
tggtgcagtgacccttctttgccagtttgtcttgggtcctgatgagctgccaggctcagtctggaaaagtgccctcaatccctgcatctccatctctcatwggcattgtgggaccccacaaagactctgtctctattcgcttaacacagtggaaaaaaaggccacccttcattctttttttttttttttttcattcaacaa

SEQ ID NO: 50284 - DNA, 201 bp, Homo sapiens
tcagccttaatatttcaaaaactatggttttcagtttgagctgttatgatgttttatctcagaagttgtagaataatttaaaccagtttttcctactttgsttccttggaggctgattcttctgcctgaattcctctcacagaacatataaaccccttttacctcccgcactggcacaaaagcaacttgtttccaagattc

SEQ ID NO: 50285 - DNA, 201 bp, Homo sapiens
actggaatagctgagatttccagaattcagttagaagatctgataagcatctaaaacttgtcctaaggtagggggagaagtgtttagcttggaaatataastcggagttcccagtcttcctcaagtaggtacttggggagatactgaagtaggaggaagatgattcctacaaaccacgccgaacaacagacagttcagaga

SEQ ID NO: 50286 - DNA, 201 bp, Homo sapiens
tgccatgccttagccaaacaccctataaatataataccccttcagccttaatatttcaaaaactatggttttcagtttgagctgttatgatgttttatctsagaagttgtagaataatttaaaccagtttttcctactttggttccttggaggctgattcttctgcctgaattcctctcacagaacatataaacccctttt

SEQ ID NO: 50287 - DNA, 201 bp, Homo sapiens
taaatagggacgttaacgctgggacgtactctgctggtttgttttgaagagaaaatgagctaatgcaagggagagggagctcagaccacagatttgtgcaragaaagtgccgaataagtgacggctgctgtttctgtttttattctgcgaggaactctaatagaagaaaaagagcatttgatgactgaatcaccggtcttc

SEQ ID NO: 50288 - DNA, 201 bp, Homo sapiens
gaatagttatgttgccatgccttagccaaacaccctataaatataataccccttcagccttaatatttcaaaaactatggttttcagtttgagctgttatratgttttatctcagaagttgtagaataatttaaaccagtttttcctactttggttccttggaggctgattcttctgcctgaattcctctcacagaacata

SEQ ID NO: 50289 - DNA, 201 bp, Homo sapiens
gtgctgagattacaggcatgagtcaccatgcccagctctctattgattatttgtgaatacttcagcttatttaattttcaaagtaatctttaaaatcggarccattgttatcacactttctaagtgaaaattgatgctcagagagattgtagagtttgctcaagtctggatacctagcaggttatagacctgagacatgaa

SEQ ID NO: 50290 - DNA, 201 bp, Homo sapiens
gtggaaatagcctggatgcaattatctgctacaagccccaccaagaagagcctccctgctggaggaaagcagaaagggaactggggtataaccaagcttgyccaatccgaggcccgtgggtcacatgctgctgagggaggatgactttgaatgaggcccaacacaagttcgtaaagtttcttaaaaggttatgaaattttt

SEQ ID NO: 50291 - DNA, 201 bp, Homo sapiens
ggaggacaggtataaaaatagtacaagggtgagtcttacaaataaattcagagtgctttgggaacatgacctaagggaaatggacccgaagtctgggaagktcagctcatgaagtgacatcttgtcctttaagacttggctctgctaggtagagtaagaaggggtggtacaaggttagcacaatccaggaagagcaaacat

SEQ ID NO: 50292 - DNA, 201 bp, Homo sapiens
ggaggctgaggcaggagagtcacttgaacctgggaggcggatgttgcagtgagctgagaagatgccactgcactccagcctgggtgacagagtaagactcygcctaaaataataaaaagaaagatcccctagggcatgtccctgatggagctgaaatgccaggtaagcaagaggcaggttactaggggtctgatatggctt

SEQ ID NO: 50293 - DNA, 201 bp, Homo sapiens
tacagacaagtacacaggctaagcatgactgcaacttttgaattgtcatgcagctcagaactgggggatctagaaactgaattcagcagctgattatttgrttcccaataccatggtcttgctacttacctactagaaaggattctcatttgtctatttaagttcttctcctctactctctgaggaggattctttcagctc

SEQ ID NO: 50294 - DNA, 201 bp, Homo sapiens
tgtgctgctcgagatgcttgcaatcaacagggcgctccccaagctctgaatgaggtgaatggcctcagaggaaaacagattagaaggcttagagatgactrcatctcaggtgcaacacttgaagcaggaagatgggagtctcagaattttccccttgcagttagaaaaatatgggacaggctggggcagtaggagtggatt

SEQ ID NO: 50295 - DNA, 201 bp, Homo sapiens
caggctgcgggctgaaggctggagattgaaataaggcagcaaattcttgctttcatgaggcttagcagggaggacaggtataaaaatagtacaagggtgartcttacaaataaattcagagtgctttgggaacatgacctaagggaaatggacccgaagtctgggaaggtcagctcatgaagtgacatcttgtcctttaag

SEQ ID NO: 50296 - DNA, 201 bp, Homo sapiens
ctgatttgacaggtcatggcaccctaaatttgcattttcaaaagctccccagggaattttgcttttccagcaggcgtctgagaaccctcatcggacatacrcagtgatgctggtaaagcctgagcagaaacaaaacagggtcccgggggcagaatgggaggcagctctgggtctcttaagatggccctggtgtgctaagtg

SEQ ID NO: 50297 - DNA, 201 bp, Homo sapiens
ccaatgcatgactatcaccttgtcattattaaagcactttccactagtttatattattttattctcataagctctgtgagggccaggatttgggtcttctyttgtcccttgctacatcctcatctatatcagtggctggcacattatctttgttgacgactgacctttccttttcctctttctttgcctggcaaactgtta

SEQ ID NO: 50298 - DNA, 201 bp, Homo sapiens
ttgatactccaataattatatatcataattgaaatccaggttttactcactggagaatttgggcaaagtcctgcaaagcaagagaaactttagttcattawtgaggctcatttttacattagcccgctctcgctacataacaatttttaaatctttttacatttatgatagtcgttactgcagtttcagaatcattaatga

SEQ ID NO: 50299 - DNA, 201 bp, Homo sapiens
cagcaatgagaaaacatcccatcatgcactgcttctagatattgtcaagagaagggtatattattatgcaaaagcagtgtctatttacagatgatgaaacracaatttttcatggggtttttctttttatttaacatcttaactgtcaattccaacaaacacacttgttttcctctatgactaatctaagaaccaagatgg

SEQ ID NO: 50300 - DNA, 201 bp, Homo sapiens
tctgtaaattagatattctggaataaaaaatttggggaaagaggaaaaggactcatgctcccaagaaggccaagtgaaaagtgatatccttctgatagggraagaagtcatgagtcattagtctggactgctatagtaatgataataatagtaagaataataatagccaccatttgtggatcacttactgcaaaccaggaa

SEQ ID NO: 50301 - DNA, 201 bp, Homo sapiens
ctcggtacccttccccagaacagccactgtgtcttcccagaaattgtgttaagaaacaaacatgtatatccttttgtgctgtgttttgtagaagtggaagytttctgtgcagccagttttgcattgtgttcctcaccaacaggatctgtcggacgccgtgtatatagttcttcctcattctctttaatggctatgtgatgt

SEQ ID NO: 50302 - DNA, 201 bp, Homo sapiens
agtattaacttttccacacttcagtatattcatgtgcgtatctactttaaaatcttcctgcatcaccatcaatagcttataattgatactccaataattakatatcataattgaaatccaggttttactcactggagaatttgggcaaagtcctgcaaagcaagagaaactttagttcattattgaggctcatttttacat

SEQ ID NO: 50303 - DNA, 201 bp, Homo sapiens
attatgcaaaagcagtgtctatttacagatgatgaaacgacaatttttcatggggtttttctttttatttaacatcttaactgtcaattccaacaaacacrcttgttttcctctatgactaatctaagaaccaagatggccaacagcacaataccaactttttgtttgtttggtttttaaatatggcaaaattacatatga

SEQ ID NO: 50304 - DNA, 201 bp, Homo sapiens
aaatgatgacctatcagagaggacataaatcactcctcttcccaaattagattaaaatcctgagctttaaaacttgcttttacctgcagactctaatgttmgacttgtggctttgtcatttccccacaggggcagcttccgctggttttacaggacagaaaagttctgtttctattactgaagaggttgaaccctctgctg

SEQ ID NO: 50305 - DNA, 201 bp, Homo sapiens
ttccggccccatgggattccgaaatgagagaaatcaggcccccaaaagaccagccttcatcaggagactcggacgagaaagtcaaaaaacctatgttgaayacagcaccattcttgcagcagtattaacttttccacacttcagtatattcatgtgcgtatctactttaaaatcttcctgcatcaccatcaatagcttata

SEQ ID NO: 50306 - DNA, 201 bp, Homo sapiens
aaacacacttgttttcctctatgactaatctaagaaccaagatggccaacagcacaataccaactttttgtttgtttggtttttaaatatggcaaaattayatatgagcttcccattttacaggtttctaagaacatcttaatgaaaataacagaactcagaaaatccactgtcattttgtccagaaatattttgttagca

SEQ ID NO: 50307 - DNA, 201 bp, Homo sapiens
atgacctatcagagaggacataaatcactcctcttcccaaattagattaaaatcctgagctttaaaacttgcttttacctgcagactctaatgttcgactygtggctttgtcatttccccacaggggcagcttccgctggttttacaggacagaaaagttctgtttctattactgaagaggttgaaccctctgctgaagct

SEQ ID NO: 50308 - DNA, 201 bp, Homo sapiens
ctccctgagatcagttgggtaaagctctgagcacagggccaggcacagtgtacacccttgcaaaaatattaatttgcctgggtgcaaggtgagggacatawccttttcctattctgaaactctactctgcttaggatgcatactgatggctctttttttgtgaatggatggaagtatgaaaggagcagtaagaaagggcac

SEQ ID NO: 50309 - DNA, 201 bp, Homo sapiens
aagtgtcctatcaagaacggcaattgtgtcgtgagtttctgtgaaaagcaagactggtcattccatcacttctgtctgtccaacatgccccagacttgctmttttggggccccatgctgttaagtaaacatcccccagccagtgtgaatatctgaaagcacctgctttgtacgcagcagggtcagagacctttatatgcac

SEQ ID NO: 50310 - DNA, 201 bp, Homo sapiens
aaaggaggaaccccttatagaaacatcagatctcatgagacttatttactaccaagagaacagtatggaggaaaccatccccatgattcattatttcccayatggtcccacctacaacatgtgggaattatgggagctacaattcaagatgagatttgggtgaggacacagccaaaccatatcaccttacaagttccatgt

SEQ ID NO: 50311 - DNA, 201 bp, Homo sapiens
gaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatg

SEQ ID NO: 50312 - DNA, 201 bp, Homo sapiens
gttttaacaggggccaagagggaaacatggggcagtgcatgactgacagctgtgctctgtcacttctacatctgccttgcagttcttcaagcagccatgarcccctgcaggcaaacctgtggtctgttcagcaggacctgtctctgctgccttagcccctgggaaagggaagcaatgctgtggctccattttcagcagcgg

SEQ ID NO: 50313 - DNA, 201 bp, Homo sapiens
gcaggagtaacaggaaggttttaagctaactatatctgtcattttttgtttgttctatttcaagaaagcaagatattttccagaaactttgagcagttatmtgtgtatgtcacgttaaccagaatggtattcaacaggcatccctaactgcagcagcagctggagaagtaagatttagttgcaaataccaataattcaagc

SEQ ID NO: 50314 - DNA, 201 bp, Homo sapiens
ccatgattcattatttcccacatggtcccacctacaacatgtgggaattatgggagctacaattcaagatgagatttgggtgaggacacagccaaaccatrtcaccttacaagttccatgtctagtacagagcttgaccctaagtggatgttcagaaagcatcttcagaatgaaaaggggggcacagttaagacctctggt

SEQ ID NO: 50315 - DNA, 201 bp, Homo sapiens
tgtgtttgtttatctgaaattctaattttactagggcgttctgtatttttatttgcaaaatttggcaaactatatgaaagatgcttcgaaaactatagagwacacagccaaagatccctgcctctcccaatcttctgggcctctttctttaggaaacaaacataaacctgcccaaactgaggttgtaccctttttacctgc

SEQ ID NO: 50316 - DNA, 201 bp, Homo sapiens
agggtttattaaaacagtaggccccccaccttcagcatttttaactcagaagttcagggatgaggactgagaatttgcatttctaactagtcccccgagtsgtgatgctactttagatcgtaacgttcatattgaaacatttgtcctacctacggatgccaatgaccaaggcatatgttggacgagcactgtgagaatagg

SEQ ID NO: 50317 - DNA, 201 bp, Homo sapiens
agctccaatcccaaacttttccaaagtctgcattgactcccttgggtttctgcctgagctctctctcctttggacactggactgccatcccattaactgtkgatgttgtcatcagtgatcagctcctggtcataaactaaggaagagttaggtgggagcactggcactgagggtccatgtgctcacttagctttccaggga

SEQ ID NO: 50318 - DNA, 201 bp, Homo sapiens
accaaggaccgtgtcaacacagttctgcaaatggaaacaaacacgccatcattcagggtcccactttgatattctgcctttgcacttgtttcattttttcyttgaagaacattctatagatcgaaggaattattccagacctctgattcatgctaggcttattctcttcctcattcagtctctcaatcaatcaatacttac

SEQ ID NO: 50319 - DNA, 201 bp, Homo sapiens
gcattgagttacacaggcaatagctttttcaacagctatttttccagaggtgtaaaaacagcctttgcctggttacattgtatatcttacctcagtaaagwcatgaaaaggaatcgtgataaggtgaatgcactcctacagagcgctaagcttcctggcgatttgacttgattcgggaatagaactcagtaaactgagcag

SEQ ID NO: 50320 - DNA, 201 bp, Homo sapiens
tgtcagaatgagttcatcacctgggctggggatcccagattctgtgagcagaagacttcatccacccaggtgtctatttcaagaacagtctcctcttttgsaaaagcgttcatggaaatggccttctctcctaacagacagcagctacagagcctcctttccctgggctgcagagggtaggttaatggagactgaggagcc

SEQ ID NO: 50321 - DNA, 201 bp, Homo sapiens
tgactaaataaatagctattcctggaggtgtgatgattatactatgcccagatcctgccaaaggcaaaaaggcaaaaagttatattcagaccagctatctstctatttttttccctgctcagggctaaatttttccgaaaaaatcacataagagtccaactgtcagaatgagttcatcacctgggctggggatcccagatt

SEQ ID NO: 50322 - DNA, 201 bp, Homo sapiens
gtattccattttcaaattaacttattctgattataaaagtaatgttcagtattgttagtaaaataaattttaaaaaaaacgaacttgtaatttccccactyagagatagcttctgataacatattggtgcttttacttctatttttttctatccatatgagtataattaaatacatattcacatctatatctatactcatt

SEQ ID NO: 50323 - DNA, 201 bp, Homo sapiens
ggtttctataattgacctgacattttgtgagagcaatcatgtttgttaaggagaaactcaagccaatgctgtagttgcaaagttctccttactattacccygggaaacaaattcatcagaagtgtgcagatgtgttttatgtgtgcgtacacacatacatccctatgcatacacaagcatgtacacacattggcatgggtc

SEQ ID NO: 50324 - DNA, 201 bp, Homo sapiens
ggtacttcatgagccaagagtgcatagaaaggtatttttggttcattactaggtttctataattgacctgacattttgtgagagcaatcatgtttgttaasgagaaactcaagccaatgctgtagttgcaaagttctccttactattaccctgggaaacaaattcatcagaagtgtgcagatgtgttttatgtgtgcgtac

SEQ ID NO: 50325 - DNA, 201 bp, Homo sapiens
atgtctgtctctaggacacggttcccattatccatgggtcaaagcttgcccgaggaacgccagctcctttgcattcccaaactttgcaagcatgtgtcatmctgcaggttctcttgggtattccattgtaaggagtctgagaagctccaaggaagaatgcagaaatacggggtatagctgaggccaggtgctgtctgatca

SEQ ID NO: 50326 - DNA, 201 bp, Homo sapiens
aatcaacctgtgagaagacaaggtgtgcagacattgtggatctgagcgagatggggagaaaaggcaataaaaagcagtagcaaaggggaaaagaaaagttygggccaggagccaagaagatactttctgtggaaaagggagggaaaaaaaaaatcactccacccctcctgtccaaatgaaaaagcatttaattgaatgttc

SEQ ID NO: 50327 - DNA, 201 bp, Homo sapiens
gcagcatggggaatttcaatcaacctgtgagaagacaaggtgtgcagacattgtggatctgagcgagatggggagaaaaggcaataaaaagcagtagcaamggggaaaagaaaagttcgggccaggagccaagaagatactttctgtggaaaagggagggaaaaaaaaaatcactccacccctcctgtccaaatgaaaaag

SEQ ID NO: 50328 - DNA, 201 bp, Homo sapiens
gaagcaatgctgtggctccattttcagcagcgggcaaggaaaagaacttgggttcgagagtttcacaacttgagattgaatctccttctgcctcctttcakttatatagtctcaagtgcttatcttcctttctctgaatttcagtttctagctctttaaacaagggtcagggacagcttactattgcagaaggtggtgaga

SEQ ID NO: 50329 - DNA, 201 bp, Homo sapiens
tcattggtaacggtggtaatagcagctctcggtctgagcgatgtttggcatctgaagtcaccattagcattttcagagaagtccagctttttaccatatarccattcattctgtcttccaatgtgatccttaaggaaaaaaaaaattcccccatagtcgtgtgatgtttaaaatgtgtttattataccttgcctgtcattt

SEQ ID NO: 50330 - DNA, 201 bp, Homo sapiens
gccaggtgtgatggcccatgcctgcaacttgctactcaggaggctgaggcagcagaatcacttgaacctggaaggtggaggttgcagtaagtcaagatcaygccactgcactccagcctgggtgacagagtgagattctgcctcagataaaaagaaagaaattggagcacctggtatatattgctttctcaatgcccaacc

SEQ ID NO: 50331 - DNA, 201 bp, Homo sapiens
ctgctcaccgcaagctccacctcccggattcacgccattctcctgcctcagcctcccgagtggctgagactacaagcgcccgccaccatgcctggctaatkttgtttttgtatttttagtagacatggggtttcaccgtgttagcctggatggtctcgatctcccgacctcgtgatccgcccgcctcggcctcccaaagtg

SEQ ID NO: 50332 - DNA, 201 bp, Homo sapiens
ttgagacagagtcttgccttgttatctaggctggagtgcagtggtgtgatctcagctcactgcaacctctaccgtcctggttcaggcagtctcttgagtakctgggattacaggcacacaccactatgtccggctaaattttgctgggcatggtggctcacgcctgtaatcccagcactttgggaggccaaggtgggtgga

SEQ ID NO: 50333 - DNA, 201 bp, Homo sapiens
actgcaactgagagttgaactgaaggatctgcatttctttctttgacatctgaaaataaaggaaataaaactactgatattgaaagtaataaaaaatgaawatgaaatgatttttactgtcagttttttttgttttgttttgttttgttttttcacagagtcttgctgtgtcacccaggctggagtgcagtggcatggtct

SEQ ID NO: 50334 - DNA, 201 bp, Homo sapiens
aatatctattctaatatgcacatatcctaatatgcatatatctattctattctaatatgcacatatcttaatatgcatgtattctgttctaatatataatwtttattctattctaatatgcacatgtcctaatacgtacatattctgttctaataatatatgacataaaatattaaatatgcaatattcaacttctggtgt

SEQ ID NO: 50335 - DNA, 201 bp, Homo sapiens
gaagccattgtgtcgcctgttagtaatgagcatttgcaagggcagcatggggaatttcaatcaacctgtgagaagacaaggtgtgcagacattgtggatckgagcgagatggggagaaaaggcaataaaaagcagtagcaaaggggaaaagaaaagttcgggccaggagccaagaagatactttctgtggaaaagggaggg

SEQ ID NO: 50336 - DNA, 201 bp, Homo sapiens
ccttacaagaattttgggagcaaggaaatcagctggtagaatctctttgatgtttctttaaagcagggtcagcaaactctaagacacagaccaaatctggyctactgcccatttttgtaaataaagttttattggaacacagccgcgcctatcatttccatatcgcctgtgcccgttctctgctgcagtggcagagctcag

SEQ ID NO: 50337 - DNA, 201 bp, Homo sapiens
tctattctaatatataatatctattgtaataagcacatatcctaatatgcacatattctaatatataatatctattcttttctcatatgaacatatctcartatgcacatattcaattctaatatatatctattctaatatgtacatatcttaatatgcacatattctaatatatatttctaatatgcacatatcctaatt

SEQ ID NO: 50338 - DNA, 201 bp, Homo sapiens
agtgatctccctgcctcggcctcccaaagtactgagattacaggcatgagccactagattttttactgtatctagcaagggccattgcaggatatcaagtmtgggaatgacacagtttctcatttcagaaccattgaattggatacagcctgagtagtattcattcattttttccacaagcatttgggtggtgacagaagg

SEQ ID NO: 50339 - DNA, 201 bp, Homo sapiens
attcaatcatttagcaccctttctcgcttgcttggaaaatacaaggtaaaaaacacactagcctactatttgatatttgtgcgtgggtgtgtgtggggggygtcatatatccctcttagcatctgataaaaaaaagatcaattcattacccagaaatatgtatctgcatgtgtgcaagtcccaattcacaattcagtacaa

SEQ ID NO: 50340 - DNA, 201 bp, Homo sapiens
ataacttcctaactcagccatagtccttacaagaattttgggagcaaggaaatcagctggtagaatctctttgatgtttctttaaagcagggtcagcaaastctaagacacagaccaaatctggtctactgcccatttttgtaaataaagttttattggaacacagccgcgcctatcatttccatatcgcctgtgcccgtt

SEQ ID NO: 50341 - DNA, 201 bp, Homo sapiens
taatatgcacatattctagtctaatatataaatctattgtaatatgcacatatcctaataagcacattttctattctaatatataatatctattgtaatawgcacatatcctaatatgcacatattctaatatataatatctattcttttctcatatgaacatatctcaatatgcacatattcaattctaatatatatcta

SEQ ID NO: 50342 - DNA, 201 bp, Homo sapiens
gtatctagcaagggccattgcaggatatcaagtctgggaatgacacagtttctcatttcagaaccattgaattggatacagcctgagtagtattcattcaytttttccacaagcatttgggtggtgacagaaggcggcagacaaagtccccccatcacatttggcaaagagggttgcggggattcattaatcaacgagcta

SEQ ID NO: 50343 - DNA, 201 bp, Homo sapiens
gaataatacaaaaaaatccaaaccttaactagtgtttgtcacagtcagtgggtacttcatgagccaagagtgcatagaaaggtatttttggttcattactrggtttctataattgacctgacattttgtgagagcaatcatgtttgttaaggagaaactcaagccaatgctgtagttgcaaagttctccttactattaccc

SEQ ID NO: 50344 - DNA, 201 bp, Homo sapiens
tatcatggggattacaattcaagatgagatttgggtggggacacaaaggctttcatggtttttggcacccgctgctgtcccctccttttgagtgtgggacrgatctgtgactggcttctagcccatagaatatggcaccttccttcacataaaccatccatctctgagccatccccggttccttgacttcatagactcaca

SEQ ID NO: 50345 - DNA, 201 bp, Homo sapiens
tgctgtacaaagacagtagtttcagcccccaaaaaacagttaaaaacaggtgttaccacttaccttcaaaaacacacttggtctggtcatgtgtaaaaggyataagattttctaatattgttcatttaaatgttagagatgcctgccaaatgtcatgatttacgttttattatatacctagtccaagacattcttcctaac

SEQ ID NO: 50346 - DNA, 201 bp, Homo sapiens
tgatgcatacatggtttcaaacactgtccacctggctacagcctgccttcgtcttaggccacacgggagctctgtttacccctacgtgccaagctttggcrtgtctttgtgccactacacactctgttcccttcttcccggaatgccttttccttcctttgtgcctgaaaaattccaatttatccttcaccacccaactta

SEQ ID NO: 50347 - DNA, 201 bp, Homo sapiens
ccctttccaggagagtgggtaacagacaagccactcagccggttttattaagatggaaattttcacaagggctaaaataaagattcaagtcaatggaagcygcctttttaattgataagagcagctcagcagtaaaggaaataggagatgcttgatgcctgtgtcgttctagtgttggggaattatatggaacactcaaag

SEQ ID NO: 50348 - DNA, 201 bp, Homo sapiens
ttgttacgatgattatatggcaaaatgcaaaacaacttgacaggactttgctatctagacttttgataatgatctctaaaagccaactcatttcatttgcrtccttttatgaataatacaaaaaaatccaaaccttaactagtgtttgtcacagtcagtgggtacttcatgagccaagagtgcatagaaaggtatttttgg

SEQ ID NO: 50349 - DNA, 201 bp, Homo sapiens
gagcaacaaccacaaagccataaaacatctacttttttaactctaagaatatgacatgactacacctccataatgcagtgtgcagaatgagaacacaggakttcagaaatagaaagccaagagcagcataaatggagcctgttggaagatgaaacgtccaggtccacactgcacctggaagccattttgtactgaacaatt

SEQ ID NO: 50350 - DNA, 201 bp, Homo sapiens
gaaatcactggtggtgttctctttaccctgctggaatcacagacactgcaagttgaaagtcacccagaggcgatctgatgttttccttcctctacagggargagaagtctcttctgcttttcacagcaggtgtcattcaacctacacacatgtgctgaaccacaggagcttgtggtctctcgaggcaggaccaccccccgc

SEQ ID NO: 50351 - DNA, 201 bp, Homo sapiens
agatggtagggcattgtctgttcagggctgctagatcaatattatagttttatttatctattaatttatttggatttctaagcagctctaccttttgttaygatgattatatggcaaaatgcaaaacaacttgacaggactttgctatctagacttttgataatgatctctaaaagccaactcatttcatttgcgtccttt

SEQ ID NO: 50352 - DNA, 201 bp, Homo sapiens
tctttgtctcaggctcagcctggaggagcccaagttagaatggaaccccagctctctttctttccccccccgcctctctctctgtctctctcccctttctytttttctctctctctctttctttctttcagtggagtcttgcttcatcgcccaggctggagtgcaatggcacaatcttgtctcactgcaacctctgcctcc

SEQ ID NO: 50353 - DNA, 201 bp, Homo sapiens
ccaacaccttcatttcacatttatcttcacttgaaaggggtgagttcatcacttttttctcctgcaccaagaccataggaagacacgaaatcatcaactawatcttccagcgttcaaatatcggaggccctggaaacagcaggtatgccgctgaatgtttttgaataaaagagagtgaagggaaacgtttgtacaaatata

SEQ ID NO: 50354 - DNA, 201 bp, Homo sapiens
gaggagaagtctcttctgcttttcacagcaggtgtcattcaacctacacacatgtgctgaaccacaggagcttgtggtctctcgaggcaggaccacccccsgcaaccccatggtcaagcagcccctgcagtagccttgttcttccccaagacccatcacccgtcctagctgggagccacgtgacgttacgctgtttccgtt

SEQ ID NO: 50355 - DNA, 201 bp, Homo sapiens
aagatggtagggcattgtctgttcagggctgctagatcaatattatagttttatttatctattaatttatttggatttctaagcagctctaccttttgttrcgatgattatatggcaaaatgcaaaacaacttgacaggactttgctatctagacttttgataatgatctctaaaagccaactcatttcatttgcgtcctt

SEQ ID NO: 50356 - DNA, 201 bp, Homo sapiens
ttgctgcaaaaccgccaacaccttcatttcacatttatcttcacttgaaaggggtgagttcatcacttttttctcctgcaccaagaccataggaagacacraaatcatcaactaaatcttccagcgttcaaatatcggaggccctggaaacagcaggtatgccgctgaatgtttttgaataaaagagagtgaagggaaacg

SEQ ID NO: 50357 - DNA, 201 bp, Homo sapiens
tttgaagatggccagtgttgctgtttctcaggccctaatatttctttgtgctcagtgaacgggcaagttatcctgaggaagaaaatatttcagaggcttcrgtgctaagtattaatcaaataggtcgggggtcgagcaggccttccacagtcattcatacaggaaaaacatattgaggctggccccaccctatatctcagc

SEQ ID NO: 50358 - DNA, 201 bp, Homo sapiens
ctagtcctcaagttttgaaattttagagacttaaaaaaaatcaataatgctttaagaagattaagaggctgtgcttatgtcagccttagacaattctggakagaagatagacttgattgtgcttctcattttgtttatgatcctgcaatgtatcacgcattctctgccaagtgaattctgactgcatgaagaaggggtaga

SEQ ID NO: 50359 - DNA, 201 bp, Homo sapiens
tacaaagtatcttatacattgtccatagctactattgttaaaattagtttatgactattacatcatagtaattgctttctaaaaagtaacttaatgaaacrcatacatcaaatgcctgatgaaagctgaattttctaaaattggtcttggccttcaaaagatttctcattccttctaccatgtatattcaacagataattt

SEQ ID NO: 50360 - DNA, 201 bp, Homo sapiens
ctaaacttttctttctgattcttcacttgatttgacatgaatatctacagttcccttaactctttgggatcttttcctctgtttttgatagtttggtgacyccagctatgaagttagaagacacacctttgtgcttccaccctttgccagaagtctaattgaagtaaatatatttatccagtcctccaggattccgtgcaa

SEQ ID NO: 50361 - DNA, 201 bp, Homo sapiens
atttctcattccttctaccatgtatattcaacagataattttgagcgcctactgtgtgccaggcagccctctgggagcaggaagactgcagtgagcaaagyaaacaaaactcccattttcctatgtcagatgcaagtggactcattcagcacatgctatttgcatcctggaggtatcaaggcaaagaaaacacagtttttg

SEQ ID NO: 50362 - DNA, 201 bp, Homo sapiens
tcaacttatttcagtaaaagtttaaaatgtttgaagtgtctcctacttgatgatatcgataagcaagaagggaactctaaatccaagaaagctaaactttkctttctgattcttcacttgatttgacatgaatatctacagttcccttaactctttgggatcttttcctctgtttttgatagtttggtgactccagctatg

SEQ ID NO: 50363 - DNA, 201 bp, Homo sapiens
caacagataattttgagcgcctactgtgtgccaggcagccctctgggagcaggaagactgcagtgagcaaagcaaacaaaactcccattttcctatgtcasatgcaagtggactcattcagcacatgctatttgcatcctggaggtatcaaggcaaagaaaacacagtttttgcctccagaggcataatcttacctcctgc

SEQ ID NO: 50364 - DNA, 201 bp, Homo sapiens
aagcataatattttcatttaaaatgtggagaaatataattaaatggcttcacagtacccactccatctcataccatttgcttcaaaatcaacttatttcartaaaagtttaaaatgtttgaagtgtctcctacttgatgatatcgataagcaagaagggaactctaaatccaagaaagctaaacttttctttctgattctt

SEQ ID NO: 50365 - DNA, 201 bp, Homo sapiens
taggtttatcgattttctatatgtttattaggctcctgctatatgccaagtactgtggttagcaccatcctcatataaacattatcatcttagcccctgarcttaaggaaatgtccaggctgctaaagcagatctgtgaaaaagctcagcctgctttttttcagctagactactatgactctagctcagaaaaaaaattat

SEQ ID NO: 50366 - DNA, 201 bp, Homo sapiens
aaataaaattagtttactcatttttaatttaattcccaggaggcattttggaaaccttccctcctcatttgacccaaaatcatttttaaaaattattgttstcctaaattgaagccctttccagcattgcgcattagaagtcttaaaactcatctgttttctttttgtaattgacttacaaatgcgtaatcgactcacaaa

SEQ ID NO: 50367 - DNA, 201 bp, Homo sapiens
aattcccaggaggcattttggaaaccttccctcctcatttgacccaaaatcatttttaaaaattattgttctcctaaattgaagccctttccagcattgcrcattagaagtcttaaaactcatctgttttctttttgtaattgacttacaaatgcgtaatcgactcacaaatgtataactgagtatgcatggcattttaaa

SEQ ID NO: 50368 - DNA, 201 bp, Homo sapiens
tgaaaagccttcaggtactttataggccatgttcattctgcaaatgtcagtggaatgttcaggaagtccaacgtagagaaaggcccaggatggctagaatraaatcagagatatccagtaggacctgatcactggcagaacccagactggggccagctgatgaagccagagaggcattcgcttcagggaccaaaactttca

SEQ ID NO: 50369 - DNA, 201 bp, Homo sapiens
ctgatgaagccagagaggcattcgcttcagggaccaaaactttcattcagtaagagcgggggtcctcaaccacgggccacaggccagtactagcctatgasctgttaggaacctggctgcccagcaggaggtaagtagcaggcaagcaagcaagccaagcttcatctgtatttacagccactccccatcgcttgcactact

SEQ ID NO: 50370 - DNA, 201 bp, Homo sapiens
tcagaaatgtctgtctctaggacacggttcccattatccatgggtcaaagcttgcccgaggaacgccagctcctttgcattcccaaactttgcaagcatgwgtcatcctgcaggttctcttgggtattccattgtaaggagtctgagaagctccaaggaagaatgcagaaatacggggtatagctgaggccaggtgctgtc

SEQ ID NO: 50371 - DNA, 201 bp, Homo sapiens
atggatggatgggaggatgatttatattttcatctcggtatagttcataggtctaggatcagaaataaactagaataaatataaatattgcttttcttaaygttggtttaaaatgcaaatgcatggcatacagaaaaaactttttttttttttttagctctgaaagctcaatttttactacatgatttccctagtagaagt

SEQ ID NO: 50372 - DNA, 201 bp, Homo sapiens
attgtctttgtggctcatccaggcagcctcatcctgaatgtctatgatgtaagtcaaagaaaagaaaataatcagtcctgaatttggagggaagagatcawaagcccagtacatagtcccaacaggccacagtgattgtgtaaaaatacgttttatatcttgtatttgatttgccacacagtttaacagaaaagtaacttt

SEQ ID NO: 50373 - DNA, 201 bp, Homo sapiens
tattggatggatggatgggaggatgatttatattttcatctcggtatagttcataggtctaggatcagaaataaactagaataaatataaatattgctttwcttaacgttggtttaaaatgcaaatgcatggcatacagaaaaaactttttttttttttttagctctgaaagctcaatttttactacatgatttccctagt

SEQ ID NO: 50374 - DNA, 201 bp, Homo sapiens
gtaattgaatcacgggggtgggtttttcccatgctgttctcgtgatagtgaataagtctcacgagatttgatggttttatagaagagagttccctacacaygctctcttgcctgctgccgtgtaggatgtgcctttgctcatccttcaccttctgccatgattgtgagtcctccccggctatgtggaactgtgagtccatt

SEQ ID NO: 50375 - DNA, 201 bp, Homo sapiens
ctgctgcacgtcagaaccacttaggaaacattttcaaactacgaattcctgagctcagtgccctagaaactttcatttgtgctctagattacgacttgagsttgaggaatagggcgttggggaatggtaatgaatggacgcatggacagacagatggataaatgaaaggaaacatatttctccctcttttcttttgttctt

SEQ ID NO: 50376 - DNA, 201 bp, Homo sapiens
gggtttttcccatgctgttctcgtgatagtgaataagtctcacgagatttgatggttttatagaagagagttccctacacacgctctcttgcctgctgccrtgtaggatgtgcctttgctcatccttcaccttctgccatgattgtgagtcctccccggctatgtggaactgtgagtccattaaaccttttttactctttt

SEQ ID NO: 50377 - DNA, 201 bp, Homo sapiens
tttaaacacggggcttgtaactcagctcacacccaacaaatcaggttgtaaagagggttcactaaaatacaaattaggctaaagcaggaggtaaagaagtmgtcaaatcatatatcgcctgagaacacagggggagcgacaatgatcgggatataaacccaggcattcgagcagggtgtggtaaccccctttgggtcccct

SEQ ID NO: 50378 - DNA, 201 bp, Homo sapiens
ggtagttcctaaatgctgctgcacgtcagaaccacttaggaaacattttcaaactacgaattcctgagctcagtgccctagaaactttcatttgtgctctrgattacgacttgaggttgaggaatagggcgttggggaatggtaatgaatggacgcatggacagacagatggataaatgaaaggaaacatatttctccctc

SEQ ID NO: 50379 - DNA, 201 bp, Homo sapiens
gccacatttcctgataccagatgctttcagggcaaccttgatcatgggtttttgtctattgcatcttcatgctgcaagaaaattctgtgtgtaagcatctytgtctcccagcaaaatgtggccagtggaaggtccacatgaggccttttcagtctggcatccacagcactagcacagggcctgccacaaaataggccccca

SEQ ID NO: 50380 - DNA, 201 bp, Homo sapiens
cacttgtattttttatggtactaagaaagaaaaatgctgacgcttaaacctgcacacagtaattccttaacatcaatggtaaggttcctccctaattttgraggcattaaaatggggtcggggaaatgtcttacaaatgatattttttaaaaaaataaaataaaacaaagataatcatgtcttggattatcatgactcaca

SEQ ID NO: 50381 - DNA, 201 bp, Homo sapiens
aaggaagagaaaccaactaggaagagttggggatggagttaactgacactaaatttggcctgagcttctcattggcttgccgtacacaattgccactgtgygataagagcaacgtgttaattgcagtggtagttcctaaatgctgctgcacgtcagaaccacttaggaaacattttcaaactacgaattcctgagctcagt

SEQ ID NO: 50382 - DNA, 201 bp, Homo sapiens
tttcttctttcctgcggtgggggatgggactgacccatcaaagcacatctcatatttgaaatgtatgagattcttggatagtgcaaaatacaatgtgtgcrttacacactgaggaggctgctgcagtttctccaaacccctacaggctgggagacttttaagagacccttagagagtgtcacctttgtttatgcagttttc

SEQ ID NO: 50383 - DNA, 201 bp, Homo sapiens
ttttatcgggcttggggtgtgaccttagcccctctcctttgtgaggggagatggcagaactctcagaagctttttctattctcatctttgttggttactgkggaaaaactggatttcgctgcactcatcaaataaagaggcccaggtagcagcgcctccacgttttgttcaagtggggttttctgcgtgtgccgctggcca

SEQ ID NO: 50384 - DNA, 201 bp, Homo sapiens
catccctcctccagagaggagggtacggtgagatgacagaacacatccagtatgagaatttctatagcaccaactttccagaaagtgtttcagaagcttasagaattaaaatgtgaaccagacaggaagttaaacttgacaaggaagagaaaccaactaggaagagttggggatggagttaactgacactaaatttggcct

SEQ ID NO: 50385 - DNA, 201 bp, Homo sapiens
acaatgtgtgcgttacacactgaggaggctgctgcagtttctccaaacccctacaggctgggagacttttaagagacccttagagagtgtcacctttgttwatgcagttttcataaatttcttttacttggccgtagtctctgggtgatacttgttgtaacaggcaactattacagtacaagatatcctgcttcagatctg

SEQ ID NO: 50386 - DNA, 201 bp, Homo sapiens
gtagcagcgcctccacgttttgttcaagtggggttttctgcgtgtgccgctggccaattcttcaagaaaagtgtttgttcttctctggcggtttggtgttyctatgtttcaacatgggggtaccaaataattcatttccccttttcccaacagatgcattcttgtgacctcactgatgacaggggcgtcgtttattctaac

SEQ ID NO: 50387 - DNA, 201 bp, Homo sapiens
ataaagagagaaaaaatctggattagctttttaatctggagtatcaggaaaatatcagtagacatggtgcggatataattcctgtggcagaaagcataatwttttcatttaaaatgtggagaaatataattaaatggcttcacagtacccactccatctcataccatttgcttcaaaatcaacttatttcagtaaaagttt

SEQ ID NO: 50388 - DNA, 201 bp, Homo sapiens
ctggagtgcagtggtatgatctcagctcactgcaacctccaccctccgggttcaaatgattctccttcctcagcctcctgagtagctaggactacaggtgsctgccacagcgcccggctaattttttgtatttttagtacagatagggttttaccatcttggccaggctggtcttgaacttctgacctcgtgatccacccg

SEQ ID NO: 50389 - DNA, 201 bp, Homo sapiens
gtgaattaggaagttgggaaattgacagaaaaagaaaacagaaggttttttatcctactgacagtggtgagctgccaggaaatcacatagtacaacattgsacattcacgtatataaagctctgtgcaagaccagagtcctgtgagtagaaggaaaaatgaagggccaggcacggtggctcacacctataatcccaccact

SEQ ID NO: 50390 - DNA, 201 bp, Homo sapiens
tcctctcttctgtctaatctactatacccatttattgatttaattacactcaggccaggcacggtggctcacgcctgtaataccagcactttgggagaccsgtgggcagatcacttgaggtcaggagttcaacaccagcctggccaacatggtgaaaccctgtctctactaaataaatacaaaaattagtcaggcgtggtg

SEQ ID NO: 50391 - DNA, 201 bp, Homo sapiens
acttctatttagacaacctaaggttactttggttttaaaaaatatcatttcacactaaccttgctttcattgaagacttctcttctgcttctttatcaaamgtggtgcttctgggccatgcctctcccgtcttttgataacaacaatattctcagagaacacagtatcctgggctgaatgttacatgtagtcactcactta

SEQ ID NO: 50392 - DNA, 201 bp, Homo sapiens
agtacaaaggtacaggggcagcagctggagatgacagcacagtctgttgccatgtgtagttcatggcgcagggtcagggcagaaactccttaatattaaayttagtgtacagtaactctaatgcctgatatttgatttgcattaagcactgacaagaacctttcatgtctatttctgccctggggtcctaaaacataaatt

SEQ ID NO: 50393 - DNA, 201 bp, Homo sapiens
tttctctctacattatgcagaataatcttttgcaaggttaaaacagatattatgagactttctgagaatagtcgtgagaatttatggatggagggtgggcygcagggaaaatgataaatgcataatttacactgttttttcactggctagtaataatgactataatatcatgaaacattgtttttaacaaatgaattatta

SEQ ID NO: 50394 - DNA, 201 bp, Homo sapiens
tctgttgagctatttttaagctcaccaatcctctcttctgtctaatctactatacccatttattgatttaattacactcaggccaggcacggtggctcacrcctgtaataccagcactttgggagaccggtgggcagatcacttgaggtcaggagttcaacaccagcctggccaacatggtgaaaccctgtctctactaaa

SEQ ID NO: 50395 - DNA, 201 bp, Homo sapiens
ttcattgaagacttctcttctgcttctttatcaaacgtggtgcttctgggccatgcctctcccgtcttttgataacaacaatattctcagagaacacagtrtcctgggctgaatgttacatgtagtcactcacttaatccatgcaccaaccccatcaggtgaaaaccattactgtccccacttagtaccgttatacctcag

SEQ ID NO: 50396 - DNA, 201 bp, Homo sapiens
gccctgtgcttaacaggagggcccatgcgtgcgagttaatgctctgtcatcactaccctgaaattcttaatagatttttttttgtgttttgtaaatgaagyccaaaggaacaatggagcatgagctggggcttggagcctcacttcacagacagccccacctcctcctgcctcctcacttccctgggagaggtctttagcc

SEQ ID NO: 50397 - DNA, 201 bp, Homo sapiens
acacacgtaccttacaaaatttctaattataggccaggcgcggtatctcatacctataatcccagccctttgggaggccgaggcaggcagatcatgaggtyaggagttcaagaccagcctgatcagcagggtgaaaccccatctctactaaaaacacaaaaattagctgggcatggtggtgtgcacctgtaatcctaacta

SEQ ID NO: 50398 - DNA, 201 bp, Homo sapiens
tcatggtgacagattcagggaaaccacccatgacgaatatcacagatctcagggtacaagtgtgctcctgcaggaattccaaagtggactgcaacgcggcrggggccctgcgcttcagcctgccctcagtcctgctcctcagcctcttcagcttagcttgtaagttgacctaactccagtgcatgcacaaacaggaaattg

SEQ ID NO: 50399 - DNA, 201 bp, Homo sapiens
atctagatggtatattctgctacatgcctatcctgtatgacattgcctcttgcgcctaggctacaaacctgtacggctgttactctattgaatactgtaarcaattataacacaacagtaaatatgtgtgtatctaaacatagaaaagataccataaaaatacagtataaaatatttaaaatggtatccctgtataggaaa

SEQ ID NO: 50400 - DNA, 201 bp, Homo sapiens
ccatggttataccacattttatgcattcatccactaagggacatttaggcagtttcagtttttggctattgtgagtaacgctgctgtgaacattcatgtamaagtcattaagtctttatctgcgttttctctcacatcctaaacagctagaataaaaaaaaaaagtacccataatatcactccaaattagtaatctgtaat

SEQ ID NO: 50401 - DNA, 201 bp, Homo sapiens
caaatggaaatgactctccagttccatgggggcacaggtggcctggaaaaagctaccccagtctgtgagcccagacagtccagaaggccccctcttagatstcaatcccagcacatttaatttcagttttgtgtgaccctaatagagatccttcatcaagttttattcttcataaaagatccatttccatagactcataaa

SEQ ID NO: 50402 - DNA, 201 bp, Homo sapiens
gtttgcaaaaattatggcgctggtcctctccccagccaacttaactgggcttctaccatcctcctccttcctgatctttcttttctcttcctgagcatctwtccagttccctatttaatcatatgtaatcttcagtatgtgcttttatgtggaaagccagatgtgtaccagttgatgtcaccatgatggacaagaaaaagg

SEQ ID NO: 50403 - DNA, 201 bp, Homo sapiens
ctctgtcacccaggctggagtgcagtggcatgatctcggctcactgcaaccttctgcctcccagcttccagcaattctcctgcctcagcctcctgaggagstgggattacaggcgagtgccgccacgcccagctcatttttgtatttttagtgaagatggggtttcaccatgttggtcaggctgatctcgaactcctgacc

SEQ ID NO: 50404 - DNA, 201 bp, Homo sapiens
attataatctaatgagacaactttcctatatgtggcccgtcattgactgatatattgttatccagcaatgactgtacttaagtaactttaatagaagcatkaagaatgtagtagttgtcatttgaaaagggccttgctaaatgtaaccttcagttaaagcaagtcagcctagtggaggatggtggctgctcatgttgtctt

SEQ ID NO: 50405 - DNA, 201 bp, Homo sapiens
gctcatttgtatcttgtaactgcagtagtcaccagcaccctgaaacctcctggagatccttgttgatcatacctggaacttcagccaggtcacttacctarcaggtgtggttctggagtcatcgatcatctgtcctgcactacaactcaaggatataggtcctatatgtccctcgggcttctggacctagcctaaagatgc

SEQ ID NO: 50406 - DNA, 201 bp, Homo sapiens
agcttagaattactttacacacacatgcctacaccccccctcgcaacacacacacgtaccttacaaaatttctaattataggccaggcgcggtatctcatrcctataatcccagccctttgggaggccgaggcaggcagatcatgaggttaggagttcaagaccagcctgatcagcagggtgaaaccccatctctactaaa

SEQ ID NO: 50407 - DNA, 201 bp, Homo sapiens
agttctaccttaaaatggcaattggtcatttagatttaataatttaggactttttggcaattcaatgagttctttctaaggtaaatgttttggtgtttaarctataacattatcatacctataataaaaacgacataaaacttataagatcctgtcctccagctggaaaatgagagatgggcaaatgctccagttttcaca

SEQ ID NO: 50408 - DNA, 201 bp, Homo sapiens
aaccacacttcctgggtttgcctctcgtctcagccacttaccagctagataactgaggtgatgggcaagcggctttacctccctgggcctcagcttccctstccataaaatgggctaatgacacctgcctcatagggtttgtgggatgattaaatgcttgcaatgccctgagtcatctgctatggtacgaaccctcataaa

SEQ ID NO: 50409 - DNA, 201 bp, Homo sapiens
gtcatggggattaataaactcgctattaattaaagaatgtgtttgcaagtgattataaaatttaaaaaaaacagaaaatttcaaatttcattttccagttstaccttaaaatggcaattggtcatttagatttaataatttaggactttttggcaattcaatgagttctttctaaggtaaatgttttggtgtttaagctat

SEQ ID NO: 50410 - DNA, 201 bp, Homo sapiens
gttgtgtatgttgctcagatcatgtagccagtaagtaaggtgccagagtctccatctgttcagcttctatcattccaaggattccactctcaaggccccayaccaggccagtagaataaaaatctctgggggagagtctcagacatcaagagaattttaaaatatcttcaatgagcagccagggttgcaaggcataccccc

SEQ ID NO: 50411 - DNA, 201 bp, Homo sapiens
ttatttcctgtgtgaaacaacttttatcaaaatgtatttgacactgggagtgtgggtgaactggtgaaaaggtccctgagagttcgggtccctgagagttscaagcacaaatcctgttaacaggtaataagattatgagcatagcccatgtagagcgcatggttttatcagctgaagtgaagcaccaagatgccaagttgt

SEQ ID NO: 50412 - DNA, 201 bp, Homo sapiens
agccccatttgtggctttttcattcttgtctcttaggttattttattaaaaaaaagatttctgatttgtagctagaacatggttgatgcccaacaaatackgattgaataagtcatattttcacataaatctcaggtcatggggattaataaactcgctattaattaaagaatgtgtttgcaagtgattataaaatttaaa

SEQ ID NO: 50413 - DNA, 201 bp, Homo sapiens
ataacaaattcagaagtgaaaaataatttggtatgctgaaatggtggcctaaagtgtgaacgattaacttaataggaacaaatgtaagattccgtacttgwttctaaacaatgaactttactagtagagaagttgactagtagagaatgaagtttactagtagagaaattgggaagccatgatttagtagaggcataaatg

SEQ ID NO: 50414 - DNA, 201 bp, Homo sapiens
cactgggagtgtgggtgaactggtgaaaaggtccctgagagttcgggtccctgagagttgcaagcacaaatcctgttaacaggtaataagattatgagcayagcccatgtagagcgcatggttttatcagctgaagtgaagcaccaagatgccaagttgttaatggaattcagcatctgtgtctttcatgggtctctaaat

SEQ ID NO: 50415 - DNA, 201 bp, Homo sapiens
tgcatttatagtgtttgtttaaggaaggagatactttaaaggttacttttaaaagtaaattcttattgcaaagtaagctcatccaggcacggtggctcacrcctgtaatcccagcactccgggaggccgaggtgggtggatcccctgaggtcaggagttcgagaccaacctgaccaatatggtgaaaccctgtctctacta

SEQ ID NO: 50416 - DNA, 201 bp, Homo sapiens
tcaccacgacaataagctccaggtattgaaacatcaagactgaagccaccacttacgatccagtcaacctttttaactgtcagtgcttccagtctttgccsaaatacacagcattaaaattcataagtcaacccatgtccgtgcgtcctttttctctcccatatccagttggtcacttgcttcatgctgatccatccatag

SEQ ID NO: 50417 - DNA, 201 bp, Homo sapiens
gtttttgggaatatatgaggtttttaaattctatcttacatgactttccctctccggagagatgtatccttttatctgtttttgaaatctatataaaagakgagttatgattgatcacaaataatagagactagaaataacactgttgaacaaaatagaggtagtttctctcacttaaaagtttggaagtgaaggctgggc

SEQ ID NO: 50418 - DNA, 201 bp, Homo sapiens
tgccgaaatacacagcattaaaattcataagtcaacccatgtccgtgcgtcctttttctctcccatatccagttggtcacttgcttcatgctgatccatcyatagcggtcgtggtccacactccagccctcctttacatcctccagacagatagggttctttctatggcttaaaggtgccaacctcattcctgtctcaggg

SEQ ID NO: 50419 - DNA, 201 bp, Homo sapiens
ccatatccagttggtcacttgcttcatgctgatccatccatagcggtcgtggtccacactccagccctcctttacatcctccagacagatagggttctttmtatggcttaaaggtgccaacctcattcctgtctcagggacctcacacaattgctcctttagcctgaaacaatcacccactaatctctgcatagctgagac

SEQ ID NO: 50420 - DNA, 201 bp, Homo sapiens
ttaccccactgaaattagcatccccctttactgtgttccattaaacctcccacttttctttcttttgaagcatttaccatcatccacaagcatccaatgtrtatcaccgttgtgtggtttattgttggcttcttcattgctagaccaagagctccatgaaagcatgggccttgtctctcttgttctcagtgaaatcatatg

SEQ ID NO: 50421 - DNA, 201 bp, Homo sapiens
tctaatgttcgacttgtggctttgtcatttccccacaggggcagcttccgctggttttacaggacagaaaagttctgtttctattactgaagaggttgaamcctctgctgaagctaattccaaacaaagtaggcaccatatcttctttcaaaagatcccttagggaataattgcaaagagatgctgtgattaggtaattac

SEQ ID NO: 50422 - DNA, 201 bp, Homo sapiens
ttctggtggtaatcaaaggaacgagctccagataggaaagtcttccctgtaattaatttaaacaagttcagtagactccaattatctagtctgctacaacwtggagaaatgactgggaaaggaactcctgggcaactggaatgaattccatgatggctttattaaggagtacatgtaacaaatccaaagtctttaagctta

SEQ ID NO: 50423 - DNA, 201 bp, Homo sapiens
ccgtttctaaaaaaaaaaaaaaatcaatggtacctcctatagagtcaggtgatggtgttgattatgatgatgatggcaaagacggtggtgaaggtgatggygatgatcatggtgatgatgatgggctgatgatgactgtgatgatcatcatggcaaagatgacaatagtgaggttgatgatggtgaagataccaatagcaa

SEQ ID NO: 50424 - DNA, 201 bp, Homo sapiens
aattacacacaattcaatcatgctgtcaggaatattatcttgctttgttttggtgggtgggaccagaatgattcagatagtagcatcctcacaatttcttsgagctatttactcataaatatttctgttggggtaattttccccattttttttatcacttgctgctgtgaaaattgagatggaaaaagtagatgtaaataa

SEQ ID NO: 50425 - DNA, 201 bp, Homo sapiens
ttttaactcattatgaaatccccactgctgagcacaatgctgaacacctttgaagtaattaataaataacgactaaattactgctgtgtagataaggcagwtaggattaggttctttcaacagtgaggaaatcagagctcattctaacttaagggtttagaagtatcagaggcaggactctgacccgggtctccagactca

SEQ ID NO: 50426 - DNA, 201 bp, Homo sapiens
ttgttcaagtggggttttctgcgtgtgccgctggccaattcttcaagaaaagtgtttgttcttctctggcggtttggtgttcctatgtttcaacatggggrtaccaaataattcatttccccttttcccaacagatgcattcttgtgacctcactgatgacaggggcgtcgtttattctaacaaatgctcttgtccaaatt

SEQ ID NO: 50427 - DNA, 201 bp, Homo sapiens
gccaattcttcaagaaaagtgtttgttcttctctggcggtttggtgttcctatgtttcaacatgggggtaccaaataattcatttccccttttcccaacaratgcattcttgtgacctcactgatgacaggggcgtcgtttattctaacaaatgctcttgtccaaattccaaccatgttgccaagagatggcatagctggt

SEQ ID NO: 50428 - DNA, 201 bp, Homo sapiens
ggtttggtgttcctatgtttcaacatgggggtaccaaataattcatttccccttttcccaacagatgcattcttgtgacctcactgatgacaggggcgtcrtttattctaacaaatgctcttgtccaaattccaaccatgttgccaagagatggcatagctggtgagggctggactttaggggccaatctccactcctgag

SEQ ID NO: 50429 - DNA, 201 bp, Homo sapiens
ttcaacatgggggtaccaaataattcatttccccttttcccaacagatgcattcttgtgacctcactgatgacaggggcgtcgtttattctaacaaatgcwcttgtccaaattccaaccatgttgccaagagatggcatagctggtgagggctggactttaggggccaatctccactcctgagctcccctgaccacacagg

SEQ ID NO: 50430 - DNA, 201 bp, Homo sapiens
agccattttctgagtagttacatctcctttgcactcttttcgacctccatctctaattttcaggacccttgtgattgcattgggttcacctgggtaagtgrgaagactctttttaaggtcagctgattaacaacccaaattccacctgcataggttctgtttgccatataagtttataagttcctttatatctccgagtag

SEQ ID NO: 50431 - DNA, 201 bp, Homo sapiens
gagagccttcatgtctcaggtcccaatagcagtttctatgactgaccagcctgtccacagagcatctcctcactggacaggcattgtgggcacgctcctgsggaggaagaatcagggtggtgaggcaattagtaggtgttctacaatcctgacatctttctcagaccagcccccatctctgtctattggcgagatttcttc

SEQ ID NO: 50432 - DNA, 201 bp, Homo sapiens
cgagacactgagtgtccaggtgaccccctgtgtttcccaggccttccgccatctggctcctggctcttgaccacgactggctgcgtgatttgcagagcccrttgtaaaatgaaaactcagggtcccttgttcaacaacaattaagaatgtcaagagggtgacaacagagcactaaacccagcacagggactgtctgagcaa

SEQ ID NO: 50433 - DNA, 201 bp, Homo sapiens
attaacctcagtaaggaagacaccaggttcaagaggctgaagaagagacccagagccagcaaaggaggcatggggttttattaggggcttacatccaggcragagagtctagcggcaataagctggacattagaaccgccttatatacagaaacagtccagcaacagagggctggataagatttcaccttcctatgatcca

SEQ ID NO: 50434 - DNA, 201 bp, Homo sapiens
catcttgggccaggcgtggtggctcgcgcctgtaatcccagcactttgggaggccaagtcgggaggatcacgagttcgggagatcgagaccatcctggctwacacggtgaaaccctgtctctactaaaaatacaaaaaaattaccttggcatggtgacaggcacctgtagccacagctactcgggaggctgaggcagaaga

SEQ ID NO: 50435 - DNA, 201 bp, Homo sapiens
ctcttgaccacgactggctgcgtgatttgcagagcccattgtaaaatgaaaactcagggtcccttgttcaacaacaattaagaatgtcaagagggtgacarcagagcactaaacccagcacagggactgtctgagcaaggggttctgtgcaactgtgcaggtcacacgttcatgaagtccacctgctcttgagcttgcctt

SEQ ID NO: 50436 - DNA, 201 bp, Homo sapiens
aaccgccttatatacagaaacagtccagcaacagagggctggataagatttcaccttcctatgatccactgtcagcaggctagatgacataagcacacagyctagtggcagtgggctggggaggaaaactgcaaacatcatgcaatttatataacattttcccttaacacactccccctaatgacctccacctggcaacct

SEQ ID NO: 50437 - DNA, 201 bp, Homo sapiens
cacaatcccttagatcttcacagatttttaaatctttaattagggctcctccatcctggctgaatgtttgaattacctgtggagttactggatgataccartggccaggccctaccccagacaagttgaatatgaactccgagtgtgggacccaatgtattttaaaaagttccacagaatggctgggtacggtggcttact

SEQ ID NO: 50438 - DNA, 201 bp, Homo sapiens
atagagatgaggacagtggtgatgacaccgctgatgaggatggtgggaggaaggccatgatgaagaagaagattgtgatgagaaagatattattatgacartgatgtttccaaaatgtcagaggccaaattgacattcttatcgaaagggccacctcccctccaggttaaaaggctactcttttcctttaaagtgacatat

SEQ ID NO: 50439 - DNA, 201 bp, Homo sapiens
ctccagcctgcactccagtgacaaagcgagactgtctcaaaaaaaactcttaaattggttaaacaaacaaaaaaaaccacaccgtgtccttttgttgtttytaagggtttatggaaaaatatattggagagttacaactacttcaggctaattcaatataaagagtatttttattattagtttggaatattaaagtttcca

SEQ ID NO: 50440 - DNA, 201 bp, Homo sapiens
ggtctactttagggtttcactgagtacaggtggtcacagatatccacaggttccaaccagtgatggaaaatattcagggaaaaaaaaacagtaaaaataayaccataaccataaaaaaagcaatgtaataactatttacatagcatttacattgtattagctatcatatataagtaatctagagatgatttcaagtataca

SEQ ID NO: 50441 - DNA, 201 bp, Homo sapiens
ctgcctattttaagcaattttacttgaactttcaaatatgtgccttggtcatcccaacagatacctgcacctagttggccaatcagatcactaattgtccrgtctcagcgattgatctagacacatttatgaccaatatatggcaaatgagagttctttgggggaaattaatttgaatgttgcagagtgttggccttctca

SEQ ID NO: 50442 - DNA, 201 bp, Homo sapiens
catctgatatttaccaggaattaggggagaaacagtggatactaccatggttcctgcttttaaggagctcatagtctaagagtggagtcagataagtcaayaagattacaaaataaatgccagaagaggaaaaagtgggagacgccaaggaggcaaggagggacaccaagcccagccacaataagagtgggaatgtcagag

SEQ ID NO: 50443 - DNA, 201 bp, Homo sapiens
ggctttaccattttacaaatgagcttactgtgatgctcagagaatccagagaacaagctccaaggtcatggacagaaaaagtggcagaaacaggaagtgamccaggttcctgtgattcaaaagctgcagtcctaactgtgatgctgtgctttcctcatctgccatcaatgcttccaacctccagggtgtttggagaaaaaa

SEQ ID NO: 50444 - DNA, 201 bp, Homo sapiens
tattggagagttacaactacttcaggctaattcaatataaagagtatttttattattagtttggaatattaaagtttccacttaaaattgattttttgaartgttttcaggcaacatcatttaattcagcatagagtatcctatgtctttcaaaaagaacttcatgggaatggtagataaaaagattaagtggaattttta

SEQ ID NO: 50445 - DNA, 201 bp, Homo sapiens
agagggaaccactcttctgacacttaactgtacaaattagattggcctgtttggggactttctactgatggacccatgctgtgtatactcttttgtgtcamcttctttcagtcatcatggttagtcagatgcatgttgttgttgcatatcgtttgttcattctcctccttgctgctgtgcaatataccattacgggaacta

SEQ ID NO: 50446 - DNA, 201 bp, Homo sapiens
caaagagaaaactctaaactctgttaataattgtacattgtaaggtagtaaggcatgttagcctcactgtgcttgtcacagatcagaatctacctagagarctggggtacacgtagaagcccaagagtactagatgatctcctataaagagccaggatggtagaagacctgtggattggccttctgctatgtttctgtttc

SEQ ID NO: 50447 - DNA, 201 bp, Homo sapiens
agagttcctaggtcctgtgttcagattttgagagccttcatgtctcaggtcccaatagcagtttctatgactgaccagcctgtccacagagcatctcctcrctggacaggcattgtgggcacgctcctgcggaggaagaatcagggtggtgaggcaattagtaggtgttctacaatcctgacatctttctcagaccagccc

SEQ ID NO: 50448 - DNA, 201 bp, Homo sapiens
tttatgattatggatcatggttgttgtttcccatttattccaagggagcgatgtttggggaagggctgagtacacaagatcacattcagttgctaaatttktacccaaaccaggaagccatttgcactaagcacattctgatggaaatgtgctaagattgtggcttctttaggggcctgggccagggcatggatttgatgc

SEQ ID NO: 50449 - DNA, 201 bp, Homo sapiens
taaggggtgtaagaaaaatcttactgtcgaagtctggataaaaggaagaaattaggacagtaaaatgaatcatgatgggggaccccagttttggccatgtstcacctaatatgtcataaacagttcttcagcttcattaaagaatagcttaccagaaagaagggcagacactggaggctgaactgcagcgaatgaaaacct

SEQ ID NO: 50450 - DNA, 201 bp, Homo sapiens
tgacacttaactgtacaaattagattggcctgtttggggactttctactgatggacccatgctgtgtatactcttttgtgtcaccttctttcagtcatcayggttagtcagatgcatgttgttgttgcatatcgtttgttcattctcctccttgctgctgtgcaatataccattacgggaactaaccacattcaattctat

SEQ ID NO: 50451 - DNA, 201 bp, Homo sapiens
agagattaaagaaatcttcgcctccaagaagtctggatctaagtcatctccctttacttgatcaggcccatttccaccccctagttcagttgacagagatmggatggcagcctctgccagcatgtttcaggatatacccaggaagcaaatacctggttggaataacaaagtccaaagcgaagcaagagggtgattgttaaa

SEQ ID NO: 50452 - DNA, 201 bp, Homo sapiens
gtgaaatcatatgtgctcaatatgggggttagcacatagtcaatgaatattcaaattcattcatttaaatatttaaatatttaaaaaataaatattgagayacactaccattcatttggcacacagcacatgctacttttaattgtgatggctcaaataacctatgatactgcaaagaccatttttatgcccttataggtc

SEQ ID NO: 50453 - DNA, 201 bp, Homo sapiens
cattattcattctcagtccctgtgcttttatgattatggatcatggttgttgtttcccatttattccaagggagcgatgtttggggaagggctgagtacasaagatcacattcagttgctaaatttgtacccaaaccaggaagccatttgcactaagcacattctgatggaaatgtgctaagattgtggcttctttagggg

SEQ ID NO: 50454 - DNA, 201 bp, Homo sapiens
ccagaaagaagggcagacactggaggctgaactgcagcgaatgaaaacctgaaataatcacaaggtggtcctgttgccatcatctctttatcagtataaarataaacaacctttgaaaacagatggagacagtcattgctcaacttgtcataacttattacatatttggctgtcaatttgtacttaaaaaaccaactagct

SEQ ID NO: 50455 - DNA, 201 bp, Homo sapiens
taaaaattaagaaatttttagtgaaaccaatgaatttgctttcagaaaacagcattttacaatatctattgggtaattatatcaaatactcgattccatgkttgctggtattggataaatgactaaatttgtaattaaacacatcttttggactaaagttactaaacagatagttgagtcaattacataacagcaatgggc

SEQ ID NO: 50456 - DNA, 201 bp, Homo sapiens
ctccaagagttcctaggtcctgtgttcagattttgagagccttcatgtctcaggtcccaatagcagtttctatgactgaccagcctgtccacagagcatcycctcactggacaggcattgtgggcacgctcctgcggaggaagaatcagggtggtgaggcaattagtaggtgttctacaatcctgacatctttctcagacc

SEQ ID NO: 50457 - DNA, 201 bp, Homo sapiens
ttggcacacagcacatgctacttttaattgtgatggctcaaataacctatgatactgcaaagaccatttttatgcccttataggtcatgtagtaccttttrttctctgatatgtccctagtacacattacagtgtttcacacagagtaggcacttaaacataccagctagtggatagtgtgatgatgccaggaagtaatat

SEQ ID NO: 50458 - DNA, 201 bp, Homo sapiens
ctctgccactctgcagttccatcctcctaccctcagagtacaggggcagggatttctttaacagtcttcacacccagaactgagaaccaacctcccacctrgctggccagtagagtcttttgaagatgagaaaaaaaaaaaaaaaaagaaaaaaagaaaaagctgaatgatgagcagtggcctccaattggacatcccctc

SEQ ID NO: 50459 - DNA, 201 bp, Homo sapiens
ttcttagcattcttttctcagagaacatgtgtatagtccttgtatagggccataattttcagatacacttttcccactcttctttgtgcttctctgtcctyagttgcttttctcatttaatctttataatttccctgtgatttaaattatactttcattttacagatgagaaaattgagacacttatattcacatatccca

SEQ ID NO: 50460 - DNA, 201 bp, Homo sapiens
taaacagtgtgaagtccacaggtctgaataatttcttcttgctccaagagttcctaggtcctgtgttcagattttgagagccttcatgtctcaggtcccartagcagtttctatgactgaccagcctgtccacagagcatctcctcactggacaggcattgtgggcacgctcctgcggaggaagaatcagggtggtgaggc

SEQ ID NO: 50461 - DNA, 201 bp, Homo sapiens
caaatgcttccaggtccacaccacagggaaacagaacttccttcacctaactgtcaaacacagggcctggacttaacattatatcactggaataagatgcrctgactgacttcttctaattaggactcattccaaaagttcaatcggtaggagatagagaaaggcaatcctaacccaaaccacatgagcagagaagaagta

SEQ ID NO: 50462 - DNA, 201 bp, Homo sapiens
ctccattcagcaaaaatgcattgagctccagctacatgatgaggactgctgtaaattccgtggacacagcagtgaacagaacagaccaagccctgtcctasagtccacctgctagtaagggaacctgacaaatcaaaagttaataaaatacatggtgtgtcagttgctatgataggtcctgataggggctatggaggtcaa

SEQ ID NO: 50463 - DNA, 201 bp, Homo sapiens
aagtccagaacactttttacttagccttcctttcctctctccttcactcaaggtcagattttcatctcagtttgatagctctccccgctcctcccagcttygtccccattttttctcacccggctgtttcccctaatataataattggtcttcaattttaacttgcatttgctcctcaggagatctgaacttatatgtcat

SEQ ID NO: 50464 - DNA, 201 bp, Homo sapiens
tatacaagggtaggaaactaacaagtatggagcatctcatatgtgtactggcatctgacttctcatttagtcctcataacaagtttataaggtagatagtracatcccacattacagaggaaaaacacgagcttgtaattgcatgataagcgcataaggagcaaatctggaatccaagcctgtgttctctgcagggtgcca

SEQ ID NO: 50465 - DNA, 201 bp, Homo sapiens
aagaagagggagtgggtatcaggacagttaagcagcatactcctgctatagttagtgcttgaggcagtcctgtagcacatccccacagcaatctgtactgsaagttgaagaatgaatgctatgagaactttatctccttcttatgccaccatcatagagtcaccctagtctcccaatttgcttcaccgcgcaatgtcagga

SEQ ID NO: 50466 - DNA, 201 bp, Homo sapiens
tgagcctgggaggtcaaggctgcagtgagctgtgatcataccactgcgctccaacctaggtgacagagggagaccctgtctcaaacaacaacaacaaaatytggggcttaactgcccagagaagcccagcaggtgaggccaggttttaaaactagatagcccaggtcctcagccgggccactggcttgattctgctttggt

SEQ ID NO: 50467 - DNA, 201 bp, Homo sapiens
ggccaggcatggtagctcactcctgtaatcccagcactttgggaggccaaggctgatggatcacttgaggtcaggagttcgagaccagcttggccaacacrgtgaaaccccatctctactaaaaatacaaaaattagtcaggcatggtggcagacgtctgcaggctcagctacttgggatgctgaggcaggagaatcgctt

SEQ ID NO: 50468 - DNA, 201 bp, Homo sapiens
ccatatgaccatccctagatcaggagtggggtcagccccacccacctgaactgtacctgtactgagggtgaggaaggggtgatgcccgagggaattataahataggtaccagaagaagagggagtgggtatcaggacagttaagcagcatactcctgctatagttagtgcttgaggcagtcctgtagcacatccccacagc

SEQ ID NO: 50469 - DNA, 201 bp, Homo sapiens
gggatgctgaggcaggagaatcgcttgaacctaggaggcagaggttgcaatgagccaagttcacagcaatgcactccagcctgggtgacagagttagactmggtctcaaaaaataaaaataaaaatgaataaataaataaatgtgtctacaaacagaggtttttgagagtcaggcataagcccccaccttagtgatactga

SEQ ID NO: 50470 - DNA, 201 bp, Homo sapiens
atgataggaatggaaagccctgattggccaggcctgaaccatatgaccatccctagatcaggagtggggtcagccccacccacctgaactgtacctgtacygagggtgaggaaggggtgatgcccgagggaattataacataggtaccagaagaagagggagtgggtatcaggacagttaagcagcatactcctgctatag

SEQ ID NO: 50471 - DNA, 201 bp, Homo sapiens
acagaggtttttgagagtcaggcataagcccccaccttagtgatactgatgcagccacctcgaaatgggaggtgggtcacccatctttatttgtggtcccsgaagaaagaagatctcagcggggagaaggtggggtggggcacatcaactccttgcaggtagacactctgacaagaatgtatgcactactcaaaatgtttc

SEQ ID NO: 50472 - DNA, 201 bp, Homo sapiens
ttcattctcaggttgactttctttgtgtggttacaggtggccactactagctccagatggatgccctaaccacctccaagtttaacagaaagataacttcytttccctaagcgttctgaaagaactaaaggacaatgtcctggaattgaatttcactcccagggtggactcacttaggttatgtcctcatcgcatgatgat

SEQ ID NO: 50473 - DNA, 201 bp, Homo sapiens
caatcaatgatattttaaagcagcacataagagtatttagctttaatgtgatcattgcctcaggctgtaataaaaacagaatttttccccaattattatcmgtcactcctcctccatagtccatcatgataaaaccgagcgactttcattcctcaccaggcaactaatcatccctttgctgagcattcttcataaatggaa

SEQ ID NO: 50474 - DNA, 201 bp, Homo sapiens
gtatttagctttaatgtgatcattgcctcaggctgtaataaaaacagaatttttccccaattattatccgtcactcctcctccatagtccatcatgataaraccgagcgactttcattcctcaccaggcaactaatcatccctttgctgagcattcttcataaatggaatggaataaatttcattatgcaatgcggtaatg

SEQ ID NO: 50475 - DNA, 201 bp, Homo sapiens
tcctaatcatgcagcccataataggctgtgccaaccccacttatcctcaaaacagccctcccttaccttgccggcctcatctaaatgctgctgtctgcagkgcacggtggctcatgcctgtaatctcagcactttgggaggctgaggcgagaggatcacctgaggttgggagttcgagtccagcctggccaacatggtaaa

SEQ ID NO: 50476 - DNA, 201 bp, Homo sapiens
gagccactgcgcctggcctacacagtttttatgcatattgctctctgtacggagaaaggtaatgcagactcattcatcctttgtatttcaggtctattgcyacttctttgggaaacatcacccctcagtctagatctgatacccctcttattccctcttctgttttatacctcttcttcctagcccaggtgtttacaattc

SEQ ID NO: 50477 - DNA, 201 bp, Homo sapiens
aaggtatttacacagttttgttttgggtttctttgttttttgttttgttttgttttgttttgtttttttcaacggagtctcactctgtcaccaggctagartgcagtggcgcaagctcagctcactgcaacctccgcctcccaggttcaagcgattctcctgcctcagcctctcaagtagctgggactacaggcacctgcc

SEQ ID NO: 50478 - DNA, 201 bp, Homo sapiens
caggacacagagtgattcaccttcagtatagctcccactagtgtgttgctcttatcccacaagaacgtgactatccaggattccttaaatccaccaggctytgagccagactgcatttaccaatccacagaaatagtgcagaccaattccttttgtgaaaattaacatatattttgtctatggccttctcttcatcacttg

SEQ ID NO: 50479 - DNA, 201 bp, Homo sapiens
agggagggcacttgagttcagaagccaaaagaaatgggtattgctctttccgcgctaagcagttctgaacctagaccatatccttgggagaccagagcagstgtaagcagcaaactgcctcttttctgcctccctgtgaacctgcttccctggagggtatgctcaaactcaattccctgttttattgttcaaaggacaggg

SEQ ID NO: 50480 - DNA, 201 bp, Homo sapiens
ttagctgggcttggtgacgagtgcctgtagtctcagctacttgggaggctgaggtgggaggatcgcttgagcccaggaggttgggtctgcagtgagccacrgttgcactccagcctgggcaacatggcaagactcggtctcaaaaaaaaaaaaaaaaaaaaaaaaaaaaggaaactttaaaagttaaaaaaaatagaaaaa

SEQ ID NO: 50481 - DNA, 201 bp, Homo sapiens
aaattaagaaatttttagtgaaaccaatgaatttgctttcagaaaacagcattttacaatatctattgggtaattatatcaaatactcgattccatggttkctggtattggataaatgactaaatttgtaattaaacacatcttttggactaaagttactaaacagatagttgagtcaattacataacagcaatgggcatt

SEQ ID NO: 50482 - DNA, 201 bp, Homo sapiens
tttccttagaaaaccttcaaaacagcagtgtcacagaatcactcttgattaaccactggacttggaaaggcctaaggttgagaggctcagatggccccagmgtaaaagccctcagtatgcctgcttcactgagcattacatgagactgttccagctctgtgatgatcaaataagaaaagcttgtgaggattttcactcttc

SEQ ID NO: 50483 - DNA, 201 bp, Homo sapiens
cccgctttgtaccccacctcactcccagcttctagatacctgaggtttggcgacccagctacgagactgtcccttccttccaccacctgatagtgcaaaaytgggacaaagtcatcattaggcagcgtagttagtagcaagatattagaagtcctcagaatagcatttgcgttttcatatactactttgttaaccctatgc

SEQ ID NO: 50484 - DNA, 201 bp, Homo sapiens
aaactagatagcccaggtcctcagccgggccactggcttgattctgctttggttttgcacaccagggtctctttctttgttactgaggacggttaggagasaactggctcatgtccacctgcttggtcaggaaacaattttagattggtgtgtttggggtggccagttgagtgaatggctgtaggctgtgtcccaggcact

SEQ ID NO: 50485 - DNA, 201 bp, Homo sapiens
gtcagaaggactgtcctgctgttgatgacttcactttacttaagcatggttcaatcagaagcaggggagtgaggaaattccttaacatatttatcaacatstgtttctaggcatccagctatgtacaggaaggaactgttgaccacagaaagcatcctgcttgggcatttctgtgcaatgtctctttgctggaaggaccat

SEQ ID NO: 50486 - DNA, 201 bp, Homo sapiens
tgagtgaatggctgtaggctgtgtcccaggcactacagtcacatttgcaacaattctcacattggcagtctgctgctcatgacgaagagacgtgtctacayctgaaagcaaaacttggcctgcagggtgaccacctcattctggtttgcccaggagtgtcctggaatcccctcagtcctgggagaactatctggttctcat

SEQ ID NO: 50487 - DNA, 201 bp, Homo sapiens
cttctgctataagccatggtgtcctgggaatgtaagtggtaacgcctgttccctacccccgtggctgaggaacaccagccctgccctattcctctgtgggkgattgtggcgataattctagttccctggaaagcacacatctgagattcagcatgatgtatcttatccccagcacgattattttccccctcattttttctt

SEQ ID NO: 50488 - DNA, 201 bp, Homo sapiens
gcaacaattctcacattggcagtctgctgctcatgacgaagagacgtgtctacacctgaaagcaaaacttggcctgcagggtgaccacctcattctggttkgcccaggagtgtcctggaatcccctcagtcctgggagaactatctggttctcatttggaaccaggaggccccaaacccattcaaactaaagaatcttcaa

SEQ ID NO: 50489 - DNA, 201 bp, Homo sapiens
ctgccgttagctgaatatggcagcacttccatgctgagatctatgaagtatagattatacatttccatgctcattcaaaatatgtattttttatgattgaygaggacattgcagcatgccaccttcataatttgcatttttaaatggttctgtgtgtaaatcattggcgtgtattacctcaatcagaagccaaataactaa

SEQ ID NO: 50490 - DNA, 201 bp, Homo sapiens
atgatgattaacaacaacaacaacaaactccatctctacctcttagtctgtgtttccttcattctcaggttgactttctttgtgtggttacaggtggccaytactagctccagatggatgccctaaccacctccaagtttaacagaaagataacttcctttccctaagcgttctgaaagaactaaaggacaatgtcctgga

SEQ ID NO: 50491 - DNA, 201 bp, Homo sapiens
gcctgcagggtgaccacctcattctggtttgcccaggagtgtcctggaatcccctcagtcctgggagaactatctggttctcatttggaaccaggaggccmcaaacccattcaaactaaagaatcttcaatggaaatttagtttccaatgagaatcgttccaactagatattccccaaaatgctagaatttaaaatagcag

SEQ ID NO: 50492 - DNA, 201 bp, Homo sapiens
tgcttttcttaaatatgttgtgcgggaatcagagataaatataccttaacacatttttatatttcattactattcaatatattttttttgttgttctaacraagaaaacctccagcttttataataccattaccgtcaaattaaagactagccttcatctttccaaacatatattttgtgctttgctcaaagccaggaatg

SEQ ID NO: 50493 - DNA, 201 bp, Homo sapiens
cttccccatacttttttctccttttcctcttcctctataaactctaggttctttcactgcatttcttttttgtaaacagctttactgaggtataattgacmtacaaaaaattgctccggtttaatgtatacagtgtgatgagtttggatatatacaagcactggtgaaaccatcagcttcataatcaaggcttccaatatc

SEQ ID NO: 50494 - DNA, 201 bp, Homo sapiens
acccagattaagaagcagaacaagactcttcctcttatagccccttctaatcaccagcttctccccagagggaaccactcttctgacacttaactgtacarattagattggcctgtttggggactttctactgatggacccatgctgtgtatactcttttgtgtcaccttctttcagtcatcatggttagtcagatgcatg

SEQ ID NO: 50495 - DNA, 201 bp, Homo sapiens
catgaccacatcactgcactccagcctgaacgacagagtgagaccctgtctcaaaataaataaatatttttaaatagataattacagtaactttccctggstacaaaaaattttctgtttaagggaaagtattaaaagagaaaacgatgtattcataaaatgataggaatactgttttgaagaacctattttgatgctatt

SEQ ID NO: 50496 - DNA, 201 bp, Homo sapiens
tccttttgaagcaccactattagatcattcggtcacagaaagcatggtttgattggaattagaactcactgcctcctctggtgagtttgatgcttgacaaygatgtgccattttgtcacatcaaagaggttcacctggtgacatctgccatctctgctcatgtttgctttaacatcacacttctccctggaaagcacactg

SEQ ID NO: 50497 - DNA, 201 bp, Homo sapiens
ccgtcaaattaaagactagccttcatctttccaaacatatattttgtgctttgctcaaagccaggaatgacctggctcatgaaggggttcattagcaagawgcttgaaggaaaggaaaaatttgctagttgatcgagaaaatataaatgatgaggctaaactcatatttgagatgttctagattttcctggtgagatttca

SEQ ID NO: 50498 - DNA, 201 bp, Homo sapiens
cggagttgttaagggaagaaaaaaacagaacttcttaaaggttgacacggtgccactcattaattctagaaaagtttgcaggggctgttacatgtcagacrcaatgctagccttcccagatgcattgatgaacaagttgcaattcttgctgtggtgagctaatggtaaaaataaacagagcactgccacacacagacataa

SEQ ID NO: 50499 - DNA, 201 bp, Homo sapiens
aattggttcattttctaaaattatttataaaatttgttgaactacgagagttatgccaatgtatccttcccttgtgctaccgtaagaatttgtacataccyctgctaagctttgatttattttattgcactcatatgtgaatatgactgtcctcaacgctaaactttgacctctttggagaaagagacttgttttttgatc

SEQ ID NO: 50500 - DNA, 201 bp, Homo sapiens
cataattttgtcactgtcttttggagcatccccatcctcatggccagctgaaaaccccccgtcactctcagatctgcgctctcctttctcaaggggttggycgtgcttgaagtcacaggaaagcaaaacttcaaagctggctttcaaggtcaagaaaccaggcggcacttgctttaatgagagagctgcagtcaggaggaa

SEQ ID NO: 50501 - DNA, 201 bp, Homo sapiens
gttttcacatcactgacaaagatattgggctgggaagaggcacgcttggagtgagacccttcaggaagcctctgtttttaactttagctgtgacactgggmtctcagtcatggaagttcactgacatctactcatcctgcattagtaatatgggcatggtgcattttctgtatttattagctatgtttaacagaatcttta

SEQ ID NO: 50502 - DNA, 201 bp, Homo sapiens
ccatcttcatcttacaaatgagaaaactgaggcttagtgaggttctatagatgctcaaggtcacagacccaacaggtgactgagctggggtttaaatctcmagggggtcttttagtaaggcttatgcttttaagcaccaaactctaccaggatataaatggcaaaaggaactgcttaagatatgaagagaaaagaaacaca

SEQ ID NO: 50503 - DNA, 201 bp, Homo sapiens
ttgaacctgggaggtgcaggttgcagtaagctgagatcactcaccactgtactccagcctgggcaatagagcgagactccatctcaaaaaaaacaaaaatrctcttctctcttgttgtcctttgtaaacttctgaaaattagacaatacttgattcttttacttccctaacaagtacctgcttaccaacctgctatagttt

SEQ ID NO: 50504 - DNA, 201 bp, Homo sapiens
acaataattggatattacttcagtactaaaaatatttttaaggtcagccttaagtttgccagaaaatttagacttttgaaacctcatcgcaaactttgcartttatctacataacagtctaattgattctctactaggttaatcagtctatttctcattataggtgcaaagttttatttacttcaggagatagaaattggt

SEQ ID NO: 50505 - DNA, 201 bp, Homo sapiens
caatgcgtgtctgtcatataattaccctttctctgctgtctggaaacacaagacaagcccggataggaagctgcatgagctggtgaaaacaaagtggtggwcatggagtccagtgtgtgggactgcataagaggagaggcacaggcatcacccacaggcaattggagcaggtgcactgaggcccacctgctgcatgtcagc

SEQ ID NO: 50506 - DNA, 201 bp, Homo sapiens
aaccaatggaataagtcctctccaaccaccttcaattcatgtgccctttgtttcttggttcctgttgccaggagagagcttctgattggcttaggttgtawcataaggccacccttcttgggcaggtttggaggaaacaacactgtgactgacacccctgccaggtctacagggaaacacagagaggtaatggccaaagat

SEQ ID NO: 50507 - DNA, 201 bp, Homo sapiens
aaatattctcattcctacatccaatagctgtttttcttatttggttggaattttccatatgaatcaacatgctcaaccattttcttgaggatctttttgtsgtagcagttgttgtttaaaaaacaactttattaatacataattcatatactgtataattcacccatttaaaatgtgcaatttaatcttttaaagtatatt

SEQ ID NO: 50508 - DNA, 201 bp, Homo sapiens
tcgaggctgcagtgagctgtgatcatgccactgcactccagcctgggtgacagagcaagaccctgactcacacacacacacacacaaaaagtagaaacttrgaagcaacccaaatgttcatccagtagggattgactaaataaattatagtggatctgtacattggactattagacagctgttaaaatgaacagctctgta

SEQ ID NO: 50509 - DNA, 201 bp, Homo sapiens
gaaaccatgatccagcctccaggggaaggtactggcaagagccaagcattgcactcagcagataggttggggttcaaagtaaagcctggtcttagaggccractagaggaccacgtggagacatggtgtagactacagaatgtgtgtgtgcacgtgtgtgtgtgttgttgtgatatccacagtagaaacccagatctgcac

SEQ ID NO: 50510 - DNA, 201 bp, Homo sapiens
cagtccagcaacagagggctggataagatttcaccttcctatgatccactgtcagcaggctagatgacataagcacacagcctagtggcagtgggctgggkaggaaaactgcaaacatcatgcaatttatataacattttcccttaacacactccccctaatgacctccacctggcaaccttcatcaacccaaaactcagg

SEQ ID NO: 50511 - DNA, 201 bp, Homo sapiens
agtgtgttaaaaaaaaatacggtatttttttcatctacactctgtaaagacaagcccacaacttcatatggggctcagctgaaggtcagccatctcttccracacaagaaaagaaaatggcggtgttggacttaatgagacatgattctgtactatacttaataggcgattttactgatttcatgggtacatcatgctgta

SEQ ID NO: 50512 - DNA, 201 bp, Homo sapiens
gaggatctttttgtcgtagcagttgttgtttaaaaaacaactttattaatacataattcatatactgtataattcacccatttaaaatgtgcaatttaatyttttaaagtatattcacagggtgatgcaaccaccaccacagtctgattttatatttttagaggaaacaaatatatatgtttatatttaaattttatttta

SEQ ID NO: 50513 - DNA, 201 bp, Homo sapiens
tgtgtgttgttgtgatatccacagtagaaacccagatctgcacactaagaccatgggcagggtgggagaagggacccggtgagagagagggctgtcctgcraccctttgtcccacattctttggacaacttaatcctagtctcctgtatctgaggcctttgcctgcactgccataattggctcagaacccaggacagagtt

SEQ ID NO: 50514 - DNA, 201 bp, Homo sapiens
gcaagtcaaaaaaggaggaaatcgggctgcttgtgaaattctcttgtcattagttccggttgcttattagagtgtgtagaccaagcgcaaggaatgagaawaagcacacatcaccgtcagccaacaatcagccacaaagtggagcccattagatctctggcttaggctacgagagttggaagttaccgaacagattttagg

SEQ ID NO: 50515 - DNA, 201 bp, Homo sapiens
accttaatagattttaagtgtacagtagtattgactctaggtacagcattgtatggcagatcgctagaaccccttcatcttgtttaattgaaactttatgsctgttgattagtatctctcaagttttccctccccctagaccctgacagacaccaattcagtctttggtttgggttatatgactattttgagtacttcatg

SEQ ID NO: 50516 - DNA, 201 bp, Homo sapiens
gttgtgatatccacagtagaaacccagatctgcacactaagaccatgggcagggtgggagaagggacccggtgagagagagggctgtcctgcgaccctttrtcccacattctttggacaacttaatcctagtctcctgtatctgaggcctttgcctgcactgccataattggctcagaacccaggacagagttggataatg

SEQ ID NO: 50517 - DNA, 201 bp, Homo sapiens
tcttgtttaattgaaactttatgcctgttgattagtatctctcaagttttccctccccctagaccctgacagacaccaattcagtctttggtttgggttayatgactattttgagtacttcatgtaagtggaaccatgcagtattagtctttctgagactggtttatttcacgtcacataatgtcttcaagattcatccat

SEQ ID NO: 50518 - DNA, 201 bp, Homo sapiens
tgtttgtacctcttgtgtattgtgaatagtgctgcagtgaacgtggtagctctccagtaatatcttcaaactatctcttgaagatcctgatttcaatattkttggacaaatacccagaagtgggttgctgggtcatatggtagaaaagttggttttttgaaaagataagcaaaattgacaaacccttagctagactaaggg

SEQ ID NO: 50519 - DNA, 201 bp, Homo sapiens
ttttataaagctagtattaccctgacaccaaagccagacaaacaccacaagaaaagaaaacaaaagaccaatatccctgataaatgtagaagcaaaagtcyttaacaaaatactagcaaactgaatccagcagcacattaagaggatcacaggtcatgatcaagtgtgcatgggagtcaggaattgttcaacacacagaaa

SEQ ID NO: 50520 - DNA, 201 bp, Homo sapiens
ggaaaagagaggttaattagcccaaggacacacagtttccccaagatcaaagagtcagtggtggggccataatttaaaccagggcagtctgacttcagatscacacttttgacctgggcttccctgctcaattacaaataccaaattgactccttatcttctccccagaacagcctccctttccggttttctcccctttcc

SEQ ID NO: 50521 - DNA, 201 bp, Homo sapiens
agcccctttctttttcacctgtgaattagcaaatgctgcacccagaatctttcctccacctctaccccattctcttcttgctgccctgactagttgaactrtcctctttatcttaacctgtcgtgacaccacctccctggtcaccgtgctcttgccttcttgccttcttgcctttccaatttatcctgctcactgacacct

SEQ ID NO: 50522 - DNA, 201 bp, Homo sapiens
gagagtgcagaccactttcacatgcagcttctcatttcattctcataacctagaggacgggcacattatcctcctttacagatgagaaaatttccttcaayccctctgtgtcctgtctcgaggggagcagtattgggcctcttctctgaggctgatgtaactgctgattcctctcacacctcctgtgggcatctcctctgc

SEQ ID NO: 50523 - DNA, 201 bp, Homo sapiens
ggaagcaaggctggatgaggctgcagcaggcctcggatgacctaggctaaagatgctgcggatcactgtccggagactgctgtcgggggaatcccacaagwcacacatggtctggtgttggtggcggccccagaacctcactctcctctgcacacctctgcgtgcctacgtctgttcctgtgactgaggggattgtgttca

SEQ ID NO: 50524 - DNA, 201 bp, Homo sapiens
tagatagaaggcaagtgtcatatgccactgcatccccaactctgaggacaaagcctggtggcaggtggaccttcattcagggtgaattgagctgaattcgrtacatggctctgtactcagaaggcctttatttatttcttgtgttcctcttatcttgtcacactccaaaatagaaatgtatacctctgctagttgaatgac

SEQ ID NO: 50525 - DNA, 201 bp, Homo sapiens
caagttgtgtttgggaagattagaaaagggagtgcacaggaggatgaagctgaagtctctgaggaggtaatcttgttcaaataatagcttttcttgtaacyatattttgtcaaattggttatttctgatgatgtatccccaattttctgaaatgttttaaaacttacattgtagctttctctcatttccttattcctatgt

SEQ ID NO: 50526 - DNA, 201 bp, Homo sapiens
aatcggattcaggaacaacactgggttacatttggattctatgtatttttagatgtttaatttctatttgcctatttcatgaaagattggtaatcacacayaaatctgcatgagtaagaagagacccatgaaaataaatagtcctacagatgtaagatttgagataaaacatatcttaagtgaatagattgtctttgttct

SEQ ID NO: 50527 - DNA, 201 bp, Homo sapiens
aattgtctaggattcctgagaactgccatcaaacattcattttgcttttcctattgctaagcattatcagacagagacacagcttctacacaaaggaagayggtagggcattgtctgttcagggctgctagatcaatattatagttttatttatctattaatttatttggatttctaagcagctctaccttttgttacgat

SEQ ID NO: 50528 - DNA, 201 bp, Homo sapiens
atgtatgcaaaaatattttttggtgcggaggccaccaaacctgctggactcacgttcctgcttttggcaagcaaagcaaaagaaccttctgggttcccttyctgcctttcctactgagatcaagctgaaggtggaatttttctatatatccagttcagcctttgtgacctctgcctttaacacaaacaccttgtttaaaaa

SEQ ID NO: 50529 - DNA, 201 bp, Homo sapiens
aatgagatattctgaactcatgttgtaccttcctgcccaaccctggattgagtgacttcctcaaggaaccttggtttcttttcatggagggtggtctttaraaatcagtgtctgggtatttggtgaggttgtggctgctggagtgtcactgctgctaggtcctttcagcagacagagcaatgatacagacacacacatata

SEQ ID NO: 50530 - DNA, 201 bp, Homo sapiens
tcacgtttgcctcattacaattcctttggttaaagatgcttttctaagtacttcagaaaatgtatgcaaaaatattttttggtgcggaggccaccaaaccygctggactcacgttcctgcttttggcaagcaaagcaaaagaaccttctgggttcccttcctgcctttcctactgagatcaagctgaaggtggaatttttc

SEQ ID NO: 50531 - DNA, 201 bp, Homo sapiens
tcagcaggctagatgacataagcacacagcctagtggcagtgggctggggaggaaaactgcaaacatcatgcaatttatataacattttcccttaacacastccccctaatgacctccacctggcaaccttcatcaacccaaaactcagggcctcaatgtgtacagctcatgtcccatggaatgaaacggagtggggggct

SEQ ID NO: 50532 - DNA, 201 bp, Homo sapiens
gctacagacacattatgtcgatgagattagagcctttggtgttgccggctggtgtctctctggagcagcacttgctaccctccaaggaagtggaaatgatktgcgaggcagagcgtgtgcaccctgcagtgagaccattgcttcagtggttatggagcagccagagaacataaatgaactgctagctttaggggatattac

SEQ ID NO: 50533 - DNA, 201 bp, Homo sapiens
ctctgaacagccttcatccgcaatctaaatgggatctcgttattatattcttccatgtttcataagttcttaagtgattcttctttaatcccactaaatcrtgactccagatgagtttaagaaatcttaagactattttttaattattacaaaccaaaagtctcacactgaacttgagctacaataggggcaccttatcta

SEQ ID NO: 50534 - DNA, 201 bp, Homo sapiens
actattttttaattattacaaaccaaaagtctcacactgaacttgagctacaataggggcaccttatctatctgttgaatgaataaataacaatgagagarggggagggaggaagagaaattagtttaagaggcctcaggttgccacgttgggtttgaaatctagatgaagattgacatttcaccccaaatctttaactac

SEQ ID NO: 50535 - DNA, 201 bp, Homo sapiens
tacatgaatgagcatagctttattttaatactttattcacaaaatcaagcagcagcctcgatgtggcctgttaaccataactcgacgacctctattctagrgtattttgatacttgataccttcacgctctctgttttctctccccagaatcccatatttccttccacctttgttctcctagaagattcttctcagggaac

SEQ ID NO: 50536 - DNA, 201 bp, Homo sapiens
caccttctcagggcaggctgaacaaagcctgtctgaaggttgtcagataactatgttctccaaagtatggggagtttattaaaaactcagatgcctaaacyatactccgaacctactgaataaggatctctttctgtggggcccagggaatctgcattttaacagattcctaggtacaattcagtttgggaatcctacaaa

SEQ ID NO: 50537 - DNA, 201 bp, Homo sapiens
tggagatccaggtttcttccttttgaggaaatagaaagtgtgagaggttacatgggaggtttaagaaccacaccaagtacataacttctgctcacgttccwctgaccgcaatcagccacacaagtccatttgactgcaaggacgcctgagctgtacagtctagccctatgcccctggaacccaaggaaataggatccagtg

SEQ ID NO: 50538 - DNA, 201 bp, Homo sapiens
aatactttattcacaaaatcaagcagcagcctcgatgtggcctgttaaccataactcgacgacctctattctagggtattttgatacttgataccttcacrctctctgttttctctccccagaatcccatatttccttccacctttgttctcctagaagattcttctcagggaacaaataccttatttagaaaattttcct

SEQ ID NO: 50539 - DNA, 201 bp, Homo sapiens
gtgaacctggcctgtgtctgtggagattcactcgaggctttttcttgcagacataccatcttgcttttgtttctagaatatatattagctggtagctagtygacacccaggaggagacagcaaatgcaatagaaatgcatgactgcagaactcaaaccaggagagcagcttgactctcttagatatgtcttacaaatcaga

SEQ ID NO: 50540 - DNA, 201 bp, Homo sapiens
cacttcagtgagctagaatttgtattaagttctacttgctttattttccttcatttacatatgcttattagtaatacacgtgtgagaacaaaatcatataytatcagtcactgccacacaatgaataatcccatgtaaaatatttttgcacacttttgagagtgacaataacttcactgagcttggtttcttcctttgaaa

SEQ ID NO: 50541 - DNA, 201 bp, Homo sapiens
gtttgataaaaggaatttgtcattaacatttagaatttcacctttagaaattcccaatttctgggtagtgttgcgtcttcagagcagacagagatgccacmgttcagctgcctgggttcaaatctaaggccgatcctttaccaactaagtaactttggcaagttgggaaaaacaaaacaaaaaaactcactgtggttttat

SEQ ID NO: 50542 - DNA, 201 bp, Homo sapiens
tcaagatgagatgtttgcttttcaaatcagtgtgatcagtgaacctggcctgtgtctgtggagattcactcgaggctttttcttgcagacataccatcttkcttttgtttctagaatatatattagctggtagctagtcgacacccaggaggagacagcaaatgcaatagaaatgcatgactgcagaactcaaaccaggag

SEQ ID NO: 50543 - DNA, 201 bp, Homo sapiens
gagaagcttcagagtgaaataaaaattagcttagctatcttgaagaacaccaagaaggaatatgtggctgaactagaatgattttggggagagtgaaatgwtcaaagttacatccaaggttcacatcaggaccttgcaggccacagtgagaacttagaagacaattgacataggatgattggaaagcagaatactgaaagg

SEQ ID NO: 50544 - DNA, 201 bp, Homo sapiens
cagcagacatgtatctcctgttatataagcaatcagaattctcttttccaattgaacaaatccctctctgctttgatggggaaactgggatgtcagtttcsctaaaatgaaaattctatttcacagcaaaatggttccagtcaactggagagagagagaaagagaaatcataactgttttcccctccccagcctagcatcc

SEQ ID NO: 50545 - DNA, 201 bp, Homo sapiens
ttctactaaataatagcagtagcatctctccagcatttacatatgccaagctctgtattcagcactttacctcttttaattctcacgtatcctataaggaktattctcccccactttacagatgaggaaatggaggcagtgagaacataagcaacttggctgggatcactcagctactaagtcatggagccagggtgataa

SEQ ID NO: 50546 - DNA, 201 bp, Homo sapiens
atcgtgtggaaacctgtgtggtgaatagagtgggaggacaagagcagaaagagcaactcagaaacaatttactaagctgggtaagagatggtggcttggcygagaaggtaaccagcagatgatgagagatggtcaggttcaggttgtagtttgaagatacagctgatggaagcagctgatggagtggatgtgtataaggag

SEQ ID NO: 50547 - DNA, 201 bp, Homo sapiens
agagaaatcataactgttttcccctccccagcctagcatcctccccacccccttaacatggaaaactcctatacatcctttaaagcccagggaaaatgtgycttttctgttgaagccctttgtcaactcttccagacactttctcctttttaatcatgcagtagaacatggcagttaggaaaatgggctctttggaaaata

SEQ ID NO: 50548 - DNA, 201 bp, Homo sapiens
acacagtaagtgctcaatcaatgtctgatgaattaaataagctccatatagctttcctgagcaccccacattctgacccccttcatgtaaaccttaattgktattaataccattctgataacacttatctcatctgaccttacgtacttgccttttgttcatctctctggaccagaaatgcaccaaaagcagagtctgtat

SEQ ID NO: 50549 - DNA, 201 bp, Homo sapiens
agaaacaatttactaagctgggtaagagatggtggcttggccgagaaggtaaccagcagatgatgagagatggtcaggttcaggttgtagtttgaagatayagctgatggaagcagctgatggagtggatgtgtataaggagcattgggcaccctgttagcaggctttaggcttctttgactcaggcattgtaccaacatt

SEQ ID NO: 50550 - DNA, 201 bp, Homo sapiens
tcatcagggtgttggtctctcccacgggacttgattcctgttacttcttcgcaccatcccgcacaatgcctagcacacagtaagtgctcaatcaatgtctsatgaattaaataagctccatatagctttcctgagcaccccacattctgacccccttcatgtaaaccttaattggtattaataccattctgataacactta

SEQ ID NO: 50551 - DNA, 201 bp, Homo sapiens
cttcctcagattgcactggtcctgggaatggggtggcgtggggtccatgacctcagcccaaatcactcctcatacgaaggttggaacaggggacttggtcmcatgagccctatgcttcctcttaattctgaatgagtttcagattcctgcaggcagcatcagcaacatgcaaaagacgcttcttagatgcttgagactgta

SEQ ID NO: 50552 - DNA, 201 bp, Homo sapiens
ccccatctctaatcctatggtagggtatgcccttctgcaggaatcactgcttaatctcttccggcctccacctctccacctataatgtctaagtcaactgkcccctcctttgtaattccacagaactctgtgcttaccccatctcattgtgctgagctcatcagggtgttggtctctcccacgggacttgattcctgttac

SEQ ID NO: 50553 - DNA, 201 bp, Homo sapiens
gaatcagccttcccttcttattcaatgactacttttaatagagtttagggattaaaggtctcccaccttcttccatagaatttgactttcagtccaagacmccatctctaatcctatggtagggtatgcccttctgcaggaatcactgcttaatctcttccggcctccacctctccacctataatgtctaagtcaactggc

SEQ ID NO: 50554 - DNA, 201 bp, Homo sapiens
aagccgtggcttccttgaaggtcgagagcgtactttttcttgtccctttggtgtcctgaacagaaccagaatcagccttcccttcttattcaatgactacwtttaatagagtttagggattaaaggtctcccaccttcttccatagaatttgactttcagtccaagaccccatctctaatcctatggtagggtatgccctt

SEQ ID NO: 50555 - DNA, 201 bp, Homo sapiens
ttccagaattggtgagattctgaaccaaacaaaaaacaagatcacctcttttgacacagggtctgcattgtggtgatgtgtggaatatgttcatctgtacraaaatatttggggtttgagtgtaaaatcgagttgggttctagactcagataaacaagattttttttctcccccacccaaagactgtttatcagggtcatt

SEQ ID NO: 50556 - DNA, 201 bp, Homo sapiens
atatcttttatcttcacccaagccgtggcttccttgaaggtcgagagcgtactttttcttgtccctttggtgtcctgaacagaaccagaatcagccttccyttcttattcaatgactacttttaatagagtttagggattaaaggtctcccaccttcttccatagaatttgactttcagtccaagaccccatctctaatcc

SEQ ID NO: 50557 - DNA, 201 bp, Homo sapiens
gtagagctgaggtgtaatgacccagctgatctgtttgtactttctcatgctgctaatgggtacctggagttgagaatttatgcataggtgtgtacatgccrtcacagctctgtgtgcatgagtgcctgtggggtctgcgtagcatgcacacatcacagaaaccctctgccctcccttctcattcctctatttgaagccaag

SEQ ID NO: 50558 - DNA, 201 bp, Homo sapiens
gagctgaggtgtaatgacccagctgatctgtttgtactttctcatgctgctaatgggtacctggagttgagaatttatgcataggtgtgtacatgccatcrcagctctgtgtgcatgagtgcctgtggggtctgcgtagcatgcacacatcacagaaaccctctgccctcccttctcattcctctatttgaagccaagttt

SEQ ID NO: 50559 - DNA, 201 bp, Homo sapiens
aaaattttgtatagcatgtgatgctgtttgatagcattttacccacagtagaacttctttcaaaattggagtctaccctctcaagccctgctactgctttrtcaactggtttaggtactgttttaaatcttttgttgtcatttcaacaatgttcacagtatcttcccaaggaatagaatccatctcaagaaaccactttct

SEQ ID NO: 50560 - DNA, 201 bp, Homo sapiens
gattgtctctcttagacatgctggtaatacagctccttgtaaagctgattcttcccttggatttgctcatctcatatcagagactttaaggtaccctctgrcatacaccctctacaaaataggcatgttgcattttttggcatactagaccatcagaaggggaactgctatatcacagcctctggaatcctggctaactac

SEQ ID NO: 50561 - DNA, 201 bp, Homo sapiens
caaaacgaagggtctacaggccccacgcaagtccaaaatccagcagggcagataaatcttaaagctctgaaatgatcttctttgactctgtgtctcacatmcaggtcaccctgatgcaagaggtgggttctcacagtcttgggcagttccacccccatggctttgtggggtacagccccactcccagctgctttcacaggc

SEQ ID NO: 50562 - DNA, 201 bp, Homo sapiens
tgtggacccggtgacaaatgtggcaaacaggctgatgtagattccttgaatgtaccattagctactgccatgtcacattacacttgtttatgcaagaaccrtgcagcagataagagtgtttaaatgcctttattacatggcatcatggtattggtagtagttggtaatgatttttttttcctcagtgcaaagcacactctt

SEQ ID NO: 50563 - DNA, 201 bp, Homo sapiens
gatatacccaggaagcaaatacctggttggaataacaaagtccaaagcgaagcaagagggtgattgttaaatgagtaattagaataaacactgaaaaatgrtatctgcctgggcctctatttttctcgcttttgtagtcgtttttcataggttggacttcttgcccttcagagataatgaaccacaatatgcatctatctg

SEQ ID NO: 50564 - DNA, 201 bp, Homo sapiens
tagtttcacccagtagtcctgtctctacttaatggtagattccacattccagatttttaaaaaagtttattctgctttcttgtctactttaatctacacascagttcttttttttttatactttaagttttagggtacatgtgcacattgtgcaggttagttacatatgtatgcatgtgccacactggtgtgctgcaccca

SEQ ID NO: 50565 - DNA, 201 bp, Homo sapiens
aattaagcctatggaacaaaagtgttctttctcctccagactttcaaaggatgtactctagggctcgaagaaggggaacagagctgattatgttggtcctsttgtttgtgtttttcttcccatttaagaacgtacatttgaaggtgcagtcttgaaattcttgatatggatggcagacacttgtaatgagagaggaattag

SEQ ID NO: 50566 - DNA, 201 bp, Homo sapiens
cacacacacacacacacacacacacacatacacacacacacacaaaatatatatatttggagacagagcctcactgtgttgcccaggctggagtgcagtgrcatgatcatgactcactgccacctctacctcctgggctcaaatcttccttctgcctcagcctcctgagcagctgggaccgcaggattgcgtgccaccatg

SEQ ID NO: 50567 - DNA, 201 bp, Homo sapiens
ccctaaccacctccaagtttaacagaaagataacttcctttccctaagcgttctgaaagaactaaaggacaatgtcctggaattgaatttcactcccaggrtggactcacttaggttatgtcctcatcgcatgatgataggaatggaaagccctgattggccaggcctgaaccatatgaccatccctagatcaggagtggg

SEQ ID NO: 50568 - DNA, 201 bp, Homo sapiens
tgtcttgtcacacttgctgtttaacagccttaccatgccattcttgagagaaataaagtgaggtttcattaatgtgagagatcaatagtagttcagttatragttatcactgcagagggagagcagcaggttcagctcctcaagttggaaataaaaaagatgaatgggaggaggaaatgaagttagtgatctaccgcctgg

SEQ ID NO: 50569 - DNA, 201 bp, Homo sapiens
tctaaatatagcgcctgtcttgtcacacttgctgtttaacagccttaccatgccattcttgagagaaataaagtgaggtttcattaatgtgagagatcaayagtagttcagttatgagttatcactgcagagggagagcagcaggttcagctcctcaagttggaaataaaaaagatgaatgggaggaggaaatgaagttag

SEQ ID NO: 50570 - DNA, 201 bp, Homo sapiens
gggtacagcataagccaagctgcagagatgcggaggagtgaaaaagcctaagaaggtatgaattacaaatagctcagctttacagaatataacactgagtraggagaacaaacagatgaggccatgaagagtttgtctttcatgcttgaaaaactcagacattatcctgtagccactgaagggttttaaggagagtccttg

SEQ ID NO: 50571 - DNA, 201 bp, Homo sapiens
tctacttcctactctaaatatagcgcctgtcttgtcacacttgctgtttaacagccttaccatgccattcttgagagaaataaagtgaggtttcattaatrtgagagatcaatagtagttcagttatgagttatcactgcagagggagagcagcaggttcagctcctcaagttggaaataaaaaagatgaatgggaggagg

SEQ ID NO: 50572 - DNA, 201 bp, Homo sapiens
gcagggaaggcaggagtgactctgggaagacaaaccttcatgatggaggcaaccttcaagcaagtgattgtttgattatcacttgcttgaagtgattatcytccaaaggataagtgattgtttcctggggcttaggaggtgggggcgggaaatgtgcagggagggcagagggtacagcataagccaagctgcagagatgcg

SEQ ID NO: 50573 - DNA, 201 bp, Homo sapiens
aaaatattcacagattccaggaattagaacatggccatctttgatagatgtttttctgtgtgccatagaagatacgagagcttctagatccaaaagcctgrtggcatttagagctcacttccactgtgctcgatacatgaacctgacattgagcatctcacagcataatcacaggacggacgtgtgaagggaaaattgcta

SEQ ID NO: 50574 - DNA, 201 bp, Homo sapiens
tcatttttgttgtttgagttccttgtaaattctggataatagtcctttgttgaatacatactttacaaatatttttcccattctctaggttatctgcttastctgttgattgcttattttgctgtgcagaagcttttaagtttaattaaatttgaattgtccatttttttttttttttggtcatgtttgcttttgaggact

SEQ ID NO: 50575 - DNA, 201 bp, Homo sapiens
cctccctttcccagtatttattgagggatgaagagtctttctgtcaactttcagtgagaagaagtaaataaaacagctttgatggatacccccatgaacckgagtgaaagggatactcctttaaatcatagttatttcgtttgctaagcatggtggccctgagaatatgcctcccagagcctccaccacagggaacacgac

SEQ ID NO: 50576 - DNA, 201 bp, Homo sapiens
tcattcttgttgagcttgatggcattttaggcttgactttctctagaagtcttcactagattcctagaagagggaggcacagaagctcacaagctctaggyacaaaagccttgaagctttcgagaagacagataagccaggaagtgattctagctctgctgtatatctgtgtaaccatagttattcacccaacctctgagc

SEQ ID NO: 50577 - DNA, 201 bp, Homo sapiens
cactccacacaaatacaagtaaacgcatcacaatcctataactaattctgttccttgtcctgatgagcttccttctacaaatggccctaatattccctccmtttcccagtatttattgagggatgaagagtctttctgtcaactttcagtgagaagaagtaaataaaacagctttgatggatacccccatgaacctgagtg

SEQ ID NO: 50578 - DNA, 201 bp, Homo sapiens
acatgatattggctgggtattaaaggaaacaaacatgtcagacagccagaaatggcccacagcccatgaatttaaaacctctacctaagagcagcccattsctagctctcgcaccctctctgcccttgacctcaataatataccatatcttgattcactggctccaggtctcctaccaccgaggacttgccttactttttt

SEQ ID NO: 50579 - DNA, 201 bp, Homo sapiens
ctggcactgctgacaagcccagctccatggccggcccacactttgaggagctccacttctaatcatacctattcctacacatgaccatcttgtgctcatgsattttccacttgccaatgtctcagaaaccttcttcatgtccttcatcaacacgtggtatggcagaccgttgctatggccaacactgagtttcagggcttc

SEQ ID NO: 50580 - DNA, 201 bp, Homo sapiens
tccctgagtcccaccactggggataaccgctgtagacatccgagggttttgcctctctatttttaaagtgcgtatacattcataaagacacagcatcaggstgtaccaccagaggtttagatcccataggtctggggtgacacctaacagttaacattccaacaagcctcctggcactgctgacaagcccagctccatggc

SEQ ID NO: 50581 - DNA, 201 bp, Homo sapiens
gttctttgggcttcttttctattcatgaccctttggattataaaagaagagaaacaccatggggcagatatgtccaagaataaagaaaagagaaagttgcrcacctgagaagtgccccctgctggccagcatcatttctctgtgtctcactacagaaggaggtctttgtttatgaattctgccctccccctcttgccctga

SEQ ID NO: 50582 - DNA, 201 bp, Homo sapiens
cggtggcactctctcagctcactgcagcctcagacttcccgggcttaggcgatcctcccacctcagccttttaggtagtggggcctacaggcgcagaccayggcacctggctaatttttgcatttttttgtagtgacagggtctcaccgtattgcccaggatagtctcaaacgatccactcacccacttcagcctcccaaa

SEQ ID NO: 50583 - DNA, 201 bp, Homo sapiens
actccagcctgggcaacaagagcaaaactccatctataaataaataaatatccctgagtcccaccactggggataaccgctgtagacatccgagggttttrcctctctatttttaaagtgcgtatacattcataaagacacagcatcagggtgtaccaccagaggtttagatcccataggtctggggtgacacctaacagt

SEQ ID NO: 50584 - DNA, 201 bp, Homo sapiens
aaaacaaatttactaacgtagtcttcagatacataggtttgtttttctcactaatcctttgtggtcactgaaagagcataggccaccccagtcttttgccsagatagtgatgaaaatgctgatcttcgtgaatccaactgaaattttaacttcgtgcccaagctgttctagaactcaatttatcagatccagatttggtat

SEQ ID NO: 50585 - DNA, 201 bp, Homo sapiens
acaccttttatttctcagtacaatttttattttggaaatgatttttaaaaatgtagaacaatacttttgtctttatcttctgggcaaaaccagttttgaamaacagtgaacattttaataattgtagaccagtgctaatatgttttttgtttttgagacagggtctcgctctgctgcccaggctggagcgcggtggcactc

SEQ ID NO: 50586 - DNA, 201 bp, Homo sapiens
aatttttaaccaaatatttcaaaatcagttgtttaagaaaacgattacacctataccttcaatatcaaagcagatcaatttttaaaacaaatttactaacstagtcttcagatacataggtttgtttttctcactaatcctttgtggtcactgaaagagcataggccaccccagtcttttgcccagatagtgatgaaaatg

SEQ ID NO: 50587 - DNA, 201 bp, Homo sapiens
tatgaaattctgttttctctaatgtaattgtacctgagtgaaagtaactgcaatgaggactataaaggaagataaagtaggaatatgatgtataatttccytttgcataattgtaactctgaagaacgcatgctcccagcagaaaagtaatttaaattatatcacaacaaatgccatattttaaaatagaaactatccatc

SEQ ID NO: 50588 - DNA, 201 bp, Homo sapiens
taccccagaatctaactcctttccagtctgaagagctcctcaaatctctcctaaagttacttgctttacacacagccacctctattcattttttttttttwaatttccagtagccagtgtaacctgggggccagggaagacctgaacctctaggactcaaaccctgtcatgattcttgaggagagaggaaggtggaaatac

SEQ ID NO: 50589 - DNA, 201 bp, Homo sapiens
cagaagttgtggtgagccaagatcataccattacactccagcctgggcaacaagagcaaaactccatctataaataaataaatatccctgagtcccaccaytggggataaccgctgtagacatccgagggttttgcctctctatttttaaagtgcgtatacattcataaagacacagcatcagggtgtaccaccagaggtt

SEQ ID NO: 50590 - DNA, 201 bp, Homo sapiens
acctgaggtcgggagtttgagaccaccctgaccaacatggagaaaccccatctctactaaaaatacaaaattagttaggcatggtggtgcatgcctgtaakcccagctactctggaggctgaggcaggagaattgcttgaacccaggaggcagaagttgtggtgagccaagatcataccattacactccagcctgggcaac

SEQ ID NO: 50591 - DNA, 201 bp, Homo sapiens
accaagtgtatacaagtgtgacaatttcttcatgtcttttcaatacttactctttctgtttacttgatagtggacattttaatggctttgtgcagtgacamctcattatggttttgatttgcatttcttttaggattagtgatgttcagcattttttcatatgctcattagccatttgtataacttctttggagaattgtc

SEQ ID NO: 50592 - DNA, 201 bp, Homo sapiens
atttgaattagcacacaagaacattaaaataaacatgattagtatgttcaaggagacagaataaaagatagattcaagcagagagaattacacaagagatytgaaatctttaagaaggaatcagatagatattccagaactgaaatacatattatcatattaaaaactcagtaagtagacttaacagcagaacacaggatt

SEQ ID NO: 50593 - DNA, 201 bp, Homo sapiens
ccattatcactttctgtactaggttgactagggtcctccccaaattcatgtctacccagaacctcagaatgtgtcttttcagatgtaattagctaagatgwggttatgctggattagggtaggccctacgtccagtatgccttggagtatcctcataagaagaggagggccgggttcggtggctcatgcctgtaatcccag

SEQ ID NO: 50594 - DNA, 201 bp, Homo sapiens
ctaattaccacacagtctatctgattaacggtattgtgattcagatcaagcggtgagatgactacaggtaacagacccttgctatcatttgggtgttctcwcaaggaacaggagccaggtagtgaaccatgtgcctaccctttgggcagggaatgggtggctctaagagatgacagatgctgtcatccggaatcagttctc

SEQ ID NO: 50595 - DNA, 201 bp, Homo sapiens
aaatcaacaaacaaaaattagttatgtttctatacactaacactaactgatctaaaaaggaaatcaagaaaacaatccctttacaatagtaccaaaaagamtaaaatacacagtcataaacttaactaagacagtgaaagacatgtattctgaaaactacaaaacattgacgaagggaattttaaaagacacaaacagata

SEQ ID NO: 50596 - DNA, 201 bp, Homo sapiens
ctgatgttcaagggagtaattccttaagcaaaatcacatttatacacatgtcttttcaaatttttaaccaaatatttcaaaatcagttgtttaagaaaacsattacacctataccttcaatatcaaagcagatcaatttttaaaacaaatttactaacgtagtcttcagatacataggtttgtttttctcactaatccttt

SEQ ID NO: 50597 - DNA, 201 bp, Homo sapiens
aagggaacccagaagggttttttattttttggtgtggtcttcctttgtttgggatgtaagacactgattttcctgctatattatagtatgtacactgttasgaggtggcagtgcagtaccttggtcatgtaagccaatcaacaagacttgttcttttcctgatgttcaagggagtaattccttaagcaaaatcacatttat

SEQ ID NO: 50598 - DNA, 201 bp, Homo sapiens
gtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtga

SEQ ID NO: 50599 - DNA, 201 bp, Homo sapiens
ggtaaatcctcatgccagcctttcgtgggtattagatggcgaggggaaagtcatcaagccagagactgactactttgaaaattgaatacaagtctgtccartgctacagctaacattctttaagtactaaaataaattgcttgtaaataaagtaaatgaaaaaagaacacaactgtgtaagtcacaaatgaagaaggcaac

SEQ ID NO: 50600 - DNA, 201 bp, Homo sapiens
gggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcc

SEQ ID NO: 50601 - DNA, 201 bp, Homo sapiens
gaattttcaaattggactagaatgttcactacctaatgaatgtctggatctaagccaaacatggctaaccctactgtcctgcttagtttttacaacagccytataaagtaggcaatcctacactcatttctcagatgagaaagtggaaattaagagagattaagtaacttgcccagggtaaccctcttaaagaacggcaat

SEQ ID NO: 50602 - DNA, 201 bp, Homo sapiens
ctgcagctttgggaaattcccagaacagtaaacagtgtaaattctcaaaagggggtttatttcatgttacttccttttttaaagaaatgtaactgtgttgyattaccattagacgtaattgggtgagaaattacttataaacctgtcatcataacatagctattgttttctttgtccaatatattgacattttattccact

SEQ ID NO: 50603 - DNA, 201 bp, Homo sapiens
ttatatttaattatttgtgaacattcaaggaccaggcatttcagcttgaattagcatccagactcagggttgttgaagaattttcaaattggactagaatsttcactacctaatgaatgtctggatctaagccaaacatggctaaccctactgtcctgcttagtttttacaacagccctataaagtaggcaatcctacact

SEQ ID NO: 50604 - DNA, 201 bp, Homo sapiens
ttcccccaaccctctgatcttagcaaccatcttctcactttctggttctgtgatcttgactgctttagatactttgaatgtgtggattcatacagtatttktccttctatgactggcttatttcactttgcataatgcacttgaggttcatctatgtagtctcatatgacaggattttcttctttttcaagaatgcatcat

SEQ ID NO: 50605 - DNA, 201 bp, Homo sapiens
ggaggtgataaaaagtggttggatttgcagtatgtcttgaaagaggcatcagaatttgctactggattaggtgcagtatgtgatgaaagagaggagggttkagggtagtgggaagattttttaaatatttcaacttttttaaattgtaaaaaaaaaaaaaacatgactttaaatttactgtcttaatcctttttttttttt

SEQ ID NO: 50606 - DNA, 201 bp, Homo sapiens
tctctttctccttatttaaatcctatgcattctctagtgcatttgggggaaaatgtcatctctttctgtaggcattaactctctatgccctaaaatttcayataaccttggtggttccttttatctcacacatttcgcttatttctttgactaatgttattcatgaacatgtcttaccatttattctgctgcacctacaac

SEQ ID NO: 50607 - DNA, 201 bp, Homo sapiens
ttatttacttttatccctttgagtctattctccacaaagcagctatgatctgttttattgcaactggactcctcagctcaaaacccttccagggctcactsctcatgcggagtaaaagccagggccctctccatggcctacgtgcctctccagggtctgacttcccttcaccaggtccagactgtctccttcacctcacag

SEQ ID NO: 50608 - DNA, 201 bp, Homo sapiens
ttttagcacatcacctttctgccctaaaacgtttagtggctcacaagctagtttccaaattccttagcttagtagttagccctccgctaccttttcttaakgcacttttacacttttctccatgctgtaactaaacagcactacctactaaaatagaaagatacctttcaggttcctgacctcatgccagtatctaccatt

SEQ ID NO: 50609 - DNA, 201 bp, Homo sapiens
gcacggaggactttaatttgtgttcctgtcaaactctaggaatgtgaaaatgtggaaagcccatcccaaacaaaaataagcctcttgccggagtcctcacstgaaatctctctcattctcacccattcacctttcaaatctgtgcttttagcacatcacctttctgccctaaaacgtttagtggctcacaagctagtttcc

SEQ ID NO: 50610 - DNA, 201 bp, Homo sapiens
cctttgcccttccatgttatttccatttcacccaccgttgtgtgataccacagcgtctgttttacctcccactgaacaaaagaaatataatccttgaaacrtgctccttagtgtggaagagaggggtggtctgatgacttgtttcaaaatgatctcaatatcaaccactgccccaacggtcttgcatttcatacttaagca

SEQ ID NO: 50611 - DNA, 201 bp, Homo sapiens
atattttcatccctattttaagcagaattattcatagttatctacttagcagatgttcaaggatgatattctctttgtatccatctttccttatccagagrcgtaaaggaaaagcatgaagataagggacacggcatcgttaagtatcccgggtttgttaacagtagaagagagtgtggacttgcttttcactttcattgt

SEQ ID NO: 50612 - DNA, 201 bp, Homo sapiens
aggttcctgtgcctctcctggagaagcaggtgataaggtctctgtgttaaaggaggaaaccaaggttctaggcagcctcgtgggtaatacagccagtaaaytgcaaagctgggtgaactcaattgacaggactctagccagaaactggttctttgccattagtctctactgacccctatggatgtatggagggagtatggg

SEQ ID NO: 50613 - DNA, 201 bp, Homo sapiens
gtttcttctatgaagctgctcagaaactcaggctgatgggtgaccctgccattttcaacatctggtcttcaaagtgaccttagacgttgacatccctgtcrgccagaatgcagaagtatcacggcgcagcatgtgggagaggttcttatggactgtgcctggaagtggcagacattgtccccatcacttggtcaaatgacc

SEQ ID NO: 50614 - DNA, 201 bp, Homo sapiens
catttcctaaatgaattagtccagagccctgttttgaacagatgcctgtacagttcttgattggttgaggcaagtctaaactgacataagccctaactctraaacatgtgactttttactttgaaaatgtccaattctcagttgtgagctattcatgtgcaagtaacaaacacctactcaaacaagcttaagaaaagcagg

SEQ ID NO: 50615 - DNA, 201 bp, Homo sapiens
cctttcatgtacacaatttaaaatacagacccaacactcagcattcttttccttggtcagcataaagcgtgtgaatatggaaaacatgtcaagtgttgctygtcccccactgttaatgttttctcacattcctgtccagagatagttctctgcatcttttacattaaaaatcttgccataagtgtatttttaatacaaata

SEQ ID NO: 50616 - DNA, 201 bp, Homo sapiens
ggttactctgtcagtgatcattatattactccccatccctgcatgcatgttagaaaggcacacacaagctggaataatatgaatgacatttaatagactayttacaaaaatgttggaagatctggggaaaactaacgaaggaactttccgtacttgaggcctatcaatagcaggaagttattactacctctaggcctgaaa

SEQ ID NO: 50617 - DNA, 201 bp, Homo sapiens
atcccagaccttaccccagatctactgaatcagagtctgtatttttaacaagatcccctacattggaggaaagttgtagaaagactgccctggaggatttstaacatttctgtgggctctcatattccttttaaatatacattagaatgaaatgcagatattttaagatgatgtggcctttcagagagtagttgcatttac

SEQ ID NO: 50618 - DNA, 201 bp, Homo sapiens
tctcctgagtattttattgccaccacgactcatgatttcaattctcaggactgagtatctctgctgaacccaaatttaaattcttaatatgagaagctgcrctttccagtcgtgtgtcaatgcaaagtgagtggatttgggtttaactcccttggactgagtgcaattatatgttgggaggggactaacaaggtagcccat

SEQ ID NO: 50619 - DNA, 201 bp, Homo sapiens
cagaggtaaatttccagctagtatataggatagaacaagataatgtaataaaatgtacattttctaggctctctgatatgcttctaccctcctatctcttrttattaccataaatcaaatactagtcaattctaaatgtaaatatagggatgataacctctttttacaattcctctcttatctgcaactcccagagagatt

SEQ ID NO: 50620 - DNA, 201 bp, Homo sapiens
aaaactttatttacaaaagcagatggtgggccagatttgtcccattagctgtggtttgctgacctctgatttaaagagtgggaagtagatttctggaaagsgagaaaggaagactatttctagcagagagaagaaaacatataaaggcaaagagtgggaaaccagagggaataagacaaatttgatttaccaaaaagtcct

SEQ ID NO: 50621 - DNA, 201 bp, Homo sapiens
gcctagtggcagtgggctggggaggaaaactgcaaacatcatgcaatttatataacattttcccttaacacactccccctaatgacctccacctggcaacyttcatcaacccaaaactcagggcctcaatgtgtacagctcatgtcccatggaatgaaacggagtggggggctcagatgtttatcatagacaaggaacaaa

SEQ ID NO: 50622 - DNA, 201 bp, Homo sapiens
ccaaagctatggcaacaggagcaatttagattttgccctttctagaatttctgtttttatcaagacttcattatttatattaaataaattatttcttatcygatatttggatatcatagccttcctggattatatacctgagtagagtggatgcaggcatgaatttgtctaactgagggttggatggcaaggaatgtagta

SEQ ID NO: 50623 - DNA, 201 bp, Homo sapiens
taacacactccccctaatgacctccacctggcaaccttcatcaacccaaaactcagggcctcaatgtgtacagctcatgtcccatggaatgaaacggagtsgggggctcagatgtttatcatagacaaggaacaaatctcctggtcgacctctcctggattccctagtttggaacacacattcaggtgcatctgccatcct

SEQ ID NO: 50624 - DNA, 201 bp, Homo sapiens
tttgggaagggtcatacgagataatacattttcagtgtttagcaccactgggacagaataagcctgtaacaaatcacaagtgttaatagtttgtctaggcyacctctactgcatgcttatgggaacatggtcaacattgttaacttttgtgcctcagtttcccaatctgtaaagggaggataatagagccactcatcatca

SEQ ID NO: 50625 - DNA, 201 bp, Homo sapiens
tgtttcttcctcccctctgaatattccttttctgcctctctgcattccttttcctcttcccaacacctaagtgattcttaaaaatattctctgactttctrtgccttctcgatcagtgttagtttcaagttatcttgtcatagtttcatttaggagataatgcctgaatctttatcttaagccttgaaccctctagaacaa

SEQ ID NO: 50626 - DNA, 201 bp, Homo sapiens
ttctctcagcaggaggaaatatagctgcttagttaaaaataaaaaaggattctgaaggcacacagttcaaagttagaacaggcagccaatgcgtttgatgyccttgagccacatgccctcagcccacctggatctcggctgcagctgcattgggcactcccaccttcttccagcagcttctccccgcttttccaggaccaa

SEQ ID NO: 50627 - DNA, 201 bp, Homo sapiens
aagctatttgctgggtagactctttagcaagtttcatttttaacttgggtgccaagccagccaatggaatctaatgggctttgcttacaatgtgcatggcytggctatttacatgagattgacagcacgagaaaaaccagacgctatactcactaggctgatttagaggtttctctgctcatttgaattcagccaagctag

SEQ ID NO: 50628 - DNA, 201 bp, Homo sapiens
ctcccaaattaggtttacaagcaccttggaggcagaggctgtggttggtatcacgttgcattcctcccggctcttctctcagcaggaggaaatatagctgcttagttaaaaataaaaaaggattctgaaggcacacagttcaaagttagaacaggcagccaatgcgtttgatgtccttgagccacatgccctcagcccacc

SEQ ID NO: 50629 - DNA, 201 bp, Homo sapiens
acagcagcgttctgccaaagaaaagctatttgctgggtagactctttagcaagtttcatttttaacttgggtgccaagccagccaatggaatctaatgggytttgcttacaatgtgcatggcctggctatttacatgagattgacagcacgagaaaaaccagacgctatactcactaggctgatttagaggtttctctgct

SEQ ID NO: 50630 - DNA, 201 bp, Homo sapiens
tactaatagtgccatgttatctaatttttcacaggcatattcctttctcccaaattaggtttacaagcaccttggaggcagaggctgtggttggtatcackttgcattcctcccggctcttctctcagcaggaggaaatatagctgcttagttaaaaataaaaaaggattctgaaggcacacagttcaaagttagaacagg

SEQ ID NO: 50631 - DNA, 201 bp, Homo sapiens
gataatctgttacagccgtaggaaggtaatattttagcgaatatttttatttgcataagtaccacactctgtatgtgcactgagttgttctttactaataktgccatgttatctaatttttcacaggcatattcctttctcccaaattaggtttacaagcaccttggaggcagaggctgtggttggtatcacgttgcattc

SEQ ID NO: 50632 - DNA, 201 bp, Homo sapiens
gttggaggaagaggccatgtgccaagagatgccagcagcacctagaagcaggaaaaggtaagggaacctcatgtcactagaaggaatgtagccctttggaytcattttagactcccgacctccagaactgtcagagaatacatttgtgttgttttaagccaccaaatctgtgataatctgttacagccgtaggaaggtaat

SEQ ID NO: 50633 - DNA, 201 bp, Homo sapiens
gtggtcagagaggaaaggtgatgttgtcctgctggctttgaagttggaggaagaggccatgtgccaagagatgccagcagcacctagaagcaggaaaaggyaagggaacctcatgtcactagaaggaatgtagccctttggattcattttagactcccgacctccagaactgtcagagaatacatttgtgttgttttaagc

SEQ ID NO: 50634 - DNA, 201 bp, Homo sapiens
gggcatagcctacctgtgttttttgttgttgttgttgttgtttttggttttttgtttgtttgtcagttgtgagacctctctaaacctcgatttcttcatcygccacagtgagaataatcacaatcccaatctcattggcttattgaaaaaattcaaataagatgtgccaagtactagcgtgatacttatctataagcactc

SEQ ID NO: 50635 - DNA, 201 bp, Homo sapiens
tgggttcaatgaaatcaagaggtcactacgggcctcttatcccaattcacagccttgtcggcagcctcttgctcacagcacagaagggagacccccccccsccaccgccccgcctccaatcctctaccattactaaatcatcattttgctctggagagtaactgagcaaagtggaattattactgatggcctcccatgtgg

SEQ ID NO: 50636 - DNA, 201 bp, Homo sapiens
gatgcctgattctgccacttgactgcgtgtcccagaagaccagagatggactgatctcccatgcgctccaacctggctagaggaccccgggcagtttctcyttcatcagcccctccaaccataataaccataatagattttcatgcgctttaaccctggggaatcctgaattggaataggactcgggaagtttttcaaagc

SEQ ID NO: 50637 - DNA, 201 bp, Homo sapiens
tatcaaaaatatacaaagacccaattatgcaactgttagctatttgatttagaaagtattgagtgccggtgatgtgccaggtcctgaaactgcagttgttmtcagtgtgacctcacttggtacctctgatgatcccaaaggggtttgtgagatgcccaagggggccatgttggggcaactgtcctttctccacttgcccat

SEQ ID NO: 50638 - DNA, 201 bp, Homo sapiens
acccatgactttattttaacttgattacctctgtaaagaccctatctccaaataaagtcactgagagttagaactcccacatcttttttttttttttttttggtggtggttggcggggacagtgaaacccacagcagtgagagagttgtatgcacatggacacaaaagagcatctgatcataaagagaaggaaaccaaacc

SEQ ID NO: 50639 - DNA, 201 bp, Homo sapiens
cttgggagagagtgggggcaggtattgctattctttttaatgctccttcagcatttcttagatggccagccttgagaaagaaccatggcctaaagcacctrctcctgagttggtaagtggtatcaaaaatatacaaagacccaattatgcaactgttagctatttgatttagaaagtattgagtgccggtgatgtgccagg

SEQ ID NO: 50640 - DNA, 201 bp, Homo sapiens
gatgtcgaggattaaagaatataggtggtatattagtccattctcatgctactaataaagacatacctgggacagggtaatttataaagaaaagaggtgtrattgactcacagttcagcatggctggggaggcctcaggaaacttacaatcttggcagaagggaaagcaaacacatccttcttcacatggcagcagcaagg

SEQ ID NO: 50641 - DNA, 201 bp, Homo sapiens
tgtacccctcaaggtgccaacagaccctatgactgctctagtgttctctctaccagaacaaagccaagctgtactccactcaaaaatggggccaccctgcygctcagcataacagtttgctattaggaaacaaaataacagtgcttgaaaatacctaagttgtctgtggtttgtgaatctttgagttgtgtatgtagcttt

SEQ ID NO: 50642 - DNA, 201 bp, Homo sapiens
cttcccaagttgaacagcagcgttctgccaaagaaaagctatttgctgggtagactctttagcaagtttcatttttaacttgggtgccaagccagccaatrgaatctaatgggctttgcttacaatgtgcatggcctggctatttacatgagattgacagcacgagaaaaaccagacgctatactcactaggctgatttag

SEQ ID NO: 50643 - DNA, 201 bp, Homo sapiens
atgaacacatacatttgcctaggcctacacaaggtcagaatcatgaatatcactgtattctgcctccacattttgtctcactgaaaggtctttaggggttrtaacacgcatggagccatctcctatgatatcaatgccttcttctggatacctcctgaaggacctgcctgaggctgttttacagttaacattttctttttt

SEQ ID NO: 50644 - DNA, 201 bp, Homo sapiens
ccttgtcacatggctgggtctgtccctgcagtgactgtgctattcatagcaagaatgttgtgttgctaaacttggcatgaaacaatacagttatttatgcracttcatggcctagagtatcgccttggatttgagattctgctaaagctacatgagtgggcaaatcaagaaattgtattccataatttgtttccaatctga

SEQ ID NO: 50645 - DNA, 201 bp, Homo sapiens
ttttttactaacagctttattgagatataactcacatgccataaaattcacacttttaaaatgtacaattcattggttttcattatattcacagagttgtmgaattatcattactgtctaattttagaacattttcatcgtcccaaaaagaaacccgaacccatgagcagttactccccattgcccattcccccacgctgg

SEQ ID NO: 50646 - DNA, 201 bp, Homo sapiens
cagcttgcagcatatatgtgtgtgtgtgtgtgtgtgtatgtatatatatatatatatatatatatatatatatatatatatatatatataaagaaaaagcmcgagcaataaatctcaggaaccttagacttgccgtgggtatgtgcaaaaagaacatttccaaacacatggggctgtctataatcacagtaatgtacttga

SEQ ID NO: 50647 - DNA, 201 bp, Homo sapiens
cactatttaatcacaaacgttccaatcacaaatgcttcagtgacaggaatagaagctgtcacaccagacagggcagataagtccttgtcacatggctgggwctgtccctgcagtgactgtgctattcatagcaagaatgttgtgttgctaaacttggcatgaaacaatacagttatttatgcgacttcatggcctagagta

SEQ ID NO: 50648 - DNA, 201 bp, Homo sapiens
tgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgc

SEQ ID NO: 50649 - DNA, 201 bp, Homo sapiens
tgaatgttagcttagattgcaaaagggactgtgaaggtgtgattgagttaaggatcttgatttaaagaagttagtctgatacgcccaatgtaaccacaagsgtccttataagaggctcaccagtggtcagagaggaaaggtgatgttgtcctgctggctttgaagttggaggaagaggccatgtgccaagagatgccagca

SEQ ID NO: 50650 - DNA, 201 bp, Homo sapiens
tactaattcctggggcctgtgaatgttagcttagattgcaaaagggactgtgaaggtgtgattgagttaaggatcttgatttaaagaagttagtctgatasgcccaatgtaaccacaagggtccttataagaggctcaccagtggtcagagaggaaaggtgatgttgtcctgctggctttgaagttggaggaagaggccat

SEQ ID NO: 50651 - DNA, 201 bp, Homo sapiens
ctgagccagactgcatttaccaatccacagaaatagtgcagaccaattccttttgtgaaaattaacatatattttgtctatggccttctcttcatcacttrccccagcaagtctctcctcaaaggatagtcagtttggcatgatttatgtatgacgaacccaggtagactaccataactcactgttctcattgataaatcg

SEQ ID NO: 50652 - DNA, 201 bp, Homo sapiens
tatgtatgcacttattcttgcattcagcaaataagtacatagcacctatcatgaaccagtgactttgcttaggaacacaaagcaagcaaaatccctgcctygatggcacttacttcttagggaaaagagaggatgacagaactgtagagaaaacagagtataccagatagcaatgagggctgtggagaaaataaggtggga

SEQ ID NO: 50653 - DNA, 201 bp, Homo sapiens
ttgtttttctttctttttgttatttgctttatgtttgtatttgtcgtacgttgtgtttaatctaccccttctctgcccaagactgtagtatgtcgtcaggrttgagaaccactgggttaaggagttacaaaaagttaaatttctcagggctaatgttgaattcttgcatcggatgagctcattgtaacttaggaaaatcaa

SEQ ID NO: 50654 - DNA, 201 bp, Homo sapiens
tgagccacagcgcccggcctaatggcatcttagtcattcgacttttcgagacagccttatcagtagcctctgatgcttgaggttctcttgtgttgcttttygttgtcatagtatttttgttgttattgttttgtttttctttctttttgttatttgctttatgtttgtatttgtcgtacgttgtgtttaatctaccccttc

SEQ ID NO: 50655 - DNA, 201 bp, Homo sapiens
ttttattttattttattttattttattttattttattttattttattttattttatttgagacagaatctcactatgtcaccaggctggagtgcagtggcrtgatctcggatcactgcagccaacctccgcctcctgggttcaagcaattctcccgactcagcctcctgagtagctgggactacgggcacataccaccatg

SEQ ID NO: 50656 - DNA, 201 bp, Homo sapiens
ttgaattaattaccaggaacagaatcataagtggtgacaacttacaacagctcattccacattctcctgccactgatggatagatttatgcatttgaaacrttttttactgattgcctgcccatctcctgttcacatactccctgagaacctctatgtcttatccatggagtatgtccgaaaaccaattatcatccccttt

SEQ ID NO: 50657 - DNA, 201 bp, Homo sapiens
gtccctggatggacttgagggagtctctgaatgcctgaaatcacaggcaaagtgagtgtgtgtgtgcatgtgtgtgtgtatgtgtgtgtatttttctggaragggaaggaccacagtttgcatagatttcccatggagatgttgattgcaggttggtcagaaccatccttctaactaggtggtgatttggagcacaggcgt

SEQ ID NO: 50658 - DNA, 201 bp, Homo sapiens
ctaattttaatccatatattttctgtaggccactgtttgtagcttttagagtagatttccctctcttaaaagtaaactttgttttacttagaaaacacagwgaccttggagcatagtgattgttgtgtttttaaatttcattggtttaattgtcgtttaaaagtaaggttttttttgttgttgttggtttgtttgtttgtt

SEQ ID NO: 50659 - DNA, 201 bp, Homo sapiens
caaatggtagttctgttctaagttctttgagaaatctccaaactgctttggacaggggctgaactgatttacattcgcaccaacagtgtataagagttccyttttctctgtaacctgggcagcatctgttatttttttgactttttaataatagctattctgactggtgtgagatggtatctcattgtggttttgatttgc

SEQ ID NO: 50660 - DNA, 201 bp, Homo sapiens
atttaaaaaaaaataggtctgtatttaaaagttttagtgtcagctccatccagcccaagttaagtactaattcagcaagttagttaagtaataaatggctrtcactcaactacaacatatttgaattcagttttgaggccccagtagttgctaaaaatcaatgcccactttctccaggtatagtaattatttctcatattg

SEQ ID NO: 50661 - DNA, 201 bp, Homo sapiens
gttgaatgtcagaatgcctgctaatgaccctaacaatcatagcttatttctagagaatccatacagtcattgaggctttgttttttttcatcttccactcktttccttggaataagacctttaattaatgctcattaagatgcacaaatagcctggccttgaatcctcccagtgtttggttcactctcccctaacttatta

SEQ ID NO: 50662 - DNA, 201 bp, Homo sapiens
gattgctgagtcaaatggtagttctgttctaagttctttgagaaatctccaaactgctttggacaggggctgaactgatttacattcgcaccaacagtgtrtaagagttcccttttctctgtaacctgggcagcatctgttatttttttgactttttaataatagctattctgactggtgtgagatggtatctcattgtgg

SEQ ID NO: 50663 - DNA, 201 bp, Homo sapiens
ttagtatcattgctcctactaatgatagaaattgctggtgttggccgggtgtggtggctcacaccagtaatccaagcactttggcagacggaggtgaaggsatcacttgaggccaggagttcgagccagcctggccaacgtggtgaaaccccgtctgtgcttaaaaaatacaaaaaattggccaaatgcagtggctcacac

SEQ ID NO: 50664 - DNA, 201 bp, Homo sapiens
cacccagtagtaggattgctgagtcaaatggtagttctgttctaagttctttgagaaatctccaaactgctttggacaggggctgaactgatttacattcscaccaacagtgtataagagttcccttttctctgtaacctgggcagcatctgttatttttttgactttttaataatagctattctgactggtgtgagatgg

SEQ ID NO: 50665 - DNA, 201 bp, Homo sapiens
ctacgtagcattccattatcacttttgatcaacagttccctgattgattttttatttttctatagtaaacattgaaggagaaaatataattgtcgctaaayatttcagccaaataagtctgagctatgcattattctaaggccctctctcagatcttcacaatgcaaatctgagtattaaaggctctgagaattcttgcgc

SEQ ID NO: 50666 - DNA, 201 bp, Homo sapiens
ttaatgtctacgtagcattccattatcacttttgatcaacagttccctgattgattttttatttttctatagtaaacattgaaggagaaaatataattgtygctaaatatttcagccaaataagtctgagctatgcattattctaaggccctctctcagatcttcacaatgcaaatctgagtattaaaggctctgagaatt

SEQ ID NO: 50667 - DNA, 201 bp, Homo sapiens
tcatcttgtcatgctgtgttcatcatggcttttaatgtctacgtagcattccattatcacttttgatcaacagttccctgattgattttttatttttctayagtaaacattgaaggagaaaatataattgtcgctaaatatttcagccaaataagtctgagctatgcattattctaaggccctctctcagatcttcacaat

SEQ ID NO: 50668 - DNA, 201 bp, Homo sapiens
cattttaattccagagaatcagagacagcctttcccaagagatgttggcaaggtaagtcagacaaacagcaaatgacaaaaacatgtttttatgaaaagaygagcacagcagactgagtatgactgtcttggtgaccagctggaattagtcttcatctgtctatgataagagaccaaatggtttagtcatgaaaagaatgt

SEQ ID NO: 50669 - DNA, 201 bp, Homo sapiens
tctgtgactctattattatcatcatcatgatcataattattaccgcaactgccactagcattcccttccaaggtattttctcagccagcagcagcaaatckgtttgggattgtatgtcaagccctgtgaaaaagaagggtttggcacacagggcttcatacaaagaggggttttgaagctgacctggccattgccaagtca

SEQ ID NO: 50670 - DNA, 201 bp, Homo sapiens
accacctctgtttcttcatctatataatgggtcagtaatcccacccacatgaagttattgttagacttaaataagctgacccatgtaaagtgcttggaaaktccctggcacaaagcaagtgctcaataaatattatctgtgactctattattatcatcatcatgatcataattattaccgcaactgccactagcattccct

SEQ ID NO: 50671 - DNA, 201 bp, Homo sapiens
ggctcatggtaaaaattttagcaactgagataagcaaaactaagaaagatgtaaatcccactagccagataccactactcctaagacccaggtcagacagygaggcatcactgttaagagcatgggcgctatggttggacaactctatcacttactagctgtgtgtcctggagccagctacttagtccctcaccacctctg

SEQ ID NO: 50672 - DNA, 201 bp, Homo sapiens
ttggggggaacagcaacaaatgttcagttcacaagtataaaatggatatattatttatgtgcatatacatcatatactgttacatatcatagataagacawgcatattatacatatgtgtatgtatatatagtaaatataccatctatagtaataaggtttcacaaagaagagaaaatggaaatgtagagatataaaggaa

SEQ ID NO: 50673 - DNA, 201 bp, Homo sapiens
cttgaatggggcatgttctctttagcttccaggcctttgagtggttcctccacctgaaacaatctcttcttccctttgcctacctaactcctccttctttratctgcagcttaaatgtgacttcttcaaaaaagacttctttgatcccttcagtaccaaatgagttcttccctttatgcacatttttccttgtgacacttg

SEQ ID NO: 50674 - DNA, 201 bp, Homo sapiens
attaagttatattaaaagaagggtaatatgggcacaaaactgaccatttcctgattattttactacattttactattttctatgcttatttagtcctattrtttatgtatggtgaaatctatataatggggaacagctgctcatagctgccagcacttcattcagtgaagtcacattggcagcttgaagctggccatgccg

SEQ ID NO: 50675 - DNA, 201 bp, Homo sapiens
attaatctgttctataggtgtttttagtggaacatttagtgggggtccagttcatccccaattataaatataattccactgagcatcctcaactttgtgcwcattcctaataatctgcaaggaatacatttatggaaggagaattactgtcttaaaagggggttggggtgggtatatattattaaagtttgcgataaaagt

SEQ ID NO: 50676 - DNA, 201 bp, Homo sapiens
ggcacggggtttcaccattttggccaggctgatcctgaactcctgacctcaagtgatccacccgcctcagcttcccaaagtgctgggattacagatgtgarccactgtgcccagtttgaggcattgctgtttaaggggccagagagaccacaataggcacagaggctgagacaacatgggtggtaccatgtagacaacatg

SEQ ID NO: 50677 - DNA, 201 bp, Homo sapiens
gtagtatgggatacatcacagaaattgtgtatcaaagggggaaaatgtttgcaagacttagtgcctaattcacagtaagtgctcaaaaaatgcacacagtmagtgctctgtcattttctagaacacattgatgtttaaaaaaattttcctacttgtaaaacagtcaaagagttcagtgtgaagtatttgcaaaaaatttga

SEQ ID NO: 50678 - DNA, 201 bp, Homo sapiens
caggcatgagccaccgtgcccggctaattaaacttttaatgtggaaagacagcacatgcaggagataagaggtagagtgggtgatggtccaggctctgagyggaatggcctgtgttcaaatgctggcttctctaacttaccagaattacgtatgtccttgagcagagtgtttaaccttcctgtgcctcactctcctcatct

SEQ ID NO: 50679 - DNA, 201 bp, Homo sapiens
tatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatg

SEQ ID NO: 50680 - DNA, 201 bp, Homo sapiens
tgacctcatgtaaccttaacttcctaaggagaggcccacctccaagtactgccacaatgggggttagagttctatcaacatccgaatttggggggaacagmaacaaatgttcagttcacaagtataaaatggatatattatttatgtgcatatacatcatatactgttacatatcatagataagacatgcatattatacat

SEQ ID NO: 50681 - DNA, 201 bp, Homo sapiens
ataattaagttatattaaaagaagggtaatatgggcacaaaactgaccatttcctgattattttactacattttactattttctatgcttatttagtcctrttatttatgtatggtgaaatctatataatggggaacagctgctcatagctgccagcacttcattcagtgaagtcacattggcagcttgaagctggccatg

SEQ ID NO: 50682 - DNA, 201 bp, Homo sapiens
gctgtgtcctcatgtagcctcatttccttggggcatgtacctggagggtggggattagggagcatacagggtctccttttataaggatcctcatcctatcrgatcagagctccatcctcatgacctcatgtaaccttaacttcctaaggagaggcccacctccaagtactgccacaatgggggttagagttctatcaacat

SEQ ID NO: 50683 - DNA, 201 bp, Homo sapiens
agccaccttcttgctgtgtcctcatgtagcctcatttccttggggcatgtacctggagggtggggattagggagcatacagggtctccttttataaggatmctcatcctatcagatcagagctccatcctcatgacctcatgtaaccttaacttcctaaggagaggcccacctccaagtactgccacaatgggggttagag

SEQ ID NO: 50684 - DNA, 201 bp, Homo sapiens
tcatcattttattgtattttctcaactttagaacagttttcaaacatgtggaaacgttggaagaattttatagcaagcaccctttgccccatcaccgagaytctcccagcacatcttcttctgcttgctttatttagtgcacacctatccacctgttccagagatcaccactgcggcagtgggttctcaaaggagaacctt

SEQ ID NO: 50685 - DNA, 201 bp, Homo sapiens
accttgacaaagagtttataatgtaaggtcctggttcctggctctgtctgcattagattaatcagggggagcttttaagagatactagtgcacacagaccscaactcagcacagttgtatcataatcttgggagagagtgggggcaggtattgctattctttttaatgctccttcagcatttcttagatggccagccttga

SEQ ID NO: 50686 - DNA, 201 bp, Homo sapiens
catttcatcggaatgaaatcagctaacatgtgatatccttaatggttttgtagcagaaagacatctacgtgggaagggacgctgctgagtgtttagagaamagacacattcatcattttattgtattttctcaactttagaacagttttcaaacatgtggaaacgttggaagaattttatagcaagcaccctttgccccat

SEQ ID NO: 50687 - DNA, 201 bp, Homo sapiens
gcgctccagcctggggcgacagagcaagactctgtctcaaaaaaaaaaaaatcaccgtccttttttggcgttctgtcagtcaagagtattctgaagactaycgagggaggagtgtttggtttgtgccttgttttgttctgttttagcagccctggaaatcatggatacctcccttccttgaagttatctttcccatgtata

SEQ ID NO: 50688 - DNA, 201 bp, Homo sapiens
gtctcaggtaatagaaaggcctgaggaaagggagagagagggagaggaaaggctggttggtggagcagtaaggccatacacatacaacatttacctattamgttagccttcttgtatgggcatggtttgtggcatcccaaaacagttacaatagtaacatcaaagatcactgatcacagatcaccatgacagatatcataa

SEQ ID NO: 50689 - DNA, 201 bp, Homo sapiens
ctaaacgggcaaaaaatggaagaaaaatcaaaacatcactgttggctgggcacggtggctcacgcctgtaatcccggccctttgggaggccgaggcgggcrgatcacgaggtgaggagatcaagaccatcctggctaacacggtgaaaccccgtctctactaaaaataccaaaaaaaattagccgagcgtggaggcgggcc

SEQ ID NO: 50690 - DNA, 201 bp, Homo sapiens
tcatttgagttttcactggaatggcactttttatttcattcaagagctttcttttgcattcacaacttggttgattggcctaagaggcctagcttttggcyggtcttggctttcaacatactttcctcactaagaagcttaatcattctagcttttgatttaaagtgagaggtatgcaactcttccttttccttgagcatt

SEQ ID NO: 50691 - DNA, 201 bp, Homo sapiens
catctataagaagcaactcctcatctgttcaagttttatcatgagatttcagcaattcagtcacatcttcaggctctatttctaattatagttgtctttcrgtttccaccacatctgccgttacttcctctactgaagtcataaacccctgaaagtcatctatgaaggctagaatcaacttcttccaaactccttttaatg

SEQ ID NO: 50692 - DNA, 201 bp, Homo sapiens
accctgtctcaaaataaaaacatatcatgtttgaagaaccaccaataggtatcttgctctgtgacttgtgatccttaagtcaacatatatatatatatatwgtcacaggaagtcgatacatatatgggataatcaccaatctctaagatacatagcatgctcataaaatagccaagctctgtgctgagagacaaagacata

SEQ ID NO: 50693 - DNA, 201 bp, Homo sapiens
cacgtcttttgtttgttgagtatttgctaaacgggcaaaaaatggaagaaaaatcaaaacatcactgttggctgggcacggtggctcacgcctgtaatccyggccctttgggaggccgaggcgggcagatcacgaggtgaggagatcaagaccatcctggctaacacggtgaaaccccgtctctactaaaaataccaaaaa

SEQ ID NO: 50694 - DNA, 201 bp, Homo sapiens
ttgctcagccattgaataacaattgcttttggaaagattgtcataatgtatcagttagaaggcaccttagagaccatcatttcacatgacctctgtttttyagatggggaaactgaggcccaagagtgacagtcatgtgctgcaggtcacaggccaagtttgtgacaagaccggggtgtctgttcgggttttggagaaaca

SEQ ID NO: 50695 - DNA, 201 bp, Homo sapiens
tcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggcag

SEQ ID NO: 50696 - DNA, 201 bp, Homo sapiens
ttatgtagcattctttcctgactttatttttctcagctttttaatgattgtcttttcactttctgcacttacacaacattgtaaagtgttgcattttcatrtagagaaaactggaccttggtctgaatcttcccacaagggataattttataacttttttgctcagccattgaataacaattgcttttggaaagattgtca

SEQ ID NO: 50697 - DNA, 201 bp, Homo sapiens
ctcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggca

SEQ ID NO: 50698 - DNA, 201 bp, Homo sapiens
taaatggatattgtacaaatcctgcatttgcattggctctgaggacataaatcaattctcatgatcttactttggaaaaaaatttccctttgaagtcagastgagcgatttatgtagcattctttcctgactttatttttctcagctttttaatgattgtcttttcactttctgcacttacacaacattgtaaagtgttgc

SEQ ID NO: 50699 - DNA, 201 bp, Homo sapiens
actcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggaggc

SEQ ID NO: 50700 - DNA, 201 bp, Homo sapiens
aaggagggtcaagtggtacctctgtctccacctcctccaggcctacacagtttgtgactgacatactgagcaccaggtctgcatcacccaccttatcacaygtgggcacaggatctctgccgggggcaagcggtatgatgtgtcctggtcacggtctggctggtgatttggttacatccagacacggaagtcgacctagaa

SEQ ID NO: 50701 - DNA, 201 bp, Homo sapiens
gactcatgcctgtaatcccagccctttgggaggcagaggcgggtggatcacttaaggtcaggagttcaagaccagcctggccagcatggtgaaaccctatctctactaaaaaatacaaaaattagctgggtgtggtggtgcacacctgaaaccccagctactcaggaggctgaggcaggagaatcgcttgaacccaggagg

SEQ ID NO: 50702 - DNA, 201 bp, Homo sapiens
caaaggcatggtggccaagagagctagatccgttcactcaacacacaggcaggactgcaacgggtcttgtgtatcctgtggatctaatctatccttaggcrtcagtctgggaaacatgagttccgtcttctccactaatctgggaaggagggtcaagtggtacctctgtctccacctcctccaggcctacacagtttgtga

SEQ ID NO: 50703 - DNA, 201 bp, Homo sapiens
aaatgccaccataataggccgcagatcacctttattgccagcctctctagtccccaagtagctgataaaaacatagacaaaaattatagagaatgaaggaraaaaagtaaggggttattttgagagcaaagtttgcctcatctgtccaatagagactgtcttgtatgttaaaagttcatcatcaggagctgaaagaattga

SEQ ID NO: 50704 - DNA, 201 bp, Homo sapiens
ggagttcaagaacagcctggacaacatggcgaaactccatctctataaaaaatgcaaaaattagccaggcatggcggtgcatgcctgtagtcccagctccyccggagactaaggtgggaggatcgcttgagcccaggaggcaggggttgcagtgagccaagattgtaccactacactccagctggggcaacagaatgagac

SEQ ID NO: 50705 - DNA, 201 bp, Homo sapiens
atgcatgaatggatggatacatggatggatgaagttgtacaagctcaaaccagctcagattggaggaagcgtcttacttgaagccccctgtgactatgttsgggcttgtctcctaccatctcactgaaggagcctatctcctaagctctctcctagacacctgtatccttactttcccctcccttcccagcctgagcagtg

SEQ ID NO: 50706 - DNA, 201 bp, Homo sapiens
caaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggaca

SEQ ID NO: 50707 - DNA, 201 bp, Homo sapiens
cctgtcactggtcactccctgtactgttgcccaatgggacggctttcagagcacataccactctctgaagttatcgtattgtgtgttaactatttttatgrtctcccttcctcttgtagaacagaagctccatgagaacaggaatttcatgccttgttctctttcatatatgcagagtaaagaagaatgtctgacatataa

SEQ ID NO: 50708 - DNA, 201 bp, Homo sapiens
tcaaacctgggaggcggaggttgcagggagccaagattgtgccaatgcactccagcctgagcaacaaagtgagactctgtctctaaaaaaaaaaaaaaaaaatttctcagatgtgactcagtgaaggattttgagatggggagagtatcttggattagccaggtgagcctgatataatcacagagtccttataagagggac

SEQ ID NO: 50709 - DNA, 201 bp, Homo sapiens
actatggaatacactcacatcagcgtcagttggccccactcactgtggggcagaatttccctggtctgatgcctggcatctgcccagaaggcactgcagcrtaggggacagtggggtcagactccactgtaggaatctacatctccctgcacacactgtgaggccttgcaagggctactgcacatcagcgagcctccattt

SEQ ID NO: 50710 - DNA, 201 bp, Homo sapiens
acataaattaaataaatttcctcaagtaaccatctcaatagccctgggacgagtcacttatgttatcatctaaattgacttaaaacaggaatttgagactstaatttgaaaacaagagattggagcctatttagtggattttatgcagccaaagatgtttcttgttgttgttgttgttcttgcttttaactaatttgcctc

SEQ ID NO: 50711 - DNA, 201 bp, Homo sapiens
ttactgtctcatggaattcttacaactacatcatgaggaaaatagtattaatagtattatccccatttcccagatgaaaacactgaggcacagagctgtaktctgtctgaggccagagttagaccatgacttacttatttacacaaagcagcagggacctgtctttgatgatgaacaagtccaaattactacaaaactgct

SEQ ID NO: 50712 - DNA, 201 bp, Homo sapiens
cattgtttctattctgagctcagttcacgtagttcaatgtgctttggcttggctgtcactttaggggatgatagttaacccaacggagtaaatctggccarttcccgagtgggggcagggggttgggctcaactaagggcaccaacaataaatgcctccttgctggtagatgggaaggactgagaagacagaggagaaatt

SEQ ID NO: 50713 - DNA, 201 bp, Homo sapiens
gggtgtggtggcacacgcctataatcccagctactcaggaggctgaggcaggagaatcgcttgaacccaggagttggaggttgcagtgagccaagattgcrccattgcactccagcctgggcaacagagcaagactttgtctccaaaaaaaaaaaaaaaaaaaagccaagatgagcaaaagatagccagtaaacactttta

SEQ ID NO: 50714 - DNA, 201 bp, Homo sapiens
ggccaattaaccagctcccctgcatgcaaagcttgttatttctctgtgacagaggcagctctttaaaatcttaccgtgcacgttctgcaggacacctttcyctggatttttctttcacgcaaaccccattcagttcctactgtgctctgcttgcctctcctgttgttgagaggctcaggaaaaacaactggaactaattca

SEQ ID NO: 50715 - DNA, 201 bp, Homo sapiens
agctgggtgtggtggcacacgcctataatcccagctactcaggaggctgaggcaggagaatcgcttgaacccaggagttggaggttgcagtgagccaagaytgcaccattgcactccagcctgggcaacagagcaagactttgtctccaaaaaaaaaaaaaaaaaaaagccaagatgagcaaaagatagccagtaaacact

SEQ ID NO: 50716 - DNA, 201 bp, Homo sapiens
acgtggtgaaaccccatctctactaaaaatacaaaaattagctgggtgtggtggcacacgcctataatcccagctactcaggaggctgaggcaggagaatmgcttgaacccaggagttggaggttgcagtgagccaagattgcaccattgcactccagcctgggcaacagagcaagactttgtctccaaaaaaaaaaaaaa

SEQ ID NO: 50717 - DNA, 201 bp, Homo sapiens
tagccaggggtagtggtgcacacctgtagtcccagctacttgggaggctgaggcaggagaattgcttgaacccaggagacggaggttgtagtgagccaagrttgcaccactaccctccagcctggatgacagagcgagatactatctccaaaaaaaaaagaaaagaaagtgaggcaaatgaagacttgtagtgattgcttt

SEQ ID NO: 50718 - DNA, 201 bp, Homo sapiens
tgaccaacgtggtgaaaccccatctctactaaaaatacaaaaattagctgggtgtggtggcacacgcctataatcccagctactcaggaggctgaggcagragaatcgcttgaacccaggagttggaggttgcagtgagccaagattgcaccattgcactccagcctgggcaacagagcaagactttgtctccaaaaaaaa

SEQ ID NO: 50719 - DNA, 201 bp, Homo sapiens
tctcgtcaccaaaaaaaaaaaaaatttcctcttcaaatttgtaggtaaaaagacgtgtttctttaactttacctctcacaaatggtatgttcatctatcgkctgggactcttttagttaaaaaggaaacctaactcaaaccagaatgggggtggggaaagtgaattgatgtatctcacataactgggagatccaagggtgg

SEQ ID NO: 50720 - DNA, 201 bp, Homo sapiens
ggatcacaaggtcaggagttcaagatcagcctgaccaacgtggtgaaaccccatctctactaaaaatacaaaaattagctgggtgtggtggcacacgcctstaatcccagctactcaggaggctgaggcaggagaatcgcttgaacccaggagttggaggttgcagtgagccaagattgcaccattgcactccagcctggg

SEQ ID NO: 50721 - DNA, 201 bp, Homo sapiens
gtagatatttgcatctctcaacttttctcgtcaccaaaaaaaaaaaaaatttcctcttcaaatttgtaggtaaaaagacgtgtttctttaactttacctcycacaaatggtatgttcatctatcggctgggactcttttagttaaaaaggaaacctaactcaaaccagaatgggggtggggaaagtgaattgatgtatctc

SEQ ID NO: 50722 - DNA, 201 bp, Homo sapiens
atccagcacacaccagaaatggttactccaccagggagctcacctcatcttctgccattggcctcccaccccacatttttccaatgaggttctttgagtcygacttatttttgacaaagccacactggtttgtaatgagcattgcattcttttatacagagttggggagggagggagattttgaagggggaaaacacgaac

SEQ ID NO: 50723 - DNA, 201 bp, Homo sapiens
atacctgtaatcccagcactttgggaggccgaggtgggcggatcacaaggtcaggagttcaagatcagcctgaccaacgtggtgaaaccccatctctactwaaaatacaaaaattagctgggtgtggtggcacacgcctataatcccagctactcaggaggctgaggcaggagaatcgcttgaacccaggagttggaggtt

SEQ ID NO: 50724 - DNA, 201 bp, Homo sapiens
agatcaacctgggaaaggagcagctgcctgcacttcattcactgaggattcttccaaccctctctccgtctaacgggctggggtccttcatggacgcattsatagatgacagtgtgccaatccagcacacaccagaaatggttactccaccagggagctcacctcatcttctgccattggcctcccaccccacatttttcc

SEQ ID NO: 50725 - DNA, 201 bp, Homo sapiens
tctgaaaaaaagaaaaaaaagccccaccccatgtcagctaaaaattaacattaaataaaatgtggaccaggcacggtggctcacgtctgtaatcccaacastttcggaagcctaggtgggccgatcacctgaggtcaggatttcgagactagcctgaccaacatggtgaaactcatctctactaaagctataaaaattacc

SEQ ID NO: 50726 - DNA, 201 bp, Homo sapiens
gtgctgtacctgtacaagccagcaaggcaaagaggcctggttgcaagatgtgaggcaacattttatattttacttatgttattcaatttgtctacacatcyatccttttctggaaaaagaccatattgccacttgagtttcagtattacagacattgttttcctctaagtgactagactctctgtttagctcgccacacaa

SEQ ID NO: 50727 - DNA, 201 bp, Homo sapiens
gattacaggcacctgccaccacgcccagctaatttttttgtatttttagtagagacagggtttcgccatgttggccaggctggtctgaaactcctgacctyaagtgatccacccacctcagcctcccgaagtgctgggattacaggcgtgagccaccacgccaggcctgaaattagctattaaagtacataacttcctaac

SEQ ID NO: 50728 - DNA, 201 bp, Homo sapiens
gactgagtcttgctctgtcacccaggctggagtgcaagggcgcgattttggctcactgcaacttctgcctcccaggttcaagtgattctcctgcctcagcytctgaagtagctgggattacaggcacctgccaccacgcccagctaatttttttgtatttttagtagagacagggtttcgccatgttggccaggctggtct

SEQ ID NO: 50729 - DNA, 201 bp, Homo sapiens
ggctgcacagaagtgagcttaaacccttaagcaaggattggagaaggaggagggtgatttcaaaaaacactgaaattagtagctttctttttttttgtttktctgttttgttttaagactgagtcttgctctgtcacccaggctggagtgcaagggcgcgattttggctcactgcaacttctgcctcccaggttcaagtga

SEQ ID NO: 50730 - DNA, 201 bp, Homo sapiens
atgtaccttatttggaagcaggcttgttgcggatgtggttagttaaggtgaggtcatgctggagtaaggtgggccctgatccaatatgattgatgtcttcmtcaaagggggaatttgaagacaggcatgcacacagggagaacaccacataaaatgaaggcagagatcagggtgatgcttctgcaagtcaaggagttccaa

SEQ ID NO: 50731 - DNA, 201 bp, Homo sapiens
ttggcaaatggtggttatttctatccattaatgtcatctgatcatggcccctcaaacctcactttgagccttgtgagcaaatgatacatactgtttatatrtatattttcctatatatgtagaaaaatatatattaaataaatataaaatatataatttaattaaatatatttaatatatatttatagtatattaatattt

SEQ ID NO: 50732 - DNA, 201 bp, Homo sapiens
aaaaacatactctatgaaaaatatttgagaaattagtactcccaattttaggtccagatgtgttctggaatttagaaagataataagatgcacacattgtwttacacgattctacgagcggggtctcgggcagctccctgtattaaaacaggttggcatttcaatagtaaaacatatgaatgtttaccctcagtaggataa

SEQ ID NO: 50733 - DNA, 201 bp, Homo sapiens
tgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgca

SEQ ID NO: 50734 - DNA, 201 bp, Homo sapiens
ttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgc

SEQ ID NO: 50735 - DNA, 201 bp, Homo sapiens
aagttcagaataggaggaaggtgaaaaggatgagtgggcatggctcaggctgccatggagccatttcagaagtcctgagatggggacagtttgtatgtatrtcagaggagagatcaacaagggagataggagtgttattggggagcacttgaacatgaaataagtgaaaggagagccccagggagatccaagggttgacac

SEQ ID NO: 50736 - DNA, 201 bp, Homo sapiens
gtgatccttttcagactcttgtcctctagaaaagcaattcagatctcgcccaaggcttacttctcggtttctggctataattgccctcatagtaccctgaycccagactcctactggatgccatccgaaagagttctcgaagccctcatctgcgctataggcacagaccactctccccagccctgacaaccctgacctcac

SEQ ID NO: 50737 - DNA, 201 bp, Homo sapiens
gacagactgaagtctaacaagttgctccttatacttgaattcacaagtataaaatcatatggatgacttgtgcaccttgctgtcattctgtgcagagctcygcctgtgcactccttccctcacttaccgagggcctagttcatcctccacctctgtggacacaggaacgacgaaaaagtctcccttatgacctaacggctt

SEQ ID NO: 50738 - DNA, 201 bp, Homo sapiens
caatgggacagaatagctaacccagaaatctatgcatttacagtgaactcatttttgacaaaggtgccaagaacataccttggggaaaggacagtcttttsaataaatgctgctgggaaaactggatatccatatgcagaagaatgataatagagccctatctcttgccatatacaaaaagcaaatcaaaatgaattaaag

SEQ ID NO: 50739 - DNA, 201 bp, Homo sapiens
cctctagaaaagcaattcagatctcgcccaaggcttacttctcggtttctggctataattgccctcatagtaccctgatcccagactcctactggatgccrtccgaaagagttctcgaagccctcatctgcgctataggcacagaccactctccccagccctgacaaccctgacctcacatgcccttgggatttccgttcc

SEQ ID NO: 50740 - DNA, 201 bp, Homo sapiens
aattaaatgggacccaatatgtcatctaacgttagttccagccagtgtttcagccacaggacatctcggaaaggtggtcatttggctcttgcctgaagcawtcgaggaaggagagcccagttctggaattagacaattattgttcttacccttgaaccagccacttacctgctgcgttcccactcttggccaggggccaat

SEQ ID NO: 50741 - DNA, 201 bp, Homo sapiens
acatcaaagacagatgtaacaaaatgtttagagatccttccattggacttgggtcctaacttgttctttaaagaatgggaaacacaagaagtaacagagtkagaaggacttctcagacgaggaacatgaacacaggtggagttcccttggcctaagttttcttatcagtagaatggaagagataaatagaccagaggtatc

SEQ ID NO: 50742 - DNA, 201 bp, Homo sapiens
tactggatgccatccgaaagagttctcgaagccctcatctgcgctataggcacagaccactctccccagccctgacaaccctgacctcacatgcccttggsatttccgttcctcttccactgttcttttttttttttttttttcttagttgcagagtttttcggaaggactgattaccgagtctcttctttccccaagagt

SEQ ID NO: 50743 - DNA, 201 bp, Homo sapiens
tatgagtcagggcctggatctgccgtccatgttccatgggacaggccaggggttcagatgttcctcatagacaaggaaggagcctccaggtcggccactcycagatttcctagcttggaacagacatccgggtgcatcctccacacagagtcattttcagggtatgcataagttattgctatcaggtgcatttaccatgca

SEQ ID NO: 50744 - DNA, 201 bp, Homo sapiens
ggtgaagaagcgactaaagcagtgattgtagggcatttgaacttcatggaccagtaatttttttaaatcctagattgatgagagtgtattttaaaaaatttgctaagacttggtatgaattttttaaaagtaagtaaatgaagggaggggaaaacactaccgccatttacttttgccaggctttccttttaaaaggtcact

SEQ ID NO: 50745 - DNA, 201 bp, Homo sapiens
atttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgag

SEQ ID NO: 50746 - DNA, 201 bp, Homo sapiens
aaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatag

SEQ ID NO: 50747 - DNA, 201 bp, Homo sapiens
aacccggatgcaagcaccacagctatgggaacaggtggccaaggattacacagttggaaagagaggccccctctgacacctgtagcactgtggcatgggargtgctggtcttcaggggtgggtcaccgtggtgacatctcccgcagtggccctgataagggaggaggcagcagcagttggcacatggtatggaagctgaca

SEQ ID NO: 50748 - DNA, 201 bp, Homo sapiens
agcgtgtacactgctctcttcctggcaattgacagtggtgagtacttgacaaagaccatcaagggtatacttttctgctacaaatatacttttacattttyaaatttcttctgatacacccaggggtgttcttgggaagaatgtaagtgtgtgggaacagcaaagtaaatgtttaaatatacacatgttgagttcagtaat

SEQ ID NO: 50749 - DNA, 201 bp, Homo sapiens
acaaaatatcggagcctgggtatttataaagaagagaatcgtattggctgtcatttctagaggatggacaatccaaggtcaagacaccagtaggtttggtrtcttgtaaggccattctcttcttgcaatatggtgcctggcaccttgcaccctccagaagacaggaaggctgaattctcatatggcagaaagtggaagggc

SEQ ID NO: 50750 - DNA, 201 bp, Homo sapiens
tcccacttcttatgtcagtggtagaacttttgagggagacagagaattacgcatttcattaggttttgcaaatgtattgtacaattgtgcataacattttstatttaaaaatctcatatctattgttatagccctatctcatatctcatttttttagtgccttttgcttgttattgattctatttgcctgtttgtctattt

SEQ ID NO: 50751 - DNA, 201 bp, Homo sapiens
ttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatcagcaggttgccaagg

SEQ ID NO: 50752 - DNA, 201 bp, Homo sapiens
gaggcaggatgattgcttgacgccaggagtttgaaatcagcctgggtaacatagtgagacaccgtctctacaaaaaatacaaaaattatcctcttagatgyaaatgctaaaaaaataaagttagccaggtgtggtggcgtgcacctgtggtcccagctacttgggatactgaggtggtaggattgcttgagcccaggaggt

SEQ ID NO: 50753 - DNA, 201 bp, Homo sapiens
agtgtttggttatttttatacaatatttttataataatacacattctgctaccaacactccccatatattaagtattagtaaacattgaatttttttttttagattaaaaaaaaaagacttggcagtatttttttcttaccaacaagggattttcttgtggtcctcactttgagactcctgatctacagatgacaatcatc

SEQ ID NO: 50754 - DNA, 201 bp, Homo sapiens
ccaggcgtggtggcaagcacctataatcccagctactcgggaggctgaggcaggagaatcgcttgaacctgccaggcagaggttgcagtgagccgagatcrcaccactgcactccagcctaagcgacagagcaaaaaacaacacctgcagagatccaggagcaactggaactcaagaataacagagtttggataaatcgga

SEQ ID NO: 50755 - DNA, 201 bp, Homo sapiens
agttcaagaccagcctggccaacatggccaaaccccgtctccactaaaaatacaaaaattagccaggcgtggtggcaagcacctataatcccagctactckggaggctgaggcaggagaatcgcttgaacctgccaggcagaggttgcagtgagccgagatcacaccactgcactccagcctaagcgacagagcaaaaaac

SEQ ID NO: 50756 - DNA, 201 bp, Homo sapiens
ggcagatcacttgaggtcaggagttcaagaccagcctggccaacatggccaaaccccgtctccactaaaaatacaaaaattagccaggcgtggtggcaagyacctataatcccagctactcgggaggctgaggcaggagaatcgcttgaacctgccaggcagaggttgcagtgagccgagatcacaccactgcactccagc

SEQ ID NO: 50757 - DNA, 201 bp, Homo sapiens
catgttgtccaggctggtctcaaacccctgacctcaggtaatctgcctgcctcggcctcccaaagtgctaggattacaggtgtgagccaccacacccagcyccttcctttctctttcttcagaaagtaaaatattacaggcaaaggtaaaattgcctatgtttctctgcccaattttattttctgttctctctcctcagaa

SEQ ID NO: 50758 - DNA, 201 bp, Homo sapiens
gaatttatgccaaaacatgttgataaaatatatggcttcgggaacttccatgtaggatacagtacggaagtgtccccactgtgaaactagaaaaatctagwtaaattataaaaatcagataatataaaaaaatcttaattgtaaaggaatcagggagctgcagaagcattgacaactagataaactaaaataccaaagagg

SEQ ID NO: 50759 - DNA, 201 bp, Homo sapiens
ttactgcaacctccgtctcccgggttcaagtgattctcctgcctcagcctcccaggtagctaggattacaggcatgcaccaccatgcccggctaatttttstatttttagtagagacgaggtttcaccatgttgtccaggctggtctcaaacccctgacctcaggtaatctgcctgcctcggcctcccaaagtgctaggat

SEQ ID NO: 50760 - DNA, 201 bp, Homo sapiens
tatttatttatttttttgagacagagtctcactctgtcgcccaggctgaagtacagtggcgtcatctcagcttactgcaacctccgtctcccgggttcaartgattctcctgcctcagcctcccaggtagctaggattacaggcatgcaccaccatgcccggctaatttttgtatttttagtagagacgaggtttcaccat

SEQ ID NO: 50761 - DNA, 201 bp, Homo sapiens
ttatgttttccactagcagttgtatagttgtaggtctcacatttaggtctttaatccattttgagctgatttttgtatatggcatgaggtaagggtctaasttcagttttgcttgtggatattcagttttccaaacaccatttggggctgctcatttcccattgtgtagtcctggcacctttgtcaaaaataattcagcca

SEQ ID NO: 50762 - DNA, 201 bp, Homo sapiens
aaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcctca

SEQ ID NO: 50763 - DNA, 201 bp, Homo sapiens
actgtacattcaattaaacctctttcttttttaaattgcccagtctctggtatgtctttatcagcagcatgaaaatggactaatacatcatcctatctgaytaatacaggagagggaaaaactcatagcaccatatgtcatctggagcctctccaatcttttttttaataatgcccaatttacagttttataaaaattact

SEQ ID NO: 50764 - DNA, 201 bp, Homo sapiens
tcattccccgggtatgtagttaaggccatggttgtgaagtatccgcatgatgcatctccactatacaccgtgcttgtggcaatggaggaggcaaaggaccmcagaggaaggacccttaggtggaaaagccaactctgtccatgccccacctgtaaatgtttgtgttgcagaactttccccttagttcagctaaaactgagt

SEQ ID NO: 50765 - DNA, 201 bp, Homo sapiens
gaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcctc

SEQ ID NO: 50766 - DNA, 201 bp, Homo sapiens
ccgggtatggtggcgggcgcctgtagtcccagttactcgggaggctgaggcgggagaatggcgtcaagctgggggcggagcttgcagtgagcagagatcaygccactgcactccagcctgggcaacagagagagactccatctcaaaaaaaaaaaaaaagaaaagaaaagaaaagaaaagaaaaatactagctgggtgcag

SEQ ID NO: 50767 - DNA, 201 bp, Homo sapiens
tgttgcagaactttccccttagttcagctaaaactgagttcttgtcaaacaaccaggaaagactgggctcacagccacataaaagggtgagaaacagaagytattggacaaaaaggaataataactctcagcaaagcgagaaagggtcctgcttgcaggtctcccgcctcatagattgaatcccaggttaccacagaaaca

SEQ ID NO: 50768 - DNA, 201 bp, Homo sapiens
gtcagcagatcgagaccatcctggcgaacactgtgaaaccccgtctctactaaaaatagaaaaaattagccgggtatggtggcgggcgcctgtagtcccasttactcgggaggctgaggcgggagaatggcgtcaagctgggggcggagcttgcagtgagcagagatcatgccactgcactccagcctgggcaacagagag

SEQ ID NO: 50769 - DNA, 201 bp, Homo sapiens
actagctggggccgggcacggtggctcacacctgtaatcccagcactttgggaggccgaggcgggtggatcacgaggtcagcagatcgagaccatcctggygaacactgtgaaaccccgtctctactaaaaatagaaaaaattagccgggtatggtggcgggcgcctgtagtcccagttactcgggaggctgaggcgggag

SEQ ID NO: 50770 - DNA, 201 bp, Homo sapiens
agtaatttgagtgatggcagaaattggtttaagaaaaatactagctggggccgggcacggtggctcacacctgtaatcccagcactttgggaggccgaggygggtggatcacgaggtcagcagatcgagaccatcctggcgaacactgtgaaaccccgtctctactaaaaatagaaaaaattagccgggtatggtggcggg

SEQ ID NO: 50771 - DNA, 201 bp, Homo sapiens
ggccgaggcaggcggatcacgaggtcaggatatcgagaccaccctggccaacatgttgaaactctgtatctactaaaaaaatacagaaaattagctaggcrtggtggctggcacctgcagtcacagctacttgggaggctgaggcaggagaatggcatgaaaccaggaggcggggcttgcagtgagccaagatcgtgccac

SEQ ID NO: 50772 - DNA, 201 bp, Homo sapiens
aggatgttggttcaaattttgtgtgaaagcaacaatagggccaggtacggtggctcatgcctgtaatcctagccctttgggaggctgaggcgggcgaatcrcaaggtcaggagttcgagaccagcctggccaacatggtgaaaccccgtcactactaaaaatacaaaaaattagctgggcatagtggcggatgcctgtaat

SEQ ID NO: 50773 - DNA, 201 bp, Homo sapiens
tagcattttttagtaaaaacgtatttttaaattaaggtatgtacattgtttttagaaataatgctattgcatacttaataggctacattatagtataaacrtaacttttatatgcactgggaagccaaaaagttcatgtgactcactttattgtaatatttgttttattgctatggtctggaaccgaacctgcagtatctc

SEQ ID NO: 50774 - DNA, 201 bp, Homo sapiens
gtgattcctctgatggatcaagacaaaatgagtcaaaaacctgctgaaaaggattcaccattctagatgcccactaagaacatttgtgattcatgggggggtggttaaaatgtcaaaaataacaggagtttagaagatgttgatttcaatcctcatggatgattttgagaggttcaagacttcagtggaggaaggaagtgc

SEQ ID NO: 50775 - DNA, 201 bp, Homo sapiens
aggccaaggcaggagaatcggttgaaccagggagtaggaggtttcagtgagctgagatcacaccactgcactccagcctggtgacagagtgagactccgtstcaaaaaaataaataaataaaataaagtgtgaggtgaagcaggaagtgctgatatagaagctgcagcaagtcatccagaagatctagctaagatcattga

SEQ ID NO: 50776 - DNA, 201 bp, Homo sapiens
aattagctgggtgtggtggcacgtacctgtaataccagctactcgggaggccaaggcaggagaatcggttgaaccagggagtaggaggtttcagtgagctragatcacaccactgcactccagcctggtgacagagtgagactccgtctcaaaaaaataaataaataaaataaagtgtgaggtgaagcaggaagtgctgat

SEQ ID NO: 50777 - DNA, 201 bp, Homo sapiens
aaaatgattgagtttatatttgaggcaggaaataaacaagaagaatctgtaaaatcttgtcataccaagaagcagagaggctatgagatgtcattagggtsatgtcatttaaagaagccagtatgagtagctcaaagatgagataatttgagcctcaaaacaaaataagtgatttcaatggatttaaatacactaaatctg

SEQ ID NO: 50778 - DNA, 201 bp, Homo sapiens
caggtttctaagaacatcttaatgaaaataacagaactcagaaaatccactgtcattttgtccagaaatattttgttagcattgggatgcagcaatgccaytgacaagaaacccatgtggaccaccttttaatgcttaatgagcctttcttcctagcatgcattccagtgggagagaggacagaataaacgtgattaaatt

SEQ ID NO: 50779 - DNA, 201 bp, Homo sapiens
tattttagaaacggaaaggaaaaaaaaacataaacaactatcctgcctttgttttcagaattccttgtagaaataattaactagtggatgaagagagtttstctttctaggtaataagcaacgaaaaaatggcagaattagaatataatgaatttgcagttcttactaaattaatatatctaggcagtaaccatcaataaa

SEQ ID NO: 50780 - DNA, 201 bp, Homo sapiens
agactgcaaaaaaatttgttagaataatatgaacaaagactagatgtttgctgccatttagaaattctcattagtatttgttcagttatgataatgcatgstgcttctgttaaaaaaatacttttaatcttttacagataccttctaaatatttatagatgaaatcatatgatatctagaattttctttaagacaatctgt

SEQ ID NO: 50781 - DNA, 201 bp, Homo sapiens
ttagggctgtgaatgtaatttgttttgtattttcagctggtaacgcactttctgaaactttataatgcccaaatttttaggccagatgtaaaaatggagakaatttctttctttctttccatggtaagtgttacataaggacttagtcttagatttatgtgcatttacttgctatgagatattcaagagtccttgaatatg

SEQ ID NO: 50782 - DNA, 201 bp, Homo sapiens
ggaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcctgcct

SEQ ID NO: 50783 - DNA, 201 bp, Homo sapiens
tgaaaggaaacatatttctccctcttttcttttgttctttttttcttctttcctttgtctttcttttctttttttcctttatttgtttacttatttatttatttttttgagacagagtctcactctgtcgcccaggctgaagtacagtggcgtcatctcagcttactgcaacctccgtctcccgggttcaagtgattctcc

SEQ ID NO: 50784 - DNA, 201 bp, Homo sapiens
agggcgttggggaatggtaatgaatggacgcatggacagacagatggataaatgaaaggaaacatatttctccctcttttcttttgttctttttttcttcyttcctttgtctttcttttctttttttcctttatttgtttacttatttatttatttttttgagacagagtctcactctgtcgcccaggctgaagtacagtg

SEQ ID NO: 50785 - DNA, 201 bp, Homo sapiens
aggaaagaggtagaaaatgcaggtagaaagtcaggcaggtccagatggatcctctaggaccttagagaccatggttaagagtttggattttattctatacmccatgggaagtcattggtgggttttaagccggggattcacactctgtgatttaacactggctgctctttggagaatggactgtagcaagcagaagagaag

SEQ ID NO: 50786 - DNA, 201 bp, Homo sapiens
agatgcaattcatcttctcattctcaggcaggaaatctgcagttcccggagatgatttggctccacctcaaggattagcctgcacacccatacaccccacrcaagccagggtccagcatcccagggtccacttttcttggccagaggaagctggaacagaaagggaatgctaaataaaagcatgggaacatgtgggcagac

SEQ ID NO: 50787 - DNA, 201 bp, Homo sapiens
tagtcccagctactcgggaggctgaggcagcagaatcacttgaacccgggaggcggaggttgcagtgagccaagatcatgccattgatctccaacctgggygacagagcaaggctctgtctcaaaaaaaaaaaaaaaaaggaaacaagaagccattatagcatttcactggcccttcagactgggcatttctgaaagcgaa

SEQ ID NO: 50788 - DNA, 201 bp, Homo sapiens
tatggtgaaaccccatcagtactaaatatacaaaaattagctgggcatggtagtgtgtgcctgtaatcccagctactcgggaggctaaggcaggagaatcrtttgaacccaggatgcggaggttgcaatgagccaagattgcaccactgcactccaggctgggcaacagagtgagaccctgtctcgaaaaaaaaaaaaaaa

SEQ ID NO: 50789 - DNA, 201 bp, Homo sapiens
ggcagatcacctgaggtcaggagtttgagaccagcatggccaatatggtgaaaccccatcagtactaaatatacaaaaattagctgggcatggtagtgtgygcctgtaatcccagctactcgggaggctaaggcaggagaatcgtttgaacccaggatgcggaggttgcaatgagccaagattgcaccactgcactccagg

SEQ ID NO: 50790 - DNA, 201 bp, Homo sapiens
aatgtagagctgtggacagaggattgatcaaaaaaaacaaaaacaaggctggactcagtggctcacacctgtaatcccagcattttgggaggccgaggcakgcagatcacctgaggtcaggagtttgagaccagcatggccaatatggtgaaaccccatcagtactaaatatacaaaaattagctgggcatggtagtgtgt

SEQ ID NO: 50791 - DNA, 201 bp, Homo sapiens
agaggggggtgagcatcaggataaatagccagtgcatgtggggcttaatacctaggtgatgggatgatttgtgcagcaaatcaccatggcacatgtttacstatgtaacaaacctgcacatcctgctcatgtaccccggaacttcaattaaaaaaaaaaagaagaaaaaaaaaaagattgtatcctctactaaaggaagat

SEQ ID NO: 50792 - DNA, 201 bp, Homo sapiens
ctgaggcaggggaatcgcttgaacccgggaggcggaggttgcagtgagtcgagattgcgccattgcactccagcccgggcgacagcgcgagactccatctmaaaaaaaaaaaaaaaaaaaaaaaaaaaaaaaagtcttatatatgataaagggctttgtaaaccactaaactttataccaaaaaaatctattattgttagt

SEQ ID NO: 50793 - DNA, 201 bp, Homo sapiens
gtactaaaactacaaaaaaattagccgggcatgatggcaggtgcctgtagtcccagctactcgggaggctgaggcaggggaatcgcttgaacccgggaggyggaggttgcagtgagtcgagattgcgccattgcactccagcccgggcgacagcgcgagactccatctcaaaaaaaaaaaaaaaaaaaaaaaaaaaaaaaa

SEQ ID NO: 50794 - DNA, 201 bp, Homo sapiens
atatatatcagctatcaatataaataataactagcacataacacctactgtgagccagtttctgtcctgaaacatttgatttgtgtttactcattgactcmtacaaccaatgggagtagacacaattattagttgtgttttgcaaatgaggaaactaaggcaaagagaatttaagtaacttgctcagggtcacatagaaac

SEQ ID NO: 50795 - DNA, 201 bp, Homo sapiens
tattatataagaaatatatatcagctatcaatataaataataactagcacataacacctactgtgagccagtttctgtcctgaaacatttgatttgtgttkactcattgactcatacaaccaatgggagtagacacaattattagttgtgttttgcaaatgaggaaactaaggcaaagagaatttaagtaacttgctcagg

SEQ ID NO: 50796 - DNA, 201 bp, Homo sapiens
ggcatgagccaccgtgccagccacacatttaaaataatgataatagtaagccccaattatactataaaggaacaactaatttagaataggaggtctaggtmaatatgcaaatgcaaatactctggcgcaacccccctggaaaacataatgaagtggtcccgccagagtatcctcacacagggtcaccaccaacacattgca

SEQ ID NO: 50797 - DNA, 201 bp, Homo sapiens
tttcccatgtaccagggacatgggggaggggaggatttggggatgattcaagcacattacatttatcgtacacttaatttctattattattaccttatatwatgaaatagttatacaactcaccagagtgtagaatcagtgggagccctgaacttgttttcctgcaactagacagtctcatctagggtgatgggagacagt

SEQ ID NO: 50798 - DNA, 201 bp, Homo sapiens
attttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagaca

SEQ ID NO: 50799 - DNA, 201 bp, Homo sapiens
cctaggtacctggtggcctctgagccattgggaatatgcttgtggaaatacaccctcctctcgaggaagctatggtcttgtagctgagactgatcacccarcagacaatggtaaacccagtgtgccaagctctaggcagaggataaaaccacgaagacaagcagaatggaagaggaggaaaatataacactgcctcgggaa

SEQ ID NO: 50800 - DNA, 201 bp, Homo sapiens
gctttggtgccagatgcacatttgaggagtaggtggctagtcagactctcacctgagcagttaataaaatctattgccccttaatggaattttttctgcargctcgaattgatctgtcatctttgtgatttgtgagatggcagggaagcaccaaacaccatcatgacttgggccacagtggggggaaaaaaggaaaaaaga

SEQ ID NO: 50801 - DNA, 201 bp, Homo sapiens
ataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatcca

SEQ ID NO: 50802 - DNA, 201 bp, Homo sapiens
cttgtagctgagactgatcacccaacagacaatggtaaacccagtgtgccaagctctaggcagaggataaaaccacgaagacaagcagaatggaagaggakgaaaatataacactgcctcgggaaggagtgttggggcagactttctagtgtaatgaaagatgagcagaaattatttgagatgaagcaggaacaacctggg

SEQ ID NO: 50803 - DNA, 201 bp, Homo sapiens
aaaaggaaaaaaaaaaaaaaacttggccgggtgcagtggctcacacctgtaatcccagcactttgggaggcccaggtggacagatcatttgaggtcaggastttgagaccagcctgaccaacatggtgaaacctcgtctctactaaaaacacgaaagaaacagccaggtatggtggcacgtgcctgtaaccccagctactt

SEQ ID NO: 50804 - DNA, 201 bp, Homo sapiens
ctgagactgatcacccaacagacaatggtaaacccagtgtgccaagctctaggcagaggataaaaccacgaagacaagcagaatggaagaggaggaaaatrtaacactgcctcgggaaggagtgttggggcagactttctagtgtaatgaaagatgagcagaaattatttgagatgaagcaggaacaacctggggcagggg

SEQ ID NO: 50805 - DNA, 201 bp, Homo sapiens
ctttattgccctaaaatgtctctgccttcaaacaagtgggctaaagagggagggcctgatgctctgaaaaggaaaaaaaaaaaaaaacttggccgggtgcrgtggctcacacctgtaatcccagcactttgggaggcccaggtggacagatcatttgaggtcaggactttgagaccagcctgaccaacatggtgaaacctc

SEQ ID NO: 50806 - DNA, 201 bp, Homo sapiens
agtaaagtacccaaaatgcagcgattcacaataaaaacagttcatttcttcccattatctctatcctccagggactggctgggggctcggctccatgtcaycctctctctggcattcaggctgacagagtggccactttgcagaacagcggcagtggttgtgcagaggaagatggcataccacactacacacaggctcttg

SEQ ID NO: 50807 - DNA, 201 bp, Homo sapiens
catgagcctaatttgaaaaaaacctggttcacagagggctgcttaagaagttgatggttttgtttatactcaaagtcattgtggggacctctattttcacsttttttggcctaggttgtcccagtacttctctcattctgtgattgatgtcataggtgacaagtgtgatgggtcacttcactggcctctccaggcggttta

SEQ ID NO: 50808 - DNA, 201 bp, Homo sapiens
ctcctgcttgtaatcccagcgctttggcaggccacagcaggaggttcacttgagcttaagagttcaagaccagtctgggcaacatagtgagacccccatcwttataaaaattttaaaaatttaaccgggcatggtggtgcacacctgtggtcctagaaacttgggaggggctgaggtgggaggaccacttgagcccaggag

SEQ ID NO: 50809 - DNA, 201 bp, Homo sapiens
gtatcattctaaagttatcctttgtccttcttttattcttgttcatgggtatctccactagaaggaggatatatttttctggcagaagaacatgcccgtcytatttattgtgttatcactagtgtccactatagggatggacaggtggtaggtgttcaatatttgcctcatggatattgggaattactatatttattgttc

SEQ ID NO: 50810 - DNA, 201 bp, Homo sapiens
actcttttctgcccaggactagaggtcataaggcccctactaactctctggcttcatccccagtactacctgttaaccaacctgacattcctcccatcacyccgcagatcctggccccaaagccttaccttggtgctagcagctgcctctgttttgaaagctcttcccctgagttctccatgaccaagtcctcaccctttt

SEQ ID NO: 50811 - DNA, 201 bp, Homo sapiens
tccaagttttgaagaggattgaagtagaactggatggagatgggaaagagaccaataaagtgttttttgttttttaggttttttttttaagaggggaggartgaatgaagaacttcttttattttcttttccggcttggagctagctctggttcccaaatagggtcctgggggaaagacgtgatgtgagtctgggtggctg

SEQ ID NO: 50812 - DNA, 201 bp, Homo sapiens
aactgtgaagccagcacagatctcccagaacagggaacccagagcttagggctggagaaggcactcccagagaaggtccaagcctagagcagtgactgttygacttctgcccaggtacatcttgcttctcaccccatagggaaacaaccgctggaggagccaagtgttcagtgagccggtgcagttctggggccataatga

SEQ ID NO: 50813 - DNA, 201 bp, Homo sapiens
tatatatacatgagtggactggagagactgaggaggcacaagtcgaggaggaacacatcttttattttgacttaattttctttttatcccctctccttctrccccagggttcttctccgtgtggatcacattaagggagcgtataacctttcataccgcctgactaggatgatggatatggaaatacacactttgggagcc

SEQ ID NO: 50814 - DNA, 201 bp, Homo sapiens
ggagactctagtgtagtcccccagcctactgtagaggctcttcacattatcatattttatactgcataatttttgaagatgatcccttttcttccaaattstagtacaggagaggtatgctatttttccataagaaaaatcagacttactttgaaagagcagtaggattagcagacactttgaaatattacattaatccag

SEQ ID NO: 50815 - DNA, 201 bp, Homo sapiens
gtttgagagttgagagtcttttatgtagtctatatgcacatcctttgtcggagatgtggcttgcaaatatttatctcaatctgtggcttgtctgttctttmtcttaatagaatctttcacagaacaaaagtttttaatttcatgcaagtccaatttatacttttttcttctatagattgtgcttttggtgtcaactctagg

SEQ ID NO: 50816 - DNA, 201 bp, Homo sapiens
aatgtttgagagttgagagtcttttatgtagtctatatgcacatcctttgtcggagatgtggcttgcaaatatttatctcaatctgtggcttgtctgttckttctcttaatagaatctttcacagaacaaaagtttttaatttcatgcaagtccaatttatacttttttcttctatagattgtgcttttggtgtcaactct

SEQ ID NO: 50817 - DNA, 201 bp, Homo sapiens
tcatattatttcgtccaaacttaccatatcttaaaaaaaacttaccagcaaacaaatcatccaactgcctttcatctattgaatgttctacagacttaacrccattatctcgcatgaccttgatgaagatagtaaccctccctttatcaaaatggtcaatcttcattaatttattttactaattagttaaaggctggtgta

SEQ ID NO: 50818 - DNA, 201 bp, Homo sapiens
ctgagttaggtgctcatattagttccatttaacagttggagaaaatgaggctcagggaaattaaatcacttgctccacatcacacagctactaggcagtcratgctggttttgaggctaggtgatctcagtccagaggcctcagccttaaccattctgctctctcgccttcctgcattttatactccatacttctcttggg

SEQ ID NO: 50819 - DNA, 201 bp, Homo sapiens
ggcggatcacgaggtcaggagtttgagaccagcctggccaacatagcgaaaccccatctgtactaaaactacaaaaaaattagccgggcatgatggcaggwgcctgtagtcccagctactcgggaggctgaggcaggggaatcgcttgaacccgggaggcggaggttgcagtgagtcgagattgcgccattgcactccagc

SEQ ID NO: 50820 - DNA, 201 bp, Homo sapiens
atcccatctctactaaaaatacaaaaattagctggacattgtggtgcacacctgtaatcccagctacttgggtggctgaggcatgagaatcacttgaaccsaggaggcagaggttgcagtaagccgagaccacaccactgcactccagcctgggtgacagagtgagactcaccaaaaaaaaaaagaaagaaagacattatt

SEQ ID NO: 50821 - DNA, 201 bp, Homo sapiens
gaaaaaatatatgtatttggttaagatgtaattgttaccaaagcaccaggggtttggtctgggtcctgctgttcactgcacagaaagccaatcactgagayaagacaaaagccagggaagaaggctttaatcgggtgctgctgcagccaaggaaatgggaggtcagtctcaaatccatctctgaaatgaggggttgatgca

SEQ ID NO: 50822 - DNA, 201 bp, Homo sapiens
aggcaggtggatcacttgaagtcaggcgtttgagaccagactgaccaacgtggtgaaatcccatctctactaaaaatacaaaaattagctggacattgtgktgcacacctgtaatcccagctacttgggtggctgaggcatgagaatcacttgaacccaggaggcagaggttgcagtaagccgagaccacaccactgcact

SEQ ID NO: 50823 - DNA, 201 bp, Homo sapiens
gatcgtaccactgcactccagcctgggcgacagtgccagactccatctcaaaaaaaaaaaaaaataataataaacaaatggatgcatgaacaagtgcatartaggtagataaatacaccttaggagacagatcaaaatgcagacttgaatttaattggcacagacacttaattatgcatcttgacatctttgaccaaaaac

SEQ ID NO: 50824 - DNA, 201 bp, Homo sapiens
aggaataaaagaatggctactccccgtagacagagcagccccaaaggctgctggttgcccatttttgaggttatttattgatgatatgctaaacaaggggwggattattcatgcctcccctttttagatcatagagagtaacctcctgatgttgccatggcatttgtaaactgtcatggtgctggtgggagtgcagtagtg

SEQ ID NO: 50825 - DNA, 201 bp, Homo sapiens
ctgttcggttttcttccttccagtgtgctattctatagtagaaacagtgccaggccatgggatttagacatcagaggcatttccaggtttataaaaaggcraagactgtattaaagtatttgcttttaagtttgttggccagttcttctcactgaccctggataggtctaggctactctcagcttacctaccatgtctttg

SEQ ID NO: 50826 - DNA, 201 bp, Homo sapiens
ccatggcatttgtaaactgtcatggtgctggttggagtgtagcaatgaggatgaccagaggtcactctcatcgccatcttggtcttggtgggttttagccrtcttctttattgcaacctgttttatcagcaaggtctttataacctatatcttgtgctgacctcctatctcatcctgtgacttagaatgccttaaccgtct

SEQ ID NO: 50827 - DNA, 201 bp, Homo sapiens
agaaagagagtcagttgatgcctcttgagcaggcatacactctccctaggctgaaaattgagctgcattaattcagaaatatttactgagcaactactatstgtcaagcactgcactggctactgcttatggattcccccgagaagaatgcccgtcctaggagagggggcagacctgtaaacaggcagacaagcgctgtga

SEQ ID NO: 50828 - DNA, 201 bp, Homo sapiens
gcccatgtttatagttttttcttgatgatatgctaaacaaagggtgaattattcatgcctcccctttttagaccatatagggtaacttcctgatgttgccmtggcatttgtaaactgtcatggtgctggttggagtgtagcaatgaggatgaccagaggtcactctcatcgccatcttggtcttggtgggttttagccatc

SEQ ID NO: 50829 - DNA, 201 bp, Homo sapiens
ggacattagaaccgccttatatacagaaacagtccagcaacagagggctggataagatttcaccttcctatgatccactgtcagcaggctagatgacatamgcacacagcctagtggcagtgggctggggaggaaaactgcaaacatcatgcaatttatataacattttcccttaacacactccccctaatgacctccacc

SEQ ID NO: 50830 - DNA, 201 bp, Homo sapiens
taagaaaatacagtctattaaacatagttataggctgtcactatccacagttataattagatttataaatcatgtgcaagattcccagcaaaaaaaaaaaatgaatcttaaacattcttttcaactattatcaccccaaaatgaaacaaaacaaaatatagcaacgatatgaaattgtttcagtaacattgccatgttaca

SEQ ID NO: 50831 - DNA, 201 bp, Homo sapiens
gacattagaaccgccttatatacagaaacagtccagcaacagagggctggataagatttcaccttcctatgatccactgtcagcaggctagatgacataarcacacagcctagtggcagtgggctggggaggaaaactgcaaacatcatgcaatttatataacattttcccttaacacactccccctaatgacctccacct

SEQ ID NO: 50832 - DNA, 201 bp, Homo sapiens
taaatgcattaagagtcaaggagacatttttcacgtattgaaaataagatttgattgagtgcttgcaagtggcctagtgaaatctcattaaaccactgttwaatactttataaatggcagaatattaaccattaattatgaacatgaaaccagtttgaaaataagttttgcaatatctaagcttgattttcaacccttatt

SEQ ID NO: 50833 - DNA, 201 bp, Homo sapiens
gtgaccaatactagtcatgtggccccagcataactacaggagaggctggagaatatatgggaacctcctcacattcaccaaatggaatctttggtgaattytaaagattcccggcatgtcccactatctccttttggggctgagaaaatgaaagaaaaaactgacaggccaatgtactgactgctctctcacctgggtctg

SEQ ID NO: 50834 - DNA, 201 bp, Homo sapiens
tgcagtgagatcacaccactgcactccagcctgggcaacagaatgagggcctgtctaaaataaaaataaaaatagatgtgtttgtgtgtgtgtgtgtgtgatatatatatatgtatacacaaacatatatatatacatatatacacacacacattcaaagaaaaaataatacaaataaaaatacagtacaactattttcat

SEQ ID NO: 50835 - DNA, 201 bp, Homo sapiens
ccttttgcaagttattaatatatgtcacacagagcctgtttctcatatttattgaccagactaaggagagaacatcgtaccctctaacccagtggttggcrcgcttgagccagctcataccagctctcgtgagaccgttgttaatgtctctttctcactctgtcttcactgtagcttgatatcagccatggcaggattgtc

SEQ ID NO: 50836 - DNA, 201 bp, Homo sapiens
ttgcagtgagatcacaccactgcactccagcctgggcaacagaatgagggcctgtctaaaataaaaataaaaatagatgtgtttgtgtgtgtgtgtgtgtkatatatatatatgtatacacaaacatatatatatacatatatacacacacacattcaaagaaaaaataatacaaataaaaatacagtacaactattttca

SEQ ID NO: 50837 - DNA, 201 bp, Homo sapiens
atgaagcccatgctgtcaccacttttttttttaattaacagtgtctgttaaacatgcatgtgattcagaattagatatcactccccaccctcatgaaatcmtctttaaatacttgatttattatttattttccactagaatacttctggatttttcatgaagcctgagggaaaatgagaagttattatctacatcattttt

SEQ ID NO: 50838 - DNA, 201 bp, Homo sapiens
cagcccttcgtatccacaggctccacatctgcggattcaatgaactatggatcaaaagtatcctctggccgagtgtggtggctcacgcctgtaatcccaasactttgggaggccaaggcaaacagatgacttgaggccaggagttcaatactagcctggccaacatagtgaaaccccaattcactaaaaatagaaacctca

SEQ ID NO: 50839 - DNA, 201 bp, Homo sapiens
catgagtttaatattgaggttgagcgatggatacagagaagttcatcatacgaatctctccactttgatgttttcttgaactctccaatactaaaaatttwgccaaaaaaattaacaggggcaacgaactttcttctttttccaagggctttttatcgatgattttaagaaaatggtcagacagcgcaggcgtgttttacc

SEQ ID NO: 50840 - DNA, 201 bp, Homo sapiens
ggcttacaggtagctgtatgttttacaagttggcctgaggctccaaagatgcctattccaagagagaggctggacaagctgtactaccttttatgacttastgtcagaaggcacacagtgtcacctttgccacatttctttttttcttggcagataataaggcccacccaggttcaagaaaagtggggcagcaggggaagg

SEQ ID NO: 50841 - DNA, 201 bp, Homo sapiens
aaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggc

SEQ ID NO: 50842 - DNA, 201 bp, Homo sapiens
gcttttcatttaaagttatgatagccaacatttaccttttagaggtgctcaaaaggcccactgtacctttggcttcatagctgtagaaatcgggcattttmcaaaaaaaaggcagtgacggtgcctcacatctggccacaggcatctctcggcagcatgcaggtcatctagggcaagtctctgtaaaggcctttctctctg

SEQ ID NO: 50843 - DNA, 201 bp, Homo sapiens
ctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacata

SEQ ID NO: 50844 - DNA, 201 bp, Homo sapiens
ggaacctctgtctagatttcagaggatgtgtggaaacacgtgatgtccaggcagaagtttgctgcagggacagaacactcatggagaacctctgctagagyagtgcagaagggaaatatggggttggagcccccacacagagtccccactggggcactgcttagtggagctgtgagaagagggtcaccatcctccataccc

SEQ ID NO: 50845 - DNA, 201 bp, Homo sapiens
accttgtccaggggaaagtcaggactgggatccagcgtatagtcacttgctacggctattcccattatgttttgctgctgctgaaacactggaacacattstaaagttcagacactcaggaaataccccacggtgataaggacaaccggtgatgccgatgagttcccaccaggtgtcagtgcctcgaggacttgtttaatc

SEQ ID NO: 50846 - DNA, 201 bp, Homo sapiens
atatgcaagatataattttatagcatttaattgcagtatttacattgttctttttctctctctctttggtgggagagctggctttccattagttaaatgtrcatatgatgagacttgactatattcatttaagccacattcctaatcatacaatctccaccagactgtgcattacgtaaggcaagacctgttttctctgtt

SEQ ID NO: 50847 - DNA, 201 bp, Homo sapiens
tagggaaataatcaccacttacatttttatatatgtctttctaatttttctctaatcatatgtagatttttaaattaggatcacactatgtttttagttaygtctattaatgacaagatataaagcacttatatatatagctactgaacaacagaacctgtgaaaaaaaaatctcagtgttttttagctaagtggaaatcc

SEQ ID NO: 50848 - DNA, 201 bp, Homo sapiens
ctgcttacatatctgttcctgccatagcattagcgtttcaagagcaggcacctgtaccattgacattagcacatttccatccaggcagagggtagagtccyagtaaatggttattgactgaatgaataaaatgaaactgtcatgtttaaacatggcctcaaaattaattatttccctttttttcttttctctaaagtcagt

SEQ ID NO: 50849 - DNA, 201 bp, Homo sapiens
agtctctgcttctccccagctatctcttggctcagctgtctttccagtctcagagacagagaactgtgttaacattaactttcaccagcgcattggagagrcttttcgtggtgtacctgctgtcataaaagactaaaggaaagagaagtgctaggataagaatctttatagtcttcaacctccaaccttccatagtacgct

SEQ ID NO: 50850 - DNA, 201 bp, Homo sapiens
tctccttcagtcctctgtaagatagatgttccaataatgccagctgattcaaaattgaaatattgttcaaaatatgcttagattgatttttttaaaaaatkgttattcagccccagagtgaaatgactactgaactactgaatttatagcccccaaactgagggtgggaggggctctgaactgaacttcagaaagatacct

SEQ ID NO: 50851 - DNA, 201 bp, Homo sapiens
cctctttctcttccttttttcttttaattaaactccacagattctttgtttgtaactagcttacaaagaatattggccaacctgcccagtctcagaccttsaaaagataggagtctctgcttctccccagctatctcttggctcagctgtctttccagtctcagagacagagaactgtgttaacattaactttcaccagcg

SEQ ID NO: 50852 - DNA, 201 bp, Homo sapiens
cccataattcccatgtgctgtgggagggacccagtgggagataattgaatcatgggggcagtttcccccatactgttctcatggtagtgaataagtctcargagatctgatggttttatcaggggtttccacttttgcgtcttcctcattctctctttgcctgctgccatccctgtaagatgggacttgctcctccttgcc

SEQ ID NO: 50853 - DNA, 201 bp, Homo sapiens
ctaaaagccagctgtttatggctaaagattcagttttgagtccttccatatcaagatgaatatttataggtgcccattgttatactcaacaagggtgaacyaagagttctcagtcctggtcctcgtatgccggctactcacacaaaccattaggagacaagtctaagaagtgagcaatccatgtgacacacaataagtaga

SEQ ID NO: 50854 - DNA, 201 bp, Homo sapiens
agctgctgctgtaaaactgctgagaagcagcttggagttggctctactgcaacatcccttctttctgttgcagttgtccattcccttttattctgccatgwcctgcgccaaggccatcatgcccacgcctgcttctactgtctaagtaataagctgtctgcatctaaagaggtctccttgcttctttgctaggacttgcct

SEQ ID NO: 50855 - DNA, 201 bp, Homo sapiens
aaacattccaggggaccgtgtgagtcacatcagggaggacacacagggccatgaccccagtgagccattaacacacccatagcctgactctgcaacggctsccccgagggcgccccgcacaagaccaagccctttgtgtcagcttcagtttgccctcacagctaccccagaacaccactgggactgtccccgagtcacaga

SEQ ID NO: 50856 - DNA, 201 bp, Homo sapiens
cttgggaggtggtccaaggggaagtgtagaggagtgggaaagtgaggcaaggaaggaaaaggaaacagacgaggggtctgttactcaggcaggtactgctytgggtgtctggagcttaactcccctgggaacctttgagaatcagtgtggaatacctgcttccaagccatcccacctgaggggcatgggagctccagattt

SEQ ID NO: 50857 - DNA, 201 bp, Homo sapiens
agatgtcaggtccttgagaaaagtggtcctgggttgcaaaactagcaacaggttggaagatttacatctcacagggacagagaaagaatttacaattgcamgtttctaaagtaaatgcttcaagaaaagagaagtcaaggcctatattagtccattctcatactactgtatagctactactcgatactgggtaatttataa

SEQ ID NO: 50858 - DNA, 201 bp, Homo sapiens
ctggccaggtgcagtggctcatgcctgtaatcccagcactttgggaggccaaagcaggtggatcgcttgaggtcaggagttcgagaccagcctggccaacwtggtgaaaccctgctctactaaaaatagaaaatttagccaggcatggtggcaggtgcctataattccagatatttgggaggctgaggcaggagaattatt

SEQ ID NO: 50859 - DNA, 201 bp, Homo sapiens
aaaaactagaatgtagacccccatgtgctcaaagcaacagcctgcctggtttgcttggacttttcctagactgtatgataacaggtgctcgattcctctaygtaaatcttcaccttttattaatcatattaccctgcttctcttagaaaacgcacagttctgccctccctacaccaagatcacaaaaggctaagtgtaagt

SEQ ID NO: 50860 - DNA, 201 bp, Homo sapiens
ttaatcacccaataaaaataaactctgagaacaaacacagaggggtgattaactttcccattctggtcttctgacatcccggtttgctctcccagtgagcstgtttctttgagataaaccaccctgggaaactgatcacctgtccagacaccaccatgccttggcgtaagtggacaaaagtggaacgtgacctgcaagcag

SEQ ID NO: 50861 - DNA, 201 bp, Homo sapiens
gtcaaagcatatgtatggaatgaacactggaaatcagtacacagggctgggaatgtgtgattctgagcactccgtgatggaaataaccctccagctccttyacagaacagccagcagcatcacctgttttggtgatggtgcctccggatgatgatccgtgagcgcacactggactcgtgctcctgggtgagctctctcctt

SEQ ID NO: 50862 - DNA, 201 bp, Homo sapiens
tagagcaccttggacattttccttaatctgagtgtctagttttcttttctagaaaatgagaaaaaactagaatgtagacccccatgtgctcaaagcaacarcctgcctggtttgcttggacttttcctagactgtatgataacaggtgctcgattcctctacgtaaatcttcaccttttattaatcatattaccctgcttc

SEQ ID NO: 50863 - DNA, 201 bp, Homo sapiens
caaaggccatggtgtgtcggttaatcacccaataaaaataaactctgagaacaaacacagaggggtgattaactttcccattctggtcttctgacatcccrgtttgctctcccagtgagcctgtttctttgagataaaccaccctgggaaactgatcacctgtccagacaccaccatgccttggcgtaagtggacaaaagt

SEQ ID NO: 50864 - DNA, 201 bp, Homo sapiens
gctccccaccttgatcactgcaaactccccagtccctaacagagtactgggaagatagaaggtggtcaaagcatatgtatggaatgaacactggaaatcartacacagggctgggaatgtgtgattctgagcactccgtgatggaaataaccctccagctccttcacagaacagccagcagcatcacctgttttggtgatg

SEQ ID NO: 50865 - DNA, 201 bp, Homo sapiens
cccagtagatctctgcctcattttacccagcacctattcaagatggagttgctctgatttcaatgcctctgacacactaatgttagagcaccttggacatkttccttaatctgagtgtctagttttcttttctagaaaatgagaaaaaactagaatgtagacccccatgtgctcaaagcaacagcctgcctggtttgcttg

SEQ ID NO: 50866 - DNA, 201 bp, Homo sapiens
tgctcagcttggtctgagctggactcagagacccaggtgccagagcaaaggccatggtgtgtcggttaatcacccaataaaaataaactctgagaacaaayacagaggggtgattaactttcccattctggtcttctgacatcccggtttgctctcccagtgagcctgtttctttgagataaaccaccctgggaaactgat

SEQ ID NO: 50867 - DNA, 201 bp, Homo sapiens
gctttggactggggaacagggtgagttgatggtgggaggtgagcagggatcagtccccaaagccacaaaggttttgaagcctgaaagggacatgacgtacrttttttaaatctcactctcctgttctgtgagcaacagaatagaggacccggaaactgtagtagggttctgtttctacactagtgctaatgtagaacctcc

SEQ ID NO: 50868 - DNA, 201 bp, Homo sapiens
aggctatctggctccagggttcatgttcttccgacaacatcacaatgccactctcaacccaggagcaaaaccagacaaagtgcctactgcagaccggaagwccctcgtttgaagcctccattagcgtgactatgcagctagaccaacttactgttaagcaacagtaccttttactatgaggtaccctttactattaagtac

SEQ ID NO: 50869 - DNA, 201 bp, Homo sapiens
agggtagagtcccagtaaatggttattgactgaatgaataaaatgaaactgtcatgtttaaacatggcctcaaaattaattatttccctttttttcttttmtctaaagtcagtggaatggaaaaaaaaccaaaaagttgaatttttgtacaacagtttagttttacattattgtctcttctaaaataatttttcagcccaa

SEQ ID NO: 50870 - DNA, 201 bp, Homo sapiens
atctggctccagggttcatgttcttccgacaacatcacaatgccactctcaacccaggagcaaaaccagacaaagtgcctactgcagaccggaagaccctmgtttgaagcctccattagcgtgactatgcagctagaccaacttactgttaagcaacagtaccttttactatgaggtaccctttactattaagtacctttt

SEQ ID NO: 50871 - DNA, 201 bp, Homo sapiens
ggagtggagtgggagaccatctgttaggcgagtgggggaggaagacggtgggggggcggttgggatgggctctgcaggaggtgcagggcaaaacaggaagsatggccaagaccatggtagcaggcaggtgtccttggcaggagaccttcacactgatctgttgtccagtgggagatgctcagataactgggaatgtcagag

SEQ ID NO: 50872 - DNA, 201 bp, Homo sapiens
tgcatgcatacatacatgactatacgcacaatgcacacatgtttatatatgaatgtattcactcatacatgtatggttgtgtgtgtgtgtgtgtgtgtgtkttttgggaagactaattactccaggagatttacatgtagtttcccttcttaagtagatcacaaccctgctctgcatttgctgccattgtttctgttacgt

SEQ ID NO: 50873 - DNA, 201 bp, Homo sapiens
tgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactat

SEQ ID NO: 50874 - DNA, 201 bp, Homo sapiens
atgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgacta

SEQ ID NO: 50875 - DNA, 201 bp, Homo sapiens
ctaggccccagttacctccaaggagaagggatgataaatataacagtgacaaaatactctcatacacacagaaatatatagttacacttaaatgcacacasatatatacatacaaatatagagtgggtgcagtggctcacacctgtaactccagcactttgggaggccgaggtgggtggatcacctgaggtcaggagttca

SEQ ID NO: 50876 - DNA, 201 bp, Homo sapiens
tctgcaccagacataatttacttggaggcttggggagaataagcttccaggtgaggaactcagtggctgagttgcaaagagctggaaatgagagaagcaarcttaatgactatgtacgtgcttcagtttagtgcatatcccactcttgtgtcctaatccagttatttttatttctgctgaactctgtacatcctgaggatg

SEQ ID NO: 50877 - DNA, 201 bp, Homo sapiens
gaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggg

SEQ ID NO: 50878 - DNA, 201 bp, Homo sapiens
tcctcccttccttcctcccttctttcctcccttctttcctgtaggagatactttctcataaggattcatttgagacagagagggtaggagagaagggattkatgatggcataaagcttctgagaaggtgggaaaggatagacttcaaaacataagagggacctgttaactttttaaacctgggagttgaatcaatgaaaaa

SEQ ID NO: 50879 - DNA, 201 bp, Homo sapiens
gtccaaaagacaaaaaggagttgaaattttatcgttgtttttccaggcaaaagaaaatagggtatttgttgactgaagaaatgagatatttctctttggcmgtttgggcggcctaattgataggaagaggtctggtagctgagaatagcagggttagaacaatagaggattccaagatcaaggggaagggtcagaggttca

SEQ ID NO: 50880 - DNA, 201 bp, Homo sapiens
ctcagtcttactgcccagggaacagccatcagcctttgagtggcaagagttggtagattaccatcccttcttgacccttggaataggacaacttcgagatrtgttctcccgagtctcccagatgaccccagtgagtttgaacaccagttgtccacagagataatctgcccattgccacctgtgtattgactcttttacata

SEQ ID NO: 50881 - DNA, 201 bp, Homo sapiens
agtgagacttcatctcaaaaaaaaaaatgtgtttagagtttagatctcaggttaggggatcttgctacacacacacacacacacacacacacacacacacmtgcacacacatacaaatacaaagaaatacaatgaagcttttagaggtgatggatatatttactaccttgattgtggtgatggtatcacaggtatatgcat

SEQ ID NO: 50882 - DNA, 201 bp, Homo sapiens
gcacaaatagcctggccttgaatcctcccagtgtttggttcactctcccctaacttattaaagttgcttctggaagttacatagagacgtgcagttaattyctggaacagtgtgtttgtgcttctcattatgcaaaaaatatacaccttggtcaaaaaggaggtatatttttacacaactatttgttcataggacatgtat

SEQ ID NO: 50883 - DNA, 201 bp, Homo sapiens
gcagatcacgagttcaggagatcgagaccatcctggctaacatggtgaaaccccatctctactaaaaatacaaaaaaattagccgggcgtagtggcagacrcctgtagtcccagctactcaggaggctgaggcaggagaatggcatgaacccgggaggcggagcttgcagtgagccaagattgcaccactgcactccagcc

SEQ ID NO: 50884 - DNA, 201 bp, Homo sapiens
cccagtctctggtatgtctttattagtagcttgagaacggactaatataccagactctacagtttgtaacgtaggcactaggattcacagatcctaggcasctggttctcagattcgctaaactttaccattgttctttgtccgtagcctggaagcttagaatctggaaggatagagaatagagttttatagggactggga

SEQ ID NO: 50885 - DNA, 201 bp, Homo sapiens
ggaggtggaggttgcagtgagctgagactactgcactccagcctggtgacagatgcactccagcctggtgacagagtgagacttcatctcaaaaaaaaaaatgtgtttagagtttagatctcaggttaggggatcttgctacacacacacacacacacacacacacacacacacatgcacacacatacaaatacaaagaaa

SEQ ID NO: 50886 - DNA, 201 bp, Homo sapiens
ctcattaagatgcacaaatagcctggccttgaatcctcccagtgtttggttcactctcccctaacttattaaagttgcttctggaagttacatagagacgygcagttaattcctggaacagtgtgtttgtgcttctcattatgcaaaaaatatacaccttggtcaaaaaggaggtatatttttacacaactatttgttcat

SEQ ID NO: 50887 - DNA, 201 bp, Homo sapiens
gtcccaggtactcaggaggctgaggcaagagaatcgcttgaacccaggaggtggaggttgcagtgagctgagactactgcactccagcctggtgacagatrcactccagcctggtgacagagtgagacttcatctcaaaaaaaaaaatgtgtttagagtttagatctcaggttaggggatcttgctacacacacacacaca

SEQ ID NO: 50888 - DNA, 201 bp, Homo sapiens
ctttaattaatgctcattaagatgcacaaatagcctggccttgaatcctcccagtgtttggttcactctcccctaacttattaaagttgcttctggaagtyacatagagacgtgcagttaattcctggaacagtgtgtttgtgcttctcattatgcaaaaaatatacaccttggtcaaaaaggaggtatatttttacacaa

SEQ ID NO: 50889 - DNA, 201 bp, Homo sapiens
ttggggcagataattatgttgtgggaggccgtcctgtgcttataaaaggatgtttaatgcacctgtggctgtacccattagctaccagcagccctcctccsccagctgcgacaactaaaaatgtctccagaaaaatgttccaagcagggaaaactcccccgccgcaccccagttgagaaccactgatttagatcctgtctg

SEQ ID NO: 50890 - DNA, 201 bp, Homo sapiens
tatagacatttggggcagataattatgttgtgggaggccgtcctgtgcttataaaaggatgtttaatgcacctgtggctgtacccattagctaccagcagycctcctccgccagctgcgacaactaaaaatgtctccagaaaaatgttccaagcagggaaaactcccccgccgcaccccagttgagaaccactgatttaga

SEQ ID NO: 50891 - DNA, 201 bp, Homo sapiens
tcgcggcggcgaagacagatcggggctcggtagggaggtcattccgagcccagagatcctaggcaccccccacacacaggctcccactctggcgtgcgtgygtgtgtgtgtgtgtgtgtgtgtgtgtgtgtgtgtgtgtgtacgttcgttaacgggaggaggagagagctcccagtccttttttgctagcaggggcgacat

SEQ ID NO: 50892 - DNA, 201 bp, Homo sapiens
gaaaaaatcaggtgtagaattaattccaacatagacctaccttcttattgcacagacaaagacactgagatccagagacattgaggggctctcttgggctyccccaccttgtccaggggaaagtcaggactgggatccagcgtatagtcacttgctacggctattcccattatgttttgctgctgctgaaacactggaaca

SEQ ID NO: 50893 - DNA, 201 bp, Homo sapiens
ccagagttagcctgaggtcccaaactatgagcaggagaatgtcaccctaggaatggcaactagaaagtttttaccccggatgccatgatgaggcactgccrtccactggagcttgctgtgattatggaaatgttctctatctgcacatccagtatgataagcactgaccacatctggctgctgaggacttgagatgtggct

SEQ ID NO: 50894 - DNA, 201 bp, Homo sapiens
tctgaatacctcctggcagtttctacgtctttctcagggcttctaaataggaatgaacatgaaagggccgcgtggcagtgaccgcagtgtggaggttctartaatgactatgagggacacacagttttcaaggagatctaacagtgtttatgaaagattctgtttcatctcaccagtgaagagcccttcatcatctaccat

SEQ ID NO: 50895 - DNA, 201 bp, Homo sapiens
gaagccagggtctgtgatacatgacagagtgaccatagcactcaggggtgcagagggtgtgtggattctgatgacagattgcctgtctgattttgcagaaktagctccaacatggttttggtaacacccgttgccctctttaagcttgatgtctctgttttcatgtaatttgcacaaagtaggcactcactaaatatttgt

SEQ ID NO: 50896 - DNA, 201 bp, Homo sapiens
gctagctttggactggggaacagggtgagttgatggtgggaggtgagcagggatcagtccccaaagccacaaaggttttgaagcctgaaagggacatgacrtacattttttaaatctcactctcctgttctgtgagcaacagaatagaggacccggaaactgtagtagggttctgtttctacactagtgctaatgtagaac

SEQ ID NO: 50897 - DNA, 201 bp, Homo sapiens
gaagagcttggcctgaaatcagcagctctcaaattttcgtgggcatcagaatcaccaaggatgtttgtaaatgtttttaaaagtcaattttcaagactccrttaaatggagattttgatatatacaatcagagttaaatatgtgtatatataaaaaatatctttaagctagagtctcttatcagtgagactttgggctcta

SEQ ID NO: 50898 - DNA, 201 bp, Homo sapiens
gcattgagaaagaaaaatatcagttttactaaatgaaatatcaacattggagattttataagccgagaatgttagtacatcaacattagaagccctaaaarataaaattgcattcaaaggccaaaaaagtcttaggcttgctagctctccaggaaaggcctgtgtgttcaggacaggaggactaaggaccaaacaggtttg

SEQ ID NO: 50899 - DNA, 201 bp, Homo sapiens
ggaggggctctgaactgaacttcagaaagatacctcagcctgtggtctttctcttttcatagctcaaccaagctctagactgcaggggggatatagtaagrttatttagattgattctacttaaaagatgctagtttggataaaatgaagccattagttatgatggcaacccaatcaagccagtttaacaccccttatctc

SEQ ID NO: 50900 - DNA, 201 bp, Homo sapiens
atctttgaaatggatagcctcttgttctgcagaaaagcaaggatcctagaaaaaacatgcaaactgcatttcaaggaggatggcatcatctttttgtttcycttggaatgactcaggagtgaggaaacaggaatacattactgtggttcccactcatcttggcctaccaatctctcccatctttctaggtacagcccatct

SEQ ID NO: 50901 - DNA, 201 bp, Homo sapiens
caggtagaccagggcaaggatgttcaggcagaggaaatgggataaacaaaggcatggtggccaagagagctagatccgttcactcaacacacaggcaggaytgcaacgggtcttgtgtatcctgtggatctaatctatccttaggcgtcagtctgggaaacatgagttccgtcttctccactaatctgggaaggagggtca

SEQ ID NO: 50902 - DNA, 201 bp, Homo sapiens
tgcttccatttgagaaccactgttagagagaagtgtcatagtccattttgtactgctgtaacaaaatatcggagcctgggtatttataaagaagagaatcrtattggctgtcatttctagaggatggacaatccaaggtcaagacaccagtaggtttggtgtcttgtaaggccattctcttcttgcaatatggtgcctggc

SEQ ID NO: 50903 - DNA, 201 bp, Homo sapiens
gaacagttggccctttgattggctcaaactccgagactggcacgagagtaggtgacagtctgtttacacctccattcagattatagttcactatgtacagrgaaacctttaggcggaacttagcatatttaagaaggcagctttaggctaacttgattttacaaactgttatcagtaattttaatgcactataaccagcaa

SEQ ID NO: 50904 - DNA, 201 bp, Homo sapiens
ctacttgggaggctgaggcaggagaattgcttgaacccaggagacggaggttgtagtgagccaagattgcaccactaccctccagcctggatgacagagcragatactatctccaaaaaaaaaagaaaagaaagtgaggcaaatgaagacttgtagtgattgctttactataatcccctaatctcccctgacttcttcccc

SEQ ID NO: 50905 - DNA, 201 bp, Homo sapiens
tgtgaattgtaggaggcttagcagcaccaatggcctctacccactagatgccagtaccaccaccccccacccacacacacacctaatctggacaatcagawatgtctgctgatattgccagttgtcctataaggggcaaaattgcttccatttgagaaccactgttagagagaagtgtcatagtccattttgtactgctgt

SEQ ID NO: 50906 - DNA, 201 bp, Homo sapiens
tatcagactatttttaaaaatcagcaaactggatgctacatacaatagacacactttaaataaaagaacaaagaatggaaataaaagaaaaatataccttkatagtacagtctctcctaaaaacacatgaaagtattttttaaaacaagcttgtccaacccacagcctgtgggccatatgtggcccagaatggctttgaat

SEQ ID NO: 50907 - DNA, 201 bp, Homo sapiens
accacattcactgaccttcaagtcataatgcgaggctcagccatctatctcactgtggtccccgctgcagctggcttcatttattgacttcttgaaagtgscaatatccatgctcagcttggtctgagctggactcagagacccaggtgccagagcaaaggccatggtgtgtcggttaatcacccaataaaaataaactct

SEQ ID NO: 50908 - DNA, 201 bp, Homo sapiens
gtcaggagttcaagacccgtctggccaacatgtctggccaacatggtgaaaccccgtctctactaaaaatacaaaaattagccaggggtagtggtgcacayctgtagtcccagctacttgggaggctgaggcaggagaattgcttgaacccaggagacggaggttgtagtgagccaagattgcaccactaccctccagcct

SEQ ID NO: 50909 - DNA, 201 bp, Homo sapiens
ggcaaggtttttcaacagtggcactattgaaatttgaggctgggtgattctttgttatggggggctgtcctgtgaattgtaggaggcttagcagcaccaayggcctctacccactagatgccagtaccaccaccccccacccacacacacacctaatctggacaatcagaaatgtctgctgatattgccagttgtcctata

SEQ ID NO: 50910 - DNA, 201 bp, Homo sapiens
gtttgactaatccaaaataagaaaggagggggaacaacattaaaaagatggccaaatagaacaacaaggtgatacagtaagtatatacctaattataccayagtaaaatgcaaaatgtaaacagattaaatatttcaagtaatattatcagactatttttaaaaatcagcaaactggatgctacatacaatagacacactt

SEQ ID NO: 50911 - DNA, 201 bp, Homo sapiens
aggatgccactggagagggaggtcccgtcatcacctaagctaagcacagctgcctctaagtacctccttgcttggcagctggccagaccacattcactgascttcaagtcataatgcgaggctcagccatctatctcactgtggtccccgctgcagctggcttcatttattgacttcttgaaagtgccaatatccatgctc

SEQ ID NO: 50912 - DNA, 201 bp, Homo sapiens
gggaggccgaagcaggtggattagttgaggtcaggagttcaagacccgtctggccaacatgtctggccaacatggtgaaaccccgtctctactaaaaatamaaaaattagccaggggtagtggtgcacacctgtagtcccagctacttgggaggctgaggcaggagaattgcttgaacccaggagacggaggttgtagtga

SEQ ID NO: 50913 - DNA, 201 bp, Homo sapiens
gtctctggtatgtctttatcagcagcatgaaaatggactaatacatcatcctatctgactaatacaggagagggaaaaactcatagcaccatatgtcatcyggagcctctccaatcttttttttaataatgcccaatttacagttttataaaaattacttgacctgtaaagaagcaagaatgtgtaagtgatgaacaagag

SEQ ID NO: 50914 - DNA, 201 bp, Homo sapiens
ctctatagacggttgtctattaggatgccactggagagggaggtcccgtcatcacctaagctaagcacagctgcctctaagtacctccttgcttggcagcyggccagaccacattcactgaccttcaagtcataatgcgaggctcagccatctatctcactgtggtccccgctgcagctggcttcatttattgacttcttg

SEQ ID NO: 50915 - DNA, 201 bp, Homo sapiens
agacgacaaaagcgtccttttgctcatggccacatgccttgcagcacaagctcctctcaaatacttcccaggacctcaccgtaagggacagtcaaccagaygtgtgcttccacatgttcttcaaatgtgtttttcatttgcttgggttcaacctcattataatggcattagccagaggaggtagcatggtggttcaggttt

SEQ ID NO: 50916 - DNA, 201 bp, Homo sapiens
ttaaattgcccagtctctggtatgtctttatcagcagcatgaaaatggactaatacatcatcctatctgactaatacaggagagggaaaaactcatagcascatatgtcatctggagcctctccaatcttttttttaataatgcccaatttacagttttataaaaattacttgacctgtaaagaagcaagaatgtgtaagt

SEQ ID NO: 50917 - DNA, 201 bp, Homo sapiens
agggcaccagaaggcatgagctccatgtttcccagccaaggctcttccagccagcagtgctgatgggaagaacaggcaagccagagtgccttatcaagtgyaagactcaccacccatagaggatccacccaaagccaccgggagaaccaacacatccctgcagacgacaaaagcgtccttttgctcatggccacatgcctt

SEQ ID NO: 50918 - DNA, 201 bp, Homo sapiens
ggattgtactacacctgattagacttgtacttggaaaggaccccagccctcactagtagggacatgctatgtaagtcttctttgtcctctactctggtctmccccattgctacctttcttagccagggttcttggtggcagtcaacaaaatcacctccaactagtttacaaaggaagagatttattaaagagtacaggtag

SEQ ID NO: 50919 - DNA, 201 bp, Homo sapiens
gtgctacaggaaatacccacatatgaaactattctagggcaaggtttttcaacagtggcactattgaaatttgaggctgggtgattctttgttatgggggsctgtcctgtgaattgtaggaggcttagcagcaccaatggcctctacccactagatgccagtaccaccaccccccacccacacacacacctaatctggaca

SEQ ID NO: 50920 - DNA, 201 bp, Homo sapiens
atctctttctccttgaattcctccattctattttataactttcttaggccattattacctccttctttgtcttagccatttccattttgctttatccaaayatttccaaacaccaggcaccttcatctcctgtaacctatctgctctctgtgtactgtcattcactgaatgcttttaagttgactttaatttgacttgtct

SEQ ID NO: 50921 - DNA, 201 bp, Homo sapiens
aaagagggaaaagtcatttcaaaaagaaaacctttttttttctctgggtgcattttctgattctaggtgagagtcaggcttggcccatgcagagagcctargatggagggaaagaaattagaaacgagtgtcagaatcacagggagcttttgtgacaaactggaaacttgaggggctgcttttcctctgtggacaaatgcc

SEQ ID NO: 50922 - DNA, 201 bp, Homo sapiens
gtgaagatacgcatcccaagggcaggaagctccccaccttgatcactgcaaactccccagtccctaacagagtactgggaagatagaaggtggtcaaagcrtatgtatggaatgaacactggaaatcagtacacagggctgggaatgtgtgattctgagcactccgtgatggaaataaccctccagctccttcacagaaca

SEQ ID NO: 50923 - DNA, 201 bp, Homo sapiens
agtctgcatgaagagagaacagattgggaatcagaggtacttgagttcagattccagctccattgctcattagctctgtggcatggggaaatcagtgaacyctttactgctgagttatttgtaaaatgactgtgattgctgactgattatgtcaggctatacaatcatttctttggttgcaagccatggaaaccaaacctt

SEQ ID NO: 50924 - DNA, 201 bp, Homo sapiens
agtgtccccactgtgaaactagaaaaatctagttaaattataaaaatcagataatataaaaaaatcttaattgtaaaggaatcagggagctgcagaagcaktgacaactagataaactaaaataccaaagagggaaaagtcatttcaaaaagaaaacctttttttttctctgggtgcattttctgattctaggtgagagtc

SEQ ID NO: 50925 - DNA, 201 bp, Homo sapiens
atttattctttagaatacctattaattcagaagtgttctgaatggcgtcatgaaatactatgttagtgccagctcacatcctttgctgagagagttaaacrtatttgtctcaaatcagcacagccttctacagctaaggcaggtgtactggctgctccaattgagaacaaacaaggcaccagggcctttgcatgtacccca

SEQ ID NO: 50926 - DNA, 201 bp, Homo sapiens
ctgtaatcccagctacttgagagactgaggcaggagaatcgcttgaacccgggaggtggaggttgcagcgagccaagatcacaccactgttctccagcctkggcgacagagcaagactctgtctcaaaaaaagaaccaccctcttaaccgttatgctttattcgtcctactatacacagcttgggcagtgtgcctacacta

SEQ ID NO: 50927 - DNA, 201 bp, Homo sapiens
tatcaactatatggaaaatgatggaacttattctagaccaggatttcttaaaagtggcaatactgacatttgaggccagataattctttgttgtgaggggytttcctctgcactgtagaatgattattagcagtatctctggcctctgtctacccactggatgccagtagaaccctcagttgtgacaactaaaaatgtctc

SEQ ID NO: 50928 - DNA, 201 bp, Homo sapiens
attgtatcaactatatggaaaatgatggaacttattctagaccaggatttcttaaaagtggcaatactgacatttgaggccagataattctttgttgtgakgggctttcctctgcactgtagaatgattattagcagtatctctggcctctgtctacccactggatgccagtagaaccctcagttgtgacaactaaaaatg

SEQ ID NO: 50929 - DNA, 201 bp, Homo sapiens
aggctggtcgcgaactcctgagctcaggcaatccgcccaccttggcctcccaaagtgctaggattacaggtgtgagccaccgcccgcctttttttttttttgagacggagtcttgcgctgtcgcccaggcaggagagcaatggcgcaatctcggctctcttcaacctctgcctccccggttcacctgattctcctgcctca

SEQ ID NO: 50930 - DNA, 201 bp, Homo sapiens
tcttgaataaattaaggatatatacctttggcaggaatatcacagaagtattgctgtgttctcagtgcattgcatcaattggcacaagatttcattttatmccagtattgatgttgttaactttaatcacttaagatggtgtctgtaaagcttctcctctataaagttactcttttcccctttgtaattaataagtgtttt

SEQ ID NO: 50931 - DNA, 201 bp, Homo sapiens
gcagagctggacctgttactcccagttgcttgccctgaggctgtcctaggtagttgatagctgagttgactttttttctcattaaacatatttttttttttggctgggtgctgtggctcatgcctgtaatcccagcactttgggaggccgagaggggcggactgcttgaggccaggagtttgagaccagcctggccaacat

SEQ ID NO: 50932 - DNA, 201 bp, Homo sapiens
tttcagaatctggctaactccaggatgtgttgcttaggatgcctggtgtgcaggagtatatacaacagcctattctcaatggtctgcgggataaggcttcmtatgtcaggagagtggcagtccttggatgtgccaagatgcataatcttcatggagactctgaagtaggtaagttcagtgtaatccatcatggtcaatgtg

SEQ ID NO: 50933 - DNA, 201 bp, Homo sapiens
ggggaaagaattcctaatgctccttatgtgttagaggactttgttgagaatgtgaagtcggaaacatttccagctgttaagatggagctgctcactgcttygctgcgccttttcctctcccgacctgctgagtgccaggacatgctaggacgtttgttgtattactgcataggtgggtttttcagaaggaaatagtatttg

SEQ ID NO: 50934 - DNA, 201 bp, Homo sapiens; identical to SEQ ID NO: 10502

SEQ ID NO: 50935 - DNA, 201 bp, Homo sapiens
tctgtatttttatggttcagttaaatggtgaatgtttaattaggtactaagagaaataaaattgaagtgctgccaattcaaagtgtagcaaggggccgggygtggtggctcacgcttgcaatcacagcactttgggaggctgaggcgggtggatcacaagttgaggagtttgagaccagccggccaacatggtgaaacccc

SEQ ID NO: 50936 - DNA, 201 bp, Homo sapiens
tgccaagatgcataatcttcatggagactctgaagtaggtaagttcagtgtaatccatcatggtcaatgtgcctccattatgtataactttaaaaaagatkgtgtggctttggtagaaaataataatgtggccccagttctgtacatatctctttaagtaggatgcagggcttggtatcttctggagatgagaagtccttt

SEQ ID NO: 50937 - DNA, 201 bp, Homo sapiens
gactaagcaactgaataaataataatactaaagtgatcccaactattggagcttttagaagactatgttctacttggttgcttttctataatgtaagaggmatacatagaatatgaaattgttgcttttggaaaatatacttttaagattatctcaatgaagaactgatttctcctgtagcctggttttactaatttataa

SEQ ID NO: 50938 - DNA, 201 bp, Homo sapiens
gacggagtcttgcgctgtcgcccaggcaggagagcaatggcgcaatctcggctctcttcaacctctgcctccccggttcacctgattctcctgcctcagcytcctgagtagctgggattacaggtgcataccaccacacccagctaattttttgtatttttagtagagacggggtttcactatgttggccagactggtctt

SEQ ID NO: 50939 - DNA, 201 bp, Homo sapiens
actatttttgagacagtctttctctgttgcctaggctggagtgtagtggctcaatgatagctcactctagcctcaatctcataggcttaagtgatcctccmacctcagcctcataagtagttgggactacaggcatgtgctaccatgcctagctactttttaaaatttttcatagagacagggtctcaatatgttgcccag

SEQ ID NO: 50940 - DNA, 201 bp, Homo sapiens
gtttcagcatgttggccaggctggtcttgaactcctgacctcaggtgatctcccagtctcagcctcccaaagtgctgggattacaggcatgagccactgcscccggcctttactttagagtctcccagacatttcctagtcattcaagcaatacctttacaatttaaccagctggactatcacatacttaatatttttctt

SEQ ID NO: 50941 - DNA, 201 bp, Homo sapiens
gaggggtctgcggtcagtcggacgcggcgctggaaatccggcggaggacctagaagtagcgggagcgatctgtgggcggggcgaacggcctgccggccgayggtagggcctgaagagcctagggtggggctcgcggtgtcgcggagggcgtggaagtgtgtcagggccagcgtgccggccctacggaagccgagcctgagg

SEQ ID NO: 50942 - DNA, 201 bp, Homo sapiens
gagagctgaagagttggagctattcacgagactgaacatcacttccttgttgactgattgggtgattgattcctgggaattcaaacaaacaaataaaaaarcacttttttcattttatcagaactgaacttagctgaataagttattttttactgattgttaaagttgggagcagctgccagaggcctgcagagttggttt

SEQ ID NO: 50943 - DNA, 201 bp, Homo sapiens
aggagaccagtctgagaaacaataaagtccaaacttatcacagcacccaaggaacaagctgttaattcaactacctacagactcttaaaaaaatgtgtgcygctcctgctcatgtctacttacctcatagcatgtatctttaccttgctattacatctgcctagtgagctcctgctcattcagctaaagtattacttcctc

SEQ ID NO: 50944 - DNA, 201 bp, Homo sapiens
cttgggaggcggaggctgcagtgagccgagattgtgccactgcactccagcccaggtggcggagtgagactccatctcaaaaaaaaaaaaaaaaaaaaaargcgtagcaagggaacaggatgcaggtggtagaaattgagtaaacttattgactttttaaaattaaagactataactgaaatgttgatctaaagaaaatta

SEQ ID NO: 50945 - DNA, 201 bp, Homo sapiens
tttcacacgtggcagttatatggttcggtcttcgtcctgctgctttggagtaccatgtcagtctcccctctgcagcatcttttactcagctgggtagtttsctccatatcacgggcttgagcaattactggtgactcttggatctataatatagctagtacagacttccttttttagcttcagacccacgtatcccactgc

SEQ ID NO: 50946 - DNA, 201 bp, Homo sapiens
aattagctttcacacgtggcagttatatggttcggtcttcgtcctgctgctttggagtaccatgtcagtctcccctctgcagcatcttttactcagctggrtagtttcctccatatcacgggcttgagcaattactggtgactcttggatctataatatagctagtacagacttccttttttagcttcagacccacgtatc

SEQ ID NO: 50947 - DNA, 201 bp, Homo sapiens
tggctaatttttgtatttttaatagagacgggtttcaccatattggccaggctggtctcgaactcctgacctcaggtgatccaccctcctcggcctcccaragtgctgggattacagacgtaagccaccgtgcccggctgacagatacatttttaagaagcttcacagatgactctgatgtgcactctaggttagtaacca

SEQ ID NO: 50948 - DNA, 201 bp, Homo sapiens
tgcttagaacagtctggacatggcagttttttttttgccttgcactttagtgtggcctttgtcatttttgtagcagagaagttcaactttgtctacctggmgctattactctggctacatccttgttactctgaagctttccttctttatctaagaactttgttcttttttatagatggtgccctggtaaatgaattatac

SEQ ID NO: 50949 - DNA, 201 bp, Homo sapiens
atggtactattttaaggaagccttcccagtcccctaggtttgtttccctattaaactgatcaaaggcttgattccctgttacacttcactgatcaaagtgmactgatctcaatagcacaaataacaatgcgattactcatttaatatctgtcatttctgctgaagtgtaagcttcatgagcacagtaactgtgcctgtatc

SEQ ID NO: 50950 - DNA, 201 bp, Homo sapiens
taaataaataatttgacttgaacttgttttaataaaaaaaaatatattttgaaacagccctaaactcagggaaaggttgcaaggatagtacaaataatttmtctcttgaatcatttgacagtaaggagttgacatatttcatcaacccctaatacttttatacttccctcaaacaagaacattctgtaatgtaaccacaat

SEQ ID NO: 50951 - DNA, 201 bp, Homo sapiens
ttgctttactggattcctgcacctgcagcctcctgcactttttgagtgatactctgttgatgtttcctttgtctttcctcagacaggagctatactccagracactgtggaatctctcagcaagacctggtgtgctcaggattccagcttagcttatgagagagcttttctggcagtgtcagtgaaacttcttgagtacat

SEQ ID NO: 50952 - DNA, 201 bp, Homo sapiens
gcactcttcgaattgattgccaccttagattctcttttggatatagatggcatataaattataaaaacaagatttatccgacgggttttattacaaaactstgataccattgttctcttgaacagttctgttttgttttgttttgctttgcttgagatagagttgcccaggctggagtgcagtggcgtgatctcggcccac

SEQ ID NO: 50953 - DNA, 201 bp, Homo sapiens
ttaacacctcgtctatctttcagtgttcagctcactcataagctccttcaggaagtttcctttaaccctcactgccttcattaggggcctccctcaagctrtcaaagtagccagagcatacctctagcagtagtattgtaattgttttcttgttgcttgtcctcaatttttattctgttcttatctgaccacattttgtac

SEQ ID NO: 50954 - DNA, 201 bp, Homo sapiens
cctcaagctatcaaagtagccagagcatacctctagcagtagtattgtaattgttttcttgttgcttgtcctcaatttttattctgttcttatctgaccasattttgtacattgaagcaacttatggcaagaacaaatctaataaaatgatggtaaaatataaatagcgaatccagaatgggaaaaattaaaataccagtt

SEQ ID NO: 50955 - DNA, 201 bp, Homo sapiens
tactaagatatgtgcaagatcctatgagaagttagtaatgggtttcacatgactttcttaacagtattcttcaacgaaagcagagagcatgactttaatayagagcttagactgggtgcagttgctcacacctgtaacccagcactttcggaggccagggagggaggattgcttgatgccaggagttcaagatcagcctgg

SEQ ID NO: 50956 - DNA, 201 bp, Homo sapiens
agttgctcacacctgtaacccagcactttcggaggccagggagggaggattgcttgatgccaggagttcaagatcagcctgggcagcatagtgagaccctrtctgtaaaaaaattgacttagccaggcatggtggcacatgcctgaaatcccagctgctcaagaggctaaggcaggaggattgcttgagcccaggagtttg

SEQ ID NO: 50957 - DNA, 201 bp, Homo sapiens
ccctggtaaatgaattatacagtttgctgcgtgaccaggatccaattgtagttgtgaactgcttgaggtctctagaggaaattctgaaacaggaaggaggygttgtcatcaataagcccattgctcaccatctcttaaatcggtttggatgcctcagcactctttttattatgagatctgctaccttgtgggatcttgttg

SEQ ID NO: 50958 - DNA, 201 bp, Homo sapiens
atactaaagtgatcccaactattggagcttttagaagactatgttctacttggttgcttttctataatgtaagaggcatacatagaatatgaaattgttgyttttggaaaatatacttttaagattatctcaatgaagaactgatttctcctgtagcctggttttactaatttataagcaaaatgactaaagctcaggtat

SEQ ID NO: 50959 - DNA, 201 bp, Homo sapiens
gtatcaactatatggaaaatgatggaacttattctagaccaggatttcttaaaagtggcaatactgacatttgaggccagataattctttgttgtgagggrctttcctctgcactgtagaatgattattagcagtatctctggcctctgtctacccactggatgccagtagaaccctcagttgtgacaactaaaaatgtct

SEQ ID NO: 50960 - DNA, 201 bp, Homo sapiens
attgactgctgactactgtaaagctaatcttcatttcctacacataatcatctataaagtatattcatgatagagttctaatttcagcctggcttcactcsgttcctttgtaaatttctgggtctttttttcctaacttctctatgtgtgtgttagggaagtcagaatcaccttaatagtatctaagaaaaaacagtcttt

SEQ ID NO: 50961 - DNA, 201 bp, Homo sapiens
agatgtttatattttacaatccatgaaggtagtctatactgtgctcttagaacagcagccatctaatgtcattcttagttgacaggtaaacagtatgttaygtatgtaatgaggttccacaaagacaatagtgttttggaacactgcagaggcaataatttgcatattaccatcattttatagttatgaatcagtgactgt

SEQ ID NO: 50962 - DNA, 201 bp, Homo sapiens
acaactgacttactgtttatgcttgaatctttttttgttttttttttttttggagacagagtcttgctctgtcacccaggctggagtgcagtggcgtaatmtcgactcatcgcaacctccgcctcccaggttcaagcgattctcatgcctcagcctccttagtagctgggattacaggcatgcaccaccacgcccagttca

SEQ ID NO: 50963 - DNA, 201 bp, Homo sapiens
gattatggcaaataaattccataaacagaagttgaacgctggtccactgtaacttcaaaaccttccttcaaattataccatgtgcaggacctaagaagtcraggaagtatttcttaataaaattactccagaggctcttcctgaactctatttcagttctaggttggctacctaacgataaaagttaagcattaattttat

SEQ ID NO: 50964 - DNA, 201 bp, Homo sapiens
ctggtgtttttatggaaatggtgaaggccagtgccactgtagatattgtccagaagaagttggtttatctgtacatgtgcacatatgctcccctgaaaccrgatctggctctcctggccatcaatacgctgtgcaaagactgctcagaccccaatccaatggtgcgagggctggcgttacggagcatgtgtagcctcaggt

SEQ ID NO: 50965 - DNA, 201 bp, Homo sapiens
ggaaactttctgactattggtgttgacagaacatttaagctcttgggagatcatgatatgaaaattatttaaaagacaagacaaatttttctcattgcccrgattcctgggacttgccattgcttcaagcattgtaacaaatgtgttccctctgtcataggagagccttgttcttttgatgtggctatcattgctggtcgc

SEQ ID NO: 50966 - DNA, 201 bp, Homo sapiens
tttaagaattctccctttgctatgatgaacaaccacctggtcatatggcagtggcatggaaatggtcctaattttgttgctaaaatagctcttttgttttsttttttggatagaatgtcaaaactggaccaatggggccaggctgaagtattgaactttctgctacgctaccaaccccgcagtgaggaagaactatttgac

SEQ ID NO: 50967 - DNA, 201 bp, Homo sapiens
cacggatgtgtctgcggactttgcacaggctgccatctttgccataggtaggtgtctgctccttttccttcttgagaacctagaccagccagcaagaaaaytgtggttagaggaaccatagagagcaaagggcatgaatcttgcttcagaagcaaagtactatgcactaaataattgggtcagtgactacaaacacggggg

SEQ ID NO: 50968 - DNA, 201 bp, Homo sapiens
ggcgacagagactcggtctcaaaaaaaaaaaaacagtatattttatttatttcctttaagtttcaaaaggcaaactctaagctttcagtaacacctaaagygaaagaggttctcaatgaagggaaactttctgactattggtgttgacagaacatttaagctcttgggagatcatgatatgaaaattatttaaaagacaag

SEQ ID NO: 50969 - DNA, 201 bp, Homo sapiens
cctgggaggcggaggttgcagtgagctgagatcacgccactgcactccagtctgggcgacagagactcggtctcaaaaaaaaaaaaacagtatattttatktatttcctttaagtttcaaaaggcaaactctaagctttcagtaacacctaaagcgaaagaggttctcaatgaagggaaactttctgactattggtgttga

SEQ ID NO: 50970 - DNA, 201 bp, Homo sapiens
tggtggcacacaactgtaatcctagctacctgggaggctgagacaggagaattgcttgacagggagggggagtttgcagtgagccgagatggtgccattgyactccaatctgggcgacagagcaagactctgtctccaaaaaaaaaacataaataaataaataaataatttgacttgaacttgttttaataaaaaaaaata

SEQ ID NO: 50971 - DNA, 201 bp, Homo sapiens
ttggacttttggaggatccggcagaaagacctgtgaatagctgggcctcagacttcaacacactggtgccagtgtatggcaaagcccactgggcaactatytctaaatgccagggggcagagcgttgtgacccagagcttcctaaaacttcatcctttgccgcatcaggtaaaaacagtccttaccttaaatcttgtcatg

SEQ ID NO: 50972 - DNA, 201 bp, Homo sapiens; identical to SEQ ID NO: 10532

SEQ ID NO: 50973 - DNA, 201 bp, Homo sapiens
gagatagttagccataagttgaggagatattttaatccagccaaggaaactattcctacctttataagtaagctaggccgatgtttcccaaacttgccttttttttttttttttttttttttttgagacggagtctcgctctgttgcccaggctggagtgcagtggcgcaatctcggctcactgcagcctccgcctcccgg

SEQ ID NO: 50974 - DNA, 201 bp, Homo sapiens
actgatttggaagttgtttgaacccaaaaatgcatctttaacccagaataggaacgtgttttcgaagtgaccaacttgagatagttagccataagttgagragatattttaatccagccaaggaaactattcctacctttataagtaagctaggccgatgtttcccaaacttgcctttttttttttttttttttttttttt

SEQ ID NO: 50975 - DNA, 201 bp, Homo sapiens
cttcttgtctcacatgcactcggaccacaccgtgggcctgtctagcacctgggcccggcccctctactgctccccaattacagcccacctcttgcatcgtyacctacaggtatggggctggagtcggtctccgagagctggtccaggcatctgggttgggacttcaacctgtcattcttggagtcatagaatgggggccac

SEQ ID NO: 50976 - DNA, 201 bp, Homo sapiens
gtggacttctggagcctgcgccgggctggcaccgcacgtctcttcttcttgtctcacatgcactcggaccacaccgtgggcctgtctagcacctgggccckgcccctctactgctccccaattacagcccacctcttgcatcgtcacctacaggtatggggctggagtcggtctccgagagctggtccaggcatctgggtt

SEQ ID NO: 50977 - DNA, 201 bp, Homo sapiens
tttggaatagtttatgaaaatacatttttgttttataaaataaataaatgtaatagatttggttctaaattacttttttggttgtttccaaatttgtgagyctacaaaaggacaaagacttgccaccattataaatatttgaaaaggacatgtctcaactctgaaaggagtttcaaaatgagactaaacaaaggcattgaa

SEQ ID NO: 50978 - DNA, 201 bp, Homo sapiens; identical to SEQ ID NO: 10535

SEQ ID NO: 50979 - DNA, 201 bp, Homo sapiens
cacattgaccatgatggattacactgaacttacctacttcagagtctccatgaagattatgcatcttggcacatccaaggactgccactctcctgacatakgaagccttatcccgcagaccattgagaataggctgttgtatatactcctgcacaccaggcatcctaagcaacacatcctggagttagccagattctgaaa

SEQ ID NO: 50980 - DNA, 201 bp, Homo sapiens
tcctggttctgtcatgtttctctttgaaggatattttggaaccatcctctacacaggtgggcctctcaaggaatcccagtgacttctccagactagatgtwttttttttttttttttttttttttttttaatgtatagactggggcctcgcagtgttgccgaggctggtctcaaactcctgacctcaagcaatcctcccgc

SEQ ID NO: 50981 - DNA, 201 bp, Homo sapiens; identical to SEQ ID NO: 10530

SEQ ID NO: 50982 - DNA, 201 bp, Homo sapiens; identical to SEQ ID NO: 10531

SEQ ID NO: 50983 - DNA, 201 bp, Homo sapiens
tatgcactcatcaccttgcaatatattctataatttatgtatttattggactttttattgtctgattccccctgctagaatgtgaattccactatggcagkctctgttttattatgggtgtatcacaaatgcctacactaatgcctgacacagaagcattcaatatgaatgaatgaaatttatcagaacatagatatttaa

SEQ ID NO: 50984 - DNA, 201 bp, Homo sapiens
tggatgacagagcaagaccctgtctcaataaatgaatgaatgaatgaaataagtaaaactgcaacctgcccaccatccccattcccaactcctgatcatcyataccaattcatttttttcatttttttatagcactcatatactatatatatttttaaatatgctattgcttacttgttgtctatcatgcacttcctctgg

SEQ ID NO: 50985 - DNA, 201 bp, Homo sapiens
aatttaaattatttttagaatctaaagatgatcctatagatgtatgaagatattgcaattaggcttgaaggtgctgggaaaaaggaggttccctagagatmcattagttatttaatggatgatctgtgggagaacttgtacttttccacaaggtgactgacaatggcttaagtccccttacagaaaaaaaatctgcctggc

SEQ ID NO: 50986 - DNA, 201 bp, Homo sapiens
caacaagatcccacaaggtagcagatctcataataaaaagagtgctgaggcatccaaaccgatttaagagatggtgagcaatgggcttattgatgacaacrcctccttcctgtttcagaatttcctctagagacctcaagcagttcacaactacaattggatcctggtcacgcagcaaactgtataattcatttaccaggg

SEQ ID NO: 50987 - DNA, 201 bp, Homo sapiens
gacaacagagcaagactccgtctcaaaaaaaaaaaaaagtcaaaaaacaacagacgctggtgaggctgcagagaaaagggaacgcttatacactgttggtrggaatgtaaattagttcatccactgtggaaaagagaactactatttgacccagcaatcccattctgggcatatattcaaaggaaaataaatcatcctact

SEQ ID NO: 50988 - DNA, 201 bp, Homo sapiens
agccaaggaaactattcctacctttataagtaagctaggccgatgtttcccaaacttgccttttttttttttttttttttttttttgagacggagtctcgytctgttgcccaggctggagtgcagtggcgcaatctcggctcactgcagcctccgcctcccgggttcaagcgattctcctgtctcggcctcctgagtagct

SEQ ID NO: 50989 - DNA, 201 bp, Homo sapiens
tcccgactccgaccttaggatgcccttcccccaacctctcactctccaggcgcagctgcgcggctccctctggtggagctgcggcgggcaatcggaaatckgctactttggcctgtctcctccctgcagcgcgcgctttgagtgcccggctcggcctccgctcccgcgcggttgggagtgtccagcgccctccgcgatttg

SEQ ID NO: 50990 - DNA, 201 bp, Homo sapiens
cggggaggtaacggagaggagtcagtggtcactgggatgactaactgttttctcaggtatctaagcaatggatccaagccctggaggttggtgagagccaygtattacccctagatgaaattggacaagagaccatgaccgtaaccctcctcgatgccaatcactgtcctggttctgtcatgtttctctttgaaggatatt

SEQ ID NO: 50991 - DNA, 201 bp, Homo sapiens
ggcctctcaaggaatcccagtgacttctccagactagatgttttttttttttttttttttttttttttttaatgtatagactggggcctcgcagtgttgcygaggctggtctcaaactcctgacctcaagcaatcctcccgcttcagcctccacagtagctaggattattggcacaagccaccacacctggcagacttttc

SEQ ID NO: 50992 - DNA, 201 bp, Homo sapiens; identical to SEQ ID NO: 10538

SEQ ID NO: 50993 - DNA, 201 bp, Homo sapiens
acctgaggctacacatgctccgtaacgccagccctcgcaccattggattggggtctgagcagtctttgcacagcgtattgatggccaggagagccagatcyggtttcaggggagcatatgtgcacatgtacagataaaccaacttcttctggacaatatctacagtggcactggccttcaccatttccataaaaacaccag

SEQ ID NO: 50994 - DNA, 201 bp, Homo sapiens
gtcaaatagttcttcctcactgcggggttggtagcgtagcagaaagttcaatacttcagcctggccccattggtccagttttgacattctatccaaaaaasaaaacaaaagagctattttagcaacaaaattaggaccatttccatgccactgccatatgaccaggtggttgttcatcatagcaaagggagaattcttaaa

SEQ ID NO: 50995 - DNA, 201 bp, Homo sapiens
gatgtttcccaaacttgccttttttttttttttttttttttttttgagacggagtctcgctctgttgcccaggctggagtgcagtggcgcaatctcggctyactgcagcctccgcctcccgggttcaagcgattctcctgtctcggcctcctgagtagctgagattacaggcgcacgccaccacgcccagctaattttttg

SEQ ID NO: 50996 - DNA, 201 bp, Homo sapiens
tctgtcatgtttctctttgaaggatattttggaaccatcctctacacaggtgggcctctcaaggaatcccagtgacttctccagactagatgttttttttwtttttttttttttttttttttaatgtatagactggggcctcgcagtgttgccgaggctggtctcaaactcctgacctcaagcaatcctcccgcttcagcc

SEQ ID NO: 50997 - DNA, 201 bp, Homo sapiens
actagatgttttttttttttttttttttttttttttttaatgtatagactggggcctcgcagtgttgccgaggctggtctcaaactcctgacctcaagcartcctcccgcttcagcctccacagtagctaggattattggcacaagccaccacacctggcagacttttcttgagcagccttaactcaatagaagtctggag

SEQ ID NO: 50998 - DNA, 201 bp, Homo sapiens
ttcccactgtttttttttccttcttctttttgagacggagtttcactcttgtcacccaggctggagtgcagtggcgtgattgtggctcactgcaacctccrccttctgggttcaagtgattctcttgcctcagcctcccaagtagctgggatgacaggcgcctgccaccacgcccagctaattttcgtatttactattagt

SEQ ID NO: 50999 - DNA, 201 bp, Homo sapiens; identical to SEQ ID NO: 10539

SEQ ID NO: 51000 - DNA, 201 bp, Homo sapiens
gatacgtgggtctgaagctaaaaaaggaagtctgtactagctatattatagatccaagagtcaccagtaattgctcaagcccgtgatatggaggaaactayccagctgagtaaaagatgctgcagaggggagactgacatggtactccaaagcagcaggacgaagaccgaaccatataactgccacgtgtgaaagctaatt

SEQ ID NO: 51001 - DNA, 201 bp, Homo sapiens; identical to SEQ ID NO: 10540

SEQ ID NO: 51002 - DNA, 201 bp, Homo sapiens; identical to SEQ ID NO: 10541

SEQ ID NO: 51003 - DNA, 201 bp, Homo sapiens; identical to SEQ ID NO: 10542

SEQ ID NO: 51004 - DNA, 201 bp, Homo sapiens
ctattgctattggtggtggtgatagtggtgttatgtaataacctccagaccctgggtcaggccccaggctcacttctgggggagtagtggggactatggtrccttctgtgccttcaaggtgctctcaggctggtggggaagggagacaggcaaatagttttggggtctctgctaaacatccggatgtagggcaaccctgtg

SEQ ID NO: 51005 - DNA, 201 bp, Homo sapiens
cagggttgccacagatcttcaatttgtaacaaacacagtgtctgtggagtacactaaaatgaggtgtgcctgtactgacctaggttgttcaaggcagtgtrcactgccgggtagctattgctattggtggtggtgatagtggtgttatgtaataacctccagaccctgggtcaggccccaggctcacttctgggggagtag

SEQ ID NO: 51006 - DNA, 201 bp, Homo sapiens
gatcctgggcctcctttgtttcttcacttgccgcctggccaggccgctcaggtaggggaactcagctggcctgactccccctgcatcccgccaaattcccygccctaagctcgttcagcttccatttgttctcgtgagatggagcaagcggggcactcatttctcttactcttcatggtggggaaaccaaggcccggagag

SEQ ID NO: 51007 - DNA, 201 bp, Homo sapiens
tagcctggcagccactttgatgtcactctggggttgggtttctgcaagttccaggactggcccctggggaggcctcgtgggatgaggctgggccaagaacraggtgggggtagggactagggaagggcccccgtggggttggtgggggtgtggaactgagtggctttgaaccctttccatcccttctgagtcagctcaggc

SEQ ID NO: 51008 - DNA, 201 bp, Homo sapiens
accccaagctccagctccttggagtggcctctggccctttaaatctgagctgctggcctgcgggcctggggcagctggggtctggaaatgactgtggtcasggctgaagacagtggggagtagcctggcagccactttgatgtcactctggggttgggtttctgcaagttccaggactggcccctggggaggcctcgtggg

SEQ ID NO: 51009 - DNA, 201 bp, Homo sapiens
tggagcctctccctgcacgcattcagccttccaccgtgggagaggaggctctgggagtccctgcccttagctgcacgaatacagcagggccctagtgccayagccggaaaagccctgggtttgaatcctgatgctgccacttcctggctctgtggccttcgggggaaaaaaccaatttctgtgcccatttttttagttgga

SEQ ID NO: 51010 - DNA, 201 bp, Homo sapiens
ggctaagtttcgaaacaaattttatttgtatagacagggtcttgccatgttgtccaggctggtctcaaactcctggcatcaagtgatcctcccgcctcagmctcccaaagtgctgggattacaggcatgagccaccgcgcctggccagtcgcattttatggataggaaaactgggctcacagagtttaggtggcaggccct

SEQ ID NO: 51011 - DNA, 201 bp, Homo sapiens
caggcggctgctgttatgctcttggccctactttaaaaatagtcagaacttcaaacatggactcccaaggaaaacaaacagtcccgcgtccgtctgcccgcacacaccagctggtgggtaaaattagcctggtggtgactacagagccgtgaggcccggccccgctgtttgcccaggctgcggtgggctggctcccagctg

SEQ ID NO: 51012 - DNA, 201 bp, Homo sapiens
aggcggctgctgttatgctcttggccctactttaaaaatagtcagaacttcaaacatggactcccaaggaaaacaaacagtcccgcgtccgtctgcccgcacacaccagctggtgggtaaaattagcctggtggtgactacagagccgtgaggcccggccccgctgtttgcccaggctgcggtgggctggctcccagctgt

SEQ ID NO: 51013 - DNA, 201 bp, Homo sapiens
ggcatcttggaaccctgcagaagtgatggctcctgtctcttttaggtgatcatggggggtggccggaaatacatgtaccccaagaataaaactgatgtggrgtatgagagtgacgagaaagccaggggcacgaggctggacggcctggacctcgttgacacctggaagagcttcaaaccgagatacaaggtagcctgtgct

SEQ ID NO: 51014 - DNA, 201 bp, Homo sapiens
ctgtggataaagccaaacccgcccctcctgcaccccagggaaatctgtgggcattgtgaccaccacgagagtgaaccatgccacccccagcgccgcctacrcccactcggctgaccgggactggtactcagacaacgagatgccccctgaggccttgagccagggctgtaaggacatcgcctaccagctcatgcataacat

SEQ ID NO: 51015 - DNA, 201 bp, Homo sapiens
cctggaattaggcctgaaatctgctggctgtgcagggggattagcctcattgggcacaagaagaaactgaagctcagagaggggagtggcccgcggcatgyggcacaagtgacagcggtacggcccaggcaagtttgagccctggctgggaactgggacttaacagctcctgggctatggagcctgggacctggagtcagc

SEQ ID NO: 51016 - DNA, 201 bp, Homo sapiens
taggcctgaaatctgctggctgtgcagggggattagcctcattgggcacaagaagaaactgaagctcagagaggggagtggcccgcggcatgtggcacaastgacagcggtacggcccaggcaagtttgagccctggctgggaactgggacttaacagctcctgggctatggagcctgggacctggagtcagctctactgt

SEQ ID NO: 51017 - DNA, 201 bp, Homo sapiens
ttagcccaactgcctgtgaggcccagggttaggtgctggaatcacagatggatctgccctggattttgccttcaaagagtgtgtgtaggctgggctccgcrgctcacgcctgtagtcccagcactttgggaggccaaggccagtggatcacctgaggtcaggagttcgagaccagcctgaccaacatggtgaaacctcgtc

SEQ ID NO: 51018 - DNA, 201 bp, Homo sapiens
aaaagatctaccaggtgacccttttttagactgagtatcgctctgttccccaggctggagtgcagtggcgtgatctcggctcactacaacctccgcctccygggttccagagattctcctgcctcagcctcccatgtagctgggattacaggcacatgccaccacacccagctaatttttgtatttttagtagagacatgg

SEQ ID NO: 51019 - DNA, 201 bp, Homo sapiens
taaggcaggagaatcacttgaacccgggaggcagaggttgcagggagccgagatcgcaccactgcactccagcctggacaacagagtgagactctgtctcaaaaaaaaaaaagaaaagaaaagaaaaagaaaaaagaaaaaaaaaggaattgggggcctaattctgggcccacaaaaatcacccagataaggatcctccca

SEQ ID NO: 51020 - DNA, 201 bp, Homo sapiens
caggtaggggaactcagctggcctgactccccctgcatcccgccaaattccctgccctaagctcgttcagcttccatttgttctcgtgagatggagcaagmggggcactcatttctcttactcttcatggtggggaaaccaaggcccggagaggttgagccctggcgtcagcctgggcttaaatggcgcatagtcgaagac

SEQ ID NO: 51021 - DNA, 201 bp, Homo sapiens
tggagcggcctctcctggcgtgctcacctgggtgctggcgtcttggcacttgtcagggtggagagaggaggaagccagtcaagaaggggaaagacgggtgygggaggacattcactgattcaacaaacatctcattagcccaactgcctgtgaggcccagggttaggtgctggaatcacagatggatctgccctggatttt

SEQ ID NO: 51022 - DNA, 201 bp, Homo sapiens
aaaatgttgggattaacaggcggtgagccaccaggcctggcatatttttcagtttttaaagccatttcttttttctctttttttttttttttttttgagayggagtctcgccctgtcgcccaggatggagtgcagtggcttgatcttggctcactgcagcctcccaggttcaagtgattctcctgcctcagcctctggagt

SEQ ID NO: 51023 - DNA, 201 bp, Homo sapiens
gggaccccgggtctgctgagagggggctgctggaaacacggccctggtgtcaggatggagaagtccagctcttaaagggaactgactggtttgggggtgamgggagaggtccctttaggagaataggttgtggaaggagacgggtggcactgtagacactcccagcccagcaagctgctctcctttgggcatggagatgca

SEQ ID NO: 51024 - DNA, 201 bp, Homo sapiens
ggaccccgggtctgctgagagggggctgctggaaacacggccctggtgtcaggatggagaagtccagctcttaaagggaactgactggtttgggggtgaakggagaggtccctttaggagaataggttgtggaaggagacgggtggcactgtagacactcccagcccagcaagctgctctcctttgggcatggagatgcaa

SEQ ID NO: 51025 - DNA, 201 bp, Homo sapiens
ggctgctggaaacacggccctggtgtcaggatggagaagtccagctcttaaagggaactgactggtttgggggtgaagggagaggtccctttaggagaatrggttgtggaaggagacgggtggcactgtagacactcccagcccagcaagctgctctcctttgggcatggagatgcaagttaggttcagcaatccaggaag

SEQ ID NO: 51026 - DNA, 201 bp, Homo sapiens
gtcaggatggagaagtccagctcttaaagggaactgactggtttgggggtgaagggagaggtccctttaggagaataggttgtggaaggagacgggtggcrctgtagacactcccagcccagcaagctgctctcctttgggcatggagatgcaagttaggttcagcaatccaggaaggcttcctgggagaggaggcagatt

SEQ ID NO: 51027 - DNA, 201 bp, Homo sapiens
ggcatggagatgcaagttaggttcagcaatccaggaaggcttcctgggagaggaggcagatttctcccctttggtagtctttcttggggacctggccctgraggggcaagcagcccctcagcctcactgcccagaaaagcaaatccgcaggccccggctttcccacgctgtgtgctgatgttcccaggctctttcagcgcc

SEQ ID NO: 51028 - DNA, 201 bp, Homo sapiens
gagatgcaagttaggttcagcaatccaggaaggcttcctgggagaggaggcagatttctcccctttggtagtctttcttggggacctggccctgaaggggyaagcagcccctcagcctcactgcccagaaaagcaaatccgcaggccccggctttcccacgctgtgtgctgatgttcccaggctctttcagcgccggccag

SEQ ID NO: 51029 - DNA, 201 bp, Homo sapiens
ggaagtgtgaggaagtgataaagattccagaaaccttccagtgctaacagcccttgcccaccgcagttcctcatgttgccctgctaacatcggtatgtatmcacacacatgcacacacgtgaacatgtttgcacatatgctccccacgcatacacacatgctcagcgcctccgccttccagaggtgagcgtccgccagccc

SEQ ID NO: 51030 - DNA, 201 bp, Homo sapiens
cctccctcaccgaggcctttgccttggtgtcccaaggaggcagaattgaccacgggcaccatgaaggaaaagccaagcaggccctgcatgaggcggtggasatggaccgggccatcgggcaggcaggcagcttgacctcctcggaagacactctgaccgtggtcactgcggaccattcccacgtcttcacatttggtggat

SEQ ID NO: 51031 - DNA, 201 bp, Homo sapiens
tcatcatgttcctgggagatggtgaggcccaggggcctgtgggaggggtggaacaggacacctagctaggagccccgggagccaggctgagttgaaggggkctgtgttgaaggggctagggctctggaggaagggtgtttaaaaggatgaggggccaggctgtggattcaagaggcctgctctgccagacagccccctgag

SEQ ID NO: 51032 - DNA, 201 bp, Homo sapiens
aaagccaagcaggccctgcatgaggcggtggagatggaccgggccatcgggcaggcaggcagcttgacctcctcggaagacactctgaccgtggtcactgyggaccattcccacgtcttcacatttggtggatacaccccccgtggcaactctatctttggtaggtgggccttctttggggtggacactcctggggtctcc

SEQ ID NO: 51033 - DNA, 201 bp, Homo sapiens
ctggatgatggatggatgatggatggatggatggatggatggatggatggatgatggatggatggatgggtggatggatggatggatgggtggatggatgratgggagggacatgggtacaatgaaaactggggaatggttagttggaaataataaggtttagaaggtggcttcttggaggcattgcagggcccttcaaag

SEQ ID NO: 51034 - DNA, 201 bp, Homo sapiens
gatagtcagtgactaatcatttccttcccttggaggggataccagagagaggcggatggtgaggaggaggctgggccagggaataacctgcgtggacattsagtcaccctgagcacctattgtatgtaggcacctggcggggcatgcgtgaggcacagaggctgagtcagatggccaaggaaacatggaatgctgtgtgcc

SEQ ID NO: 51035 - DNA, 201 bp, Homo sapiens; identical to SEQ ID NO: 10569

SEQ ID NO: 51036 - DNA, 201 bp, Homo sapiens
gggccccagcatgacccctgaacaccccctccctgtgcaggtctggcccccatgctgagtgacacagacaagaagcccttcactgccatcctgtatggcartgggcctggctacaaggtggtgggcggtgaacgagagaatgtctccatggtggactatggtgagacctccaggacccagggctgggaggggacagggcac

SEQ ID NO: 51037 - DNA, 201 bp, Homo sapiens
tgaacaccccctccctgtgcaggtctggcccccatgctgagtgacacagacaagaagcccttcactgccatcctgtatggcaatgggcctggctacaaggyggtgggcggtgaacgagagaatgtctccatggtggactatggtgagacctccaggacccagggctgggaggggacagggcacccctcggggatgggcttg

SEQ ID NO: 51038 - DNA, 201 bp, Homo sapiens
gcaggctctcagcaggtgtttcccctggcccacagctcacaacaactaccaggcgcagtctgctgtgcccctgcgccacgagacccacggcggggaggacrtggccgtcttctccaagggccccatggcgcacctgctgcacggcgtccacgagcagaactacgtcccccacgtgatggcgtatgcagcctgcatcggggc

SEQ ID NO: 51039 - DNA, 201 bp, Homo sapiens; identical to SEQ ID NO: 10589

SEQ ID NO: 51040 - DNA, 201 bp, Homo sapiens; identical to SEQ ID NO: 10590

SEQ ID NO: 51041 - DNA, 201 bp, Homo sapiens
agcaggctgattggagaggcaggagcacgagagactgaggcccccactccccactgcagggatgggtgtctccacagtgacggctgcccgcatcctcaagrgtcagctccaccacaaccctggggaggagaccaggctggagatggacaagttccccttcgtggccctctccaaggtgagccccatccccaagcccagttc

SEQ ID NO: 51042 - DNA, 201 bp, Homo sapiens
gaagagcttcaaaccgagatacaaggtagcctgtgctggggccatgtggctgcagaggtggcctgtgatggggagaggctgtgtgacccctgctctgaagytctgttgtcctctgtagaaagggcatcggaaatctttcctccatgggctcaaatggcctaagagatatacaagcagtagatagtcagtgactaatcattt

SEQ ID NO: 51043 - DNA, 201 bp, Homo sapiens
cgcggctcacgcctgtagtcccagcactttgggaggccaaggccagtggatcacctgaggtcaggagttcgagaccagcctgaccaacatggtgaaacctygtctctactaaaaatacaaaaattagccgggcatggtggcgcgtgcctgtaatcccagctactccggaggctgaggcaggagaattgcttgaacctggga

SEQ ID NO: 51044 - DNA, 201 bp, Homo sapiens
gcctcccaggttcaagctattctcctgcatcagcctctggagtagctgggactacaggcatgtaccaccatacctggctaatttttgtatttttagtagaratggggtttcaccatgttggccaggctggtctcaaactcctgacctcaggtgatctgcctgcctcggcctcccaaagtgctgggattacaggtgtgagct

SEQ ID NO: 51045 - DNA, 201 bp, Homo sapiens
gccactggggcgaaggcctggccatctcctgaccctcctctcccacctgcagacgtacaacaccaatgcccaggtccctgacagcgccggcaccgccaccrcctacctgtgtggggtgaaggccaatgagggcaccgtgggggtaagcgcagccactgagcgttcccggtgcaacaccacccaggggaacgaggtcacctc

SEQ ID NO: 51046 - DNA, 201 bp, Homo sapiens
ccttctgtagtttggtcaattcgacatttattccatttgtaagtgttctgttttttgctaaacctttaggatgttttcattgtgtgtacgtgttttttttytgttttgtttttttgtttttttgttttttttgagacagtcttgctctgtcacccaggctggagtgtagtggcacgatcactgctcatacagcctcaacct

SEQ ID NO: 51047 - DNA, 201 bp, Homo sapiens
tctgtagtttggtcaattcgacatttattccatttgtaagtgttctgttttttgctaaacctttaggatgttttcattgtgtgtacgtgttttttttttgttttgtttttttgtttttttgttttttttgagacagtcttgctctgtcacccaggctggagtgtagtggcacgatcactgctcatacagcctcaacctccc

SEQ ID NO: 51048 - DNA, 201 bp, Homo sapiens
ccctgggttgtcatgagcatgacatgaacttgtgttgtataagttatctgttgctgtataacaaattatctcaaaacttaggccaggtgcaggccgggtgyagtggctcatgcctgtaatcccagcactttgggaggccgaggtgggcggagcacaaggtcaggagatcgagaccatcctggctaacgaggtgaaacccca

SEQ ID NO: 51049 - DNA, 201 bp, Homo sapiens
ttagttggaaataataaggtttagaaggtggcttcttggaggcattgcagggcccttcaaagaagatcccaggggttaccaagccaccaaggagcctaatmtgggggctggggactgtactcctggggccccagcatgacccctgaacaccccctccctgtgcaggtctggcccccatgctgagtgacacagacaagaagc

SEQ ID NO: 51050 - DNA, 201 bp, Homo sapiens
catttattccatttgtaagtgttctgttttttgctaaacctttaggatgttttcattgtgtgtacgtgttttttttttgttttgtttttttgtttttttgktttttttgagacagtcttgctctgtcacccaggctggagtgtagtggcacgatcactgctcatacagcctcaacctccccaaataaagtgatcctcccac

SEQ ID NO: 51051 - DNA, 201 bp, Homo sapiens
ctgggcttaagcgatcctcctgccgtggcctcccaaggtgctgagatttacaggagtgacctattcaggcatgagattacatgcctgacctattcagtttytttttttttttttttttttgaggcggaatctcgctctgtcacccaggctggagtgcagtggtgtgatctcagctcaccgcaacctctgcctcctggattc

SEQ ID NO: 51052 - DNA, 201 bp, Homo sapiens
tgggcttaagcgatcctcctgccgtggcctcccaaggtgctgagatttacaggagtgacctattcaggcatgagattacatgcctgacctattcagtttctttttttttttttttttttgaggcggaatctcgctctgtcacccaggctggagtgcagtggtgtgatctcagctcaccgcaacctctgcctcctggattca

SEQ ID NO: 51053 - DNA, 201 bp, Homo sapiens
gacctattcagtttctttttttttttttttttttgaggcggaatctcgctctgtcacccaggctggagtgcagtggtgtgatctcagctcaccgcaacctstgcctcctggattcaagcaattctcctgcctcagcctcccaagtagctgggattacgggcatgtgccaccatgcctggctaatttttttttgtattttta

SEQ ID NO: 51054 - DNA, 201 bp, Homo sapiens
gaggcggaatctcgctctgtcacccaggctggagtgcagtggtgtgatctcagctcaccgcaacctctgcctcctggattcaagcaattctcctgcctcarcctcccaagtagctgggattacgggcatgtgccaccatgcctggctaatttttttttgtatttttagtagagatgagatttcaccatattggccagactg

SEQ ID NO: 51055 - DNA, 201 bp, Homo sapiens
gtggtgtgatctcagctcaccgcaacctctgcctcctggattcaagcaattctcctgcctcagcctcccaagtagctgggattacgggcatgtgccaccaygcctggctaatttttttttgtatttttagtagagatgagatttcaccatattggccagactggtctcggactcctgaccttgtgatccacccaccttgac

SEQ ID NO: 51056 - DNA, 201 bp, Homo sapiens
aatttttttttgtatttttagtagagatgagatttcaccatattggccagactggtctcggactcctgaccttgtgatccacccaccttgacctcccaaartgctgggattacagacgtgagcctccgctcccggccgacctattcagtttcttaatggtatgttttgataacaagaggttttcaattttgatgaagtcca

SEQ ID NO: 51057 - DNA, 201 bp, Homo sapiens
caccccgatctgtggataaagccaaacccgcccctcctgcaccccagggaaatctgtgggcattgtgaccaccacgagagtgaaccatgccacccccagcrccgcctacgcccactcggctgaccgggactggtactcagacaacgagatgccccctgaggccttgagccagggctgtaaggacatcgcctaccagctcat

SEQ ID NO: 51058 - DNA, 201 bp, Homo sapiens
ctcctgaccttgtgatccacccaccttgacctcccaaaatgctgggattacagacgtgagcctccgctcccggccgacctattcagtttcttaatggtatsttttgataacaagaggttttcaattttgatgaagtccaatttaccttttttttcttttatggaattagtattctttgcctaacccaaagtcatgaaaata

SEQ ID NO: 51059 - DNA, 201 bp, Homo sapiens
gataacaagaggttttcaattttgatgaagtccaatttaccttttttttcttttatggaattagtattctttgcctaacccaaagtcatgaaaatattatsgagtcagggccgggcgtcgtggctcatacatgtaatcccagcactttgggaggccgaggtgggcggatcacctgaggtcaggagttcgagaccagcctgg

SEQ ID NO: 51060 - DNA, 201 bp, Homo sapiens
atggagtttcattgtgttgcccaggctggtctcaaactcttgggctcaagtaatccacccgccttggcttcctagagtgctgggattacaggtgtgagccmccgcatctggtcctgttaatggtttttctttagaattcattgtgctatggctggtagtggcgtggggtgggattcggggagccatgcacttcttgccctt

SEQ ID NO: 51061 - DNA, 201 bp, Homo sapiens
tacaacaccaatgcccaggtccctgacagcgccggcaccgccaccgcctacctgtgtggggtgaaggccaatgagggcaccgtgggggtaagcgcagccamtgagcgttcccggtgcaacaccacccaggggaacgaggtcacctccatcctgcgctgggccaaggacgctggtgagtcgggggagcagtggggagcaggg

SEQ ID NO: 51062 - DNA, 201 bp, Homo sapiens
accaatgcccaggtccctgacagcgccggcaccgccaccgcctacctgtgtggggtgaaggccaatgagggcaccgtgggggtaagcgcagccactgagcrttcccggtgcaacaccacccaggggaacgaggtcacctccatcctgcgctgggccaaggacgctggtgagtcgggggagcagtggggagcagggccagct

SEQ ID NO: 51063 - DNA, 201 bp, Homo sapiens
aacccgcccctcctgcaccccagggaaatctgtgggcattgtgaccaccacgagagtgaaccatgccacccccagcgccgcctacgcccactcggctgacygggactggtactcagacaacgagatgccccctgaggccttgagccagggctgtaaggacatcgcctaccagctcatgcataacatcagggacattgacgt

SEQ ID NO: 51064 - DNA, 201 bp, Homo sapiens
gggaaatctgtgggcattgtgaccaccacgagagtgaaccatgccacccccagcgccgcctacgcccactcggctgaccgggactggtactcagacaacgrgatgccccctgaggccttgagccagggctgtaaggacatcgcctaccagctcatgcataacatcagggacattgacgtgagtgctcgggggcagccgggc

SEQ ID NO: 51065 - DNA, 201 bp, Homo sapiens
agagtgaaccatgccacccccagcgccgcctacgcccactcggctgaccgggactggtactcagacaacgagatgccccctgaggccttgagccagggctrtaaggacatcgcctaccagctcatgcataacatcagggacattgacgtgagtgctcgggggcagccgggcagggacggggtgaggcggggcctctggtgg

SEQ ID NO: 51066 - DNA, 201 bp, Homo sapiens
tcatctgaggccacagagtactggccagagaggagacatagatccccagaatttcagttggaaggcctttagaagctggctcggtcaactgggctcttggygcaccagggagactgaggcccagagaggagaagaggcttgcccagggtcacacaattgcttagggcagagtggactgggaattcagtctcctggccttaa

SEQ ID NO: 51067 - DNA, 201 bp, Homo sapiens
cccgatctgtggataaagccaaacccgcccctcctgcaccccagggaaatctgtgggcattgtgaccaccacgagagtgaaccatgccacccccagcgccrcctacgcccactcggctgaccgggactggtactcagacaacgagatgccccctgaggccttgagccagggctgtaaggacatcgcctaccagctcatgca

SEQ ID NO: 51068 - DNA, 201 bp, Homo sapiens
gtctcttttaggtgatcatggggggtggccggaaatacatgtaccccaagaataaaactgatgtggagtatgagagtgacgagaaagccaggggcacgagkctggacggcctggacctcgttgacacctggaagagcttcaaaccgagatacaaggtagcctgtgctggggccatgtggctgcagaggtggcctgtgatgg

SEQ ID NO: 51069 - DNA, 201 bp, Homo sapiens
gaataaaactgatgtggagtatgagagtgacgagaaagccaggggcacgaggctggacggcctggacctcgttgacacctggaagagcttcaaaccgagayacaaggtagcctgtgctggggccatgtggctgcagaggtggcctgtgatggggagaggctgtgtgacccctgctctgaagttctgttgtcctctgtagaa

SEQ ID NO: 51070 - DNA, 201 bp, Homo sapiens
cctggctacaaggtggtgggcggtgaacgagagaatgtctccatggtggactatggtgagacctccaggacccagggctgggaggggacagggcacccctyggggatgggcttgggaatagggtgtcagcttgtggtcaaggtcaggggtctcagaatgactggggcttgagtcccagtttgattgttgagtcccaggttg

SEQ ID NO: 51071 - DNA, 201 bp, Homo sapiens
gtgtcagaacaggctcaggttcaaatcccgtggccttaggcaaaatgactttcccacattgagcctccttttcctcttctgtgaaatgggagcattcaagscagcctggaagggagatggaaaagctgcgtgcgcagcgccaggcccctggcaggctctcagcaggtgtttcccctggcccacagctcacaacaactacca

SEQ ID NO: 51072 - DNA, 201 bp, Homo sapiens
gggtcacagcctctcagcatccacatcctcctggcgtcctcctcaggtctcttcgagccaggggacatgcagtacgagctgaacaggaacaacgtgacggwcccgtcactctccgagatggtggtggtggccatccagatcctgcggaagaaccccaaaggcttcttcttgctggtggaaggtagggaccccgggtctgct

SEQ ID NO: 51073 - DNA, 201 bp, Homo sapiens
gccaagcaggccctgcatgaggcggtggagatggaccgggccatcgggcaggcaggcagcttgacctcctcggaagacactctgaccgtggtcactgcggwccattcccacgtcttcacatttggtggatacaccccccgtggcaactctatctttggtaggtgggccttctttggggtggacactcctggggtctcctgt

SEQ ID NO: 51074 - DNA, 201 bp, Homo sapiens
ctggccagcaccttgatggtgggaaccacgcctgctttttaaccacttaatcctggaagtgacatacatcacttccgcccttagtgcattggcaagaaccrgtcctgtgatccttcctggatgcgaggaaagctaggaaatgccgtcttcgcttgggctaccgctgccaccaacaccaacacagcaggttctcatcctggg

SEQ ID NO: 51075 - DNA, 201 bp, Homo sapiens
ggagcagatcttcctcccctcctccctcaccgaggcctttgccttggtgtcccaaggaggcagaattgaccacgggcaccatgaaggaaaagccaagcagrccctgcatgaggcggtggagatggaccgggccatcgggcaggcaggcagcttgacctcctcggaagacactctgaccgtggtcactgcggaccattccca

SEQ ID NO: 51076 - DNA, 201 bp, Homo sapiens
gccctgcatgaggcggtggagatggaccgggccatcgggcaggcaggcagcttgacctcctcggaagacactctgaccgtggtcactgcggaccattcccrcgtcttcacatttggtggatacaccccccgtggcaactctatctttggtaggtgggccttctttggggtggacactcctggggtctcctgtctacccacc

SEQ ID NO: 51077 - DNA, 201 bp, Homo sapiens
tctcagcaggtgtttcccctggcccacagctcacaacaactaccaggcgcagtctgctgtgcccctgcgccacgagacccacggcggggaggacgtggccrtcttctccaagggccccatggcgcacctgctgcacggcgtccacgagcagaactacgtcccccacgtgatggcgtatgcagcctgcatcggggccaacct

SEQ ID NO: 51078 - DNA, 201 bp, Homo sapiens; identical to SEQ ID NO: 10586

SEQ ID NO: 51079 - DNA, 201 bp, Homo sapiens; identical to SEQ ID NO: 10593

SEQ ID NO: 51080 - DNA, 201 bp, Homo sapiens
accgcgaggctcagactggtgggaacagagggctgcctggcgcccaggaccctccaagctgggagtgtccaccaggcagcgccctcctgttagcaagggargtgttcctttaaggtcacagagccctcggctgctgggccaagcctccagccaggcccctgcactcacccggaggtgggaagcgggggcggaggctgcgag

SEQ ID NO: 51081 - DNA, 201 bp, Homo sapiens; identical to SEQ ID NO: 10605

SEQ ID NO: 51082 - DNA, 201 bp, Homo sapiens
ggaggcataaaaaggtggtgcagatggggtatgatgagggcagtgtctatgttttaaggtcccagaaccatccaaagtatttaagagctgaaaacagtgtwcagagcaggaaacctcagccctgctacttgcatgtgttagttggataggtcactcttttcccatatatatatatatatatacacacatacacatatatga

SEQ ID NO: 51083 - DNA, 201 bp, Homo sapiens
ggaagggtgtttaaaaggatgaggggccaggctgtggattcaagaggcctgctctgccagacagccccctgaggatctgggggtgaagggagagaggggcygctcactgacatttacagagccatgcccagtgccaactgcccgagcctgccttggtaccgaactagagagcttctgggtacccaagcaggctgattggag

SEQ ID NO: 51084 - DNA, 201 bp, Homo sapiens
tcatgagcatgacatgaacttgtgttgtataagttatctgttgctgtataacaaattatctcaaaacttaggccaggtgcaggccgggtgcagtggctcaygcctgtaatcccagcactttgggaggccgaggtgggcggagcacaaggtcaggagatcgagaccatcctggctaacgaggtgaaaccccatctctactaa

SEQ ID NO: 51085 - DNA, 201 bp, Homo sapiens; identical to SEQ ID NO: 10608

SEQ ID NO: 51086 - DNA, 201 bp, Homo sapiens; identical to SEQ ID NO: 10609

SEQ ID NO: 51087 - DNA, 201 bp, Homo sapiens; identical to SEQ ID NO: 10610

SEQ ID NO: 51088 - DNA, 201 bp, Homo sapiens
catttgttctcgtgagatggagcaagcggggcactcatttctcttactcttcatggtggggaaaccaaggcccggagaggttgagccctggcgtcagcctrggcttaaatggcgcatagtcgaagactagccaaaccctctgttgggtttcctaagctacaaaacgggggctcttcatccatattgtgagatcagggatgt

SEQ ID NO: 51089 - DNA, 201 bp, Homo sapiens
cctgggttgtcatgagcatgacatgaacttgtgttgtataagttatctgttgctgtataacaaattatctcaaaacttaggccaggtgcaggccgggtgcrgtggctcatgcctgtaatcccagcactttgggaggccgaggtgggcggagcacaaggtcaggagatcgagaccatcctggctaacgaggtgaaaccccat

SEQ ID NO: 51090 - DNA, 201 bp, Homo sapiens; identical to SEQ ID NO: 10613

SEQ ID NO: 51091 - DNA, 201 bp, Homo sapiens
aggagcctctgcgagggggaggggtcctaggggtggggccagcagggaggctctgggttctgaaggctttcccaggtccccaccctctccttgtcctgagyggaggctatgggagaaggcacctgcctccaggccaagcctatctcaatgcctatccctggggccaaaattcagagcatcccagcctgaactggtggcact

SEQ ID NO: 51092 - DNA, 201 bp, Homo sapiens
atccctggggccaaaattcagagcatcccagcctgaactggtggcacttatggaactgctaccatgtgcaagggctcgggatgcagagatgggtaagatgwtggtctttacgttcacagagcttcaggctagcagggaggagagacagaccaataaccggaagaataatcatgtggggctggatgagcctttcagtgctcc

SEQ ID NO: 51093 - DNA, 201 bp, Homo sapiens
tggtctttacgttcacagagcttcaggctagcagggaggagagacagaccaataaccggaagaataatcatgtggggctggatgagcctttcagtgctccygggtcactacacttttatttttctttattcgctcacctgttttggaccctcagtgcagagagagtgggatacgttatctcacttagcacatgacataccc

SEQ ID NO: 51094 - DNA, 201 bp, Homo sapiens
ccctatgctaatgtacttaatatggccttggagttgtaagtgtccttgtacgttacacagcattctgtccgtgggggtggtttgcacttacatacactgcrtttgattctttacattcatcactcagtcctctgcctttagaccccaccacgctgctgtttggacatctagttttaataccactgccacgcagacattgcc

SEQ ID NO: 51095 - DNA, 201 bp, Homo sapiens
ccagagccaaatattcagctgcctccttagtgtctccacttctaaaagacatctccaactcaacatatccaaaaacaagttcctgattgtctccacctcaygcctcaaaagaccaccccaaacgccgaaaggctgaatgcttttttctttttcttttttttttttttctgagatggagtctcactctgttgcccaggctgg

SEQ ID NO: 51096 - DNA, 201 bp, Homo sapiens
agtgcagcacatagacttgctttcattttgtcagtatcctttatagattgttcatgtaagctcccaaagagtagtatttattttattgaaataaaatgcaygtagagaaaaatgtgtgtatcatacattgacagctgaacccaccgtgtaaccagcacccacccacccagatcaatcataaaccgaaccgcaccagcaccc

SEQ ID NO: 51097 - DNA, 201 bp, Homo sapiens
tccctctcttagcttctggctaccctccctaccacgcatggtttatttgaatgaggcaaggccttaggatttttcgatttgtggatggcgaatagccagcrtgtctccttcctctctcctgccctgcacccacatcagacatcactagtcaaccactgcttgctttccttcccagattccttctaagtacagtgctccaga

SEQ ID NO: 51098 - DNA, 201 bp, Homo sapiens
cgtgatctcagctcactgcaaccttcgccacccaggttcaagtgatcctcctgcctcagcctcctgagtagctgggattacaggcgtgcgccgcaacaccyggctaattttttgtattcttattagagacggggtttcatcatgttggccaggctgatctcgaactcctgacctcaagtgatccacccgccttggcctccc

SEQ ID NO: 51099 - DNA, 201 bp, Homo sapiens
gtcttggcctggccccgaacaggcctctgacgccaaggagccagccagaaaccagcggtggtgagcacgggctcccccgggagcggtttcctttgtgagcraggccaggatgggccgcccaggctagctgctcccagagccacaacaaagggaggacacgccctgccagcctgccgggccaccgcgaggctcagactggtg

SEQ ID NO: 51100 - DNA, 201 bp, Homo sapiens
taagctgtgtgaccttgggcaagtgatttctcctctttctgcctcagtttcctcttctataaagtagggataatgatgctcccataaaatggagatagtgrtggggctggagacaacccctgggttgtcatgagcatgacatgaacttgtgttgtataagttatctgttgctgtataacaaattatctcaaaacttaggcc

SEQ ID NO: 51101 - DNA, 201 bp, Homo sapiens
tcccgtgtaggccccacatccctagaaaatcatgccttaagagtgggttttagagtcagtttcacctttaccattcagtggctacgtggtctgtgtgcctyggtgccctcatctgtaaagagggaataacaggaacaaccctggagggagagagcacaggagagccacctccaggaagcaggggctgggagggggggtgcg

SEQ ID NO: 51102 - DNA, 201 bp, Homo sapiens
tttctgcaagttccaggactggcccctggggaggcctcgtgggatgaggctgggccaagaacgaggtgggggtagggactagggaagggcccccgtggggwtggtgggggtgtggaactgagtggctttgaaccctttccatcccttctgagtcagctcaggctgggccagagccccctccaagctcaagccagagagaca

SEQ ID NO: 51103 - DNA, 201 bp, Homo sapiens
cgctgggtggcaggtgctattatccccacattacagatgaggaaacggaaacacaaactcccccagctgggaagtgagaagtagacatgtttgttccctgyggtgacccatccatccattcaaggctactgctttctccgtaatgcaaatgacataacccatcttcctagaagagtcagttccctatttatcttaaaacca

SEQ ID NO: 51104 - DNA, 201 bp, Homo sapiens
gccgccattctggtgagaaaatgtctcatctgaggcccatttcccctcctccactccttctgagcccttctatagctcctcttctttctctgcctcattcygctggtccctgccatgccactactaactaaaagtccatagactataagcccaacatgcacgtactaggcatggtgctcagtgccttgcctgtaattacta

SEQ ID NO: 51105 - DNA, 201 bp, Homo sapiens
cctgcatgaggcggtggagatggaccgggccatcgggcaggcaggcagcttgacctcctcggaagacactctgaccgtggtcactgcggaccattcccacrtcttcacatttggtggatacaccccccgtggcaactctatctttggtaggtgggccttctttggggtggacactcctggggtctcctgtctacccacctg

SEQ ID NO: 51106 - DNA, 201 bp, Homo sapiens
tactcttgagggtctgggtttgtggtttcagtttcttcctctgcaaaagggctgctagtaccccttggtagagttaggggagagggcacgagggagacagkaggccctgggcaagaatccagttgcgctggttgtattgacatgcatggacttgagagttatcctgaaaccctatccctccttatctgtgatttgggaatc

SEQ ID NO: 51107 - DNA, 201 bp, Homo sapiens
cttcagccttcttttttttcttcaattagatataacttacagaaaagggcaccgatcttaaatacatagcctgaaaaaattttgacatatatttatacccrtgtaaccgccacccagatcaagacagaacatttctggttgtgaggcatctgtgggcttccctgtgccaaccccctcccaaagccagaggagatgcccagg

SEQ ID NO: 51108 - DNA, 201 bp, Homo sapiens
cccgacatgtggcctggggcgagttccttcccctccctatgcctcagtttccccacctgtgcagcagaaacagagagccacacttgcttgctcccagggcygtgggaggccgtgatgaggtcatggatgtgagaacatttgttgtacaggcacagggtataattacatggggactgctcctcagaggggtttgtcagggac

SEQ ID NO: 51109 - DNA, 201 bp, Homo sapiens
agttgggcaaatcatctaacacgaggcctatttcataataaagtgttgactatctcatgtcaatttcttggctatactgtattgaatgtgaaaaacagaayggctggttgggtactcgaggtgtggtttccactgaacactgtagcttttgcatcatcgtaaagaaaaaaatcttaagtgtaagttggggacagtctgtaa

SEQ ID NO: 51110 - DNA, 201 bp, Homo sapiens
tcagtgggcagtgggcctggtcaaggctatggggtcctctctggttcctcacgccccagtccccatggtgtgagtgtaggcggggtgggtgccactggggmgaaggcctggccatctcctgaccctcctctcccacctgcagacgtacaacaccaatgcccaggtccctgacagcgccggcaccgccaccgcctacctgtg

SEQ ID NO: 51111 - DNA, 201 bp, Homo sapiens
gagcagggccagcttcgtggcctgtccaggcctcagtctttctgactgtgtcatgggaaggggctagaaaaggcttctctgtggggctcccagctctgatrtgctgggagtctgtaatatccatgggattccttccgtgacaggggaagctgagggtttggggttcactcagtggtgggttctggtcccagttcatttctc

SEQ ID NO: 51112 - DNA, 201 bp, Homo sapiens
aatctttcctccatgggctcaaatggcctaagagatatacaagcagtagatagtcagtgactaatcatttccttcccttggaggggataccagagagaggyggatggtgaggaggaggctgggccagggaataacctgcgtggacattgagtcaccctgagcacctattgtatgtaggcacctggcggggcatgcgtgagg

SEQ ID NO: 51113 - DNA, 201 bp, Homo sapiens
ctgtggatagctacgggtgtcccatttcctggggcagaaactcttgtccaaaggcaccctgtcgggcagaagggccaaggtgctcccaattcccagtgggkactgcgtggggacatctgaaattgatgccctcagcagacacttccagaagagagagggtggacctggggctgtcgggatgagggtagtgggctgagggat

SEQ ID NO: 51114 - DNA, 201 bp, Homo sapiens
ccaaggtgctcccaattcccagtggggactgcgtggggacatctgaaattgatgccctcagcagacacttccagaagagagagggtggacctggggctgtygggatgagggtagtgggctgagggattggggtggtggtgacgtaaggggaggcctcttggggaggggcgtggggtgtgcttgggtccaaagctagaggtg

SEQ ID NO: 51115 - DNA, 201 bp, Homo sapiens
ccagcaatgtcatttaacaggggaagagactgaggctgagggaggtgacagagctagtacttggagcagctgggggttttttgtttgtttgtttttgagayggagtctagctctgtcacccaggctggagtgcagtggtatgatctcagctcactgcaacctccgcctcccgggttcaagcagttctcctgcctcagcctc

SEQ ID NO: 51116 - DNA, 201 bp, Homo sapiens
aaacattactctcttaattgtgctagcacaattcatttgctgccttagcagctcatctccctactgggtagaaggaatgagcatgggctttggagcgaaayccagccctgccagtgtctgcctgtgctgtgtggccttaggcaagttgctcgttgtctctgagccttggtttcttcattctgagatgtgaggagaagaccc

SEQ ID NO: 51117 - DNA, 201 bp, Homo sapiens
aagctcaacaccaacgtggctaagaatgtcatcatgttcctgggagatggtgaggcccaggggcctgtgggaggggtggaacaggacacctagctaggagmcccgggagccaggctgagttgaagggggctgtgttgaaggggctagggctctggaggaagggtgtttaaaaggatgaggggccaggctgtggattcaaga

SEQ ID NO: 51118 - DNA, 201 bp, Homo sapiens
gtgttcctttaaggtcacagagccctcggctgctgggccaagcctccagccaggcccctgcactcacccggaggtgggaagcgggggcggaggctgcgagrgttcaggcttcggcagggctttgtggaacctgccacaggcactgcccaggcactggggactttcactacctctgggagctccgtgctttctttttagagg

SEQ ID NO: 51119 - DNA, 201 bp, Homo sapiens
ccaggactggcccctggggaggcctcgtgggatgaggctgggccaagaacgaggtgggggtagggactagggaagggcccccgtggggttggtgggggtgyggaactgagtggctttgaaccctttccatcccttctgagtcagctcaggctgggccagagccccctccaagctcaagccagagagacaccagcctcagtt

SEQ ID NO: 51120 - DNA, 201 bp, Homo sapiens
ttttggggtctctgctaaacatccggatgtagggcaaccctgtgatggtggccgcagggcaggtggcagagaagtcggcgctggtcttggccccacccttsccttccccagtccccttccccctcactttcactaccctatccccagaccccccactccttcaagaaggcccctccctctcccttctccaggactcccctg

SEQ ID NO: 51121 - DNA, 201 bp, Homo sapiens
tggccgcagggcaggtggcagagaagtcggcgctggtcttggccccacccttcccttccccagtccccttccccctcactttcactaccctatccccagamcccccactccttcaagaaggcccctccctctcccttctccaggactcccctgctccccaacccctcgctggctcctgcagccccaggcccggagagaggc

SEQ ID NO: 51122 - DNA, 201 bp, Homo sapiens
tccctctcccttctccaggactcccctgctccccaacccctcgctggctcctgcagccccaggcccggagagaggcctccgctgaccccacctgagccccratcttccgccggacacttctctgtactttggagagctaaggtcctgccccagtgctgccagggtgcagggaatgatggcaggaagcaggcagctaggtag

SEQ ID NO: 51123 - DNA, 201 bp, Homo sapiens
cccctcgctggctcctgcagccccaggcccggagagaggcctccgctgaccccacctgagccccaatcttccgccggacacttctctgtactttggagagmtaaggtcctgccccagtgctgccagggtgcagggaatgatggcaggaagcaggcagctaggtagtcctgtggctctggggggcttcagtgggcagtgggc

SEQ ID NO: 51124 - DNA, 201 bp, Homo sapiens
ctcacctgccttcagccctccatgcactgccccccacaaatttctgggggctacttggcccctccacagtagagacccacgtctgcccttttcccagcatrgtggattaagtacccgctttcaggacacacagtgctgttggcccctttcactgaacagacatctgaggccaagccactcatcctggcttgccttcacccg

SEQ ID NO: 51125 - DNA, 201 bp, Homo sapiens
ctggcaagtcacctcacctctcctgtaaagttatgattataggaagccctcccactgggaaccgtggtgcagatacaatgaaataacatttgggaacagartgtagtgagtgtgaatcaaatagcagctgcacgcaatcccttcatctgcaaaagtataatgtgtctgtgtaatgtacatattgcagagagggcaaatggt

SEQ ID NO: 51126 - DNA, 201 bp, Homo sapiens
gtaattaaaaggctgaagaccgagtgctgtagaacagggcttctcaaggtgtggtccgcaaagcagcaaagcagcagcttctcctgggagcttattagaartacaatcggagcctcaccagtgggccgggaatctgttgtaacaagcccttgggggattcagatgcttgctctccttacagtttgagaaacactgcaccaa

SEQ ID NO: 51127 - DNA, 201 bp, Homo sapiens
cctgccttggtaccgaactagagagcttctgggtacccaagcaggctgattggagaggcaggagcacgagagactgaggcccccactccccactgcagggwtgggtgtctccacagtgacggctgcccgcatcctcaagggtcagctccaccacaaccctggggaggagaccaggctggagatggacaagttccccttcgt

SEQ ID NO: 51128 - DNA, 201 bp, Homo sapiens
catatccaagatctacaggctgaagactacagagtgctgataaaaccgaagaactctgactgaatgagtggagagacgtggtgtcttcatgactgggcaaytccatgtggtatagacgtaaaccctcccacattgatctgtggatttaataccatacctatcaaaaacacagtggtggaggacagatcagggatcgccagg

SEQ ID NO: 51129 - DNA, 201 bp, Homo sapiens
ccttggtaccgaactagagagcttctgggtacccaagcaggctgattggagaggcaggagcacgagagactgaggcccccactccccactgcagggatggktgtctccacagtgacggctgcccgcatcctcaagggtcagctccaccacaaccctggggaggagaccaggctggagatggacaagttccccttcgtggcc

SEQ ID NO: 51130 - DNA, 201 bp, Homo sapiens
gacttcagaaatgtgccctgtgtgggaagtggcattttgtgagcaccattgggtaccaggcactttcgcacattacctttgatactcacctaccccctacyctccagcattttgcagttaaggagactgaggctcagagggcagacaccttaggattactcctcccctaggtctctatgcctctctgctttgacccaggga

SEQ ID NO: 51131 - DNA, 201 bp, Homo sapiens
agagagcttctgggtacccaagcaggctgattggagaggcaggagcacgagagactgaggcccccactccccactgcagggatgggtgtctccacagtgayggctgcccgcatcctcaagggtcagctccaccacaaccctggggaggagaccaggctggagatggacaagttccccttcgtggccctctccaaggtgagc

SEQ ID NO: 51132 - DNA, 201 bp, Homo sapiens
agcccctgcagggaagagactcccttgacagcttccaccttaccccttgctccccaagagccctgtgcattggtgcgccacttcaccctgtgctccctaayagccctgtgcatcagtgcataaccacttctcagacaggaaacacgatcttgcactctgaacccacagctctctgttccaccccctttgctgggagccagg

SEQ ID NO: 51133 - DNA, 201 bp, Homo sapiens
gttcctcacgccccagtccccatggtgtgagtgtaggcggggtgggtgccactggggcgaaggcctggccatctcctgaccctcctctcccacctgcagaygtacaacaccaatgcccaggtccctgacagcgccggcaccgccaccgcctacctgtgtggggtgaaggccaatgagggcaccgtgggggtaagcgcagcc

SEQ ID NO: 51134 - DNA, 201 bp, Homo sapiens
caaaacatgtcagctaggcgaaggagcttttttcctgcttcggtggtcctcaggaagagtctgagggctctggaggtttgggggtgatagagcatctacckgtcaaggctcagcgagttgagcccagggtctagctggggacaggcatcgctgggtacttcattctaaagattgcacagcccctgcagggaagagactccc

SEQ ID NO: 51135 - DNA, 201 bp, Homo sapiens
tgtggggtgaaggccaatgagggcaccgtgggggtaagcgcagccactgagcgttcccggtgcaacaccacccaggggaacgaggtcacctccatcctgcrctgggccaaggacgctggtgagtcgggggagcagtggggagcagggccagcttcgtggcctgtccaggcctcagtctttctgactgtgtcatgggaaggg

SEQ ID NO: 51136 - DNA, 201 bp, Homo sapiens
ctttagcggggagggggaggggagggaggaggcctctgggacaccccgatctgtggataaagccaaacccgcccctcctgcaccccagggaaatctgtggkcattgtgaccaccacgagagtgaaccatgccacccccagcgccgcctacgcccactcggctgaccgggactggtactcagacaacgagatgccccctgag

SEQ ID NO: 51137 - DNA, 201 bp, Homo sapiens
ctacgcccactcggctgaccgggactggtactcagacaacgagatgccccctgaggccttgagccagggctgtaaggacatcgcctaccagctcatgcatracatcagggacattgacgtgagtgctcgggggcagccgggcagggacggggtgaggcggggcctctggtgggcaggaggcctcaggcccaggctggcccg

SEQ ID NO: 51138 - DNA, 201 bp, Homo sapiens
cgcccactcggctgaccgggactggtactcagacaacgagatgccccctgaggccttgagccagggctgtaaggacatcgcctaccagctcatgcataacwtcagggacattgacgtgagtgctcgggggcagccgggcagggacggggtgaggcggggcctctggtgggcaggaggcctcaggcccaggctggcccggag

SEQ ID NO: 51139 - DNA, 201 bp, Homo sapiens
cagggtgagaatatgggacacgtggacactagcccctcttccatagcctggcaacatctacaaaacatgtcagctaggcgaaggagcttttttcctgcttyggtggtcctcaggaagagtctgagggctctggaggtttgggggtgatagagcatctacctgtcaaggctcagcgagttgagcccagggtctagctgggga

SEQ ID NO: 51140 - DNA, 201 bp, Homo sapiens
gactccaggagtccaggttccaagccgaggtcactggggcttctgggcatcttggaaccctgcagaagtgatggctcctgtctcttttaggtgatcatggkgggtggccggaaatacatgtaccccaagaataaaactgatgtggagtatgagagtgacgagaaagccaggggcacgaggctggacggcctggacctcgtt

SEQ ID NO: 51141 - DNA, 201 bp, Homo sapiens
cgctggctcctgcagccccaggcccggagagaggcctccgctgaccccacctgagccccaatcttccgccggacacttctctgtactttggagagctaagrtcctgccccagtgctgccagggtgcagggaatgatggcaggaagcaggcagctaggtagtcctgtggctctggggggcttcagtgggcagtgggcctggt

SEQ ID NO: 51142 - DNA, 201 bp, Homo sapiens
ctattggtggtggtgatagtggtgttatgtaataacctccagaccctgggtcaggccccaggctcacttctgggggagtagtggggactatggtgccttcygtgccttcaaggtgctctcaggctggtggggaagggagacaggcaaatagttttggggtctctgctaaacatccggatgtagggcaaccctgtgatggtg

SEQ ID NO: 51143 - DNA, 201 bp, Homo sapiens
ggctggacggcctggacctcgttgacacctggaagagcttcaaaccgagatacaaggtagcctgtgctggggccatgtggctgcagaggtggcctgtgatkgggagaggctgtgtgacccctgctctgaagttctgttgtcctctgtagaaagggcatcggaaatctttcctccatgggctcaaatggcctaagagatata

SEQ ID NO: 51144 - DNA, 201 bp, Homo sapiens
ctcctgaccctcctctcccacctgcagacgtacaacaccaatgcccaggtccctgacagcgccggcaccgccaccgcctacctgtgtggggtgaaggccartgagggcaccgtgggggtaagcgcagccactgagcgttcccggtgcaacaccacccaggggaacgaggtcacctccatcctgcgctgggccaaggacgct

SEQ ID NO: 51145 - DNA, 201 bp, Homo sapiens
tttgtcagggacagcctgagcaggggacaggaacttgaaggaaattcgaggggagggaagatgtttcaggtgagggggtgggagatgaggagggggggccrcaggggccacgtcaaggggcacaagccagggagtgagtgaggacggaggacctgtgtgaggatccctttctttcctcctcttcctttctctcccagcccc

SEQ ID NO: 51146 - DNA, 201 bp, Homo sapiens
agccaaacagcaagtctgttatttgggagtttaatgagcccgtgtgaagtcgctgccgggctggaaacgatgaggctccctgcaggaagattgggggcttygttttccactctgaagatgccaagaggtcaggttctgtgggaacagttgtggggggcggggcaagggacccgtgacctggggtccccttctccttcttct

SEQ ID NO: 51147 - DNA, 201 bp, Homo sapiens
acaggtggccagggtttattgcagccttggtatgaagttgagtcagaatgtatcttaaatgcttagtgcctgacacacagggaacgctctgtaaatggtcygattcttattcgagtgggagttctgtggattccgggaagccaagtaaggtaagttatcagctcctccaatatccctagaagcgccaaaccaccgtcccaa

SEQ ID NO: 51148 - DNA, 201 bp, Homo sapiens
atctttcctccatgggctcaaatggcctaagagatatacaagcagtagatagtcagtgactaatcatttccttcccttggaggggataccagagagaggcrgatggtgaggaggaggctgggccagggaataacctgcgtggacattgagtcaccctgagcacctattgtatgtaggcacctggcggggcatgcgtgaggc

SEQ ID NO: 51149 - DNA, 201 bp, Homo sapiens
taatcatttccttcccttggaggggataccagagagaggcggatggtgaggaggaggctgggccagggaataacctgcgtggacattgagtcaccctgagyacctattgtatgtaggcacctggcggggcatgcgtgaggcacagaggctgagtcagatggccaaggaaacatggaatgctgtgtgcctgcatgggggacg

SEQ ID NO: 51150 - DNA, 201 bp, Homo sapiens
gaggctgggccagggaataacctgcgtggacattgagtcaccctgagcacctattgtatgtaggcacctggcggggcatgcgtgaggcacagaggctgagycagatggccaaggaaacatggaatgctgtgtgcctgcatgggggacgcctggctctgcaggcgccctggggggacagatgacagggaggagccaagaagc

SEQ ID NO: 51151 - DNA, 201 bp, Homo sapiens
gggtcctcagggagagatttttaagtgagggaaggaaacaagtaaaggcctcagactctgatagctgctggggtcagtccttccgactctccctagccccyggcatgtgctgacacagcccttcctcctagcactcccacttcatctggaaccgcacggaactcctgacccttgacccccacaatgtggactacctattgg

SEQ ID NO: 51152 - DNA, 201 bp, Homo sapiens
tcccgttcccgactgtttccatagaacctagcacagagatactcagcaggtgctctgtaggtgtttgggagtgaggaatgaatgaacaaagttgaatgaasaagcatcgggccctcccccggggctcaaatgggagagaggagcttcgtagcctgctccccctcccaccccagcaccccgtttcatcccttctgactaatc

SEQ ID NO: 51153 - DNA, 201 bp, Homo sapiens
ctcagcctcctcctcctggggctgatcctgggcctcctttgtttcttcacttgccgcctggccaggccgctcaggtaggggaactcagctggcctgactcsccctgcatcccgccaaattccctgccctaagctcgttcagcttccatttgttctcgtgagatggagcaagcggggcactcatttctcttactcttcatgg

SEQ ID NO: 51154 - DNA, 201 bp, Homo sapiens
gagccttactataatccccagcactggcccactgccctctagggaagtccttccttggatctgacctgcagcccactctgaaaccaccacacattcctgcrcaagcacttcatccagctcttcatgacagccataaataacttcctccagtaatgaatacagtcctggccagcaaggcttgccagagatgctgggcttggc

SEQ ID NO: 51155 - DNA, 201 bp, Homo sapiens
aggggagtggggagagccgggattggccaatgccctgtcttgaggatgagttgaaggaggggattatgggtgggggtggccagggtgcgcccacctggccrggggcagagccaggtcttgaatgccaggtcttgaatctgggatcctcccctccctgccactgcaagccccaagtgagttgcactgcagggctggctacaa

SEQ ID NO: 51156 - DNA, 201 bp, Homo sapiens
actgcctcacacttgcccacctgcctccctgacattacctacctaccttctgagcttgcggtttctgggctagatgcagtgaggccatgtaagaggggctyaaattccacttgaatgattgtgtggggcttgggccagccctcagggggctcagggtgagaatatgggacacgtggacactagcccctcttccatagcctg

SEQ ID NO: 51157 - DNA, 201 bp, Homo sapiens
gagtccaggttccaagccgaggtcactggggcttctgggcatcttggaaccctgcagaagtgatggctcctgtctcttttaggtgatcatggggggtggcyggaaatacatgtaccccaagaataaaactgatgtggagtatgagagtgacgagaaagccaggggcacgaggctggacggcctggacctcgttgacacctg

SEQ ID NO: 51158 - DNA, 201 bp, Homo sapiens
gatccccagaatttcagttggaaggcctttagaagctggctcggtcaactgggctcttggtgcaccagggagactgaggcccagagaggagaagaggcttrcccagggtcacacaattgcttagggcagagtggactgggaattcagtctcctggccttaagctacatgatctttccaaaggcaaccactctcctgaattt

SEQ ID NO: 51159 - DNA, 201 bp, Homo sapiens
tccaggttccaagccgaggtcactggggcttctgggcatcttggaaccctgcagaagtgatggctcctgtctcttttaggtgatcatggggggtggccggraatacatgtaccccaagaataaaactgatgtggagtatgagagtgacgagaaagccaggggcacgaggctggacggcctggacctcgttgacacctggaa

SEQ ID NO: 51160 - DNA, 201 bp, Homo sapiens
gcctcagactctgatagctgctggggtcagtccttccgactctccctagcccccggcatgtgctgacacagcccttcctcctagcactcccacttcatctrgaaccgcacggaactcctgacccttgacccccacaatgtggactacctattgggtaagtggagggggtggaggggaggatgcatggctcggagcctggtg

SEQ ID NO: 51161 - DNA, 201 bp, Homo sapiens
actctgtgttccaagtaacagaaaagccaagacgcacaatggggaaattaattggctcatgtagccaggatgttcagaggaaggcttcaggcatggctgcmtctaggagcccaagtgatgctatcaaagactcaaggtctctacctttctctagtccatctctgagaggttgcttcctcttcaggctatacaaagtgccct

SEQ ID NO: 51162 - DNA, 201 bp, Homo sapiens
ggggagcctgcattccctgagacaccccagcttccttggagtcctcctagccgggtcacagcctctcagcatccacatcctcctggcgtcctcctcaggtytcttcgagccaggggacatgcagtacgagctgaacaggaacaacgtgacggacccgtcactctccgagatggtggtggtggccatccagatcctgcggaa

SEQ ID NO: 51163 - DNA, 201 bp, Homo sapiens
cctgcattccctgagacaccccagcttccttggagtcctcctagccgggtcacagcctctcagcatccacatcctcctggcgtcctcctcaggtctcttcdagccaggggacatgcagtacgagctgaacaggaacaacgtgacggacccgtcactctccgagatggtggtggtggccatccagatcctgcggaagaaccc

SEQ ID NO: 51164 - DNA, 201 bp, Homo sapiens
ctgagacaccccagcttccttggagtcctcctagccgggtcacagcctctcagcatccacatcctcctggcgtcctcctcaggtctcttcgagccaggggmcatgcagtacgagctgaacaggaacaacgtgacggacccgtcactctccgagatggtggtggtggccatccagatcctgcggaagaaccccaaaggcttc

SEQ ID NO: 51165 - DNA, 201 bp, Homo sapiens
cctgagacaccccagcttccttggagtcctcctagccgggtcacagcctctcagcatccacatcctcctggcgtcctcctcaggtctcttcgagccagggkacatgcagtacgagctgaacaggaacaacgtgacggacccgtcactctccgagatggtggtggtggccatccagatcctgcggaagaaccccaaaggctt

SEQ ID NO: 51166 - DNA, 201 bp, Homo sapiens
gagacaccccagcttccttggagtcctcctagccgggtcacagcctctcagcatccacatcctcctggcgtcctcctcaggtctcttcgagccaggggacrtgcagtacgagctgaacaggaacaacgtgacggacccgtcactctccgagatggtggtggtggccatccagatcctgcggaagaaccccaaaggcttctt

SEQ ID NO: 51167 - DNA, 201 bp, Homo sapiens
aggggacatgcagtacgagctgaacaggaacaacgtgacggacccgtcactctccgagatggtggtggtggccatccagatcctgcggaagaaccccaaasgcttcttcttgctggtggaaggtagggaccccgggtctgctgagagggggctgctggaaacacggccctggtgtcaggatggagaagtccagctcttaaa

SEQ ID NO: 51168 - DNA, 201 bp, Homo sapiens
gacatgcagtacgagctgaacaggaacaacgtgacggacccgtcactctccgagatggtggtggtggccatccagatcctgcggaagaaccccaaaggctkcttcttgctggtggaaggtagggaccccgggtctgctgagagggggctgctggaaacacggccctggtgtcaggatggagaagtccagctcttaaaggga

SEQ ID NO: 51169 - DNA, 201 bp, Homo sapiens
gaactcctgacccttgacccccacaatgtggactacctattgggtaagtggagggggtggaggggaggatgcatggctcggagcctggtggccggagctgygtgtggccagcacctggggacaaggccctagcctgacgcccacttaggggcctctgctcttgggcttcaggacctgggagaggcaaggaagggggttctg

SEQ ID NO: 51170 - DNA, 201 bp, Homo sapiens
tgtaaatgcacacacactctagcggccccatcgagtccaggctgtgaccctctgccttggggccacagtgctgtgtgctgagccctgcaggctggaggcaractgactgatggatttgaaccccagatctgccacttctcagctgacaatagcaagttatggaacacctctgggcctcagtgctcctcatctgtgaaacgg

SEQ ID NO: 51171 - DNA, 201 bp, Homo sapiens
aggcccctggcaggctctcagcaggtgtttcccctggcccacagctcacaacaactaccaggcgcagtctgctgtgcccctgcgccacgagacccacggcrgggaggacgtggccgtcttctccaagggccccatggcgcacctgctgcacggcgtccacgagcagaactacgtcccccacgtgatggcgtatgcagcctg

SEQ ID NO: 51172 - DNA, 201 bp, Homo sapiens
ggctaaggcaggagaatcacttgaacccgggaggcagaggttgcagggagccgagatcgcaccactgcactccagcctggacaacagagtgagactctgtstcaaaaaaaaaaaagaaaagaaaagaaaaagaaaaaagaaaaaaaaaggaattgggggcctaattctgggcccacaaaaatcacccagataaggatcctc

SEQ ID NO: 51173 - DNA, 201 bp, Homo sapiens
ccacagatcaagttgcatctgactagagagcctgtcctctaccctatttcctgcacaagtctttttctttgtaatgcaacaagcgctactcagctcagatycagtgggacacagggaaaggggctgtagtgtagcccagccttgctgagggagacccctgcctcgccaaagcacttcgctcacaaaggctgaaactggcct

SEQ ID NO: 51174 - DNA, 201 bp, Homo sapiens
gctatccttaccccgccaagtaactgcctctctctgtgtttagagaaagagaaagaccccaagtactggcgagaccaagcgcaagagacactgaaatatgycctggagcttcagaagctcaacaccaacgtggctaagaatgtcatcatgttcctgggagatggtgaggcccaggggcctgtgggaggggtggaacaggac

SEQ ID NO: 51175 - DNA, 201 bp, Homo sapiens
tggggaagggagacaggcaaatagttttggggtctctgctaaacatccggatgtagggcaaccctgtgatggtggccgcagggcaggtggcagagaagtcrgcgctggtcttggccccacccttcccttccccagtccccttccccctcactttcactaccctatccccagaccccccactccttcaagaaggcccctccc

SEQ ID NO: 51176 - DNA, 201 bp, Homo sapiens
agcctaggcagtgatgaggcccagaaacctgcctctcccttgggactgaacatgggcacagctctgtgcctcataaaaggttcctaccccacacctggggygggccctggtacagtctagcttagttcctcctgctttcctccaccgcaggctcagtgcggggcccgcggcctctgcgtctttctctcagcttaccatgat

SEQ ID NO: 51177 - DNA, 201 bp, Homo sapiens
caggttgaatggctgcgtaaaatgcctaggctgtggtgctagctcagagtggtgcccggcgaaggttcctgtccttccctagctaacaaaggttaatccascagcagtgttgtggggctggggagcagatcttcctcccctcctccctcaccgaggcctttgccttggtgtcccaaggaggcagaattgaccacgggcacc

SEQ ID NO: 51178 - DNA, 201 bp, Homo sapiens
gactcctgtgtcagaacaggctcaggttcaaatcccgtggccttaggcaaaatgactttcccacattgagcctccttttcctcttctgtgaaatgggagcrttcaagccagcctggaagggagatggaaaagctgcgtgcgcagcgccaggcccctggcaggctctcagcaggtgtttcccctggcccacagctcacaaca

SEQ ID NO: 51179 - DNA, 201 bp, Homo sapiens
ttgcctttgtacctgccatcccctcccctgcagcaacctctccctgtttgtgttgccagttggcatcatggctgtttttctagagcttgctttggatatcytgaaccctttgtaatctgatcatccacatagcatctggctctgagtttcagttcctggagggtaggagccccatctgagtcactcgtgaattcccatgcc

SEQ ID NO: 51180 - DNA, 201 bp, Homo sapiens; identical to SEQ ID NO: 10595

SEQ ID NO: 51181 - DNA, 201 bp, Homo sapiens
cggccaggtttgtttaaaatatatcatgaaccaggctgtgttctaagcagctcacatgtattttttcatttatccttgcacctgaggctcagagagattawgttcatgtctcctaggtcacctggttggtgtcacgtgcaaatattttaatatctcccaggacatgtgtgttccaaataacataatatgggaaccacctcc

SEQ ID NO: 51182 - DNA, 201 bp, Homo sapiens
ttcaatatgagaaagcagcctcattctctgccccacccaaacctctgcgtgcaccttacagctccctgttctccaggaaagacgttcacggcttctggacyttggcatgggctgttccagcagcttagacttccttccctccacttctgctgaaacacttcagcacatcctcaagactccttccctgaccatgcctcatgg

SEQ ID NO: 51183 - DNA, 201 bp, Homo sapiens; identical to SEQ ID NO: 10596

SEQ ID NO: 51184 - DNA, 201 bp, Homo sapiens
ccaatcatgatctgagcagaagctggcaggagggagccccgaatctgctggaggaaactcggtgctggggggactttagagaagaaatgacagcggtcatraatcattgtaacagtaacagctcatattaactgagtggcaggcactgttcaagcaagtcagatacattaatcatttaatcctcatatcagccctaggagg

SEQ ID NO: 51185 - DNA, 201 bp, Homo sapiens
tactcagcaggcaggtgagcttctgggttctagagtctcagagctggaaggactgtctgcagccatccaggtgaacaggtctctgggaaatcccaaagcayatggtggcttgatcgagtgggcggggaagggtccatccgttctctgctccagcccctcatctgccccacttgcccatctctgccccgcagtccatccacc

SEQ ID NO: 51186 - DNA, 201 bp, Homo sapiens
aaggcctggccatctcctgaccctcctctcccacctgcagacgtacaacaccaatgcccaggtccctgacagcgccggcaccgccaccgcctacctgtgtrgggtgaaggccaatgagggcaccgtgggggtaagcgcagccactgagcgttcccggtgcaacaccacccaggggaacgaggtcacctccatcctgcgctg

SEQ ID NO: 51187 - DNA, 201 bp, Homo sapiens
gaccggtattcaggaaaggaaactgatctgtcacctcacccctgcctggggcagcccagcatgtgtcagccccctaatccccgggtactgcccaggacaarcagtaacagggacaaccaccctccaacatggggaggcctgcaacagctctggggcagaaggaggctcagggaggtagcaacttaccacccagcagctcgt

SEQ ID NO: 51188 - DNA, 201 bp, Homo sapiens
ctcccacctgcagacgtacaacaccaatgcccaggtccctgacagcgccggcaccgccaccgcctacctgtgtggggtgaaggccaatgagggcaccgtgrgggtaagcgcagccactgagcgttcccggtgcaacaccacccaggggaacgaggtcacctccatcctgcgctgggccaaggacgctggtgagtcggggga

SEQ ID NO: 51189 - DNA, 201 bp, Homo sapiens
taaaaaatataagaaaaaaaaatgaatagaagcacaaaggaagggaagggatcacccaaggtcctatagctcatacatgggttaatccagaattggaaccygggcagccttgctccagagtccggtctcacttaatgagtactagataattctctgcatgtcagatgggtacactcttcttgaacctgctagttcttttgg

SEQ ID NO: 51190 - DNA, 201 bp, Homo sapiens
ggggagcaaggcaggagttgagcaaatagcaggaacagactgtgtgacacttgctgggaggctccgaggctccagctccctgagcttagaagtgcggagtktatctatcccctgcgcgattcctgggggaagggaaggacaggcgaaggggcatggcggggcagtcctggtgtctccaggaccagggtcagggggaggcca

SEQ ID NO: 51191 - DNA, 201 bp, Homo sapiens
ccttggcttcctagagtgctgggattacaggtgtgagccaccgcatctggtcctgttaatggtttttctttagaattcattgtgctatggctggtagtggygtggggtgggattcggggagccatgcacttcttgcccttaaaactagcagccagggaaaacgtatggctcctggatcctccctctcaaatcagtcccaaa

SEQ ID NO: 51192 - DNA, 201 bp, Homo sapiens
tttgctaacatctttgctcatttcttttgcatgtttctcacagtttatggagactttttgtttgcttcattttgtttcgtttttttgagacagggtctccwctgttgcccaggctggagtgcagtggcgtgatctctgctcactgcagcctcgacctcccgagctcaagtgatcctcccacttcagcctcctgagtaactg

SEQ ID NO: 51193 - DNA, 201 bp, Homo sapiens
ggacatgcagtacgagctgaacaggaacaacgtgacggacccgtcactctccgagatggtggtggtggccatccagatcctgcggaagaaccccaaaggcytcttcttgctggtggaaggtagggaccccgggtctgctgagagggggctgctggaaacacggccctggtgtcaggatggagaagtccagctcttaaaggg

SEQ ID NO: 51194 - DNA, 201 bp, Homo sapiens
ttcttaatccttccctgcttcctcctggaagcgtcctcaagctaataacttagctctctcctccatcgttcagcagctggatacactctgtaatttattcyacttatgtgtttgttatttcaactggtttttcacatagagtgtttccactggggtcttttaaccattcctctttctgttttgctaacatctttgctcatt

SEQ ID NO: 51195 - DNA, 201 bp, Homo sapiens
agctaacaaaggttaatccagcagcagtgttgtggggctggggagcagatcttcctcccctcctccctcaccgaggcctttgccttggtgtcccaaggagrcagaattgaccacgggcaccatgaaggaaaagccaagcaggccctgcatgaggcggtggagatggaccgggccatcgggcaggcaggcagcttgacctcc

SEQ ID NO: 51196 - DNA, 201 bp, Homo sapiens
ggccatcgggcaggcaggcagcttgacctcctcggaagacactctgaccgtggtcactgcggaccattcccacgtcttcacatttggtggatacacccccygtggcaactctatctttggtaggtgggccttctttggggtggacactcctggggtctcctgtctacccacctgggagcaggagtgggtgggagagccagc

SEQ ID NO: 51197 - DNA, 201 bp, Homo sapiens
gccatcgggcaggcaggcagcttgacctcctcggaagacactctgaccgtggtcactgcggaccattcccacgtcttcacatttggtggatacaccccccrtggcaactctatctttggtaggtgggccttctttggggtggacactcctggggtctcctgtctacccacctgggagcaggagtgggtgggagagccagca

SEQ ID NO: 51198 - DNA, 201 bp, Homo sapiens
aggggttaccaagccaccaaggagcctaatctgggggctggggactgtactcctggggccccagcatgacccctgaacaccccctccctgtgcaggtctgkcccccatgctgagtgacacagacaagaagcccttcactgccatcctgtatggcaatgggcctggctacaaggtggtgggcggtgaacgagagaatgtctc

SEQ ID NO: 51199 - DNA, 201 bp, Homo sapiens
gagtgacacagacaagaagcccttcactgccatcctgtatggcaatgggcctggctacaaggtggtgggcggtgaacgagagaatgtctccatggtggacyatggtgagacctccaggacccagggctgggaggggacagggcacccctcggggatgggcttgggaatagggtgtcagcttgtggtcaaggtcaggggtct

SEQ ID NO: 51200 - DNA, 201 bp, Homo sapiens
ctgtctcctggagagtgattcgcctccattgtgttcagagacataaagtacttggaacggggcccagtaaagaataaaccgtgtttctattattagccttrttatggctacacaatagttaaggcgggaacaataggaagtgtgaggaagtgataaagattccagaaaccttccagtgctaacagcccttgcccaccgcag

SEQ ID NO: 51201 - DNA, 201 bp, Homo sapiens; identical to SEQ ID NO: 10622

SEQ ID NO: 51202 - DNA, 201 bp, Homo sapiens
cctcccgagtagctgggattacaggcatgcaccaccacacccagctaattttgtatttttagtagagacggggtttctccgtgttggtcaggctggtctcraactcccgacctcaggtgatctgcctgcctcagccacccaaagtgctgggattacaggtgtgagccaccacgcccggcccttcttgttcttttctttgaa

SEQ ID NO: 51203 - DNA, 201 bp, Homo sapiens
ggagtgccatagcgccatctcggctcactgcaacctccgcctcccaggttcaagctattctcctgcatcagcctctggagtagctgggactacaggcatgyaccaccatacctggctaatttttgtatttttagtagaaatggggtttcaccatgttggccaggctggtctcaaactcctgacctcaggtgatctgcctgc

SEQ ID NO: 51204 - DNA, 201 bp, Homo sapiens
gacctcaggtgatctgcctgcctcggcctcccaaagtgctgggattacaggtgtgagctaccacgcccggcctactttattaatttttaaccttttttgcygcattatataatttttgatatgtggtgtttttaatcattcagttctaagtaattttaagtttctactatgacttttctttgatccttgaaatttttaggg

SEQ ID NO: 51205 - DNA, 201 bp, Homo sapiens
tctccgtgttggtcaggctggtctcgaactcccgacctcaggtgatctgcctgcctcagccacccaaagtgctgggattacaggtgtgagccaccacgccyggcccttcttgttcttttctttgaacttgaatttgttttgaaaaactaaactttactaaattatttgctcagtcttcagatatcttgaatacaatctgtg

SEQ ID NO: 51206 - DNA, 201 bp, Homo sapiens
tttgcttcattttgtttcgtttttttgagacagggtctccactgttgcccaggctggagtgcagtggcgtgatctctgctcactgcagcctcgacctcccragctcaagtgatcctcccacttcagcctcctgagtaactgggactatagttgtgcaccaccacggccagctaattttttttgtattttttgtagagatgg

SEQ ID NO: 51207 - DNA, 201 bp, Homo sapiens
aaccctcatgtgaccgccaccacaccccaagaaccaggcatccagggatgattccataaattgaaacctggtgctgtgccctcctctgccccccactacaygggaggtggtgatggccaagtgtcgtctgcctgccctgcgtattcacatggtcacagatgggtacatatctgtacactcaaccaccagcatgcccggcaa

SEQ ID NO: 51208 - DNA, 201 bp, Homo sapiens
tggccccagtgtgcaagccatggagggagcggagaagccctccacagtgagtcccccttggctgggggatggaatagattggggaagggaggctggaggamggaatagattggggaagggaggctggagggacctctggaaggaccccaagctccagctccttggagtggcctctggccctttaaatctgagctgctggcc

SEQ ID NO: 51209 - DNA, 201 bp, Homo sapiens
ccgcacggaactcctgacccttgacccccacaatgtggactacctattgggtaagtggagggggtggaggggaggatgcatggctcggagcctggtggccrgagctgcgtgtggccagcacctggggacaaggccctagcctgacgcccacttaggggcctctgctcttgggcttcaggacctgggagaggcaaggaaggg

SEQ ID NO: 51210 - DNA, 201 bp, Homo sapiens
cttcctcctagcactcccacttcatctggaaccgcacggaactcctgacccttgacccccacaatgtggactacctattgggtaagtggagggggtggagkggaggatgcatggctcggagcctggtggccggagctgcgtgtggccagcacctggggacaaggccctagcctgacgcccacttaggggcctctgctcttg

SEQ ID NO: 51211 - DNA, 201 bp, Homo sapiens
tagagagccacaggggctctgggaaagggaggaggattctgggaggacacggagtcagcgaagaggaggattgagtttcaacaaacccagagctgaagctkcagactgaagcctagggtagtggatgtgggctttgccaagagataggcccagagggcagctctggggctgaactctagccccccaccgctgtccctcacc

SEQ ID NO: 51212 - DNA, 201 bp, Homo sapiens
agagagccacaggggctctgggaaagggaggaggattctgggaggacacggagtcagcgaagaggaggattgagtttcaacaaacccagagctgaagcttsagactgaagcctagggtagtggatgtgggctttgccaagagataggcccagagggcagctctggggctgaactctagccccccaccgctgtccctcaccc

SEQ ID NO: 51213 - DNA, 201 bp, Homo sapiens
agagctgaagcttcagactgaagcctagggtagtggatgtgggctttgccaagagataggcccagagggcagctctggggctgaactctagccccccaccrctgtccctcaccctggtgtactcttgagggtctgggtttgtggtttcagtttcttcctctgcaaaagggctgctagtaccccttggtagagttaggggag

SEQ ID NO: 51214 - DNA, 201 bp, Homo sapiens
agcccctggcatattgtggctgctcaataaacagtgttccagcgaatgttggttgaataacatatagggaaagccctaggcatagaaggtgtttagtcaaratcagctggatcttagagacatagggcagacgcctgagaaaggctgggacagctcacttggggtgacgaggtctcccatgaaagcatttggggtctggat

SEQ ID NO: 51215 - DNA, 201 bp, Homo sapiens
gatcttagagacatagggcagacgcctgagaaaggctgggacagctcacttggggtgacgaggtctcccatgaaagcatttggggtctggatttcagggcrgtgctggtttcctctctggccacagcctgcaagcagcgagccatataggagaggaaagtttggctgggtgtggggcctcacccgggagtcccagcacttt

SEQ ID NO: 51216 - DNA, 201 bp, Homo sapiens
aaggcagagcttgtacctgcaagtcctgtcacagggctggcacacaatagatgcatggaacctggtggtcaaagggttgtaaacttcaatggacaacaacytgtcagaaagtgaggatctgagtcctgcagggctattagacaagtccagccccaaaactttctgtaattctagaagtttatagattccaagtagaaagtg

SEQ ID NO: 51217 - DNA, 201 bp, Homo sapiens
aaggtctctacctttctctagtccatctctgagaggttgcttcctcttcaggctatacaaagtgcccttccccaccacttcacaccctcataacccagcargcagacagagtcttccagctggagccagtcagggtccacctggagctggaggcgggatcagtcccacccaaaccaggctgaaagggggagggtcacttcc

SEQ ID NO: 51218 - DNA, 201 bp, Homo sapiens
ctggaaaaaccagaagtgtgacctttattttatttttgcagagatggggccctgctatgttgctcagcctgggttcaagaagtctacccaccttggccccygaaagtgctgagattataggcatgaaccattgtgcctggcccacaagtgcaccctttaaaaagatctaccaggtgacccttttttagactgagtatcgct

SEQ ID NO: 51219 - DNA, 201 bp, Homo sapiens
tttgtcattcaggtgcatgaactttacctggccaggtctgcaaactgctgggcagagctcagcaaatattttatgttctttaaaaaagtttttaggtggcygaagcaaattgcttttactggaaaaaccagaagtgtgacctttattttatttttgcagagatggggccctgctatgttgctcagcctgggttcaagaagt

SEQ ID NO: 51220 - DNA, 201 bp, Homo sapiens
gtgtgggaagtggcattttgtgagcaccattgggtaccaggcactttcgcacattacctttgatactcacctaccccctactctccagcattttgcagttmaggagactgaggctcagagggcagacaccttaggattactcctcccctaggtctctatgcctctctgctttgacccagggaagggaggagaggacaggct

SEQ ID NO: 51221 - DNA, 201 bp, Homo sapiens
gcctgctgtgtgctgggttatgggagatccatcacaaactgccttcctaaggctgcagggggtgggggattgttgacttttgcggtgattaaacaactttwatttagttgctggtgtttttaaaccaggcaatttcattttatataaagataaggatttctggcttctcttgaaagatcagaagatgtggccatatggggc

SEQ ID NO: 51222 - DNA, 201 bp, Homo sapiens
gactggagagcagtggcatgaacatggctcactggagcctcgacatcctgggttcaagcacacctcctgcctcagtctcctaagtagctgggaccacaggygtgcaccaccacatccagatcatttttgatttttttttttttttttttggagacagagtcttgctctgtcacccaggctggagtgcagtggtgcaatctt

SEQ ID NO: 51223 - DNA, 201 bp, Homo sapiens
tggtgaaaccgcccatctctactaataatacaaaaattagccaggtgtggtcgtgggcgcctgtaatcctggctactcgggaggctgaggcaggagaatcrcctgaacctcggaggtggagtttgcagtgagccgagatcgtgccatttcactctggcctgggtgacaagagtaaaactcttgtctcaaaaaaaaaaaaag

SEQ ID NO: 51224 - DNA, 201 bp, Homo sapiens
tggaagccactgccagacacctactgctgtggatggggagactgagacccgggcaatcctcagaactgaagcgggggcctgtctttagcggggagggggargggagggaggaggcctctgggacaccccgatctgtggataaagccaaacccgcccctcctgcaccccagggaaatctgtgggcattgtgaccaccacgag

SEQ ID NO: 51225 - DNA, 201 bp, Homo sapiens
gcctgaacctcggaggtggagtttgcagtgagccgagatcgtgccatttcactctggcctgggtgacaagagtaaaactcttgtctcaaaaaaaaaaaaagaagaagaagaagaagaagaagaagattagactgggacttgggagattaccaaatacaggcagatgggaaagcacagtgagaagtctcccaggctggagtg

SEQ ID NO: 51226 - DNA, 201 bp, Homo sapiens
acacagtgctgttggcccctttcactgaacagacatctgaggccaagccactcatcctggcttgccttcacccgacatgtggcctggggcgagttccttcmcctccctatgcctcagtttccccacctgtgcagcagaaacagagagccacacttgcttgctcccagggccgtgggaggccgtgatgaggtcatggatgtg

SEQ ID NO: 51227 - DNA, 201 bp, Homo sapiens
atatgggttaagagcttgtagtttggagttggacaatttgggctcagaatcccagctctgctgcaggtctgctgtgtgacctcaggcaagttacttaaccyttctgtgcttttttcctcttcataaaatgtgaatgatactaagagtacctacctcaaagtgtaggagcacagtgaatgcagctgtcattctgctggtgac

SEQ ID NO: 51228 - DNA, 201 bp, Homo sapiens
aaaaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccagg

SEQ ID NO: 51229 - DNA, 201 bp, Homo sapiens
aaaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccaggt

SEQ ID NO: 51230 - DNA, 201 bp, Homo sapiens
accttgttggctaggctggtctcaaactcccaacctgaagtgatccgtccacctcggcctcccaaagtgctaggattataggcatgaccaccacgcccggscagcctttaacatttgaatggctgtttagctggatagaaaattcccagctcaatctttttttccttctgtagtttggtcaattcgacatttattccattt

SEQ ID NO: 51231 - DNA, 201 bp, Homo sapiens
aaatgacagtagatgtccactccactcaccagagggagtgcagtggagagccgtagaaacttctgcattgtaccttttgatttgcaaggttccttccctttttttttttttttttttttttgagacggagtcttgctctgtcacccaggctggagtgcagtggcgcgatcttggctcactacaacctccacctcccaggtt

SEQ ID NO: 51232 - DNA, 201 bp, Homo sapiens
tggcgcccgccaccacgcctggctaattttttgtatttttagtagagacagggtttcactgtgttagccaggatggtcttgatctcctgaccttgtgatcygcccgcctcggcctcccaaaatgctgggattaaaggcgtgagccaccgtgcccggccaggttccttcccttctaagacgctgatactggaggcagaatgg

SEQ ID NO: 51233 - DNA, 201 bp, Homo sapiens
aaccctgggctgcccccactgatctcagcctctctgtgcaaaattataagcccagaggagctgacccaggagggagaggccaacgtgactgaagcccctcmctttgtggagcgggcactctgtctagatacaagaggcccccaggaagctgcgatcacgggaaagtacacagggagctgagagagcagcatgacatgagga

SEQ ID NO: 51234 - DNA, 201 bp, Homo sapiens
atcctcagctggttagtggggagacctatccctgcccctgatgtgctgtgtgacactggggaggttgtgtaccctctctgtgtcttccttttctttttccttttttttttttttttgagatggagtctcactctgtcacccaggctggagtgcagtggcacgatcacagctcattgcaagctccacctcccgagttcacac

SEQ ID NO: 51235 - DNA, 201 bp, Homo sapiens
agcctagcagtttctctacattgtaaactataagaaatagaggtgtaaacagactatagcctacacttgtgccaatcaccaagttttgggggtttttttgyttttgtttttgtttttgtttttttttaagacagagtctcactctgtcgcccaggctggagtacagcattgtaatctcagctcactacaacctccgccacc

SEQ ID NO: 51236 - DNA, 201 bp, Homo sapiens
cagtgagccaagatcgcaccactgcactccagcctgggtgacagagcaagactccgtctaaaaacaaaaaacaaagaacaaacacgaaaaaacttaggccrggtgcaatggctcgcgcctgtaatcctagcactttgggaggccaaggcaggttgatcacttgagcccaggagtttgagaccagcctgggaaacatagcga

SEQ ID NO: 51237 - DNA, 201 bp, Homo sapiens
ctccaagctcaagccagagagacaccagcctcagtttctctacgtggcacatggggccagagcttcatcctccttgcccaggcagggtgcttacccaggarctcggtctagacctctaagacggggagagagcgtctacaccatggccccgagcctggccacattgggtatcaggtcccgtgtaggccccacatccctaga

SEQ ID NO: 51238 - DNA, 201 bp, Homo sapiens
gtgttagccaggatggtcttgatctcctgaccttgtgatccgcccgcctcggcctcccaaaatgctgggattaaaggcgtgagccaccgtgcccggccagkttccttcccttctaagacgctgatactggaggcagaatggagtttattatccctgctctacagccaaggaaacagcccttgaatattcagcgaggactct

SEQ ID NO: 51239 - DNA, 201 bp, Homo sapiens
gagctgacccaggagggagaggccaacgtgactgaagcccctcactttgtggagcgggcactctgtctagatacaagaggcccccaggaagctgcgatcaygggaaagtacacagggagctgagagagcagcatgacatgaggaccagccacagggcagcagccaggcatggcttcctgcagctctcattgccagaaccac

SEQ ID NO: 51240 - DNA, 201 bp, Homo sapiens
cccactgaggcagggctccctgtgcctgggatggctgaggcacgagctctgccattggtgaccgaggttgtcctggcatgtgactgagatgggggtggcaygtacactggacatggagctggacggacctggcctgaatcccagcgctcccacgtggttgctttgtgaccctgaacctccctcctgttctgagccttggtt

SEQ ID NO: 51241 - DNA, 201 bp, Homo sapiens
atatatctgaggagtaggagtggagagatgagacttccctaagacttggaatgggtctaatgtattcaactggtcctcagatatttatagcctgctgtgtrctgggttatgggagatccatcacaaactgccttcctaaggctgcagggggtgggggattgttgacttttgcggtgattaaacaacttttatttagttgct

SEQ ID NO: 51242 - DNA, 201 bp, Homo sapiens
cctgggcactgcaggccccaggcatggtgtctctgggccctgctatctccctcccctgcgatctccctactgcgcctccctgctgcttctctcctgccacyagtcctctggcttcagtcctctgcccacagagttggtttggggcatcatgaccgtcctggagcctcagggacccccagagaagctttggcttctctgaac

SEQ ID NO: 51243 - DNA, 201 bp, Homo sapiens
agtactcagcaggcaggtgagcttctgggttctagagtctcagagctggaaggactgtctgcagccatccaggtgaacaggtctctgggaaatcccaaagyatatggtggcttgatcgagtgggcggggaagggtccatccgttctctgctccagcccctcatctgccccacttgcccatctctgccccgcagtccatcca

SEQ ID NO: 51244 - DNA, 201 bp, Homo sapiens
cccaggtgctcacatctcaagggccttcggggtgaggggagagggttccagaggcagtgttctggctgctcggctacttggaagccactgccagacacctrctgctgtggatggggagactgagacccgggcaatcctcagaactgaagcgggggcctgtctttagcggggagggggaggggagggaggaggcctctggga

SEQ ID NO: 51245 - DNA, 201 bp, Homo sapiens
aaacatcagaaacatgagaaataaggaaacaagagaaataaggaaaaacatttgcagcataaagtagaatgagagagtgtaaaaaataaaagagctgaaarcaaatattcaatatgagaaagcagcctcattctctgccccacccaaacctctgcgtgcaccttacagctccctgttctccaggaaagacgttcacggctt

SEQ ID NO: 51246 - DNA, 201 bp, Homo sapiens
tgtaggcggggtgggtgccactggggcgaaggcctggccatctcctgaccctcctctcccacctgcagacgtacaacaccaatgcccaggtccctgacagygccggcaccgccaccgcctacctgtgtggggtgaaggccaatgagggcaccgtgggggtaagcgcagccactgagcgttcccggtgcaacaccacccagg

SEQ ID NO: 51247 - DNA, 201 bp, Homo sapiens
aggattccagctccctaggagctcaccacggtgagagggtgacaacctatgattctctaaggctctgattaatttcaccaagggcttcatggcactgggtkctgggagcttggggaggagccgaaactgctgtctgggctggggtagggtagggagagggcagggggagggattcattggttggacagcatgggacattct

SEQ ID NO: 51248 - DNA, 201 bp, Homo sapiens
ctgcctccttgtaccagctcccaacccccccgccaacacttcgttaattgctcccagaaaaactctatgcttaaagttttccatgcttaaattctcagcckcactgtggcatgaaatcaattgtttgcattgaatttgacttctcaaattaaggggtaaaatttgagatgagagtagggggttagggaggagatgaggacg

SEQ ID NO: 51249 - DNA, 201 bp, Homo sapiens
ttatattttattttattttattttgagacagagtctcgctctgttgccaggctggagtacagtggcacgatctcagctcactgcaacctctaactctctarttcaagcgattatcctgcctcagcctcccgagtagctgggattataggcacacaccaccatgcccagctaatttttgtatttttagtagacacggggttt

SEQ ID NO: 51250 - DNA, 201 bp, Homo sapiens
cagggaatgatggcaggaagcaggcagctaggtagtcctgtggctctggggggcttcagtgggcagtgggcctggtcaaggctatggggtcctctctggtycctcacgccccagtccccatggtgtgagtgtaggcggggtgggtgccactggggcgaaggcctggccatctcctgaccctcctctcccacctgcagacgt

SEQ ID NO: 51251 - DNA, 201 bp, Homo sapiens
tccaactcaacatatccaaaaacaagttcctgattgtctccacctcacgcctcaaaagaccaccccaaacgccgaaaggctgaatgcttttttctttttcttttttttttttttctgagatggagtctcactctgttgcccaggctggactgcagtgatgcgatctcagctcactgcaaactctgcttcctgggttcaagt

SEQ ID NO: 51252 - DNA, 201 bp, Homo sapiens
ccttccccctcactttcactaccctatccccagaccccccactccttcaagaaggcccctccctctcccttctccaggactcccctgctccccaacccctygctggctcctgcagccccaggcccggagagaggcctccgctgaccccacctgagccccaatcttccgccggacacttctctgtactttggagagctaagg

SEQ ID NO: 51253 - DNA, 201 bp, Homo sapiens
ttttctgagatggagtctcactctgttgcccaggctggactgcagtgatgcgatctcagctcactgcaaactctgcttcctgggttcaagtgattctcctrcctcagcctctcaggtagctgggactacaggtgcacaccaccatgcccagctaatttttgtagagagagtttcaccatgttggccaggctggtctcaaac

SEQ ID NO: 51254 - DNA, 201 bp, Homo sapiens
gggtttcaccgtgttagccaggatggtctcgatctcctgacctcatgatccgcctgcctcggcctcccaaagtgctgggattacaggcgtgagccaccgcbcctggcctttctttctttctttctttctttctttctttctttctttctttctttctttctttctttctctctttctttctttttctttctttctttcttt

SEQ ID NO: 51255 - DNA, 201 bp, Homo sapiens
aaagtgctgggattacaggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatcc

SEQ ID NO: 51256 - DNA, 201 bp, Homo sapiens
agggaaatctgtgggcattgtgaccaccacgagagtgaaccatgccacccccagcgccgcctacgcccactcggctgaccgggactggtactcagacaacragatgccccctgaggccttgagccagggctgtaaggacatcgcctaccagctcatgcataacatcagggacattgacgtgagtgctcgggggcagccggg

SEQ ID NO: 51257 - DNA, 201 bp, Homo sapiens
aagtgctgggattacaggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatccg

SEQ ID NO: 51258 - DNA, 201 bp, Homo sapiens
ttacaggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagac

SEQ ID NO: 51259 - DNA, 201 bp, Homo sapiens
tacaggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagacc

SEQ ID NO: 51260 - DNA, 201 bp, Homo sapiens
acaggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagacca

SEQ ID NO: 51261 - DNA, 201 bp, Homo sapiens
ggcgtgagccaccgcgcctggcctttctttctttctttctttctttctttctttctttctttctttctttctttctttctttctctctttctttctttttctttctttctttctttctcttttctttctttctttctttcttttctttttctttcctttctttcctttcttttctctcgcatccgagtgaagagaccacca

SEQ ID NO: 51262 - DNA, 201 bp, Homo sapiens
ccagctgtgggctgccccaaagacctccctggctggagcctctccctgcacgcattcagccttccaccgtgggagaggaggctctgggagtccctgccctyagctgcacgaatacagcagggccctagtgccacagccggaaaagccctgggtttgaatcctgatgctgccacttcctggctctgtggccttcgggggaaa

SEQ ID NO: 51263 - DNA, 201 bp, Homo sapiens
gggtttcaccgtgttagtcaggatggtctcgatctcctgacctcgtgatctgcccacctctgcctcccaaagtgctgggattacaggcttgagccaccgcrcccggcctgtgccttccttttcttgttgtttgtgagagcaaggatgggccggccatgtctcctagtaccagggaggctccccctgcagagggctgaggga

SEQ ID NO: 51264 - DNA, 201 bp, Homo sapiens
taggtgatcatggggggtggccggaaatacatgtaccccaagaataaaactgatgtggagtatgagagtgacgagaaagccaggggcacgaggctggacgkcctggacctcgttgacacctggaagagcttcaaaccgagatacaaggtagcctgtgctggggccatgtggctgcagaggtggcctgtgatggggagaggc

SEQ ID NO: 51265 - DNA, 201 bp, Homo sapiens
gatggagtgcagtgacgtgatctcagctcactgcaaccttcgccacccaggttcaagtgatcctcctgcctcagcctcctgagtagctgggattacaggcrtgcgccgcaacacccggctaattttttgtattcttattagagacggggtttcatcatgttggccaggctgatctcgaactcctgacctcaagtgatccac

SEQ ID NO: 51266 - DNA, 201 bp, Homo sapiens
gtgtcacttgccttatccggcccagtccttagagcgaccctgaggggatgatgccagcaatgtcatttaacaggggaagagactgaggctgagggaggtgrcagagctagtacttggagcagctgggggttttttgtttgtttgtttttgagacggagtctagctctgtcacccaggctggagtgcagtggtatgatctca

SEQ ID NO: 51267 - DNA, 201 bp, Homo sapiens
cccgccaagtaactgcctctctctgtgtttagagaaagagaaagaccccaagtactggcgagaccaagcgcaagagacactgaaatatgccctggagcttyagaagctcaacaccaacgtggctaagaatgtcatcatgttcctgggagatggtgaggcccaggggcctgtgggaggggtggaacaggacacctagctagg

SEQ ID NO: 51268 - DNA, 201 bp, Homo sapiens
agatgcccaggcttacattggccaccagagacttgctttgcctgttttgagcctcatataaatggaatcatatagtatgtaccgatcagtgccctttcccyggcattctatcgtgagcattagcacatatcatttagtagtctccaaaaacaatagcctcttggaatccagttgtccagagccattgttgcttaaaccaga

SEQ ID NO: 51269 - DNA, 201 bp, Homo sapiens
cctctcccacctgcagacgtacaacaccaatgcccaggtccctgacagcgccggcaccgccaccgcctacctgtgtggggtgaaggccaatgagggcaccrtgggggtaagcgcagccactgagcgttcccggtgcaacaccacccaggggaacgaggtcacctccatcctgcgctgggccaaggacgctggtgagtcggg

SEQ ID NO: 51270 - DNA, 201 bp, Homo sapiens
ggctgattggagaggcaggagcacgagagactgaggcccccactccccactgcagggatgggtgtctccacagtgacggctgcccgcatcctcaagggtcrgctccaccacaaccctggggaggagaccaggctggagatggacaagttccccttcgtggccctctccaaggtgagccccatccccaagcccagttcaggt

SEQ ID NO: 51271 - DNA, 201 bp, Homo sapiens
tagacctggctcagatttgacttgaattcacatttcttatgaatgactgtctttctctatcccttccatagctccaaggcaaaatgtgtaccttaaaacarcttcagcagacctggtgtggtggctttagcaggcctggtatggtggctcacgcctgtaatcccagtgcgttgggaggctgaggtgggaggatcgcttgag

SEQ ID NO: 51272 - DNA, 201 bp, Homo sapiens
cagacgtacaacaccaatgcccaggtccctgacagcgccggcaccgccaccgcctacctgtgtggggtgaaggccaatgagggcaccgtgggggtaagcgyagccactgagcgttcccggtgcaacaccacccaggggaacgaggtcacctccatcctgcgctgggccaaggacgctggtgagtcgggggagcagtgggga

SEQ ID NO: 51273 - DNA, 201 bp, Homo sapiens
ccccaaggtctctaattcttgggcttaagcgatcctacagccttggcctcccagtcttgggattacaggcgtgagccaccatgcacggcctatatatgcctttttttttttttttttttgagacagtcttactctgtcttccaggctggagtacagtagcatgacatcagctcactgcaacctctgcctcccgagttcaag

SEQ ID NO: 51274 - DNA, 201 bp, Homo sapiens
agtccaggttccaagccgaggtcactggggcttctgggcatcttggaaccctgcagaagtgatggctcctgtctcttttaggtgatcatggggggtggccrgaaatacatgtaccccaagaataaaactgatgtggagtatgagagtgacgagaaagccaggggcacgaggctggacggcctggacctcgttgacacctgg

SEQ ID NO: 51275 - DNA, 201 bp, Homo sapiens
cccaaggtctctaattcttgggcttaagcgatcctacagccttggcctcccagtcttgggattacaggcgtgagccaccatgcacggcctatatatgcctttttttttttttttttttgagacagtcttactctgtcttccaggctggagtacagtagcatgacatcagctcactgcaacctctgcctcccgagttcaagt

SEQ ID NO: 51276 - DNA, 201 bp, Homo sapiens
aatccagcagcagtgttgtggggctggggagcagatcttcctcccctcctccctcaccgaggcctttgccttggtgtcccaaggaggcagaattgaccacrggcaccatgaaggaaaagccaagcaggccctgcatgaggcggtggagatggaccgggccatcgggcaggcaggcagcttgacctcctcggaagacactct

SEQ ID NO: 51277 - DNA, 201 bp, Homo sapiens
aatgaagcaagtcacacattttttggtttcccagtgcatataaaagttatgtttgcaccctacagtagtcttttaagtgtgggatagcattatgtctaaaraaatgtatataccttaatttaaaaatatgctattgctaaaaaacgctaatgaagtgagctcatgtttttggaaaaaatgatgctgatagacttgcttgac

SEQ ID NO: 51278 - DNA, 201 bp, Homo sapiens
tgtactcctggggccccagcatgacccctgaacaccccctccctgtgcaggtctggcccccatgctgagtgacacagacaagaagcccttcactgccatcmtgtatggcaatgggcctggctacaaggtggtgggcggtgaacgagagaatgtctccatggtggactatggtgagacctccaggacccagggctgggaggg

SEQ ID NO: 51279 - DNA, 201 bp, Homo sapiens
tgggtgccactggggcgaaggcctggccatctcctgaccctcctctcccacctgcagacgtacaacaccaatgcccaggtccctgacagcgccggcaccgscaccgcctacctgtgtggggtgaaggccaatgagggcaccgtgggggtaagcgcagccactgagcgttcccggtgcaacaccacccaggggaacgaggtc

SEQ ID NO: 51280 - DNA, 201 bp, Homo sapiens
ggaggcctctgggacaccccgatctgtggataaagccaaacccgcccctcctgcaccccagggaaatctgtgggcattgtgaccaccacgagagtgaaccrtgccacccccagcgccgcctacgcccactcggctgaccgggactggtactcagacaacgagatgccccctgaggccttgagccagggctgtaaggacatc

SEQ ID NO: 51281 - DNA, 201 bp, Homo sapiens
taaagccaaacccgcccctcctgcaccccagggaaatctgtgggcattgtgaccaccacgagagtgaaccatgccacccccagcgccgcctacgcccactyggctgaccgggactggtactcagacaacgagatgccccctgaggccttgagccagggctgtaaggacatcgcctaccagctcatgcataacatcagggac

SEQ ID NO: 51282 - DNA, 201 bp, Homo sapiens
attgtcctgcctcagcctcctgagtagctgggattataggcgcacatcaccacgcccggctaattttttttttttaaatttttagtagagacggggtttcrccatgttggccaggctggtctcaaactctggacctcaggtgatccgcccgttttggcctcccaaagtgctggcattataggcgtgagccatcgcgcccgg

SEQ ID NO: 51283 - DNA, 201 bp, Homo sapiens
atggtattggagataagattgctctgttgtttcaaaacatgtctactttttcgattggcctggcagttggtttggtgaagggctggaaactcaccctagtkactctatccacgtctcctcttataatggcttcagcggcagcatgttctagggtaagtgagatggctaatgcaatattgaatggaagcagcagtgtggact

SEQ ID NO: 51284 - DNA, 201 bp, Homo sapiens
tacaaattaagactttcattaacttgatagtcaaaattcatataaaatattttagttgaaaatgtgaacagtttactagttaatattctgaagtactcttmatttagttctctttacatagagagataatgatagattcttttactactattttctgaaattattcaggctattattacacatgtacatgaaacaaacata

SEQ ID NO: 51285 - DNA, 201 bp, Homo sapiens
acattctaatactctttcttcaggttgaccctgtattatgttggaataggtgttgctgccttgatttttggttacatacagatttccttgtggattataaytgcagcacgacagaccaagaggattcgaaaacagttttttcattcagttttggcacaggacatcggctggtttgatagctgtgacatcggtgaacttaac

SEQ ID NO: 51286 - DNA, 201 bp, Homo sapiens
gaaaaccatccttatactatttttaaaatgtagagactgtcagtttactcctttgaagatttataacatttcctttgtttttccaagaaacccagtatagrtaacttttccacagctggatataaacctgaatccatagaaggaactgtggaatttaaaaatgtttctttcaattatccatcaagaccatctatcaaggta

SEQ ID NO: 51287 - DNA, 201 bp, Homo sapiens
ggaagaaaaccatccttatactatttttaaaatgtagagactgtcagtttactcctttgaagatttataacatttcctttgtttttccaagaaacccagtrtagataacttttccacagctggatataaacctgaatccatagaaggaactgtggaatttaaaaatgtttctttcaattatccatcaagaccatctatcaa

SEQ ID NO: 51288 - DNA, 201 bp, Homo sapiens
atggtcatctcattgaccagtaaggaattaagtgcctattccaaagctggggctgtggcagaagaagtcttgtcatcaatccgaacagtcatagcctttarggcccaggagaaagaacttcaaaggtctttccttttaaatataacaagatatgcttggttttattttccccagtggctactaagttgtgttctgtttttg

SEQ ID NO: 51289 - DNA, 201 bp, Homo sapiens
agattcttttactactattttctgaaattattcaggctattattacacatgtacatgaaacaaacataacaagatctaaatttgtttttagaagaatttgyttttggttataattatgtactcattttctgaaaatgtgtccatcatcttcttattgtggttttatgattttccctccatacattccaatagattctgaaa

SEQ ID NO: 51290 - DNA, 201 bp, Homo sapiens
acttcattagtgtatttaccaaaaaagtagttgttgttaaagattgcacaaggcgattactaataaaacactggcttcatagaaaaagacatgattttaartgaaatagataaaattactagtgtgatcaatttctaatgtctgctacagaatttgtataaagacctacctactcctacttccttattttttttctgatta

SEQ ID NO: 51291 - DNA, 201 bp, Homo sapiens
taaaattactagtgtgatcaatttctaatgtctgctacagaatttgtataaagacctacctactcctacttccttattttttttctgattaaaactttgaycgaaattctcttttcaaagctctttagttttgaaagttgttacttaattaccgattaccattattggtatagtattgacttccaccatttttcttaactg

SEQ ID NO: 51292 - DNA, 201 bp, Homo sapiens
aataattatatattacattctattgtctttcttatataactgcagaaagataaatatcactttgtttgttcctgtaggttttctttagtgtaatccatagyagttattgcattggagcagcagtccctcactttgaaaccttcgcaatagcccgaggagctgcctttcatattttccaggttattgataaggtaagacctc

SEQ ID NO: 51293 - DNA, 201 bp, Homo sapiens
tggcagtgggaagagtacggtagtccagcttctgcagaggttatatgatccggatgatggctttgtaagtgcagctagcaaaaccatgcacagtccacctratggaatctggaaacaccgcagggctggcagctctgtaacttttcattttcaacagtagagctgggagagaagccatattgttttctttcctttgtatcc

SEQ ID NO: 51294 - DNA, 201 bp, Homo sapiens
catctcattgaccagtaaggaattaagtgcctattccaaagctggggctgtggcagaagaagtcttgtcatcaatccgaacagtcatagcctttagggccmaggagaaagaacttcaaaggtctttccttttaaatataacaagatatgcttggttttattttccccagtggctactaagttgtgttctgtttttgtaagg

SEQ ID NO: 51295 - DNA, 201 bp, Homo sapiens
gcagctctgtaacttttcattttcaacagtagagctgggagagaagccatattgttttctttcctttgtatccattcactcagcaaatatttatttagagmcaactatgtgtcaggcactgttttaggttctgagaatacctaggtgaataaaacagataaaaatctgccctcatgaagtttacattctaataatcagagg

SEQ ID NO: 51296 - DNA, 201 bp, Homo sapiens
tttcattttcaacagtagagctgggagagaagccatattgttttctttcctttgtatccattcactcagcaaatatttatttagagccaactatgtgtcakgcactgttttaggttctgagaatacctaggtgaataaaacagataaaaatctgccctcatgaagtttacattctaataatcagaggcagacaataaaaaa

SEQ ID NO: 51297 - DNA, 201 bp, Homo sapiens
atcaaaatatagtcagtctttgatttctaaaatatgctacttctcagcttatattttggtctagtatgaaaaaccctaaaatcaatacagtaaaaggcatyacaacatggttcattctttggattggcagatcatggtggatgagaatgacatcagagctttaaatgtgcggcattatcgagaccatattggagtggttag

SEQ ID NO: 51298 - DNA, 201 bp, Homo sapiens
tttgcaattaaaatacatataaaattccaccatcccagagggtcacaataacagaaatgtttattttaatgggcatatttcacaaaccaaacttgacggaytgtaataattttattcttggtttttaatttaaaaaatttgttatgccagtaattgtctcttgtccccattatttaggatcataattaggacatatttagg

SEQ ID NO: 51299 - DNA, 201 bp, Homo sapiens
cttataatatacacagattttaaaattaatgtataataattagctgatactggttagcctttcactcataaacaaccatgaaattggataaaacatatgargccaagggcagtcatttccatgcattggatgagaggtaatgaaagactgattcctaacagagaggaatctcataaaggtactccatgaattctgtctggg

SEQ ID NO: 51300 - DNA, 201 bp, Homo sapiens
agctgcaagcggaacactggatagaagtcaggcagtgctgcgggggcgttgaaagtgcagcgcagctggaatggagagatcacattaacacctttttaacvccccaggcaagtagctaaaacaccaaaaaagccacaccttaggagtcaggaccacaccttagagtaagatctacctgccctaacaaaccctgagaccaag

SEQ ID NO: 51301 - DNA, 201 bp, Homo sapiens
aggctgaggcaggtggatcacttgaggaaaggagtttgttaccagcctggacaacatggcaaaaccctgtctctactaaaaatacaaaaaattagctgggygtggtggtgcacacctgtaatcccagctactcgaaaggctgagacaggagaatcacttgaactcaggaggcaaaggttgcagtgagctgagatagcacca

SEQ ID NO: 51302 - DNA, 201 bp, Homo sapiens
ttgaatgaacaaattgtgatagatctaatttttctttttcctttttcttttttttttttttttttttgatatggggtctcactctgtcacctagggtggastgcaatgcacaatctcagctcactgcagcctcgacttcccaggctcccaggctcaggcagtccttccacctcagcctcctgagtagctcatgccactaca

SEQ ID NO: 51303 - DNA, 201 bp, Homo sapiens
agcctgttttgttcgggaccaccatcagtaacaatatcaagtatggacgagatgatgtgactgatgaagagatggagagagcagcaagggaagcaaatgcrtatgattttatcatggagtttcctaatgtgagtacactgtgcagcctgtgtccttagcttatggtggcagcgctgcgacattccaatataaggtaatgaa

SEQ ID NO: 51304 - DNA, 201 bp, Homo sapiens
ccgaggagctgcctttcatattttccaggttattgataaggtaagacctcttattgctttgaagaataactatcattactgcaagaaggagacaaaaaaayatacaccctcattttcactaaaacaataggatggacaaatttaatgttggccagttgtttatgggaaagagagactgcctttaattcttttctaagagga

SEQ ID NO: 51305 - DNA, 201 bp, Homo sapiens
tgctacttctcagcttatattttggtctagtatgaaaaaccctaaaatcaatacagtaaaaggcatcacaacatggttcattctttggattggcagatcayggtggatgagaatgacatcagagctttaaatgtgcggcattatcgagaccatattggagtggttagtcaagagcctgttttgttcgggaccaccatcagt

SEQ ID NO: 51306 - DNA, 201 bp, Homo sapiens
atggacaatatatatgttagaaatattttatcaaaatatagtcagtctttgatttctaaaatatgctacttctcagcttatattttggtctagtatgaaaraccctaaaatcaatacagtaaaaggcatcacaacatggttcattctttggattggcagatcatggtggatgagaatgacatcagagctttaaatgtgcgg

SEQ ID NO: 51307 - DNA, 201 bp, Homo sapiens
tttcacaaagaacaaatcaaaagacataagcacccagaggctgaagtactgattaagctgatattaaaacacaactgggattgtcatttcctgttctaacsatttgatcacgctgccttctgtttctgtgcttctttcctatttttcattagaaatttaatacattggtaggggaaaaaggagctcaaatgagtggagggc

SEQ ID NO: 51308 - DNA, 201 bp, Homo sapiens
ttgtggatcttagaataaagataatcagatgatctggcaaggttttaggccaattattcttttgcagttttgttggtgcccatctaccagaaaaagtctayggacaatatatatgttagaaatattttatcaaaatatagtcagtctttgatttctaaaatatgctacttctcagcttatattttggtctagtatgaaaaa

SEQ ID NO: 51309 - DNA, 201 bp, Homo sapiens
accccaggcaagtagctaaaacaccaaaaaagccacaccttaggagtcaggaccacaccttagagtaagatctacctgccctaacaaaccctgagaccaakccatgacaagatgcccagagaagagaggttttggaggttgtgttctgccaagttatgtggctttctacaaattcaccccaaggaaacctaaaatgaagat

SEQ ID NO: 51310 - DNA, 201 bp, Homo sapiens
ataattttattcttggtttttaatttaaaaaatttgttatgccagtaattgtctcttgtccccattatttaggatcataattaggacatatttaggccaamaaaatcattaaagatttaaggtgcttcttaaatctttgggaacacacatttccttttgttgatgttttgcccctttcaatgacttcctttccttaaaaca

SEQ ID NO: 51311 - DNA, 201 bp, Homo sapiens
tatgcacatgtgcctttcccttcttcctttcctggggcttttactgcaccagcaattgcggctagtactttatcacctttacacacacgcacacacacacrcagtttatcctactccatcattcagtctttgacaagttcttgtgaaaatgtgtgtcttttttattgtcttccccctttcacttcattagtgtatttacca

SEQ ID NO: 51312 - DNA, 201 bp, Homo sapiens
taaaaaaataccattagtctacttagaattcaaattctgcctgacttaaatgttcagaacattattactacacagagtcattttttaactgtggttgtggkttattacagatggtcatctcattgaccagtaaggaattaagtgcctattccaaagctggggctgtggcagaagaagtcttgtcatcaatccgaacagtca

SEQ ID NO: 51313 - DNA, 201 bp, Homo sapiens
agaagggagggaatgttgtggagaaaaatagcgtattaacatctgtacccagtacctatcaagaatttcaaagtttgttccagaagaatgatgtagaaaayatctccacttttctttttctttttttttttttcttggagcttacagtgttgcacttaactttctcagccttgtaagtggcatagaggataagacagtgat

SEQ ID NO: 51314 - DNA, 201 bp, Homo sapiens
gaaaaactatgatcattttttaaagcacaggaagctaacattgcataagaaatgtgaaatcaggccgggtgcggtggctcacgcgtgtaatcccagcactktgggaggccgaggtgggcagatcacctgaggttaggagtttgagaccagcttcgccaacatggtgaaaattcatctctactaaaaagacaaaaaaattag

SEQ ID NO: 51315 - DNA, 201 bp, Homo sapiens
atatctactaagttaatttttgacaaggcgaatggaactcagtgggggaaagaaatatcttttcaacaaatggtgctggaacaaatggttatccttgtggaaaaaataaaatgtgacctttactttacatcacacacaaaaattaatttgccatagaccttgtaccaaaattgtaaagcgtaaacttcaaaaattaaaact

SEQ ID NO: 51316 - DNA, 201 bp, Homo sapiens
gaaatcagtataatcattctagaaagcaatttggcagtttattataatgttaaacatacacttatgactcagcattctattcctaggtatttattcaaaakaaatgaaaacatgaccacaaaaatatcttgtacatgaatattcatagcagctttatttataatagccaaaaataggaaacaatttaagtgttcatcagca

SEQ ID NO: 51317 - DNA, 201 bp, Homo sapiens
catagcagctttatttataatagccaaaaataggaaacaatttaagtgttcatcagcagttgaatgaacaaattgtgatagatctaatttttctttttcctttttcttttttttttttttttttttgatatggggtctcactctgtcacctagggtggagtgcaatgcacaatctcagctcactgcagcctcgacttccca

SEQ ID NO: 51318 - DNA, 201 bp, Homo sapiens
agatctagagttgccagatgaactactggattcccagttaaatttgaatttcagataatgaataattttttagcaatattgcataaaacatacttatactaaaaaaaactcattgcttttctgaattcaaatgtaacagctttgtgttttcttgtgtgttgtttgtttttgctaaatctggcaacccaaggtaaactcgca

SEQ ID NO: 51319 - DNA, 201 bp, Homo sapiens
actggattcccagttaaatttgaatttcagataatgaataattttttagcaatattgcataaaacatacttatactaaaaaaaactcattgcttttctgarttcaaatgtaacagctttgtgttttcttgtgtgttgtttgtttttgctaaatctggcaacccaaggtaaactcgcattgtgtggaacactacttagcaat

SEQ ID NO: 51320 - DNA, 201 bp, Homo sapiens
aaatctagagtaaaagtgcaggtgtgagaagaggtactcctactggtggtccccgatttctcacctccttcagagaacttttctcggcttggccctctgamggttttatgtttggcttatgcaaagggtccattgctttacaaatggtgagatcaaagcaagagaattcaaagggagattcccctgtttagggctaactac

SEQ ID NO: 51321 - DNA, 201 bp, Homo sapiens
aagtgcctattccaaagctggggctgtggcagaagaagtcttgtcatcaatccgaacagtcatagcctttagggcccaggagaaagaacttcaaaggtctktccttttaaatataacaagatatgcttggttttattttccccagtggctactaagttgtgttctgtttttgtaaggtatacacagaatctcaaagatgca

SEQ ID NO: 51322 - DNA, 201 bp, Homo sapiens
gtttagggctaactacatacagatgcaagcaaagataggtgagaatttctcaacaggatcactgttgtcatttcgagagggtaattattgtgaggcttcamtcacattgcaggtccctggcacactaaatgctgtagcaaccccagtcattgagaaaatgtttaaagtgttccctcatgggtcaccatgagcccaccaagg

SEQ ID NO: 51323 - DNA, 201 bp, Homo sapiens
tggacttgctttttggtatggaacctccttgattcttaatggagaacctggatataccatcgggactgttcttgctgtaagtcttgtttgagaacaaggtrtcaggcctggataatctttccttacctagtttagccaaaattcctctttgaagataaatattcaaagatggatgtttttattaaacaaatatttgtttcc

SEQ ID NO: 51324 - DNA, 201 bp, Homo sapiens
taccacaaatatggaagacaaaatatctactttgttaaagataaatttattttaaaacaaatcaaaagaacacctaaaaagtatctcaagatggaaaaaamgttttaggggaaagtttgttttggtagcaattttttttcatgctgtttttcagagtatccaggaaggaaattgtgggtaacataccaaattgctaataaa

SEQ ID NO: 51325 - DNA, 201 bp, Homo sapiens
actccatatttttaaagatttgcattctctccaagttgatatataaatattgtgctttatcaatcaaaatctcaccagtttttatgtgtatgtgtagaaaytgacatgttgattccaaaatttatttggaaattcaaaagaccaacatagccaaaacaattttgaaagaaagaccaaagctggaggacctaaatatctaat

SEQ ID NO: 51326 - DNA, 201 bp, Homo sapiens
tctgggtttgggaacacacctaaatgtcttgggttgacgctgccacctgttggtggttcctagatgctaccccactcaacatactcattttaaccccctcstctctaacctaggagaattatgcacatgtgcctttcccttcttcctttcctggggcttttactgcaccagcaattgcggctagtactttatcacctttac

SEQ ID NO: 51327 - DNA, 201 bp, Homo sapiens
agaaatagattcacaaatatctactaagttaatttttgacaaggcgaatggaactcagtgggggaaagaaatatcttttcaacaaatggtgctggaacaawtggttatccttgtggaaaaaataaaatgtgacctttactttacatcacacacaaaaattaatttgccatagaccttgtaccaaaattgtaaagcgtaaac

SEQ ID NO: 51328 - DNA, 201 bp, Homo sapiens
taccccactcaacatactcattttaaccccctcctctctaacctaggagaattatgcacatgtgcctttcccttcttcctttcctggggcttttactgcascagcaattgcggctagtactttatcacctttacacacacgcacacacacacacagtttatcctactccatcattcagtctttgacaagttcttgtgaaaa

SEQ ID NO: 51329 - DNA, 201 bp, Homo sapiens
ccccctcctctctaacctaggagaattatgcacatgtgcctttcccttcttcctttcctggggcttttactgcaccagcaattgcggctagtactttatcrcctttacacacacgcacacacacacacagtttatcctactccatcattcagtctttgacaagttcttgtgaaaatgtgtgtcttttttattgtcttcccc

SEQ ID NO: 51330 - DNA, 201 bp, Homo sapiens
tgacaaggcgaatggaactcagtgggggaaagaaatatcttttcaacaaatggtgctggaacaaatggttatccttgtggaaaaaataaaatgtgaccttyactttacatcacacacaaaaattaatttgccatagaccttgtaccaaaattgtaaagcgtaaacttcaaaaattaaaacttacgaaaaaatctttgtaac

SEQ ID NO: 51331 - DNA, 201 bp, Homo sapiens
ctctctaacctaggagaattatgcacatgtgcctttcccttcttcctttcctggggcttttactgcaccagcaattgcggctagtactttatcacctttayacacacgcacacacacacacagtttatcctactccatcattcagtctttgacaagttcttgtgaaaatgtgtgtcttttttattgtcttccccctttcac

SEQ ID NO: 51332 - DNA, 201 bp, Homo sapiens
aaaatttgaacagacattttacaaaagaagaatcaaatgaacaatacatacattgaaaatatgcaccattattagtcaccagagaactctaaaataaaacrataatgagataccattttacactcttagaatggccaaaattaaaaagactaacaaatgtaacttttggtgatgatgtaagcaattagatctctcattcat

SEQ ID NO: 51333 - DNA, 201 bp, Homo sapiens
ctagttaatattctgaagtactcttaatttagttctctttacatagagagataatgatagattcttttactactattttctgaaattattcaggctattaytacacatgtacatgaaacaaacataacaagatctaaatttgtttttagaagaatttgtttttggttataattatgtactcattttctgaaaatgtgtcca

SEQ ID NO: 51334 - DNA, 201 bp, Homo sapiens
actaaaaaaaactcattgcttttctgaattcaaatgtaacagctttgtgttttcttgtgtgttgtttgtttttgctaaatctggcaacccaaggtaaactygcattgtgtggaacactacttagcaataaataggagtgaacaactgatacaacatggatgaatatcaaaaacattaagctaggtaaaagaaacaagccaa

SEQ ID NO: 51335 - DNA, 201 bp, Homo sapiens
taacttatttagaagtgacaatgaagagattccaggccataaaaagaaaacattttaccattattatgttattatttcacgttcctaattaggtagtacaygtgggttcattttagcagagtttacattttgaaagtgtttcttttctaaagggtcttaacccaagcattcatgcattcacatgagtagatttctgcaagc

SEQ ID NO: 51336 - DNA, 201 bp, Homo sapiens
aaagtgtttcttttctaaagggtcttaacccaagcattcatgcattcacatgagtagatttctgcaagctggaaagaagggtcaacgagcaggtgagtcayccattaaaagtgacttctaagttcctgatattttgctatttgtcatcccccttgacaaaaaagaaagcattctcggaccagtgacgtggtctgacagtaa

SEQ ID NO: 51337 - DNA, 201 bp, Homo sapiens
tggagggcagaaacagaggatcgcaattgctcgtgccttagttcgaaaccccaagattctgattttagatgaggctacgtctgccctggattcagaaagcragtcagctgttcaagctgcactggagaaggtaagtgagcagaaacgtttcttatttccatactcctggttcattattgttttgaagtacaagaaagtata

SEQ ID NO: 51338 - DNA, 201 bp, Homo sapiens
atgatgtgactgatgaagagatggagagagcagcaagggaagcaaatgcgtatgattttatcatggagtttcctaatgtgagtacactgtgcagcctgtgyccttagcttatggtggcagcgctgcgacattccaatataaggtaatgaaacaacaactgatgcagaatagtaggggtgtgattaaattctggattgtcct

SEQ ID NO: 51339 - DNA, 201 bp, Homo sapiens
gtaaaaatatatacatgaggctgatacacaagcaatcatccagtctatacctccattccaagtggtttgcactttccacctccctagagtggcccaccacyatcatcactattataaccatgcccaccctttgcttcttctacatacacctgtgggattctcttctctgaccacttttcttctttaggatacccccaggta

SEQ ID NO: 51340 - DNA, 201 bp, Homo sapiens
atttagaattaatggggtgctgtaaagcctttttttaaaaatatttcctgaagtattagatcctcagcatcccctgaaattgttgtgcggagcaccttgtkacatatgaaaggatgagatttgcaattaaaatacatataaaattccaccatcccagagggtcacaataacagaaatgtttattttaatgggcatatttca

SEQ ID NO: 51341 - DNA, 201 bp, Homo sapiens
aaaaagtgacataaggaaacttactagggctacagaaatgttctatatctttattggtatggtggtaacatgggtgtactcatttgtcaatactcatagasttatatccttaaaatggatgcattttattgtgtgtaaatttcttcaaaaagcctgattttttaaatgtgaagatcaatctctagaaattaagggtttaga

SEQ ID NO: 51342 - DNA, 201 bp, Homo sapiens
tgtgtgttgtttgtttttgctaaatctggcaacccaaggtaaactcgcattgtgtggaacactacttagcaataaataggagtgaacaactgatacaacayggatgaatatcaaaaacattaagctaggtaaaagaaacaagccaaagaagtacatactgtatgatttcatttacataaagttctagatccaggaaaattc

SEQ ID NO: 51343 - DNA, 201 bp, Homo sapiens
taatcaaaagttgttccttattaggaaaaggccaaggatacttggattaatctgtgtttctattgcttctcggccttttggctaagatcaagtgtaatctrtgttcttttttatttggtcatatcttccattctttcttacctaattcctctaatatctctctgtgagcctaaaccaataattatatattacattctattg

SEQ ID NO: 51344 - DNA, 201 bp, Homo sapiens
ggaggatcacttgagcccaggaggtggaggctacagtgagctgtgatcaagccactgcactccagcctgggagacagttagaccctgtctcaaaaacaaaygaacaaacaaacaaaaaccctcaattcccacgaacgccccaggagataagggagcatggcccaggccttgagccagggcttctggcagtaggggagcctc

SEQ ID NO: 51345 - DNA, 201 bp, Homo sapiens
ctgaatggctcaaggctgctgccgtgtgcagggggctagacgtggggcgggcaggcagggctcctggtaacagccctgcaggccgcagtggagagcagggytccggcagggccgcccaggagctttcggaaggcccggccccggcccctttccgagcagcccgggcctccgccctgccctctgtccccaacgccgggagcc

SEQ ID NO: 51346 - DNA, 201 bp, Homo sapiens
agggggctagacgtggggcgggcaggcagggctcctggtaacagccctgcaggccgcagtggagagcagggttccggcagggccgcccaggagctttcggmaggcccggccccggcccctttccgagcagcccgggcctccgccctgccctctgtccccaacgccgggagccgccgttcgtcctccagagccccgcccggg

SEQ ID NO: 51347 - DNA, 201 bp, Homo sapiens
gagaaccagggccaaatgttcagctcactgtgaccttagcaaccctggtttcccctccccaggccacatccttcccaggtggagcttgctctccagccctycccccaccccattcctgaaggctgggaacaaggagggctctgtctggtagcctgagagctgggccctgcccttggacttctctgaggaattcaggcctga

SEQ ID NO: 51348 - DNA, 201 bp, Homo sapiens; identical to SEQ ID NO: 10884

SEQ ID NO: 51349 - DNA, 201 bp, Homo sapiens
tggcctgctgctgcctgcaccgccgggccaaaaggaggcctcctatgacccaggtagccagctgcgcactgggacggggtggccagatagaaagcccgcaytccaggccttgctctgtagtgaccccatctcagcacctgctaggtctctctggagtctccacacatttcttgcttgccctttggttctgtttggggcagc

SEQ ID NO: 51350 - DNA, 201 bp, Homo sapiens
ttgttataaatcgttaggatactgcctcccccagggtctaaaattacatattagaggggaaaagctgaacactgaagtcagttctcaacaatttagaaggmaaacctagaaaacatttggcagaaaattacatttcgatgtttttgaatgaatacgagcaagcttttacaacagtgctgatctaaaaatacttagcacttg

SEQ ID NO: 51351 - DNA, 201 bp, Homo sapiens
gcgcttctcagcactccctgtgatgggaacagaggggcgaggggcagagcgttcccagctgcagggtatgtcattttagagccctggggcaggtcacggayggcctggagcagccctgtggtttgcccacggggtgaccggccagggctgccatctcaccctgagagtccctcttttccacttgcaggtgtacgagaggct

SEQ ID NO: 51352 - DNA, 201 bp, Homo sapiens
ggggaaaagctgaacactgaagtcagttctcaacaatttagaaggaaaacctagaaaacatttggcagaaaattacatttcgatgtttttgaatgaatacragcaagcttttacaacagtgctgatctaaaaatacttagcacttggcctgagatgcctggtgagcattacaggcaaggggaatctggaggtagccgacct

SEQ ID NO: 51353 - DNA, 201 bp, Homo sapiens; identical to SEQ ID NO: 10880

SEQ ID NO: 51354 - DNA, 201 bp, Homo sapiens
tgcttcaatcaataacagccgctccagagtcagtagtcaatgaatatatgaccaaatatcaccaggactgttactcaatgtgtgccgagcccttgcccatsctgggctcccgtgtatctggacactgtaacgtgtgctgtgtttgctccccttccccttccttctttgccctttacttgtctttctggggtttttctgttt

SEQ ID NO: 51355 - DNA, 201 bp, Homo sapiens; identical to SEQ ID NO: 10883

SEQ ID NO: 51356 - DNA, 201 bp, Homo sapiens
ttgattgcttttttgtagtgttcagaaaaaaggttctttgtgtatagccaaatgactgaaagcactgatatatttaaaaacaaaaggcaatttattaaggraatttgtaccatttcagtaaacctgtctgaatgtacctgtatacgtttcaaaaacaccccccccccactgaatccctgtaacctatttattatataaaga

SEQ ID NO: 51357 - DNA, 201 bp, Homo sapiens
tgagctgtgatcaagccactgcactccagcctgggagacagttagaccctgtctcaaaaacaaatgaacaaacaaacaaaaaccctcaattcccacgaacrccccaggagataagggagcatggcccaggccttgagccagggcttctggcagtaggggagcctcccccatttgctaagcggactttcctcttccttctgt

SEQ ID NO: 51358 - DNA, 201 bp, Homo sapiens
gccattgcttaagaagtgcaggtcacggagactttgctcctcgttttccagaagggggaaactgaggcctagagagtgaagtggctgttccaggctgcacrgtgacaggtagaaggatggttgggatcaaggaacggccatccagcaacctcccctgtccccctttgccaccccagacccaggcctgcccacctctctcct

SEQ ID NO: 51359 - DNA, 201 bp, Homo sapiens
agctgtggcacagtgtctcacacctgtaacaccagcactttgggaggctgaggcgggaggatcacttgagcctacttggagaccagccaggccaacaaagygagaccccatctcttttttttttttttttttttttatcaaaacccatacgattgagtgacaaggacctgaggactgcagctgcaggtgtggccacctggt

SEQ ID NO: 51360 - DNA, 201 bp, Homo sapiens
cctccagggctcaacactgtgacatctctattccccaccctccccttcccagggcaataaaatgaccatggagggggcttgcactctcttggctgtcaccygatcgccagcaaaacttagatgtgagaaaaccccttcccattccatggcgaaaacatctccttagaaaagccattaccctcattaggcatggttttgggc

SEQ ID NO: 51361 - DNA, 201 bp, Homo sapiens
gaagagctaggcagggtgtctgccccctcctgagttgaagtcatgctcccctgtgccagcccagaggccgagagctatggacagcattgccagtaacacargccaccctgtgcagaagggagctggctccagcctggaaacctgtctgaggttgggagaggtgcacttggggcacagggagaggccgggacacacttagct

SEQ ID NO: 51362 - DNA, 201 bp, Homo sapiens
cagccgcgcttctcagcactccctgtgatgggaacagaggggcgaggggcagagcgttcccagctgcagggtatgtcattttagagccctggggcaggtcrcggacggcctggagcagccctgtggtttgcccacggggtgaccggccagggctgccatctcaccctgagagtccctcttttccacttgcaggtgtacgag

SEQ ID NO: 51363 - DNA, 201 bp, Homo sapiens
ttcacagccttagtatgtgccgttcgctctgcgagaaaagccaccgcccacccaggtggttcctcctggtctgtctgatttcagaactggagatggcctcyggtcctgtttccaccctgggggcgcctctctgcggggcgcctctctctctggggtacctctttgtctgtggggcacctctctgtggggcgctttccttct

SEQ ID NO: 51364 - DNA, 201 bp, Homo sapiens; identical to SEQ ID NO: 10885

SEQ ID NO: 51365 - DNA, 201 bp, Homo sapiens
gagtaagtctgcgttgctgcttgtggggtcttccccatctcagggcggggaccgggggtggcggtccagacaagtaatcaaggacgatgcccaggaggggrcaggtacggggtggcaggagctctgccggcgggctcaggaagccttcaccacagctgcctgagctcacccttgccaaatgagggctggggcagcagcaac

SEQ ID NO: 51366 - DNA, 201 bp, Homo sapiens
gctgtagaccctgctgctggtctctgcctgcctctcactggtgtctttatgaagcttttccaggctcccagacccattcagggcctgagctcggcctggtyccaagccctgcttccctgtggcctccaccgccatctccagccccttcttctaccaaggtaggtgtcccctgccccccagggaagattcgagacaaggagg

SEQ ID NO: 51367 - DNA, 201 bp, Homo sapiens
tccctcccaggtgctgccgcccaggctggcctctggggtgctcaggcgcatccgtgtcagccccaaagagcagagtgtctgtcccgactgcgctgagggcrtggggcagccgggcaggccactggctctggcgacctctagaagcccagccggccccacatgcctcccttagcaagaccctggcccactccttccctcgcc

SEQ ID NO: 51368 - DNA, 201 bp, Homo sapiens
tgggcagaagggaagagacagggaccccacctgatccaggctctcttcccacagccaggcccagagagctcagtgtccctcctgcagggagcccgcccctytccgttttgctggcccctctgtgagatttcccggggcacccacaacttctcggaggagctcaagatcggggagggtggctttgggtgcgtgtaccgggcg

SEQ ID NO: 51369 - DNA, 201 bp, Homo sapiens
cagggctgccatctcaccctgagagtccctcttttccacttgcaggtgtacgagaggctagagaagctgcaggcagtggtggcgggggtgcccgggcattyggaggccgccagctgcatccccccttccccgcaggagaactcctacgtgtccagcactggcagagcccacagtggggctgctccatggcagcccctggca

SEQ ID NO: 51370 - DNA, 201 bp, Homo sapiens
ttccttctgtaggcttgggcctggaacaggacaggcaggggcccgaagaaagtgatgaatttcagagctgatgtgttcacctgggcagatcccccaaatcyggaagtcaaagttctcatggtcagaagttctcatggtgcacgagtcctcagcactctgccggcagtgggggtgggggcccatgcccgcgggggagagaag

SEQ ID NO: 51371 - DNA, 201 bp, Homo sapiens
aagctggccctgtacgaggatggggccctggacagcctgcagctgctgtcgtccagctccctcccaggtgctgccgcccaggctggcctctggggtgctcrggcgcatccgtgtcagccccaaagagcagagtgtctgtcccgactgcgctgagggcatggggcagccgggcaggccactggctctggcgacctctagaag

SEQ ID NO: 51372 - DNA, 201 bp, Homo sapiens; identical to SEQ ID NO: 10881

SEQ ID NO: 51373 - DNA, 201 bp, Homo sapiens
cttcaaggacttcccgaccaccagggacaaagggatgagccctgggagccgaagcccagcagattctattgaacgtgtccccagccattgcttaagaagtkcaggtcacggagactttgctcctcgttttccagaagggggaaactgaggcctagagagtgaagtggctgttccaggctgcacggtgacaggtagaaggat

SEQ ID NO: 51374 - DNA, 201 bp, Homo sapiens
ccaggtggagcttgctctccagccctccccccaccccattcctgaaggctgggaacaaggagggctctgtctggtagcctgagagctgggccctgcccttrgacttctctgaggaattcaggcctgaggccagggaggcagggtgctaggctgcgggctggggagccacagcatgaggctaagggagtgccatctccaccc

SEQ ID NO: 51375 - DNA, 201 bp, Homo sapiens
gttgtccttgagtaataaaaacgtatgttgcaatctcgggctctacttgtggactttgttgcaccgaaagccttgagctttcctgatgccttacacttcakggttcttgagcgtccagggtcttgttactactctgggctggccacacccagcacttcccgtgtcaggtttttcctgatgtagtccatgttttttatgcta

SEQ ID NO: 51376 - DNA, 201 bp, Homo sapiens
agaagcccagccggccccacatgcctcccttagcaagaccctggcccactccttccctcgcctcctgacagtagcacctcctttagcccgagggtgcctgycccactctgtgctttcaggaaataggaagccccagcaggaattttccatcccaggtactatttgaagaaccactgcttaggaaccctcagctgggcgagg

SEQ ID NO: 51377 - DNA, 201 bp, Homo sapiens
cttctgtgtttgaactgaagtctgtattgtaactatgtttaaagtaattgttccagagacaaatatttctagacactttttctttacaaacaaaagcattyggagggagggggatggtgactgagatgagaggggagagctgaacagatgacccctgcccagatcagccagaagccacccaaagcagtggagcccaggagt

SEQ ID NO: 51378 - DNA, 201 bp, Homo sapiens
gtggctttgggtgcgtgtaccgggcggtgatgaggaacacggtgtatgctgtgaagaggctgaaggaggtgagtgtcgcaccctggcagggaccctggaargccatcagataaccctcaccacttctccagcctttccccctcgcttccccacacaactccttcagccctcattctggcgtagggtccctggccccttggt

SEQ ID NO: 51379 - DNA, 201 bp, Homo sapiens
agcctgagctccgccctagctttgccagcatcttggagcgtctgcagtactgcactcaggtgtgcccccgacctaatctaacatcctggtcttgtgggtcwggagggagggccagaaaactctatgcccccctgctccctgactcttccattacaggacccggatgtgctgaattcactcctgccaatggagctggggccc

SEQ ID NO: 51380 - DNA, 201 bp, Homo sapiens
agggcatcttcacatccaagacagattcctggtgataacacccttcccctccccttccccactgttcccctcccctgaggctaatcctgtcctttccagcmacctcatgtgaggggaggctacacctgacgggcctcacttggttcccccacttgtgatgcaggtcttttggggtgctgctctgggagatcttctcactgg

SEQ ID NO: 51381 - DNA, 201 bp, Homo sapiens
agtcctggctcaggggacccccatcccaactccctccccaaggaacagcccttccacacagcttttaaggaaatagatcaggaagagcaagaacttctagrttctggcagtgattttttttgcctactctgtagggatattgccgcccggaactgcctgctgagctgcgctggacccagccgagtggccaagattggggac

SEQ ID NO: 51382 - DNA, 201 bp, Homo sapiens
gagtagcaatgaggttcagccttgcagtcacaaaggcaccactaaaaggcacaagtaatggcaggtaatgaggccttacttggagcagtttagagtacttmccacgtgtggtgacgcatgccacacactcaccaccaccaccactgccacaaatgaagtgcacactccactgctcctgtcctcaggaacctggaagccccc

SEQ ID NO: 51383 - DNA, 201 bp, Homo sapiens; identical to SEQ ID NO: 10928

SEQ ID NO: 51384 - DNA, 201 bp, Homo sapiens
agtccctgagcccactcctgcactgcactgaagagccacctgcactgtgaataaccttgcatagcacaggattcttgcatagcatagggtcatttgaaaartgggctgtcatcatgccattgcactccagcctgggcgacaagagcaaaactctgtcttaaaaaaaaggaaagtgggctgccagtcgtgctggatggcaat

SEQ ID NO: 51385 - DNA, 201 bp, Homo sapiens
ctgaggtagcaagtcaggggacacagagggcctctccagctttgtggagcctaaaacatggtttccgtctccctcctggtaacgggatatgtcccccaccycactcagcaagtttcgccatcagaacattgtgcggtgtgtggggctcagcctcagggccacccctcgcctcattctgctggaactgatgtctggagggga

SEQ ID NO: 51386 - DNA, 201 bp, Homo sapiens
cacggcggaggtagggtggacagtgacctgctagttggaggtttcaccctcagggtaacgaagtccacgtgcgcaccgacttgcgtcttggactattccgsggggaggtccaccttgagtgcccttcaaggtggcagtagtcgccaccgagttagcccttacccggaacctcttacaccgagcggaaggcccccaaccagg

SEQ ID NO: 51387 - DNA, 201 bp, Homo sapiens
ggccgcctgcccactcccttccaacgtgtcttcctgcagagccctgggccatggtgcctttggggaggtgtatgagggactggtaattggccttcctgggractccagtcccctgcaggtagctatcaaggtgagaggagtgggacttctggctgggggtaggagagcggaacaccctgaagggaaggacaatgactagag

SEQ ID NO: 51388 - DNA, 201 bp, Homo sapiens
cctcgcctcattctgctggaactgatgtctggaggggacatgaagagtttcctgaggcacagtcggccacacctggtgagacccttgtcttagccccccccaggcccctctaaagaccctgtccatgtgtctgagacctacatggactgatgccccctctgcctgacccagggccagccatcacctctggtcatgcgggac

SEQ ID NO: 51389 - DNA, 201 bp, Homo sapiens
aaacagggtctcgccacgcccccgacccaccggaagcagctggggctggatgagtcattaattcattcattcactctgggaaggtttatttgtgcgcctgwgtggcgggtgctgatacaggcgcagtgaaggtgattccagcgtctccagtgagctgtcaagagcctggacttagcatctgaagcccccggtttgcgctcc

SEQ ID NO: 51390 - DNA, 201 bp, Homo sapiens
cctggccaacatggtgaaaccctgtgtctactaaaaacacaaaaaatagctgggcgttgtggcgcttgcctgtagtcccagctactcgggagactgaggcrggagaatcacttgaacccgagaggcagaggttgcagtgagccgagatcgcgctattgcactccagcctgcatgacagagtgagacttcgtttaaaaaaga

SEQ ID NO: 51391 - DNA, 201 bp, Homo sapiens
catatgattttgcaggtggtggggaaactctcagggcagttgtggcctgtgctacatcacccattgaccagaggtgccagtactagtgctcaagatcaatygatcgatcggtctacctacctatcatctattgaccttcagtgctactaaaaacactcggatcttctaacgtctggtccagtctttcaccccatcacagtg

SEQ ID NO: 51392 - DNA, 201 bp, Homo sapiens
ttctcccaacacctttcaggcgccattctctgctctagcccggggtcccaggagacttttctgcggtcctcgcccctgccgctggcaagtcccagcccccrggacccgaaagtcagcgccccgcctagtatcttggagccagcctccccgctgaattctccgggtgagctttagacgcctccttcctctttcgctcaccat

SEQ ID NO: 51393 - DNA, 201 bp, Homo sapiens
ggttgcagtgagccgagatcgcgctattgcactccagcctgcatgacagagtgagacttcgtttaaaaaagaaaaaaaatcatgactcttggagcccaggrattgcctcccgcccagggcgtctgcagggaccagggaagtcctcatcatgcactcccaccttgactctggcccgcatctgccctcttttttgccctggct

SEQ ID NO: 51394 - DNA, 201 bp, Homo sapiens; identical to SEQ ID NO: 10948

SEQ ID NO: 51395 - DNA, 201 bp, Homo sapiens; identical to SEQ ID NO: 10939

SEQ ID NO: 51396 - DNA, 201 bp, Homo sapiens
tttgtttttgtttttttggtgtgccccttatctcttctagcctccagctaatcttgagagcatcccatcctctggacctctcctcttaccacccgcaactyggcagccctgtgtcctctctgaagtacacaggttggctcatgtcaactgtgtctgccgcctccccacagaggcacttgccttttagcacagttacacatg

SEQ ID NO: 51397 - DNA, 201 bp, Homo sapiens
gcttcctggaacacgccgctggccccacaggtgcgcgctggcgagctggaaccgttgctggtggcggccggaggcggcggtcgggcctacctgaggccgcrggaccgaggccggactcaggcctcccccgagaaactggagaaccgctcggaggcgcccgggagcggcgggagaggcggggcggcaggtgagggcgcgggc

SEQ ID NO: 51398 - DNA, 201 bp, Homo sapiens; identical to SEQ ID NO: 10932

SEQ ID NO: 51399 - DNA, 201 bp, Homo sapiens; identical to SEQ ID NO: 10943

SEQ ID NO: 51400 - DNA, 201 bp, Homo sapiens
cacatgatctacattctcacagaaagggactgtgaggacatgggacaggaggggctcaggcaggcaggaggcatcccagccagcctcagcgaggccttcargctccagctgattaccccctcctcacctccttcactcccacttgtgaacagacagcatttgcatcatgatgctggagaagagagggccacactgggattt

SEQ ID NO: 51401 - DNA, 201 bp, Homo sapiens
tcatacatacacacatgatctacattctcacagaaagggactgtgaggacatgggacaggaggggctcaggcaggcaggaggcatcccagccagcctcagmgaggccttcaggctccagctgattaccccctcctcacctccttcactcccacttgtgaacagacagcatttgcatcatgatgctggagaagagagggcca

SEQ ID NO: 51402 - DNA, 201 bp, Homo sapiens
tcctctggcgtcctggggtctgaggtgggcgtggccagaccagctttaggtccggggagtgtctcgccagcggcagcacacccctgtaagtggtggccagrgctgccgtggcaaaatgagctgtcaactttaggttgacaggggtgtggccgcgaccgcaagggcttttgttgccgggtggacccaacagggatgggctgc

SEQ ID NO: 51403 - DNA, 201 bp, Homo sapiens
gtcaaaacaatgcaaaatggcagttaaataggaggaataccttccagaatctactgtactacatggtgactgtagttaatgacgatgtattcttgaaaatygctaagagaggcggggcgcggtggctcacgcctgtaatctcaacactttgggcggcggaggcgggtggatcttgaggtcaggagtttgaggccagcctgg

SEQ ID NO: 51404 - DNA, 201 bp, Homo sapiens
ggtcactgcaacctccgcctcccgggttcaagtgattctgcagcctcagtcgctggagtagctgggattgcaggcgtgcgccaccacacccggctaatttkgtatttttagtagaggcggggttggccaggctggtcttgaacttctgacctccggtgatccgctcaccacggcctcccaaagtgcaatgattataggcgt

SEQ ID NO: 51405 - DNA, 201 bp, Homo sapiens
gagccgagattgcgccattgcactccagccagggcgacagagtgagactctgtctcaataaaaaaagaatatgatctggcgcctgtaatctcagcactttsggaggccaaggcaggtggatcacctgaggtcaggggttcgagaccagcctggccaacatggtgaaaccctgtgtctactaaaaacacaaaaaatagctgg

SEQ ID NO: 51406 - DNA, 201 bp, Homo sapiens
gaatcacttgaacctgggaggcggaggttgtggtgagccgagattgcgccattgcactccagccagggcgacagagtgagactctgtctcaataaaaaaaraatatgatctggcgcctgtaatctcagcactttgggaggccaaggcaggtggatcacctgaggtcaggggttcgagaccagcctggccaacatggtgaaa

SEQ ID NO: 51407 - DNA, 201 bp, Homo sapiens
gtaagggagagggaggccctgagaagctccagaaggggaagtaacttgctcaatgtcacctctccgtcccagttcttagaatatgatctctcagctgggcrtggtggctcacacctgtaatcccagaactttgggaggtcgaggcaggcaggtcacctgaggtcgggagttcgagaccagcctgaccaacatggagaaacc

SEQ ID NO: 51408 - DNA, 201 bp, Homo sapiens
gacagagtctcgctctgtcacccaggctggagtgcagtggtgcgatcttgggtcactgcaacctccgcctcccgggttcaagtgattctgcagcctcagtcgctggagtagctgggattgcaggcgtgcgccaccacacccggctaattttgtatttttagtagaggcggggttggccaggctggtcttgaacttctgacc

SEQ ID NO: 51409 - DNA, 201 bp, Homo sapiens
agtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgggtc

SEQ ID NO: 51410 - DNA, 201 bp, Homo sapiens
aagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgggt

SEQ ID NO: 51411 - DNA, 201 bp, Homo sapiens
acgaagtccacgtgcgcaccgacttgcgtcttggactattccgcggggaggtccaccttgagtgcccttcaaggtggcagtagtcgccaccgagttagccsttacccggaacctcttacaccgagcggaaggcccccaaccagggcggcgccaaggggtgcttgagcctccccacatttccacgaaccctcctgaaataag

SEQ ID NO: 51412 - DNA, 201 bp, Homo sapiens
agaagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgg

SEQ ID NO: 51413 - DNA, 201 bp, Homo sapiens
acagaagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatctt

SEQ ID NO: 51414 - DNA, 201 bp, Homo sapiens
tgaaaccctgtctgtactaaaaatacaaaaattagccgggcgtggtggcgggagcctgtaatcccagctactctggaggctgaggcaggagaattgcttgwacctgggaggcggaggttgcagtgagccgagatcactccattgcacttcagcctgggcgacgagggaaattctgtctcaaagattaaaaaaaaaacaatg

SEQ ID NO: 51415 - DNA, 201 bp, Homo sapiens
atatagggtcagctgggcatatggcaggggcaggggaggtaaagggggtactagactctctaggactcttctccaggccgcctgcccactcccttccaacrtgtcttcctgcagagccctgggccatggtgcctttggggaggtgtatgagggactggtaattggccttcctggggactccagtcccctgcaggtagctat

SEQ ID NO: 51416 - DNA, 201 bp, Homo sapiens
gccagttattaccgcaggggggaccgggccttgctcccagtcaagtggatgcccccagaggccttcctggagggcatcttcacatccaagacagattcctrgtgataacacccttcccctccccttccccactgttcccctcccctgaggctaatcctgtcctttccagccacctcatgtgaggggaggctacacctgacg

SEQ ID NO: 51417 - DNA, 201 bp, Homo sapiens
gggcccagccacttccagcttttgatcttggggccagaggccgccttacacacaccccaggtgtccatggggagcactggattgctctcccattatgagcrtccttcatctgggcagaccccccaccctgcagatgcttctaataaaaagctcttctcatcctccagcgatctgtggatgccagggaccggaactgaggaa

SEQ ID NO: 51418 - DNA, 201 bp, Homo sapiens; identical to SEQ ID NO: 10947

SEQ ID NO: 51419 - DNA, 201 bp, Homo sapiens
aagacacaaaactacctgaagggagtggctcccacatttgtagggtaccttacagagcaatttcccttcatatgattttgcaggtggtggggaaactctcmgggcagttgtggcctgtgctacatcacccattgaccagaggtgccagtactagtgctcaagatcaatcgatcgatcggtctacctacctatcatctattg

SEQ ID NO: 51420 - DNA, 201 bp, Homo sapiens
ggaggtccaccttgagtgcccttcaaggtggcagtagtcgccaccgagttagcccttacccggaacctcttacaccgagcggaaggcccccaaccagggcrgcgccaaggggtgcttgagcctccccacatttccacgaaccctcctgaaataagtgtaatatctgatttttcggtgtgcaaacctacccttcccatcccg

SEQ ID NO: 51421 - DNA, 201 bp, Homo sapiens
gcctagtatcttggagccagcctccccgctgaattctccgggtgagctttagacgcctccttcctctttcgctcaccataccagacccctctggcccagcyaggggctcgacgacccttgcctcgctccttgctctcaggcaccgaggggtcttggctgttttctacctgcggggccagcggccggcatgggcccacacag

SEQ ID NO: 51422 - DNA, 201 bp, Homo sapiens
gcttttcccctgcctcagctgaggccactaccctggttgactcccatggtgacatggatgcctcatccagtatcgtgggtctgagtcctcatctgcagggkccttgagctttcctcggcacccatccccgtttcccatctgggacttcattatcatcagcatctgctccacctccaaaaccactggtggaagcagcctcct

SEQ ID NO: 51423 - DNA, 201 bp, Homo sapiens
cttttcccctgcctcagctgaggccactaccctggttgactcccatggtgacatggatgcctcatccagtatcgtgggtctgagtcctcatctgcagggtscttgagctttcctcggcacccatccccgtttcccatctgggacttcattatcatcagcatctgctccacctccaaaaccactggtggaagcagcctcctc

SEQ ID NO: 51424 - DNA, 201 bp, Homo sapiens
ttctttcaggagtaagatggtattgtactgtggttttgatttgcatttccctgatcattagtgatgttgagcattttttcttatgtttgttggccatttgyatattttcttttgagaattgtgtattcatgtccttagcgcactttttgatgggattgtttgtttttcttgctaatttgagttctttgtagattctggata

SEQ ID NO: 51425 - DNA, 201 bp, Homo sapiens; identical to SEQ ID NO: 10988

SEQ ID NO: 51426 - DNA, 201 bp, Homo sapiens
tgaatatcttcttaaaatttacaattgttttgaccatttcccagtccttaaaccaatgataacattttattttctttttcttttttcttttctttctttctttttttttttttttttgagacagagttttgctctagttgcccaggctggagcaatggcacgatcttggctcaccgcaacctccacctcccaggttcaagc

SEQ ID NO: 51427 - DNA, 201 bp, Homo sapiens
agaactcattatagtggcttcctaacttgtgaactaagagtacttatgggctgggcgcagtagttcatgcctgtaatcccagcactttgggaggccaaggygggtggatcatgtggtcaggaaatagagaccatcctggccaaaaaggtgaaacctcatctctactaaaataaaaaaattacttgcgtgtggtggtgcaca

SEQ ID NO: 51428 - DNA, 201 bp, Homo sapiens
ctcatcttgaactcccgacctcaagtgatcctcctgcttcagcctcccaaagtgctaggattacagatatgagccaccacgcttggcccactgagcttgtkttcctgccactagatggtcccctctaggggtgatgggagacagtgacagatcatcaggcattataatctcataaggaatgcataacctagatcccttgca

SEQ ID NO: 51429 - DNA, 201 bp, Homo sapiens
atttgtacagccatattcataacagcattactcacaatagcccagaggcgaaacaaccccagtgtccattgatggaaggatgaatgaataaatagaatgcrgtgtatccacacaatgggatattgttcagcctttaaaaggaaggaaattctgacacatgctacatacaacatggttataccttcgggacattatgctaag

SEQ ID NO: 51430 - DNA, 201 bp, Homo sapiens
tgagccgggcgtggtggcagtcgcctgtaatcccagttacagaggctgaggcaggagaatcgcttgaacccgggaggcgaaggttgcagtgagccaagatytcgccattgcactccagcctgggtgacaagaacgaagctctgtcttaaataaataaataaatctacaagtcctttcacttggcacaaatcactgtataat

SEQ ID NO: 51431 - DNA, 201 bp, Homo sapiens
ttgtgaccgtggagacttacggcagtgcaaaggcggccataaacaatgcacaagcaatccagcatggctgtgttccaataaaacttgatggattataaaayttgaatctcattttttatagagtatgaaaccatttattctgaagcacacactcatactccaaaaacaatactatatattccctctctctctctcctgtgt

SEQ ID NO: 51432 - DNA, 201 bp, Homo sapiens
tgaatcacttttccttcctattctaagtcatagctagggagagggcttcctggaagagggtggagacctggagtgtcctggagggaaaaaactggactgtyagctgcagagaggtcattactctgccatgagacagacacagctgtgaccagctgcaatagcagcacctggtctctcaaggcgtgtcttccctgggagcag

SEQ ID NO: 51433 - DNA, 201 bp, Homo sapiens
tttattaggtgtgagatgaactgtgttacagattttatatgccgctgttgaaagacaacaataagtggtagtgagtggatattgtgaccgtggagacttayggcagtgcaaaggcggccataaacaatgcacaagcaatccagcatggctgtgttccaataaaacttgatggattataaaatttgaatctcattttttata

SEQ ID NO: 51434 - DNA, 201 bp, Homo sapiens
aatagggggccactgggaggaaatatgtaccagcatggcgggtcatgtaactgggaaaacccagtcaagatatttcaggccaaggaaagaaaatgttctcrtgacctagaagcaaaggtaattgtatgtgtatgtatttaaaaagtatgtataaaaaacctcacctgaaccttgatttctaaacatgcaaaaatccttttc

SEQ ID NO: 51435 - DNA, 201 bp, Homo sapiens
cgtctgagacacactgtccctcggctgctcgcgtgcacacaggcttgaggatccggacacgacacgctctgtccgtgacccagccctccccacctccagcrcccccgatgccacccccaccctcactgccggttccagtcgggccccagtaaagccagccgagccctcccagcttcacccgggctgattacttctacagac

SEQ ID NO: 51436 - DNA, 201 bp, Homo sapiens
aggcagcacatcacagcgggaggagctgtcccaggtggcccagctcagcaatggcaatgggggtccccagagtcattctgctctgcctctttggggctgcrctctgcctgacaggtacgcaaacttctgaatccagtagtgagaaggggcaggtggcctggactcctagatctgagggaggagagactgggggcctggact

SEQ ID NO: 51437 - DNA, 201 bp, Homo sapiens; identical to SEQ ID NO: 10989

SEQ ID NO: 51438 - DNA, 201 bp, Homo sapiens
ggccgaggcgggcagatcacttgaggtcaggaattcaagaccagcctggccaacatggtgaaattctgtctctactacaaatacaaaaattagccaggcayggtggcacatgcctgtaatcccagctactcgggaggctgaggcagaagaatggtgtgaacctgggaggcggagcttgcagtgagccgagatcacgccact

SEQ ID NO: 51439 - DNA, 201 bp, Homo sapiens; identical to SEQ ID NO: 10990

SEQ ID NO: 51440 - DNA, 201 bp, Homo sapiens; identical to SEQ ID NO: 10991

SEQ ID NO: 51441 - DNA, 201 bp, Homo sapiens
ttcccaggtccttgaaaaagacattcctgggttgtaacgctggcaagagaccaggagaagatttacctacatttcaaaggggcagagaaggccgggcacastggctcacgtctgtaatcccagcaatttgggaggccgaggcgggcagatcacttgaggtcaggaattcaagaccagcctggccaacatggtgaaattctg

SEQ ID NO: 51442 - DNA, 201 bp, Homo sapiens
gagtgctacgcctgtatcggggtccaccaggatgactgcgctatcggcaggtcccgacgagtccagtgtcaccaggaccagaccgcctgcttccagggcartggcagaatgacagttggtaaggggctggaagggtggaagggcctgggcaagggatatggaggcagggcagccatgagggtagtgataccagacaggccc

SEQ ID NO: 51443 - DNA, 201 bp, Homo sapiens; identical to SEQ ID NO: 10994

SEQ ID NO: 51444 - DNA, 201 bp, Homo sapiens
tgggcaccaactctctagcttcccaaggccatcagtctcccatagtggttccctcacatacataacagaaagtaacattgaggaaatgagctacactttcygctagctggagaaacaagttcttttgtcctttttggaagctctggtgttggcagattcggctcatcataaaaagtttgaaacactggtttgggagagtgc

SEQ ID NO: 51445 - DNA, 201 bp, Homo sapiens; identical to SEQ ID NO: 10995

SEQ ID NO: 51446 - DNA, 201 bp, Homo sapiens
cccagtcggcagtgcgggtaagggtgggagaagcaatgaggcgaatgcgagcagccgaagaaggcgacagtgtggctgggtatgaagacttgagggagggrgtggggcaaaacgaggtcaggcgtctccctggccgcgtgtgatggaccgtccgtggtggtgacagacatggtgtagggggtgtgtgcaatattatgtgcg

SEQ ID NO: 51447 - DNA, 201 bp, Homo sapiens
atagatagatagatagagtggggcgtggtggctcacacctggaatcccagcagtttgggaggccaaggcgggtgaatcgcttgaggttaggagttcgagaycagcctggccaacatggtgaaactccatctctactaaaaatacaaaaattaggcatggtggtgcacacctgtagtcccagctactcaggaggctgaggca

SEQ ID NO: 51448 - DNA, 201 bp, Homo sapiens
ggaatagcttgaacctgggaggcagagattgcagtgagctgagatggcgccactgcactccagcctggtgacagagtgagactccatctcaaaaaaaaaawaaataaataaagtccttatggtataaagagccaagtggaaacccttgaaactcaatactgtgctgtgggaggaattgcagagattgcatcatcatcaaaa

SEQ ID NO: 51449 - DNA, 201 bp, Homo sapiens
cctctttctttctctctttccttctttctttctttctttctttctccctttgtcacccaggctagagggcagtggcgtgatctctgctcactgcaacctcygccttccaggtccaagccattctcctgcctttgcctcccaggtagctgggattataggtgcccaccaccacatcaggctaatttttgtatttttagtaga

SEQ ID NO: 51450 - DNA, 201 bp, Homo sapiens
gaccaattgtttgggccttttgatgtgtttttttttttttttctctccatgtatctgtgttacatgggtctatacattttgtatccatatgtgattttgatttttttttttttttgagacagagtctccctctgtcgccgcccaggctggagtgcagtggcgcgatcacagctcactgcaacctctgcttcccaggctcca

SEQ ID NO: 51451 - DNA, 201 bp, Homo sapiens
ggctggggcagtggctcaggcctgtaactctagcactttgggaggcagaggctggcgaatcacgaggtcagaagtttgagaccagcctggccaacatggcraaaccccgtctctactaaatatacaaaaagttagctgggcgtggtggcgggcacctgtaatcccagctactcgggaggctgaggcacgagaatcgcttga

SEQ ID NO: 51452 - DNA, 201 bp, Homo sapiens
gctactcgggaggctgaggcacgagaatcgcttgaatccgggaagcggaggttgcagtgagccgaaatcgggtcactgcactccagcctggcgacagagcraggctccgtcctccgccccacaaaagaaaaagtggatgagggacgagcggtgaggggaggaaacaatggggaagcaaggaagagaaggtgggagaggcgc

SEQ ID NO: 51453 - DNA, 201 bp, Homo sapiens
ggtctgagggagaaggtttgaccctggtctgagggagaagatttggccctggtctgagggaggaggcatgaccctggtctgagggaggaggcatgaccctrgtctgagggaggaggcatgaccctggtctgagggaggaggcaagaccctggtctgagggagaaggtttgaccctggtctgagggagaagatttggccctg

SEQ ID NO: 51454 - DNA, 201 bp, Homo sapiens; identical to SEQ ID NO: 10986

SEQ ID NO: 51455 - DNA, 201 bp, Homo sapiens
ctgagggagaagatttggccctggtctgagggtggaggcatgaccctggtctgagggaggaggcatgaccctggtctgagggagaagcctggccctgctcwgaggaaggaggccatgccctggtctgagggaggaggcataaccctggtctgggggaggaggcatggcccctggtctgagggaagaggcatggccctggtc

SEQ ID NO: 51456 - DNA, 201 bp, Homo sapiens
aaataaataaagtccttatggtataaagagccaagtggaaacccttgaaactcaatactgtgctgtgggaggaattgcagagattgcatcatcatcaaaayttagaggatgcaggattatttgtccctatcatacctccattcatttcacttggcccctgcaaaaaacctgcatgactgaagctagtggatgtggtagatt

SEQ ID NO: 51457 - DNA, 201 bp, Homo sapiens
gtgtccatcacatggagttattcctgagtctgcaaatgtttttctctgtgattgggccatctgagtttgctgattgtcaattatcaaagtgaggctcccaycctcccacagagactgggcgataggggtgctgtctcccttgatgatttcaaagggataattcccaggtccttgaaaaagacattcctgggttgtaacgct

SEQ ID NO: 51458 - DNA, 201 bp, Homo sapiens
ctggtctgagggtggaggcatgaccctggtctgagggaggaggcatgaccctggtctgagggagaagcctggccctgctctgaggaaggaggccatgcccyggtctgagggaggaggcataaccctggtctgggggaggaggcatggcccctggtctgagggaagaggcatggccctggtctgagggaggaggcacgaccc

SEQ ID NO: 51459 - DNA, 201 bp, Homo sapiens
aggcagagattgcagtgagctgagatggcgccactgcactccagcctggtgacagagtgagactccatctcaaaaaaaaaaaaaataaataaagtccttayggtataaagagccaagtggaaacccttgaaactcaatactgtgctgtgggaggaattgcagagattgcatcatcatcaaaatttagaggatgcaggatta

SEQ ID NO: 51460 - DNA, 201 bp, Homo sapiens
atgtgtccatcacatggagttattcctgagtctgcaaatgtttttctctgtgattgggccatctgagtttgctgattgtcaattatcaaagtgaggctccyatcctcccacagagactgggcgataggggtgctgtctcccttgatgatttcaaagggataattcccaggtccttgaaaaagacattcctgggttgtaacg

SEQ ID NO: 51461 - DNA, 201 bp, Homo sapiens
tggtctgagggtggaggcatgaccctggtctgagggaggaggcatgaccctggtctgagggagaagcctggccctgctctgaggaaggaggccatgccctrgtctgagggaggaggcataaccctggtctgggggaggaggcatggcccctggtctgagggaagaggcatggccctggtctgagggaggaggcacgaccct

SEQ ID NO: 51462 - DNA, 201 bp, Homo sapiens
caagttaactcaaaatattcacctctcaccttttatttagagccttctccaggctctaaataaaatataaatacaaaggatatttaataattctttatgarcatattttaaagctgtattagaaactacacaaatgctgccaaagaaaggtgtttgatcacgctgtgggtggtctggtatatatttactattatttaaaaa

SEQ ID NO: 51463 - DNA, 201 bp, Homo sapiens
ttgcagtgagctgagatggcgccactgcactccagcctggtgacagagtgagactccatctcaaaaaaaaaaaaaataaataaagtccttatggtataaaragccaagtggaaacccttgaaactcaatactgtgctgtgggaggaattgcagagattgcatcatcatcaaaatttagaggatgcaggattatttgtccct

SEQ ID NO: 51464 - DNA, 201 bp, Homo sapiens
ttgcctaggctggagtgtagtgacacaaacacagctcactgcagcctcaacctcctgggctcaagtgatcctcctacctcagcctccatccccagtagctrgaaccacaggtgcacgccaccttgcccgactaatgattcttctttaaaattgtttgtaaagaaagggtctcactgtgttgtccaggctggtctcgaactc

SEQ ID NO: 51465 - DNA, 201 bp, Homo sapiens
agaggctgaggcaggagaatcacttgaacccgggaggcagaggttgcaatgagccaagattgcaccactgcgctccagcctgggcaacagaatgaaacagygtctcaataaataaatacataaatacacaaataaatacaacaataatccccacaaagaaagctcttaacaacagggatgatccatcccatgaaagtaagt

SEQ ID NO: 51466 - DNA, 201 bp, Homo sapiens; identical to SEQ ID NO: 10984

SEQ ID NO: 51467 - DNA, 201 bp, Homo sapiens
tagcaatccaaagcgaactttggattttgcttgtgtatttattagagacaaggtctcgctctatcccaggctggagtgcagtggcacaatcagctcaccgyggcctcaatctcccaggctcaagcaatcctcccacctcagcctccctagtagctgggactataggtgtgtgccaccacaccctgctaatttttgtatttt

SEQ ID NO: 51468 - DNA, 201 bp, Homo sapiens
tcccaagtagttgggcctgcagggggacaccaccatgcctgaccaattgtttgggccttttgatgtgtttttttttttttttctctccatgtatctgtgtwacatgggtctatacattttgtatccatatgtgattttgatttttttttttttttgagacagagtctccctctgtcgccgcccaggctggagtgcagtggc

SEQ ID NO: 51469 - DNA, 201 bp, Homo sapiens
atgtctatcaaggacaaaaaataatcaggaccagaaaatggaaagctattatgaaacaaagtggatcattgaatgaatttttgagaaaaacaaagttgcamggggaaaaaatttccacagctgctattttggcagaatgtagcacagatccattaattattgagcagaacagaccatgaatttactccttccacttttggg

SEQ ID NO: 51470 - DNA, 201 bp, Homo sapiens
cttctgtgatttgggacctctctgggtatgattttctgtgcatctggtccctctctgtgttgatatggttatcatacaggcacaagcatcctcacagacakacgctttgtgtctgtgtgattttccatgtgtgaagtgctgtgccttagttagggaggtttatattgcagggtccagatgcgtacttgttttgtgtgagaa

SEQ ID NO: 51471 - DNA, 201 bp, Homo sapiens
tagaaaggaggctattcctgcacacaaccaaatctgtgtgtttctgctccttaatgggagagagtttgatttctgtatgtgtccaggttcagtatgtcctrtgagtctctgtgcttgtgtgtgtttctctgtataggttttaaagtcttagtctgaacaaatgcgtttgtgggtctgtttctgagtttgctttctttgtaa

SEQ ID NO: 51472 - DNA, 201 bp, Homo sapiens
tagtggctgctgtcaaagaaaaattgcacaggcaaggcagactttattcaaggagattgcaatagggaaagagactgaactcaactccactgaaacaaatrtgctagggtggttaagccctaggtgagttaatggaaaaatattggaggacaatgggggaggtgggtcaacgggatgtgtccatcacatggagttattcct

SEQ ID NO: 51473 - DNA, 201 bp, Homo sapiens
gaaatgagtagaatgtggtggatgctgtgatttgccaccaagatctctttaggaatgaaggactctgacagctgcttctgatgtcagccccttgggcattkcctcagctgatcagaacccagaagcccagtgccagacctccccctggggtgcactgaacccttggattgactgaatcaggacccaatctcaccctctgct

SEQ ID NO: 51474 - DNA, 201 bp, Homo sapiens
tgatgatttcaaagggataattcccaggtccttgaaaaagacattcctgggttgtaacgctggcaagagaccaggagaagatttacctacatttcaaaggsgcagagaaggccgggcacactggctcacgtctgtaatcccagcaatttgggaggccgaggcgggcagatcacttgaggtcaggaattcaagaccagcctg

SEQ ID NO: 51475 - DNA, 201 bp, Homo sapiens
caaatgtttttctctgtgattgggccatctgagtttgctgattgtcaattatcaaagtgaggctcccatcctcccacagagactgggcgataggggtgctrtctcccttgatgatttcaaagggataattcccaggtccttgaaaaagacattcctgggttgtaacgctggcaagagaccaggagaagatttacctacatt

SEQ ID NO: 51476 - DNA, 201 bp, Homo sapiens
aagtgcacacagcactcacatactcatgcattcaccagactggtctgcctaccctgtaagcctcaatccctgaaactgacaactgctgtgaagaccttcartgcctccaccttccacgggggcttcagaaaaaccatcctccttcctggccagactccactctccagagacccccgagcacaaccctgccccggtctggat

SEQ ID NO: 51477 - DNA, 201 bp, Homo sapiens; identical to SEQ ID NO: 10996

SEQ ID NO: 51478 - DNA, 201 bp, Homo sapiens
tcagttaattgttgcagtttttaaatattcaaataactgatgataaataatgtcagaaatgaaagtgtccccctactcattccctatctacagaaatgacsaaagttaatattttcaggtattcttccagatttttctgtacactgaatgtatgtataaagacacagctattttatacagaaatgggatcatgctatccat

SEQ ID NO: 51479 - DNA, 201 bp, Homo sapiens
gaaacccttgggacgcgccgtcccaaacttgggtttctggcgtctcctgcgtttccggcccgggactacaattcccacaggtcactgggccgaatgagcgkgcgctcctgatccgctttgcgcatcccagtgattcttgggttccgcgtgtagtttcggaaggagacatcgaagcagggcgaggcgcagagggcgttgcgg

SEQ ID NO: 51480 - DNA, 201 bp, Homo sapiens
agcacgagccccgatcccgcccccagggtatcgcgcgccggtgaccctggtgcggaagggctgctggaccgggcctcctgcgggccagacgcaatcgaacscggacgcgctgccgccagactactcggtggtgcgcggctgcacaactgacaaatgcaacgcccacctcatgactcatgacgccctccccaacctgagcca

SEQ ID NO: 51481 - DNA, 201 bp, Homo sapiens
ggagttcccagactttttaacaaccagatcttgcataaactcattactgtgggagggcaccatgcaggggctacctttcactgaaactaatcaagttaccrccgctactgagtacccaatctgctagcagcagaggctgatcctgagcacttgatatgcaactgcttctcaaggagaccagccagctacctcatagtaacg

SEQ ID NO: 51482 - DNA, 201 bp, Homo sapiens
gggtttcactatgttgcccaggctggtctcaaactcctgagctcaagcaatccactcacatcagccaatgagactggccttttttcttgtggttgtttttwaaatagagataaggtctcactctgttgcccacactaaggtgtagtagcacaaccatggctcactacagcctcaaactcctggctcaagcaattctcctgc

SEQ ID NO: 51483 - DNA, 201 bp, Homo sapiens
ggcccatggctttctgtttggtcaggatcttgtaaggaatgagactggaagctcaggggcaagtaggtctaggaagaagtatgtggatacatttatgggcrtacatacaaaatgcatgcatatatgtgtctcatcctaattcctactaaaaataatccttggttgggcacagtggctcatgcctgtaatcccagcactttg

SEQ ID NO: 51484 - DNA, 201 bp, Homo sapiens
atggatgctcccaaaaggtacagggagctgacacttcaaagtctccaaaagtacctgaatgataccagaatcaaaagtgcacacagcactcacatactcaygcattcaccagactggtctgcctaccctgtaagcctcaatccctgaaactgacaactgctgtgaagaccttcaatgcctccaccttccacgggggcttca

SEQ ID NO: 51485 - DNA, 201 bp, Homo sapiens
gaaggtacccacatttagtaaactgcttatgaaaatcaaatatgaaaaaaaattttgagaggccagatgtttgcaaacatgattggaaatggaaccatgcrtggaaactgatggaatgcaacagaagatccttgagaacattctaaggcattcagaattctaaggcattcaacagactcgtgaacactcagacaccaggca

SEQ ID NO: 51486 - DNA, 201 bp, Homo sapiens
ggtgatgggagacagtgacagatcatcaggcattataatctcataaggaatgcataacctagatcccttgcatacgcaattcacaataggattcacgctgytatgagaatctaagccactgatctgacaggagacagagctcaggtggtagtacaagtaatggggagaggctgtaaatacagatgaatcttccctccctca

SEQ ID NO: 51487 - DNA, 201 bp, Homo sapiens
gactacatttctagaaatggattcctgaattaaaagagatgcttctcttaaatatttatgtaaagttactctcagaaaggttgtaagtggattcctcccamcaaaagtattgtgaatgaatatcttcttaaaatttacaattgttttgaccatttcccagtccttaaaccaatgataacattttattttctttttcttttt

SEQ ID NO: 51488 - DNA, 201 bp, Homo sapiens
tctggtcactgatatcacctctctcatcctctgccatctctcacctcctggtctctcttgcttatcaagagaagactagagctcttggatcccagcttttyccctgcctcagctgaggccactaccctggttgactcccatggtgacatggatgcctcatccagtatcgtgggtctgagtcctcatctgcagggtccttga

SEQ ID NO: 51489 - DNA, 201 bp, Homo sapiens; identical to SEQ ID NO: 10997

SEQ ID NO: 51490 - DNA, 201 bp, Homo sapiens; identical to SEQ ID NO: 10998

SEQ ID NO: 51491 - DNA, 201 bp, Homo sapiens; identical to SEQ ID NO: 10983

SEQ ID NO: 51492 - DNA, 201 bp, Homo sapiens
ggaagagacccgcccacatagggagggtgggacgaagaaatactggccaggctgggtggccgggatgcttaggactcagtaaggagaaccagccaggcagmacatcacagcgggaggagctgtcccaggtggcccagctcagcaatggcaatgggggtccccagagtcattctgctctgcctctttggggctgcgctctgc

SEQ ID NO: 51493 - DNA, 201 bp, Homo sapiens; identical to SEQ ID NO: 10985

SEQ ID NO: 51494 - DNA, 201 bp, Homo sapiens; identical to SEQ ID NO: 10987

SEQ ID NO: 51495 - DNA, 201 bp, Homo sapiens
ttgtctactggttctgtttctgtggttaatccaagactaacacagaatgtgttggagccagcgtggtggctcatgcctgtaatcccagcactttgtgaggytgggttgggcggatcacctgaggtcaggagttcaagactagcctggccaacatggtgaaatcccgtctctactgaaaatacaaaaattagccgggcatgc

SEQ ID NO: 51496 - DNA, 201 bp, Homo sapiens
caactttgatggtgtcacctctatccataatggttgaagctgttatgtggagtctctggcaagatacaaaagcaaaattacagcccgtaaggttctgaagyaagtccatttattatgcagcatataagtgctttcaatttgaaaaccagctgctgagtactaatagagtctgtgattttgaccatgggacatcaagtatct

SEQ ID NO: 51497 - DNA, 201 bp, Homo sapiens
agaataagttattacaactcacacttcctaaactgataaacaggcacataatttggtagggctctttgacatttgaaagtgatagatacatgataggtagrtagatagatagatagatagatagatagatagatagatagatagagtggggcgtggtggctcacacctggaatcccagcagtttgggaggccaaggcgggt

SEQ ID NO: 51498 - DNA, 201 bp, Homo sapiens
cagcaacatccctgcatgaactcagaacaactctacatgggcacaagcagcaacgaaacctgacctcatgcctgcaatgggcactacttgtctcaagcccyagggctttcctgttgatgctgatgcatgagacgttacagaacccattgaactattcacacgcgacctggaagtacagcggagttaatagtctctgggaca

SEQ ID NO: 51499 - DNA, 201 bp, Homo sapiens
cgagtaactgggactacaggcacatgccaccgtgcacagctagtttttaaattttttgtggagacggggtctccgtgtgttgcccatgctggtctcaaactcctttttctttctttctttttttttttagaaataggttctcactatattgcccaggctggcctcaaactcctggcctcaaacaatccccccactttcggc

SEQ ID NO: 51500 - DNA, 201 bp, Homo sapiens
gtatgaaaccatttattctgaagcacacactcatactccaaaaacaatactatatattccctctctctctctcctgtgtgtttgcgtgtgtgtgtgtgtgkgtgtgtgagagagagaaaggttttaaaggagacaactaactgattctgaggttagggcaaaaagattggggctgtggttggtgtggtaagaacctttgga

SEQ ID NO: 51501 - DNA, 201 bp, Homo sapiens
atgaaaccatttattctgaagcacacactcatactccaaaaacaatactatatattccctctctctctctcctgtgtgtttgcgtgtgtgtgtgtgtgggkgtgtgagagagagaaaggttttaaaggagacaactaactgattctgaggttagggcaaaaagattggggctgtggttggtgtggtaagaacctttggata

SEQ ID NO: 51502 - DNA, 201 bp, Homo sapiens
tcaggtgatccacccaccccagcctcccaaagtgctaagattacaggcgtgagccactgagcccagcctacttttcagtttttaacataatttttgttttrtccacaacttttcaagtattgaaagtagaataaaaacatgggttcttagtctttagctatctgttaaagcctatgaatgccttcttaaaatcatgttttt

SEQ ID NO: 51503 - DNA, 201 bp, Homo sapiens
atacataatatacaatacatattatgtatgcatacataatatacaatacatattatgtatgcatacataatctataatatacataatatataatataatayataatatacatatataatatataatatattatgtatacataatatacatatataatatataatatattatgtatacataatatacatataatatataata

SEQ ID NO: 51504 - DNA, 201 bp, Homo sapiens
gctagtcgctgaatttctgttgatgtctcttgaattaaatacagaagtggcattttaaagagtagttaattgcctcatttgaaacagatgtctgatcattaaaaaaaaaaaaacgtaaaaaggaaaattacctacctaaagatgtgaaagcaatagatgagaattgtcttttaactatctgtaaagactgtggatatttaa

SEQ ID NO: 51505 - DNA, 201 bp, Homo sapiens
aaaaatactactgacttttgtatgttgactttgtgtcttacaactttactgaattcatgtatcagttctaatagttttttgatggagtctttcttctctcttttttttttttttttttgaggcggattcatgctctgtcgcccaggctggagtgcagtggcgcaatctcggctcactgcaacctccgcctcccaggttcaa

SEQ ID NO: 51506 - DNA, 201 bp, Homo sapiens
gtatacataatatacatataatatataatatattatgtatacataatatacatataatatataatatattatgtatacataatatacatataatatataattattatgtatacataatatacatataatatataatatattatgtatacataatatacatataatatataatatattatgtatacataatatacatataat

SEQ ID NO: 51507 - DNA, 201 bp, Homo sapiens; identical to SEQ ID NO: 11022

SEQ ID NO: 51508 - DNA, 201 bp, Homo sapiens
ctgagatgggaggatagtttgagcccaagagtttgaggctgtagtgagctatgatcataccactgcactccagcctgggcaaaagagcaagaccctgtctaaaaaaaaaaaaaaaaaatgctgggcgcggtggcttacaccaataatcgcaggactttgggaggctgataggggaggattgcttgagcccaggaattcaat

SEQ ID NO: 51509 - DNA, 201 bp, Homo sapiens; identical to SEQ ID NO: 11024

SEQ ID NO: 51510 - DNA, 201 bp, Homo sapiens
tgtgacaagttccaatttcttttcaagtcaattgaactgaaatctccttgttgctttgaaatcttagaagagagcccactaattcaaggactcttactgtrggagcaactgctggttctatcacgtatgtactctttgttctttttctcccatttggtcttcaaacactctgtgtttgtaacttgttctgcctgctaggtt

SEQ ID NO: 51511 - DNA, 201 bp, Homo sapiens; identical to SEQ ID NO: 11027

SEQ ID NO: 51512 - DNA, 201 bp, Homo sapiens; identical to SEQ ID NO: 11028

SEQ ID NO: 51513 - DNA, 201 bp, Homo sapiens
gctgcaatggtggcttcatgacaacggctttccagtacatcattgataacaagggcatcgactcagacgcttcctatccctacaaagccatggtgcgtctwaagcaaactttttgtgctgccccatgatctcatgttatccactgactgactgtgctgggcttgccaccatgccaattgcttgagaagcagtattgtgtgt

SEQ ID NO: 51514 - DNA, 201 bp, Homo sapiens; identical to SEQ ID NO: 11008

SEQ ID NO: 51515 - DNA, 201 bp, Homo sapiens
caggaggcatccagtagaaaacattgttatcagaggagatgacagctccatacgtgttgttgcccctgaagaccttccagtgggacaagaggtggagacgraatgcagtgatactgatgatcctgaccttgtataggcctaggctaatgtgtgtgtgtgtttgtattttagtttttaacaaaaaagtgtaaaaacttttaa

SEQ ID NO: 51516 - DNA, 201 bp, Homo sapiens
atttgctttgtagaccagtgaagaagtgatgtctttgatgagttccctgagagttcccagccagtggcagagaaatatcacatataagtcaaaccctaatyggatattgcctgattctgtggactggagagagaaagggtgtgttactgaagtgaaatatcaagtgagtattaccatcccaagcctctgaaccctaggtag

SEQ ID NO: 51517 - DNA, 201 bp, Homo sapiens
actgaagtgaaatatcaagtgagtattaccatcccaagcctctgaaccctaggtagagctctttaaatgcttagtctagctacagaatttgacagtgaatyttacagtcccacgtgttactttctagttatttttgttattcttgtcttcccaactaaattataagttccttaagggcaaggatcacatattatattttat

SEQ ID NO: 51518 - DNA, 201 bp, Homo sapiens
ttgctgaatgtagagttgccacaaaccttcaatttgtaaaaaatgcaatatctagctgggtgcagtggctcatgcctataattccagcgctttgggaggcmaaatcaggaggatgactggagcctaggagattgaggttacaattagctatgatcataccacctgtattacagcctagacaacagagcaaaacactgttcc

SEQ ID NO: 51519 - DNA, 201 bp, Homo sapiens
tcagcccccacagtgcttttctaagtgatcatagagccacctacttagacaaacactgaactaagcaaataggtgtttaacacagacttttattgctcacrctatgcattgactgcactggactctccaataagccaattgcttgagaagcagtgttgtgtgagagagccctggtgatcaggaagtttctccatttcactt

SEQ ID NO: 51520 - DNA, 201 bp, Homo sapiens; identical to SEQ ID NO: 11011

SEQ ID NO: 51521 - DNA, 201 bp, Homo sapiens
ttatctctatgtaatatttccctacagtccacctgaaagtctgaggggccattgtcctggcaagttttgcatgtatgaggatgttcacaatttgaaagaayagaatagttctgtatttcctccattattgctgaaacccgggactgttaggatttggaagatttgcaaaggaaggagccttagacacatgaaaaagttaaa

SEQ ID NO: 51522 - DNA, 201 bp, Homo sapiens
cacgatctcagctcactgcaacctctgcctcctgggttcaagcaattctcctgcctcagcctcctgagtagctgggactacaggtgcgtgccaccatgccyagctaatttttgtatttttagtagagatggggtgtcaccatgttggccaggatggtctcgatctcttgaccttgtgacccgcccgccttggcctcccaaa

SEQ ID NO: 51523 - DNA, 201 bp, Homo sapiens
ggaggctgaagcaggagaatcgcttgaactcaggaggtggaggtgcagtgagccgagatcacgccactgtactccagcctcggcaacggagcaagactccrtcccaaaattaaacagattttaagcaaactatccttaaaattatttctctgtatttaaactttttcttctgcagcctcccatgctcaaccttattctcag

SEQ ID NO: 51524 - DNA, 201 bp, Homo sapiens
agtcaaaccaattttaccttatctatgtccttgattctgttccttctctgtttcttctattacggctctagttcaggcatctctagtgtggactattgctrtacccttctaactggtctcctttactctctattttcttcccctttaccctcaaatccatctttcatactgctgccaaacttatttgtctaaaatatgaac

SEQ ID NO: 51525 - DNA, 201 bp, Homo sapiens
aaaagtcaaacttacagaaacagacagtagaatgatagctgccagggactggaggctgggtaatgaggagatgctgatcaaagagtgtaaactttcaggtrtaagatgaacagattctgggaatcaaaggtacagcacgggtggagatggatgtgttatttcatttgattatgtcaatcattgcacaatgtgcacatacat

SEQ ID NO: 51526 - DNA, 201 bp, Homo sapiens
ggaagttagcaggactcagtcaaaaagaggtctgggatcttttgcaaaactgggggcaattgatcttggtcggtaaaactgagaaaagtaaattgtttagwtgttgaatggggtctgggattccttggtctcactgactgaattcatactgctagtaactagaccctcaattcaattttcatactagaactcaggtccaaa

SEQ ID NO: 51527 - DNA, 201 bp, Homo sapiens
ggaggatcacctgaggttgggagttcgagaccagcctggccaacatggagacactccatctctactaaaaatacaaaattatccgggcatgatggcgcacrcctgtaatcccagctactcaggaggctgaggcaggagaatcacttgaacctgggaggtggaggttgcagtgaggcgaggttgtgccattgcactccagcc

SEQ ID NO: 51528 - DNA, 201 bp, Homo sapiens
actatagttttccttaggtattaagtctattcatcaatatagcactaaagctttccaaaccattattttgagttacctgaaatccctggagaaattattaycttatttcattctaattttgttttacggcctttcatatgtaatcacttataggagaaaaacaatgagataaaaagttgataacatggtttgattgtacgc

SEQ ID NO: 51529 - DNA, 201 bp, Homo sapiens
tttaccactgttgccaaagtgaagaagggaacgccctaggtagactgaattccttcttaaatgcaggaatctcctttgtaattatttctcacatgggaaaycagtttagtccactttttagacagcccttttataaaattctgccttgctttgaaacaaaaatctgcctccctgtaacttctagtttttaccattctcttt

SEQ ID NO: 51530 - DNA, 201 bp, Homo sapiens
agactgtggatatttaaacaggtcagttaagaagagcccatgtattcaaaaattcaggagataaactgatttttcagaggtttgtctctcttaaggatgatttttttttttttttgagagagagagaaagagatttcctttgattagatttgttggcaaatcctggaaagtccctgttttctaaccctctagatgtgtttg

SEQ ID NO: 51531 - DNA, 201 bp, Homo sapiens
ctatgctgtttaaattactatagttttgtaatatattttgaaaccaggcattttgtaatgcctccagctttgttcctcttgctaaagattactttgactayttaaggacttttgtagttccgcatgaatttgaggattgttttttctatttctgtgaagaataacattagaattttgatagaaattgcactgaatttctag

SEQ ID NO: 51532 - DNA, 201 bp, Homo sapiens
cctgacttttgattcgtatcctacctttataattgatctcaaagtgcacttctttttttttttttcctttcttgcacttagttagatttgtttgcctttayaccattgcttctcatcttgtggtttggaagtaagcccatcatgcatgcccattatgtccattactggggtaacagtaaaaccttgctccaagggaaagaa

SEQ ID NO: 51533 - DNA, 201 bp, Homo sapiens
cagcactttgggaggccaagggggaaggatcctttaaggccaggaatttgagaccagcctaggcaacatagggagaccctgtctctacaaaaaaaaaaaataataataaaataaaaataaaaataagctggttgtggtggtgcaggcttgcagtcctagctactcgggcagctgagatgggaggatagtttgagcccaaga

SEQ ID NO: 51534 - DNA, 201 bp, Homo sapiens
aaatcacctaacgatgcatttctcagaacatattccagtcattaaacaatgcctgactgtatatttgctttgtagaccagtgaagaagtgatgtctttgaygagttccctgagagttcccagccagtggcagagaaatatcacatataagtcaaaccctaatcggatattgcctgattctgtggactggagagagaaaggg

SEQ ID NO: 51535 - DNA, 201 bp, Homo sapiens
atcgcttgagcctgggaggttgaggctacagtgagccatgatcacaccactgcacttcagtctgagtgacagaaggaaaccctgtctcaaaacaaacaaamaaaaagaagtaaatggtactgctaatctcttattcttttccacctacatatttttctttcaattagttttggatttcttacccgaggttctctaaaataa

SEQ ID NO: 51536 - DNA, 201 bp, Homo sapiens
gaccttgtatctgttttagggttcttgtggtgcttgctgggctttcagtgctgtgggggccctggaagcacagctgaagctgaaaacaggaaagctggtgwctctcagtgcccagaacctggtggattgctcaactgaaaaatatggaaacaaaggctgcaatggtggcttcatgacaacggctttccagtacatcattga

SEQ ID NO: 51537 - DNA, 201 bp, Homo sapiens
cttcatcatatttatacttctttttgcaggatcagaaatgtcaatatgactcaaaatatcgtgctgccacatgttcaaagtacactgaacttccttatggsagagaagatgtcctgaaagaagctgtggccaataaaggcccagtgtctgttggtgtagatgcgcgtcatccttctttcttcctctacagaagtggtaaaa

SEQ ID NO: 51538 - DNA, 201 bp, Homo sapiens
atgcaatatctagctgggtgcagtggctcatgcctataattccagcgctttgggaggccaaatcaggaggatgactggagcctaggagattgaggttacarttagctatgatcataccacctgtattacagcctagacaacagagcaaaacactgttccttaaaaaaaaaaaaaagctaatatctgcaaagcacaataaag

SEQ ID NO: 51539 - DNA, 201 bp, Homo sapiens
ctgggtgcagtggctcatgcctataattccagcgctttgggaggccaaatcaggaggatgactggagcctaggagattgaggttacaattagctatgatcrtaccacctgtattacagcctagacaacagagcaaaacactgttccttaaaaaaaaaaaaaagctaatatctgcaaagcacaataaagcaaagcacaataa

SEQ ID NO: 51540 - DNA, 201 bp, Homo sapiens
ttattttctcttatgaaaacatgtggtcacaacatatgcagctaatagcaacacttcctatgttacctttccttacacagaatgaaacggctggtttgtgygctcttggtgtgctcctctgcagtggcacagttgcataaagatcctaccctggatcaccactggcatctctggaagaaaacctatggcaaacaatacaag

SEQ ID NO: 51541 - DNA, 201 bp, Homo sapiens
ggctatggtgatcttaatgggaaagaatactggcttgtgaaaaacaggtaatatatttacactttatatttaattggaatcaggaatttgagggagtttcrgcaaatactctcatgattttgatgatgatcattatgatcacgatattgacaatgatgaactttatagcttcttacaaagtgacattctaaattactcagt

SEQ ID NO: 51542 - DNA, 201 bp, Homo sapiens
gaaatcactttttaaagtgctactaagcattggaagtagtatttctgacataaatctgcagctgttccctgtgactatatatcccaggaattttcctgtakaattctgtttataatagtctgtccctttgatagactttgcattgttattttctcttatgaaaacatgtggtcacaacatatgcagctaatagcaacactt

SEQ ID NO: 51543 - DNA, 201 bp, Homo sapiens
tctcaggtgtctactatgaaccatcctgtactcagaatgtgaatcatggtgtacttgtggttggctatggtgatcttaatgggaaagaatactggcttgtkaaaaacaggtaatatatttacactttatatttaattggaatcaggaatttgagggagtttcagcaaatactctcatgattttgatgatgatcattatgat

SEQ ID NO: 51544 - DNA, 201 bp, Homo sapiens
aatgcttagtctagctacagaatttgacagtgaatcttacagtcccacgtgttactttctagttatttttgttattcttgtcttcccaactaaattataarttccttaagggcaaggatcacatattatattttatttatacagttggccctccatatccacagcttccacatctgcagattccaccaaccgtggatcaaa

SEQ ID NO: 51545 - DNA, 201 bp, Homo sapiens
aaggtaaataaagaaacctacacccagatacatgtaacgaagttgtaaaacatcaaaaagaaagagcaaatcatggctgggtgtatggttcatgcctgtartcccagcactttgggaggccaagggggaaggatcctttaaggccaggaatttgagaccagcctaggcaacatagggagaccctgtctctacaaaaaaaaa

SEQ ID NO: 51546 - DNA, 201 bp, Homo sapiens
tcatgtgacaagttccaatttcttttcaagtcaattgaactgaaatctccttgttgctttgaaatcttagaagagagcccactaattcaaggactcttacygtaggagcaactgctggttctatcacgtatgtactctttgttctttttctcccatttggtcttcaaacactctgtgtttgtaacttgttctgcctgctag

SEQ ID NO: 51547 - DNA, 201 bp, Homo sapiens
gggaatgcactcatacgatctgggcatgaaccacctgggagacatggtaggtacattacaagaaatcccactttcacgtctgggtaaatatcatttccttyctgtctccccaaaagcaatttgaaggtaaacaacaataacaaaggaatgtatagtacaaagttggaaaacagtagaattgaaggacgtaagaacgtgtac

SEQ ID NO: 51548 - DNA, 201 bp, Homo sapiens
ttgagttgattattgtatatggggtgacataagggttcaatttcatttttctgcatttggatagccagttttcccaatactatttattaaacagactatcytttccccattgtgtgttcttggcacctttgctgaaaattgattgaccataaagttgcaggttatttctgggctctatatcctattccattggtaaatgtg

SEQ ID NO: 51549 - DNA, 201 bp, Homo sapiens
tcctttctgtctccccaaaagcaatttgaaggtaaacaacaataacaaaggaatgtatagtacaaagttggaaaacagtagaattgaaggacgtaagaacktgtacagaaatttcttacttagttctattttgactgctttctttctttaacaaatcacttctttagaggaaattttaaactcagagactaccattgtttt

SEQ ID NO: 51550 - DNA, 201 bp, Homo sapiens
aaaatgcaatatctagctgggtgcagtggctcatgcctataattccagcgctttgggaggccaaatcaggaggatgactggagcctaggagattgaggttrcaattagctatgatcataccacctgtattacagcctagacaacagagcaaaacactgttccttaaaaaaaaaaaaaagctaatatctgcaaagcacaata

SEQ ID NO: 51551 - DNA, 201 bp, Homo sapiens
cctgacccaggacttccctccaggtgtggatgacactgtcacggtgctcctgcagtacccaggggaggtccatggcagcttcacctgcagcatcaccgtgyagctctccaacacggcctccgtgagcggcaccaagggcatggtacaggtgaggcatggcgggcccaagcgctggggatcgtgcccctaaaataggagggg

SEQ ID NO: 51552 - DNA, 201 bp, Homo sapiens
gctcctatgaggagctggccaaggacccgagcgtgggtgagtggcgagggcgatgggggtgctggccgccgcccctggagcggtgccccctggctgccccstgggagatgcaaggctcctcaggatggtccaatccctttgggttccataaagacctttggctgggaggagaactataaaacgggcttggtctgggactgg

SEQ ID NO: 51553 - DNA, 201 bp, Homo sapiens
gctcctcaacccctgctggtgcccgaccgagctggtggtgaagggggagcataaggagttcccgctgcccccagtcccaaaggactgcaattttgacaacrgggcaggcatgagttatgaggccaagcacgtctgggagtgcctacgcaagggtaaggatatggatgcggggcaggcgccaggcctggtagggggatgttg

SEQ ID NO: 51554 - DNA, 201 bp, Homo sapiens
ggtgaagggggagcataaggagttcccgctgcccccagtcccaaaggactgcaattttgacaacggggcaggcatgagttatgaggccaagcacgtctgggagtgcctacgcaagggtaaggatatggatgcggggcaggcgccaggcctggtagggggatgttgggcccctccccacctgctctgtcaccctgctgttta

SEQ ID NO: 51555 - DNA, 201 bp, Homo sapiens
ggaattctgggaattgtagttctttgggtcttgggcgcgtgggtaggaggggtccctaactacactctccccacaggtatgaaggaaagtcctgtgattcycctgtcggaaagtgagctcctggctgacatccttgaagaggtgaggaaggccattggagtcaccttcccccaagacaaacgctgatgtatccccgaataa

SEQ ID NO: 51556 - DNA, 201 bp, Homo sapiens
gtgaagggggagcataaggagttcccgctgcccccagtcccaaaggactgcaattttgacaacggggcaggcatgagttatgaggccaagcacgtctgggagtgcctacgcaagggtaaggatatggatgcggggcaggcgccaggcctggtagggggatgttgggcccctccccacctgctctgtcaccctgctgtttag

SEQ ID NO: 51557 - DNA, 201 bp, Homo sapiens
cagccccttcctaaggacagctccctaagggagacaggggtgtgaccgaccacctggtccctgggtgctagggcggggcctcgaagttgtgggcggagctmggctgtctgggtgggcggggctgctgacctcttgacctactcccaccctagaggtggcctacattggcacccagcacccccagcacaaggcggcggtgat

SEQ ID NO: 51558 - DNA, 201 bp, Homo sapiens
tctctccctccagctcctcaacccctgctggtgcccgaccgagctggtggtgaagggggagcataaggagttcccgctgcccccagtcccaaaggactgcrattttgacaacggggcaggcatgagttatgaggccaagcacgtctgggagtgcctacgcaagggtaaggatatggatgcggggcaggcgccaggcctggt

SEQ ID NO: 51559 - DNA, 201 bp, Homo sapiens
gacctcttgacctactcccaccctagaggtggcctacattggcacccagcacccccagcacaaggcggcggtgatgctgtgcttggcggcgggcaaggccrttctgtgcgagaagcccacgggcgtgaacgcggcggaagttcgcgagatggtcgcggaggcccgatcccgagccctcttccttatggaggtgagggcaga

SEQ ID NO: 51560 - DNA, 201 bp, Homo sapiens
tgacctcttgacctactcccaccctagaggtggcctacattggcacccagcacccccagcacaaggcggcggtgatgctgtgcttggcggcgggcaaggcsgttctgtgcgagaagcccacgggcgtgaacgcggcggaagttcgcgagatggtcgcggaggcccgatcccgagccctcttccttatggaggtgagggcag

SEQ ID NO: 51561 - DNA, 201 bp, Homo sapiens
tttcactgtgttagccaggatggtcttgatctcctgtcctcgtgatccgaccacctcggcctcccaaagtgctgggattacaagcgtaagccaccgcgccyggccatttttctttttaatcaatcctgccacttgaagattatatggtaagggaaatctgcagtctatacacaatactgagttgctccaagcccttgagga

SEQ ID NO: 51562 - DNA, 201 bp, Homo sapiens
tatccccctatgattgggaccccagaagggattagaactggttggttaactcctttccttgtggtctgcaggccatctggacccgcttctttcctgcctcygaggctctgaggtctgttttggcccagggaactctaggagacctccgggtggctcgggcagaatttgggaagaatctcatccacgttccccgggccgtag

SEQ ID NO: 51563 - DNA, 201 bp, Homo sapiens
gggcggaggatggggacccgcccccggggtgggcggggcgtcaggtacttaattcgcgcctggagggaccgaaggtgccgagggctccgcatcgcaaccawggcgctgcgctggggcatcgtgtctgtcggcctcatctccagcgacttcacagccgtgctgcagacgctgcctcgctctgagcaccaggtctgcccgccc

SEQ ID NO: 51564 - DNA, 201 bp, Homo sapiens
gttggttaactcctttccttgtggtctgcaggccatctggacccgcttctttcctgcctccgaggctctgaggtctgttttggcccagggaactctaggasacctccgggtggctcgggcagaatttgggaagaatctcatccacgttccccgggccgtagaccgggcccaggctgggggggccctgctggacatcggcat

SEQ ID NO: 51565 - DNA, 201 bp, Homo sapiens
caggggaggtccatggcagcttcacctgcagcatcaccgtgcagctctccaacacggcctccgtgagcggcaccaagggcatggtacaggtgaggcatggygggcccaagcgctggggatcgtgcccctaaaataggagggggacaaatggcctctggagctagatgagagcttaaccagccaatttcacatcattgctaa

SEQ ID NO: 51566 - DNA, 201 bp, Homo sapiens
gcggtggcggcccgcgatctgagccgtgcgaaggagtttgcacagaaacacgacatccccaaggcctacggctcctatgaggagctggccaaggacccgarcgtgggtgagtggcgagggcgatgggggtgctggccgccgcccctggagcggtgccccctggctgccccctgggagatgcaaggctcctcaggatggtcc

SEQ ID NO: 51567 - DNA, 201 bp, Homo sapiens
agaggttgaagtgagccaagatcgcgccactgcactccagcctgggcgacagagtgagacttggtcttagaaataaataaataggccgggcgcggtggctsacgcctgtaatcctagcactttgggaggccaaggcgggcagatcatgaggtccggagatggagaccatcctggctaatacggtgaaaccgcatctccact

SEQ ID NO: 51568 - DNA, 201 bp, Homo sapiens
aacccactggcctgcatgctctatacctacatctaatctcttcttataaggacaccagtcatattgtcatattggataagggcccaccctaatgacctcatttttttttttttttttgagttggagtctcgctctgtcgcccaggctggagtgcaacggtgcgatcttcagctcactgcaacctccacctcccgggttcaa

SEQ ID NO: 51569 - DNA, 201 bp, Homo sapiens
tgctatgttgtccaggctggtctggaacttctgacctcaggtgatccgcccgccttggcctcccaaagcgctggggttacaggcatgagccacagcgcccrgcccccagttccaggagtttttttttgttgttgtcattttgcatttttctacatagatgatgtcatctatgaacaaagagttttatttctaccttctgta

SEQ ID NO: 51570 - DNA, 201 bp, Homo sapiens
cccggggatggacagggcaagctcttagccaccaggttcaagagggaggcccctgtgcaccacctggcatgttcctggaggcagcctcagcagcaccgttrgtgaaggcagcagtgccacttcttctctccctccagctcctcaacccctgctggtgcccgaccgagctggtggtgaagggggagcataaggagttcccgc

SEQ ID NO: 51571 - DNA, 201 bp, Homo sapiens
gctgagatggcgtcactgtactctagcctgggcgacagagtgagactccatctcaaaaaaaaaaaaagctgccccactttgcagaagaggcccttgccttrgcttccactcagctggaaagtatccaagagtgcctgagccacccagatgtgatgcccttcatctttgacctttaaccccaaggagcaagaggcagttcat

SEQ ID NO: 51572 - DNA, 201 bp, Homo sapiens
cttgccatgcaagaagtgaagtctcttgcccaaggttccacaggcaggatttggggcctgtgcagtctcagagactctgccctgagagaccctgccctgayccaggacttccctccaggtgtggatgacactgtcacggtgctcctgcagtacccaggggaggtccatggcagcttcacctgcagcatcaccgtgcagctc

SEQ ID NO: 51573 - DNA, 201 bp, Homo sapiens
gtgctcctgcagtacccaggggaggtccatggcagcttcacctgcagcatcaccgtgcagctctccaacacggcctccgtgagcggcaccaagggcatggyacaggtgaggcatggcgggcccaagcgctggggatcgtgcccctaaaataggagggggacaaatggcctctggagctagatgagagcttaaccagccaat

SEQ ID NO: 51574 - DNA, 201 bp, Homo sapiens
taaatctagcctacgtgcacatccggtcacagcacctttccttgaacttattcatgatacagattccttttctacatagacacagtaacaatctgatctctctttcttttccccacacaaacctgagtgtcttgaggtttggaaaggccttgatgtaagctactatgaagataatttcaatattgggggatttaataacgg

SEQ ID NO: 51575 - DNA, 201 bp, Homo sapiens
aaatctagcctacgtgcacatccggtcacagcacctttccttgaacttattcatgatacagattccttttctacatagacacagtaacaatctgatctctctttcttttccccacacaaacctgagtgtcttgaggtttggaaaggccttgatgtaagctactatgaagataatttcaatattgggggatttaataacggc

SEQ ID NO: 51576 - DNA, 201 bp, Homo sapiens
aatctagcctacgtgcacatccggtcacagcacctttccttgaacttattcatgatacagattccttttctacatagacacagtaacaatctgatctctctttcttttccccacacaaacctgagtgtcttgaggtttggaaaggccttgatgtaagctactatgaagataatttcaatattgggggatttaataacggct

SEQ ID NO: 51577 - DNA, 201 bp, Homo sapiens
tagaccgggcccaggctgggggggccctgctggacatcggcatctactgtgtccagttcacctccatggtctttggagggcagaagccagagaagatttcygtcgtgggaaggcgtcatgaaacaggtaccatctatcctggaatatttcatggtgatgggaatgattctgtctctctgggagcactgaactgaggacaag

SEQ ID NO: 51578 - DNA, 201 bp, Homo sapiens
atctagcctacgtgcacatccggtcacagcacctttccttgaacttattcatgatacagattccttttctacatagacacagtaacaatctgatctctctttcttttccccacacaaacctgagtgtcttgaggtttggaaaggccttgatgtaagctactatgaagataatttcaatattgggggatttaataacggctt

SEQ ID NO: 51579 - DNA, 201 bp, Homo sapiens
acaccacgcctggctaattttttgtatctttagtagagacagggtttcaccgtgttagccaggatggtcttgatctcatgaccccacgatctgcccacctyagcctcccaaagtgctgggattacaggcgtgagccaccgcgaccagccagcacttcattcttttgccttgccatgcaagaagtgaagtctcttgcccaag

SEQ ID NO: 51580 - DNA, 201 bp, Homo sapiens
atcacttgaaccagggaggcggaggttgcagtgagctgagatcacaccactgcactccagcctggggatagagtgagactccgtctcaaacaaacaaacaracaaatagcggtaagtggggcacatgcctatactcccagctactcaggaggctgaggcgggaagatagcttgagcccaggagtacaaggctgctgtgagc

SEQ ID NO: 51581 - DNA, 201 bp, Homo sapiens
cctacattggcacccagcacccccagcacaaggcggcggtgatgctgtgcttggcggcgggcaaggccgttctgtgcgagaagcccacgggcgtgaacgcrgcggaagttcgcgagatggtcgcggaggcccgatcccgagccctcttccttatggaggtgagggcagaggagcccttccaatatccagcgtaaaagtgct

SEQ ID NO: 51582 - DNA, 201 bp, Homo sapiens
cgacttcacagccgtgctgcagacgctgcctcgctctgagcaccaggtctgcccgccctccggattctggggaagaggaggcggggggcgggactccagartctaaaggaggagggagtttagggttcaggactagtgagtgggtcgtcattgcagtgaaacgtctgtttccttgctacctccttctccatctctgttctg

SEQ ID NO: 51583 - DNA, 201 bp, Homo sapiens
gcggaggatggggacccgcccccggggtgggcggggcgtcaggtacttaattcgcgcctggagggaccgaaggtgccgagggctccgcatcgcaaccatgscgctgcgctggggcatcgtgtctgtcggcctcatctccagcgacttcacagccgtgctgcagacgctgcctcgctctgagcaccaggtctgcccgccctc

SEQ ID NO: 51584 - DNA, 201 bp, Homo sapiens
tacgtagaaaatgaagacataagaaactccattttgaactgtactaagaaaaattgtttctgctttgagatgctattaacctgtaactttagccccaaccstgtgctcacagaaacatgtcctgtattgaatcaaagtttaatggatttagggctttgcaggatgtgccttgttaacaatatgtttgcaggcagtatgctt

SEQ ID NO: 51585 - DNA, 201 bp, Homo sapiens
gtggctggaggcgagatatgctggcagtgatactgctctgttactctttgctacactgagatgtttgtgtaaagtgaaacataaatctagcctacgtgcayatccggtcacagcacctttccttgaacttattcatgatacagattccttttctacatagacacagtaacaatctgatctctctttcttttccccacacaa

SEQ ID NO: 51586 - DNA, 201 bp, Homo sapiens
gtgcacatccggtcacagcacctttccttgaacttattcatgatacagattccttttctacatagacacagtaacaatctgatctctctttcttttccccrcacaaacctgagtgtcttgaggtttggaaaggccttgatgtaagctactatgaagataatttcaatattgggggatttaataacggctttcccccagatc

SEQ ID NO: 51587 - DNA, 201 bp, Homo sapiens; identical to SEQ ID NO: 11044

SEQ ID NO: 51588 - DNA, 201 bp, Homo sapiens
ctggggggcaggtggtggagaaggacggggaggaggaggatggggatctctggctggtgggagaaaggggaagagggagttctatttccatcccacaaacrgctctgatgccccacccttcctgagagcccttgtttgctcacttagtagttgcatctcacccctcccccacactcctgcccttttcagttcttcaaatat

SEQ ID NO: 51589 - DNA, 201 bp, Homo sapiens
ctaatggtggggtttcttctgggctccagtattggccaactctgcatgttgccttgtacttttcatttagatctggtggttctccggagagcagcttcctygggtgttacatgagccaagccctcactgtacagaagagtgagagctgaaacctgttccctgagctgatcagaaggacatcccttggcccctccatctggg

SEQ ID NO: 51590 - DNA, 201 bp, Homo sapiens
tcctggaccagcacatccctgaagacgattttgctaacggctcctgggtgcatctgacagtcaattgtatgaagctggggggcaggtggtggagaaggacrgggaggaggaggatggggatctctggctggtgggagaaaggggaagagggagttctatttccatcccacaaacagctctgatgccccacccttcctgaga

SEQ ID NO: 51591 - DNA, 201 bp, Homo sapiens
ttctgtaactgctttttctacatctcatcatgaaacctcccagacttcatcctgatctgtagtctcccctcttggccctgccttggtcctggctctactayctgctcactcctctgccctctcccccttcctcatcgtcttaaatgctagttcaggggttcaagtcttctagggagtgggctgatggggcagcagggtagg

SEQ ID NO: 51592 - DNA, 201 bp, Homo sapiens
cagtcgagctggactcatgcctaggtctatctggctcccaagtgtgtgcttgtatcacgaggctacactgccagggacccatgaagctgtctggggtgcayagttgcatccagggagggtgctgagggcttgggtaggcaccctcggtctgagcctggcagtgtggtgtggatgctgactaagagtgggattgaggtgtct

SEQ ID NO: 51593 - DNA, 201 bp, Homo sapiens
agtgcaatgtctgggcgcagttagcaccattttttgaacttctttgtggatgtgtggacgtgaacttgcccatttaggtgactgtgggttccctgccttcygagagcttaagagagcagagactgtgtctcctgttttcttcacacgccgctgcatatgggaagatctgaagtcaacaggctttagccctgcaggtggagg

SEQ ID NO: 51594 - DNA, 201 bp, Homo sapiens
aagcacaggtgtacagagagggtggctggggagggcccaggatccccaaaggtcagtgactggatggggctggcctgggttgctgctttaggtggcacctrttgggacttaaaatcgtgtgtagcctccctgggcgccttctgctgcaccccagctggctccctagaatggctacaatggctctgcttcctcctaatcccg

SEQ ID NO: 51595 - DNA, 201 bp, Homo sapiens
ccccctcccagcactgaccctagccccccgttgtgccctcatgccacccatcatgcaggtcgagggaagcctgaggtggtatcggtggtgggccgggctgrggagagtgtggtgctgggctgtgacctgctgcccccggccggccggccccccctgcatgtcatcgagtggctgcgctttggattcctgcttcccatcttc

SEQ ID NO: 51596 - DNA, 201 bp, Homo sapiens
ggctgtgacctgtggctgaattggttcacagcaagataggagggagatttgtgcctgagggcagggcccgtggaagctaagggggttcccaatgcaggctrttgctctgaaaccagcaccttaattttaaaaggctcagtaagcagacaaagcgatcttagtgcccagtagtgtgttatagtggaaaggacatgggtgctt

SEQ ID NO: 51597 - DNA, 201 bp, Homo sapiens
ccagcctcccccatttcctcacctttctagtatctgcattcagcactcaccattctcccagtactcctacccctgctcttactccccagggcttcaagatcccccccttccccctacccctcacttaactacactcctccctcctttctcttcccagtgcctttctctaatggtggggtttcttctgggctccagtattgg

SEQ ID NO: 51598 - DNA, 201 bp, Homo sapiens
ctacatctcatcatgaaacctcccagacttcatcctgatctgtagtctcccctcttggccctgccttggtcctggctctactatctgctcactcctctgcsctctcccccttcctcatcgtcttaaatgctagttcaggggttcaagtcttctagggagtgggctgatggggcagcagggtaggtgcggctgtgacctctc

SEQ ID NO: 51599 - DNA, 201 bp, Homo sapiens
ttaaatgctagttcaggggttcaagtcttctagggagtgggctgatggggcagcagggtaggtgcggctgtgacctctctgcttttccagggacactcagyctgcttctgagtagagaagcacaggtgtacagagagggtggctggggagggcccaggatccccaaaggtcagtgactggatggggctggcctgggttgct

SEQ ID NO: 51600 - DNA, 201 bp, Homo sapiens
gcagctctggggtctacacctgccaagcctccagcactgagggcagcgccacccacgccacccagctgctagtgctaggtgctctctggcgggagggctgsggtccagggttacctatgcaagggggctgtgacctgtggctgaattggttcacagcaagataggagggagatttgtgcctgagggcagggcccgtggaag

SEQ ID NO: 51601 - DNA, 201 bp, Homo sapiens
cttaggacccatctattcccagtcaggccctgcctcccaggctcctctgctctagactgtgccttgcccccttgggccatctgtactggaagggcctagcragcttcacatctgagctcttcactcagtgaacctcagggcttcttctcattgtcctgcccgcctcttgcaggtgtgaagactccagaggagggctgcctc

SEQ ID NO: 51602 - DNA, 201 bp, Homo sapiens
cgagaactatgagtgggactcagaattccctggggacatggaattgctggagactttgcacctgggcttggccagctcccggctcagacctgaagctgagmcagagctaggtgtgtgagccccccggaaaggcaggcatctcggccatactgtcccacatccccccgccaccttaggacccatctattcccagtcaggccc

SEQ ID NO: 51603 - DNA, 201 bp, Homo sapiens; identical to SEQ ID NO: 11052

SEQ ID NO: 51604 - DNA, 201 bp, Homo sapiens; identical to SEQ ID NO: 11051

SEQ ID NO: 51605 - DNA, 201 bp, Homo sapiens
attgttggacgatgaggtcaggcgaggttagcccatgcatagacagggcgtccgtctggagcagggactcagggactgagccccacccgcgggctccatckctgagtcctcactggggcgaggggaaaaaagggcgtcggactttagctggctggccccgagtgaccccgggtcgtggcgccggccctgggccagctcgtg

SEQ ID NO: 51606 - DNA, 201 bp, Homo sapiens
cccgcccgcctcgccgtgcctctggcggctccaattggccgccgcgggagggggattggcggtctccagggcgacgggaggcgctcggggcatccgaggckgggaggcgggtccgccccctattgtgtagcggcgagagtggagccgagcggtgcggagcaggtgagggagggggcgtactggaggtatagaagtggtggt

SEQ ID NO: 51607 - DNA, 201 bp, Homo sapiens
gatttgggagctcgccaatgcagacaggtatttccagtcctgctagagaagcaatgggtggaggtagaaatggggatgggggaggagatcggatgagcccsggacctgggtggatcccctgggaggagggcggggagtcatgctccccgcctggttctcctacccccaggctcagatttcaaccctcgctgccgcctctgt

SEQ ID NO: 51608 - DNA, 201 bp, Homo sapiens
tcacagcctgctcaccacaacgtctgtgttgacagggtgtttctgcccggagcccccacccagcctccaacactgtttggtacacagaagccatggcaacrgcccccacctcatcccctcctcccacgcaagctttggagcttcctgtttgtgtagcctcagctttctcttctgctcctgactctcggtggtgaggggctg

SEQ ID NO: 51609 - DNA, 201 bp, Homo sapiens
actgtgggctgaggccaccttcctccccttgtgcatcccacaggacccccagtcatcgtggtgccccccaagaacagcacagtcaatgcctcccaggatgyttcattggcctgccatgctgaggcataccctgctaacctcacctacagctggttccaggacaacatcaatgtcttccacattaggtggggtcaccctcat

SEQ ID NO: 51610 - DNA, 201 bp, Homo sapiens
accttcctccccttgtgcatcccacaggacccccagtcatcgtggtgccccccaagaacagcacagtcaatgcctcccaggatgtttcattggcctgccaygctgaggcataccctgctaacctcacctacagctggttccaggacaacatcaatgtcttccacattaggtggggtcaccctcattaggaaggtggaggtg

SEQ ID NO: 51611 - DNA, 201 bp, Homo sapiens
cctacgcttttcccagccggatggggttgggcgcctggtgttgggtgagagagtctccgcctagagggccttgatttttgcctgtgtcacctactattctyatgcccttccagatccacctcttatcttctctccgaccgggaagtcagctgcaccgtaagtgcctccacctccttggctttcttctgcctttccattgta

SEQ ID NO: 51612 - DNA, 201 bp, Homo sapiens
caggcctggcctggttggaactgccccttctcaggaccccgccctatggctctggcacctcagagcttgagggcaatggccccagagtggagcagatacastgcagctggaggccgtgaccctgccagctgtgtccaggccccagcgttgggcggtggagggggttcctcagcatccactttccacccagtggtgggtctg

SEQ ID NO: 51613 - DNA, 201 bp, Homo sapiens
cacattgcagccgcctgcagccccgggtgcggatcctggtggacgggagcctgcggctgctggccacccagcctgatgatgccggctgctacacctgtgtrcccagcaatggcctcctgcatccaccctcagcctctgcctacctcactgtgctctgtaagcctgaccccagcttctccctcagcctgctcccttcccctg

SEQ ID NO: 51614 - DNA, 201 bp, Homo sapiens
agggcccttatttgtcacagaggggtgaaggcgacagcactggttccatcttgctgctataccttgtgagcatcaagagtaaggaaagaagcgagagcagsctaggccatgagagtcttgatctaccatacttccttcaaaaatatttttccaagcatatgaggaaccccagttctcttctggcttagtttttcaagaccc

SEQ ID NO: 51615 - DNA, 201 bp, Homo sapiens
cagcctgatgatgccggctgctacacctgtgtgcccagcaatggcctcctgcatccaccctcagcctctgcctacctcactgtgctctgtaagcctgaccycagcttctccctcagcctgctcccttcccctgggccaggccaagcccctctcccccaacttgccactactttcccccagacccagcccaggtgacagcta

SEQ ID NO: 51616 - DNA, 201 bp, Homo sapiens
gcagaggtcaaggtggggatgagcaatgtgatgtagaggggaggaggctggaggcagggagactggcaagtaggctgttggagaaacccaggtgagacatrccacaggtgtaaaggtgaggacagcagagaaggggaaatgtttaggaggtaggatttgaaaaacctaatgagcaagtagatatgggaggtaatcgaggaa

SEQ ID NO: 51617 - DNA, 201 bp, Homo sapiens
ggctgctgataatagccctgagggattaggggctttggcaggcggggtctgggttccccctgctagggcctcaaacactgctgaggttttcagggaaacartcctctatcaggagtactcccaggagctcacaccttcccctacataaagagcccagaggtggacagatcctgtaagagtccagaggagactacatgctgg

SEQ ID NO: 51618 - DNA, 201 bp, Homo sapiens
ggggtccctctgcaggaaggaaaggaagcactggaaatcagagaggggtcaggcctagacatggagctgctggagtcttctgcacagctgtgggtttctcrtcctgccccctctcttgtactgccatcccgggcttgtctctgctgagctcctctctctagctgtcatcttctcttccttccagttccctggctggtccca

SEQ ID NO: 51619 - DNA, 201 bp, Homo sapiens
ggtatggaatgtatgtgctgaccccctaggtgagtctggggattggaacagggatcttaggtctgcctctctctctctctctctctctctctctctctctstgtgtgtgtgtgtgtgtgtgaagttttttacaggtgaataaacaaagtttgaaagatgtttctgtgtgttatctgtctttgagagagtgccaggaaaatc

SEQ ID NO: 51620 - DNA, 201 bp, Homo sapiens
tgcaaacaacataagattaagaaaatgcagccaggcacagtgactcacagcttaatcccagcgctttgggaggctgaggcaggaggatcccttgaggccaygagtttgaaaccagcctgggcaacatagcaagacccctctcttcaaaaattaaacaattagccaggcatggtgacacgtgcttgtactactagctacttg

SEQ ID NO: 51621 - DNA, 201 bp, Homo sapiens
ccagtcctgctagagaagcaatgggtggaggtagaaatggggatgggggaggagatcggatgagcccgggacctgggtggatcccctgggaggagggcggsgagtcatgctccccgcctggttctcctacccccaggctcagatttcaaccctcgctgccgcctctgtggcgcgcccgttcggggagcggagagggtcgcc

SEQ ID NO: 51622 - DNA, 201 bp, Homo sapiens
gtatttcaccagggggagtgagggaacgtgaggaggcagacttcagcaagaaggatggcgggccctttaatagagaaataggagctggttttgggtggaasactctgaacttagttgtggagtgctgggaagagagccaggtgaagtcccagcaggcaggaagccccacgcggcccaactacaggggtggccattcacagt

SEQ ID NO: 51623 - DNA, 201 bp, Homo sapiens
ggtgaggtattgggcacctgggttagggccagagacagagaagtaattcaagaggtgacaagcagggatacaaatggtaaatgagcagagttaaactgackcccccaaacacacacaccattcctaggcagtggaactgcatgaatggagttgctcttgatggaacagagagaatttggaaagaagaatgggtctcaggga

SEQ ID NO: 51624 - DNA, 201 bp, Homo sapiens
caacttgcttactgttttctttatgtttgagggaaggcaggggcaggtcccctgggtgtccctagggtgggccttcccagctccagcagccgcagcccatsagcttctgcctgcccgtgggggtggggaagagaaacagctgctgaccaggcctggcctggttggaactgccccttctcaggaccccgccctatggctctg

SEQ ID NO: 51625 - DNA, 201 bp, Homo sapiens
cctggtaggcaacttgcttactgttttctttatgtttgagggaaggcaggggcaggtcccctgggtgtccctagggtgggccttcccagctccagcagccrcagcccatcagcttctgcctgcccgtgggggtggggaagagaaacagctgctgaccaggcctggcctggttggaactgccccttctcaggaccccgccct

SEQ ID NO: 51626 - DNA, 201 bp, Homo sapiens
tcttcaaatataaattcaatcagccttctaggctcggtgtcaggaactccctctttctcttccctcctgcttccctggccagggaagtgggtgggagagaggggctcttgggccctgagtgaaacacagctcacatatatatagcaccttgtgttttcaaaataccttttcacccaagcccttattatttatctctcactc

SEQ ID NO: 51627 - DNA, 201 bp, Homo sapiens
ggacccctgcctaggtctggaggtctacccttcgcgcacgcagctgccgggcctcctgcctcagcccgtgctggccggcgtggtgggcggagtctgctttytgggagtggccgtccttgtgagcatcctggccggctgcctcctgaaccggcgcagggctgcccgccgccgccgcaagcgcctccgccaaggtaagtccct

SEQ ID NO: 51628 - DNA, 201 bp, Homo sapiens
ggcctcctgcctcagcccgtgctggccggcgtggtgggcggagtctgctttctgggagtggccgtccttgtgagcatcctggccggctgcctcctgaaccsgcgcagggctgcccgccgccgccgcaagcgcctccgccaaggtaagtccctccaccctcagccctgctactgcgcacttgggcctagcctccttaagccc

SEQ ID NO: 51629 - DNA, 201 bp, Homo sapiens
ggcttggctctcccccaggctctggacatccaacctgggttcagccccaggccagtgtgtgggggtgggttgacagaatcctcatttggcctgggtgcagyagacagggtggccctgggctgaggactcctatgaggcagggctggtgggtgggcagcaggctggagccctgagtggtctccctggcccttggacactgct

SEQ ID NO: 51630 - DNA, 201 bp, Homo sapiens
ggtctacacctgccaagcctccagcactgagggcagcgccacccacgccacccagctgctagtgctaggtgctctctggcgggagggctggggtccagggytacctatgcaagggggctgtgacctgtggctgaattggttcacagcaagataggagggagatttgtgcctgagggcagggcccgtggaagctaagggggt

SEQ ID NO: 51631 - DNA, 201 bp, Homo sapiens
tggggcgaggggaaaaaagggcgtcggactttagctggctggccccgagtgaccccgggtcgtggcgccggccctgggccagctcgtgctcctgggctttyccgcgcgacccttcacttcctggttccaggagcacgtgtgagcactgcgtgccctctgagtccccgaggccgcccttttcattcctgttcctgctagctt

SEQ ID NO: 51632 - DNA, 201 bp, Homo sapiens; identical to SEQ ID NO: 11053

SEQ ID NO: 51633 - DNA, 201 bp, Homo sapiens
aaatgatggcaaagagtcaagaaggagaactgaagtttctttcgtgtgatgactgggaaattgtgtgtcccgggggaacacacacttcttaccaggtgctrtgtggggtagtgggttgagggcaggggcaaggaggcatccatccttaaagtgggcaccatctgggcagaggacagcaacactgtctggaaggccagggat

SEQ ID NO: 51634 - DNA, 201 bp, Homo sapiens
ccttgcccccttgggccatctgtactggaagggcctagcgagcttcacatctgagctcttcactcagtgaacctcagggcttcttctcattgtcctgcccrcctcttgcaggtgtgaagactccagaggagggctgcctcctgaacactgcccatgttactggccctgaggcccgctgtgctgcccttcgggaggaattcc

SEQ ID NO: 51635 - DNA, 201 bp, Homo sapiens
ttagccttggggtgggtatgggggtgttcctcaagggttcctctttgagcatgtgagggcaggggaggaatagggctggttctggagaagctgaactgggrgtttctccagtcacccaaagtcctaaggtgcctacagagatactgatggcactccccctcccagcactgaccctagccccccgttgtgccctcatgccac

SEQ ID NO: 51636 - DNA, 201 bp, Homo sapiens
agctgccttgggagctgacttggcaaccccacgctcagagcacagccttcctcagctgcacacggtgggaggcgcctgggcaagatttgggagctcgccartgcagacaggtatttccagtcctgctagagaagcaatgggtggaggtagaaatggggatgggggaggagatcggatgagcccgggacctgggtggatccc

SEQ ID NO: 51637 - DNA, 201 bp, Homo sapiens; identical to SEQ ID NO: 11054

SEQ ID NO: 51638 - DNA, 201 bp, Homo sapiens
gccttgcccccttgggccatctgtactggaagggcctagcgagcttcacatctgagctcttcactcagtgaacctcagggcttcttctcattgtcctgccygcctcttgcaggtgtgaagactccagaggagggctgcctcctgaacactgcccatgttactggccctgaggcccgctgtgctgcccttcgggaggaattc

SEQ ID NO: 51639 - DNA, 201 bp, Homo sapiens
tgctcttactccccagggcttcaagatcccccccttccccctacccctcacttaactacactcctccctcctttctcttcccagtgcctttctctaatggwggggtttcttctgggctccagtattggccaactctgcatgttgccttgtacttttcatttagatctggtggttctccggagagcagcttcctcgggtgtt

SEQ ID NO: 51640 - DNA, 201 bp, Homo sapiens; identical to SEQ ID NO: 11058

SEQ ID NO: 51641 - DNA, 201 bp, Homo sapiens; identical to SEQ ID NO: 11060

SEQ ID NO: 51642 - DNA, 201 bp, Homo sapiens
gttacatgagccaagccctcactgtacagaagagtgagagctgaaacctgttccctgagctgatcagaaggacatcccttggcccctccatctgggctccygtggataggaggggctgggtgagcaggccagctgggctatggtgtggtgcctcggcctggccgtcctcagcctggtcatcagccagggggctgacggtaa

SEQ ID NO: 51643 - DNA, 201 bp, Homo sapiens
ccacagggcgggctgagcagagaggggaggaggtgcaggcaggtgatgcagaagggaagtttcttttcaaactgggggcagttattggcaaacagcctggkgggagtgtatgtgtctacacaagccctgtgggaatggatgaaagcgggccccaattagcaccagtggagaaaaaaacggctgtgcccaccagccctccct

SEQ ID NO: 51644 - DNA, 201 bp, Homo sapiens
gactgacatttatctggcccagctttcgggctgggggaagtggagggggcgggttgctcttaatgaggtttaaaaataactgatttaggggaggatctgcyggaaatgtgcagcttgataagctggggtaaaaaggagcagccatgttggagtcgggacgggagggactggcccaagacacagcctctgcggccgagaggt

SEQ ID NO: 51645 - DNA, 201 bp, Homo sapiens
cccaagacacagcctctgcggccgagaggtgttgagggtttgaggcaggctggtccccttgtatttcgcagagccccaaggtccattgagagggggtgacrggattgtttaacctgggtgtgtgggagagggggagctggagtgacttcatccctgaaggccaacctggcctggagccagatgtggttagaaggggtggct

SEQ ID NO: 51646 - DNA, 201 bp, Homo sapiens
ccatcagcttctgcctgcccgtgggggtggggaagagaaacagctgctgaccaggcctggcctggttggaactgccccttctcaggaccccgccctatggytctggcacctcagagcttgagggcaatggccccagagtggagcagatacactgcagctggaggccgtgaccctgccagctgtgtccaggccccagcgttg

SEQ ID NO: 51647 - DNA, 201 bp, Homo sapiens
gggcaggtggtggagaaggacggggaggaggaggatggggatctctggctggtgggagaaaggggaagagggagttctatttccatcccacaaacagctcygatgccccacccttcctgagagcccttgtttgctcacttagtagttgcatctcacccctcccccacactcctgcccttttcagttcttcaaatataaatt

SEQ ID NO: 51648 - DNA, 201 bp, Homo sapiens
atcacctagggatattatatactttgtagatgaacagtagcaatatcttagttccagactccctgctgttacttcactcaaagtacatagcatcccattgycattaactgtgttgtgaagccaaaccttttcttcctgttagtccaaataaaattagtaagcatatttattgcaaaagaaatgacaacatacctgcccaaa

SEQ ID NO: 51649 - DNA, 201 bp, Homo sapiens
tggctggttatttttcagggatgctgaaagcagtataaactgctgtcttagattcggatcactgctggtcactccagatcctaggctgtttagggccacgytgctttgtgaaacacaagatcttggctaagctgcaaatctactcactcattctgtccatctcctggaccaccctcccccaacacacacacattagtttta

SEQ ID NO: 51650 - DNA, 201 bp, Homo sapiens
caaagcagaaagggaccccaaagaccctctgatgcttgaatatcctttgtaaactctagtcaaatggttggacaatctgagcttgtacatcctgagagacagggcgctcactacctcaaaaggcaacccaaaccatctcagattcgccctgatgcccagaagtttcttaatattgagtcaatatgtcttcctgtgtatcca

SEQ ID NO: 51651 - DNA, 201 bp, Homo sapiens
aaagcagaaagggaccccaaagaccctctgatgcttgaatatcctttgtaaactctagtcaaatggttggacaatctgagcttgtacatcctgagagacagggcgctcactacctcaaaaggcaacccaaaccatctcagattcgccctgatgcccagaagtttcttaatattgagtcaatatgtcttcctgtgtatccaa

SEQ ID NO: 51652 - DNA, 201 bp, Homo sapiens
ggcctggctctgatcccagtgaggtgctctggtgttctgggtagaaggtcccaagaggttccgttctcaaggatcttccttcctcagttaaaaaataatcrtcagctgtcactcctggctttgctcttctcagtccatgtctggcagggacctggcttacttaccaagcccagaaatattcccctggcctcctctctccac

SEQ ID NO: 51653 - DNA, 201 bp, Homo sapiens
ataatctcggctcactgtaacctccacctcccgggttcaagcgattctcctgcttcagcttcccaagtagctgggattacaggcatgcacatccacacccrgctaatttttgtatttagaagagatggggtttcaccatgttggccaggctggtctcaaactcctgacctcaagtgatcccccggcctcagcctcccaaag

SEQ ID NO: 51654 - DNA, 201 bp, Homo sapiens
tctacttattatctcaaaactttacgaagtgatacatagaatcacagaacttttttttttttttagagggagtctcactctgtcgcccaggctctggagtrcagtggcataatctcggctcactgtaacctccacctcccgggttcaagcgattctcctgcttcagcttcccaagtagctgggattacaggcatgcacatc

SEQ ID NO: 51655 - DNA, 201 bp, Homo sapiens
actgcccgctggaggtgggaggggcggggccgggggcggggcctgagccgaagaacgcgggctagtggttgccaaggtaacgcgtcaacactagggccttkgcggcgccgaggcggcagcagaagtccggagtcagggcgtgtggctgaggagatggtgagggagaacctcagatgggccccttgtgtcctgaattgggtg

SEQ ID NO: 51656 - DNA, 201 bp, Homo sapiens
aagtcacttgccctccctgagcctcactttcttcatttgtaacttgagggtggtaaaactactttgtggaatcattggcaggatgaaataaggtagtagaygggagaggctttgtgggctgaggattggtaaattaaatgtgcagtgttacttttattttcatcctgttagttcagttctggccacgtatggtggtcgagg

SEQ ID NO: 51657 - DNA, 201 bp, Homo sapiens
cccagaaacgccgtgagcgcatcgatgagatcaagaggaaaaagcttgaagagctgaggtgcgctggaatctcctcctttcccaaatcctcttccctcccscaaagagatggcaccacaggctggaaagcatggggatttgggggtgaagggccatggcagagatgctcagggagaggctcttctccccacccagggctca

SEQ ID NO: 51658 - DNA, 201 bp, Homo sapiens
gggtgggggagcgtcccctttcacttatgtattctatttgattcagtgtcccatcttctctcagcaccttacaaacacagtggcgtatgtatgtatgtgarcacctactgtcatgcctggtgtctaagggcatatggtaaatgttagttccccttttgtcctcttttaaaaatttcctatttccaagctctcatagggcat

SEQ ID NO: 51659 - DNA, 201 bp, Homo sapiens
tgttgatgtctgtccctgctcttcaacatcttcattgtgaattgaagaggactctccagagggattgagataggcttcttaatccatttagaagactctcrctctgcagcagttttcctgttggtaagggaaaggatcaacagatgcatttattttttattatttttttaaagatagggtttcactcctgtcacccaggct

SEQ ID NO: 51660 - DNA, 201 bp, Homo sapiens
gtcagaaaggttttccttgttctgccttttggtccactagttccctagtcattgtcagtccagggccatctcattggctaagcctaggtcccttggccagkctgaggtgaatatttgatgttttcagcttctgtagttggagaagagcactatctcccacaactcattagatggggaatttgccaaaataggaagttagta

SEQ ID NO: 51661 - DNA, 201 bp, Homo sapiens
tacccttcaaaaaactctcactgctttgggcttggatcgcaagccagagaccatccagctcatcacccgggacatggtccgagaactcatgtgagtacacygtcccctgcccttctatgtccagtcctcatccttttgctaaggatctttgtagggagatgggtaaacccacctggtttcattctgtcagtccaatcccca

SEQ ID NO: 51662 - DNA, 201 bp, Homo sapiens
aaagcatggggatttgggggtgaagggccatggcagagatgctcagggagaggctcttctccccacccagggctcatccctctgaagggggctccagcagwaagtcctgggatggggtcttgctggctctctgggagctccttggcaggatgctggagccttggcatgaatgtgtgtttcgggggtggattgtgagagcag

SEQ ID NO: 51663 - DNA, 201 bp, Homo sapiens
gattgtgagagcagggttggggggtgcaggcccccaggttctgtaaaccccacccagagcctgcttcctcccacctcctgtctggtccaatacctttcctyatacctgcctgcgtttccccggcagagccactggccttcccgagaagtactgcattgaagctgagcgcaaagctaacatcctgccagctacctctgtgaa

SEQ ID NO: 51664 - DNA, 201 bp, Homo sapiens
tctctacccctggggatggattcatctctcaaatccagagcccagtcttgccttccctgatgggccctgcactagaggaggtgaggaatctgttgggtgcrtcctggatgtttacaactccaggttacaagggcctcaggcaagagtcctcttttcatagggcccagggagagtcagtaagctgtttcctgtgcttccttt

SEQ ID NO: 51665 - DNA, 201 bp, Homo sapiens
caaagccctttcacatacgttattatccacagtggagaccacatacgtgatctggaaaacatggaatggtggagtgacttggagtcaggcagttgtattcyggaaaagtatccatctcaatctggtctgcagtcctgtccttgagaggtcaccttgttcggttttattcattcttcatcaaatgcacattgctatattgtt

SEQ ID NO: 51666 - DNA, 201 bp, Homo sapiens
acttaggcctagctcaaccatgtgccatgagccaacactgtgctcagtggtttaactcttgtgttagtgcttcaccctctacaaccgttctccctgccctrgctccacccactaaaagccctaattcccagaaaatcctacctgtgtcacaagctggagaggcacatctagcacacaccccgggagctgtgtcggactgcg

SEQ ID NO: 51667 - DNA, 201 bp, Homo sapiens
gcatcaagtggccagatgtggctagagccctgcagccactcctggagccagaggaagggaggaagggttccttcttggagccatctagtcctgaaaacacrttggaggacaagtggctggttatttttcagggatgctgaaagcagtataaactgctgtcttagattcggatcactgctggtcactccagatcctaggctg

SEQ ID NO: 51668 - DNA, 201 bp, Homo sapiens
cccagacgctgggtctggctgccagttctgtttgggtcagaaaggttttccttgttctgccttttggtccactagttccctagtcattgtcagtccagggycatctcattggctaagcctaggtcccttggccaggctgaggtgaatatttgatgttttcagcttctgtagttggagaagagcactatctcccacaactca

SEQ ID NO: 51669 - DNA, 201 bp, Homo sapiens
atttgcttgtaatcattataattagcgattggtttgttgaatgcgttggatagctagaaaggagaggtctatagacatgtctctggctattgttgatcacrgattttaattaatatttacagttcaaagcttctctctaggctggatgggcagggaagcttaggtttctaactagcatctatatcaaccttgtctggcgtc

SEQ ID NO: 51670 - DNA, 201 bp, Homo sapiens
acgaaaatatcaaagcagggctggcatctttatctgtccccagtcctcatcttccccagaccccctgccttctcagctgccttcccttcaagagttatctycctgcaagcaggactggatgtgcttctccttaggcactgttcagcttcttggcaatatttatttggtcatgcaaagaagaaaaccagcccgtcacctcct

SEQ ID NO: 51671 - DNA, 201 bp, Homo sapiens
tctcagatgtctgtgtcttattggcatgtacctgtcaaattggcatgtacctgcctcacccagaagcagctttcttcccacccccctaactactccctccyccatctttaatatatgtcatttgcttgtaatcattataattagcgattggtttgttgaatgcgttggatagctagaaaggagaggtctatagacatgtct

SEQ ID NO: 51672 - DNA, 201 bp, Homo sapiens
gtcttattggcatgtacctgtcaaattggcatgtacctgcctcacccagaagcagctttcttcccacccccctaactactccctcccccatctttaatatrtgtcatttgcttgtaatcattataattagcgattggtttgttgaatgcgttggatagctagaaaggagaggtctatagacatgtctctggctattgttga

SEQ ID NO: 51673 - DNA, 201 bp, Homo sapiens
gatgctgaaagcagtataaactgctgtcttagattcggatcactgctggtcactccagatcctaggctgtttagggccacgctgctttgtgaaacacaagrtcttggctaagctgcaaatctactcactcattctgtccatctcctggaccaccctcccccaacacacacacattagttttattagatgaggtttcacttc

SEQ ID NO: 51674 - DNA, 201 bp, Homo sapiens
tctttcatggagagaggaaaacctagagaacagaaatttactttaattcctgatgattttagactaagtatagacacacactagtgacccccactccttgytatccctaccattctgcgaggaatatctgtataagaacaagagacttgttttcagaaaagctggtcagggctgggcatggtggctcacgcctgtaatccc

SEQ ID NO: 51675 - DNA, 201 bp, Homo sapiens
gcatcaaaccaagctgggggcccttctaagcatgcccatgacatacagtcatgcgaccctggagctagtcctggctgggtaggagaagggggcatgcatgygcagcagcttttgggggctgatccttgagttacaaaatggggctggagcccagagggctgtggtctctgaggcatgtctactgaaggagcccacccagga

SEQ ID NO: 51676 - DNA, 201 bp, Homo sapiens
tttgctggcaggacatggaacgaaggcagcaacaaaaactgaagatgcaagctgagattaagcgcatcaatgatgaaaaccagaaacagaaagcagaactsctggctcaggagaagctggcagaccagatggtgatggagtttaccaagaagaagatggtagggacttggtttctgggacctttggttaggaatggaatgt

SEQ ID NO: 51677 - DNA, 201 bp, Homo sapiens
ctgatgacccaaactttctgcctcttcctgcagccactaagcacagctggcatcctgagctcctcttctgccgcttccaacaggtcaaggaataaggctcrctatcggaccaaagccgtgagctctgaggtggatgagagcctctttggagatatcaaggtaatcctcaacaagtcctttcaagttgatgccacctgcagg

SEQ ID NO: 51678 - DNA, 201 bp, Homo sapiens
gaactcatagtccccagcccagggccagagcgacagccccattgtgctgctccgagataagcatacccttcaaaaaactctcactgctttgggcttggatygcaagccagagaccatccagctcatcacccgggacatggtccgagaactcatgtgagtacaccgtcccctgcccttctatgtccagtcctcatccttttg

SEQ ID NO: 51679 - DNA, 201 bp, Homo sapiens
caaaaaactctcactgctttgggcttggatcgcaagccagagaccatccagctcatcacccgggacatggtccgagaactcatgtgagtacaccgtcccckgcccttctatgtccagtcctcatccttttgctaaggatctttgtagggagatgggtaaacccacctggtttcattctgtcagtccaatccccacttcttt

SEQ ID NO: 51680 - DNA, 201 bp, Homo sapiens
aaactctcactgctttgggcttggatcgcaagccagagaccatccagctcatcacccgggacatggtccgagaactcatgtgagtacaccgtcccctgccsttctatgtccagtcctcatccttttgctaaggatctttgtagggagatgggtaaacccacctggtttcattctgtcagtccaatccccacttctttccta

SEQ ID NO: 51681 - DNA, 201 bp, Homo sapiens
tatgtccagtcctcatccttttgctaaggatctttgtagggagatgggtaaacccacctggtttcattctgtcagtccaatccccacttctttcctattcrttttcccctttttgtttgatagttctttctttcttctccatcctggcctctcttgtttctcccattgttgtatctattattgccactgtcctttattctc

SEQ ID NO: 51682 - DNA, 201 bp, Homo sapiens
tcttggtaaccaaagtctacagaaagggaagtagaaccaggccaagagtttgaagcctgaatttgccagcctgcggagactgtgcaaaagaagaactagayctcagaatgggtaagacatctaggaaaagacatatctttcctgaacatgtcaacctgtttagttgacaggtgttgaagttacatcagggaaacttcacac

SEQ ID NO: 51683 - DNA, 201 bp, Homo sapiens
ccaccttgctaacaaagggggaaagagtgaagggaatttatctggggttgctttggaagggcttcaaaagaaacagggaaagtcctttggtgtcttggaawtgaaatgagccaacaaaaacaacaatccaaaaagtaaataaatagggaaagaagtaaataaatacatgattgtatgtatgtcatacatcagaaatcaaca

SEQ ID NO: 51684 - DNA, 201 bp, Homo sapiens
tgagcaggacctaatagaaaaaggacttaaaatgtctctttttagccttcaatgctacctgaccccccacttggaacatctactccccagtggacccatgscacacttgccgtctcttctgccattgggggagtccactggcatgatgggaagaggggaagagagcagagaagcctgaagtgtggtgctgagagctttccc

SEQ ID NO: 51685 - DNA, 201 bp, Homo sapiens
ccatgtagcctagcaaagagggaagagatgagaaatggtcattattgtcatctacttattatctcaaaactttacgaagtgatacatagaatcacagaacttttttttttttttagagggagtctcactctgtcgcccaggctctggagtgcagtggcataatctcggctcactgtaacctccacctcccgggttcaagcg

SEQ ID NO: 51686 - DNA, 201 bp, Homo sapiens
aattcagtgattccataatatcatctaatagttaatccacattcacattccccaattgttccaaatatgtatttctggctctcttgtttccaaactagackttaatcaaggtttgcacattgcattccgttgagtctctttagtttgttttgatctagaagagttcccccattcattcattcattcattcattcattcagt

SEQ ID NO: 51687 - DNA, 201 bp, Homo sapiens
taacaaaacactgctcttgcccattccacaggaaaggtattagagatttgtgtttggatggactgcacctacatcaatccatctttcttccttggtagctmtttatccttttacttttgttttcccttttggctcaatgataatttcaacacataagtggaagctaaatgttcacatctctcactgttctgctccctcccc

SEQ ID NO: 51688 - DNA, 201 bp, Homo sapiens
atccacattcacattccccaattgttccaaatatgtatttctggctctcttgtttccaaactagacgttaatcaaggtttgcacattgcattccgttgagyctctttagtttgttttgatctagaagagttcccccattcattcattcattcattcattcattcagttcttcattcatttttataacactgatattttgaa

SEQ ID NO: 51689 - DNA, 201 bp, Homo sapiens
caactttagcaaggaaacctgtgccttcccagctttagacctactgtatcatctcatggtggtacgaagggcagcgtttcccaccttgctaacaaaggggraaagagtgaagggaatttatctggggttgctttggaagggcttcaaaagaaacagggaaagtcctttggtgtcttggaattgaaatgagccaacaaaaac

SEQ ID NO: 51690 - DNA, 201 bp, Homo sapiens
ttaaagctagaccagcctttttggagaagttcaacttcacctattgttgtaggttagtatctaggcctagtgtctccagggccatgtgaccaccatgtttkgtgtctttactcagaagcatctctgccacagcccaaatccaactttctctgcctcaaaagcacagcctcctctatggcctatatgtggacttttgtttct

SEQ ID NO: 51691 - DNA, 201 bp, Homo sapiens
tatttctggctctcttgtttccaaactagacgttaatcaaggtttgcacattgcattccgttgagtctctttagtttgttttgatctagaagagttcccccattcattcattcattcattcattcattcagttcttcattcatttttataacactgatattttgaagcatctaggccagttgcctttaagaatatctcaca

SEQ ID NO: 51692 - DNA, 201 bp, Homo sapiens
gggagtggggaggatgccgcatgtatggtggatcttggaagaaagctagagggaaatgaggaaatgaagcagtgttgtaggtaccttttgttggggtatcrgtgactctaggggaggagagcaggtgagaaattcctgcctaagatgattttacatttcattttttaaattatgttgagaacaaaattagatgttagctta

SEQ ID NO: 51693 - DNA, 201 bp, Homo sapiens
cctgtccttgagaggtcaccttgttcggttttattcattcttcatcaaatgcacattgctatattgttcctactacatgtgccaggcactgcaccttttcscttaattacatacaaaactcatgatccaaagccatccaccttttccagttattcccaatgcttagcctcaatcccacctactgaagtttctattcatttc

SEQ ID NO: 51694 - DNA, 201 bp, Homo sapiens
atttctggctctcttgtttccaaactagacgttaatcaaggtttgcacattgcattccgttgagtctctttagtttgttttgatctagaagagttcccccattcattcattcattcattcattcattcagttcttcattcatttttataacactgatattttgaagcatctaggccagttgcctttaagaatatctcacat

SEQ ID NO: 51695 - DNA, 201 bp, Homo sapiens
tttctggctctcttgtttccaaactagacgttaatcaaggtttgcacattgcattccgttgagtctctttagtttgttttgatctagaagagttcccccattcattcattcattcattcattcattcagttcttcattcatttttataacactgatattttgaagcatctaggccagttgcctttaagaatatctcacatt

SEQ ID NO: 51696 - DNA, 201 bp, Homo sapiens
ttctggctctcttgtttccaaactagacgttaatcaaggtttgcacattgcattccgttgagtctctttagtttgttttgatctagaagagttcccccattcattcattcattcattcattcattcagttcttcattcatttttataacactgatattttgaagcatctaggccagttgcctttaagaatatctcacattc

SEQ ID NO: 51697 - DNA, 201 bp, Homo sapiens
ttatgaattgtcaagttgtcatcagctagtgcatttgatggtggtgagtgacagggggacgtgaagagtgctgcaggtgggcagacttgtaattatgaagycttctcatcacatctgcagtgtgaggagctgctagagaagtgcaatgaagatcacctgggtagttgggaaactgaaggggcacacagctctgtgaactgc

SEQ ID NO: 51698 - DNA, 201 bp, Homo sapiens
gcatattcatgtttagggggcacttgtcaaattgtttcggtgacaccacccatcttgggggttgtttaggtggaggttggactctgggagatgtggaccckgggtttctaagacactgtggcactgttctctccaagaggaaggcggcaaattgtggaacagatggaaaagaaccaggaggagcgatcgctgcttgctgag

SEQ ID NO: 51699 - DNA, 201 bp, Homo sapiens
ttctgggtagaaggtcccaagaggttccgttctcaaggatcttccttcctcagttaaaaaataatcgtcagctgtcactcctggctttgctcttctcagtycatgtctggcagggacctggcttacttaccaagcccagaaatattcccctggcctcctctctccacccgctactcttttctctggcacgccgttgttagt

SEQ ID NO: 51700 - DNA, 201 bp, Homo sapiens
tgacagagcaagactctgtctcaaaaaaaaaaaaaaaaaaagaaaagaaaagctggtcggtacacatccagccatgctcagatacagggcatcacgctgcyctatccttgaagttaggactgaccagcaggaagtgggggtgacaagcttctaagctattctttctgaactcatagtccccagcccagggccagagcgaca

SEQ ID NO: 51701 - DNA, 201 bp, Homo sapiens
gtccactggcatgatgggaagaggggaagagagcagagaagcctgaagtgtggtgctgagagctttccctctcccctccctaactctgtttattcttgtgwcagtgttcccacagaggatccctccggggagtccctaatcatcagccctgaggagtttgagcgaatcaaatgggcatcccatgtcctgaccagagaagaa

SEQ ID NO: 51702 - DNA, 201 bp, Homo sapiens
tacagtttaatctccactctccagattatcctcaatgctaagtgccatgccatccgggatgcccaaatcctggagaagcagcagatccaaaaagaactggrcacagaagagaagcggttggatcagatgatggaagtggagcggcagaaatccattcaaaggcaggaggaactggagaggaagaggagggaggaaagaatt

SEQ ID NO: 51703 - DNA, 201 bp, Homo sapiens
aggcggcaaattgtggaacagatggaaaagaaccaggaggagcgatcgctgcttgctgagcagcgggagcaggagaaggagcagatgctggaatatatggracagctccaagaggaagatctaaaggtaacaggccagacagacaatgccacgtttcaccagctgcagcatcaaaacccttcaagactctggggtttcagg

SEQ ID NO: 51704 - DNA, 201 bp, Homo sapiens
tgagggaggagaattgcttgaacccgggaggtggcggttgtagtgagccaagatcgtgccactgcactccagcctgggtgacagagcaagactctgtctcaaaaaaaaaaaaaaaaaaagaaaagaaaagctggtcggtacacatccagccatgctcagatacagggcatcacgctgctctatccttgaagttaggactga

SEQ ID NO: 51705 - DNA, 201 bp, Homo sapiens
tatggaacagctccaagaggaagatctaaaggtaacaggccagacagacaatgccacgtttcaccagctgcagcatcaaaacccttcaagactctggggtktcagggtgttgactgattttctgccaggcacatgctcatttcacaacatcatcaccgtcaactttttattgccatgttaaatatttatttcaccatggtg

SEQ ID NO: 51706 - DNA, 201 bp, Homo sapiens
tagaagagatggggtttcaccatgttggccaggctggtctcaaactcctgacctcaagtgatcccccggcctcagcctcccaaagtgctgggattacaggygtgagcccggccagaatcacagaatttttagaagcttatttcccaaatcctaggaggcacttcacagtctggctgcaatcaatctcgtttctcaccccta

SEQ ID NO: 51707 - DNA, 201 bp, Homo sapiens
tactgcattgaagctgagcgcaaagctaacatcctgccagctacctctgtgaactgaggggagccttcgtggccctcaggatgccttcgggggacagattytgcccagtctctgggcatccataattgctgctaacctagacatttcatagttacagattaaatctacttgactttaaggaacagcttggctttcttgtgg

SEQ ID NO: 51708 - DNA, 201 bp, Homo sapiens
aacttacacatccctaggcctagtgctacagtttaatctccactctccagattatcctcaatgctaagtgccatgccatccgggatgcccaaatcctggaraagcagcagatccaaaaagaactggacacagaagagaagcggttggatcagatgatggaagtggagcggcagaaatccattcaaaggcaggaggaactgg

SEQ ID NO: 51709 - DNA, 201 bp, Homo sapiens
attgtttcggtgacaccacccatcttgggggttgtttaggtggaggttggactctgggagatgtggaccctgggtttctaagacactgtggcactgttctytccaagaggaaggcggcaaattgtggaacagatggaaaagaaccaggaggagcgatcgctgcttgctgagcagcgggagcaggagaaggagcagatgctg

SEQ ID NO: 51710 - DNA, 201 bp, Homo sapiens
acgccgtgagcgcatcgatgagatcaagaggaaaaagcttgaagagctgaggtgcgctggaatctcctcctttcccaaatcctcttccctcccgcaaagakatggcaccacaggctggaaagcatggggatttgggggtgaagggccatggcagagatgctcagggagaggctcttctccccacccagggctcatccctct

SEQ ID NO: 51711 - DNA, 201 bp, Homo sapiens
tcctcctgcctcaacctcccaaagtgctaggattataggcatgagccacggcacctggccttattttgtcctattttaaaaggagtcaggaagtggtaggrgagatattggaaagtctgttgtaggggttttgtttctctctgcaaggctggggcaatggcaactattctacaaggcctttccttccggcaggctcgagaa

SEQ ID NO: 51712 - DNA, 201 bp, Homo sapiens
gaactccagtggaaggcagccgcaccttcattctaagatgcacatccttagttcaagggcctggcttctttgtctcttcatcttagccagtccacttgttygttaacagagacagcctagaaaggacaaccaaattagctttaacctcattaacacctttgattagaagttgggatgagggccatatgcaggcagaaaaga

SEQ ID NO: 51713 - DNA, 201 bp, Homo sapiens
tggtacgctggcgccggggtttggggatcgggcttccaggctgcgtcttcccgggttcccactagctactcactgctccaaggttatggctgaactcatasatacctacgttgagttcctgaatctcggcttgatagatgtttcaattgaacttgatcttaaagaacccacactctggtttgggatggtgacaaataccaa

SEQ ID NO: 51714 - DNA, 201 bp, Homo sapiens
caaggaacccctaagaaggaagatgccacaaaggcaggcaaggggagtaagtgcgggtgcccctgggtggcatcttcctgtgtggaggagggaagagtgcygggccgggtgcaggaagctgttctgggcctgggtgcgcctgcctggagctcatctcgccatgcccctctgggcttgatttccttctcacagtgggatgat

SEQ ID NO: 51715 - DNA, 201 bp, Homo sapiens
acccctaagggcctgggcaagaaaaaggagaaatcatgggtaggtgtgcaatgggacagatcctgggtgctggacggacaggggagggggcttccatcatrtacagaggtggtggagggaagaaggccacatgggcctttgaagttccccctaaggccccgggtcctaacctgggctccttccctcaccactgcccatccc

SEQ ID NO: 51716 - DNA, 201 bp, Homo sapiens
tcatgatgggaggaggtcaaaatattcatgctaacaggagtttggaagaagttgactccaaccctcatggatgacttggaggggctcaagacttcagtggrggaagtaactgcagatgtggtagaaatagcaagagaactagaattagaagtggagcctgaagatgaaactgaattgctgcaattcatgataaaagttgaa

SEQ ID NO: 51717 - DNA, 201 bp, Homo sapiens
gaacaggctcctcctggtttgttacctccatagcacaaggaaaaagagggctcagtgctaagctccccattttgccagggagcttctgtgggacttccctraaaagatccctctctgaagctgagagaatgaactcgtttcactcaaggggaaaccactctcagaaccaccatctctcactgcttagtgatgtgtcctcac

SEQ ID NO: 51718 - DNA, 201 bp, Homo sapiens
tgagtgctctggctcagggtttgaggttgcggtacagctgctgactgtggctgcacttacctcaaggatcaactgtggtggagaatctgcctccaggctcrcttatgtggctgcctgggcctctccacaggctgcctgagtgtccttaccacatggcagctggccagctgagagagtgccagagagcactcaagacggaag

SEQ ID NO: 51719 - DNA, 201 bp, Homo sapiens
tgactgtcgagaggatttaaagactcaattcctgcaatgcagttaaaatagcacctggcacttagctcaataaaagctgttattttttccccctcaatatragtctgagaccctgcctcacccttcatctcaccccacccaggtccctctgctatttcttcccgaaagcatctcaccccagaggagtcctatacaaattat

SEQ ID NO: 51720 - DNA, 201 bp, Homo sapiens
tccgtgctcccacagtgctctgagcttgcctctgtcagcgctcactccagaccacgttactttcactttctggctcctccacacaaaggagcttcttgagsgtatgggcttatttatttttgtatccccagcacttgggacaaagcctggactatagccggcagtcaaaacatgtatgttgaatgaatgaatgaatgaatg

SEQ ID NO: 51721 - DNA, 201 bp, Homo sapiens
atggcttttatttctgaagaagctacgaggtgagatcattagtgagcataagaaaggggtgtggaaggggaaaagagctgtgctgtgtgacaggtaactayctgctaaagtgcagagagcccatttccatccaggcatgaagtactacagggcagcgctcttttagagcagggcttctcaaggtgttgtccttggaccagc

SEQ ID NO: 51722 - DNA, 201 bp, Homo sapiens
gaacaaggtccttttgcacctcaacctcatccgtatgtctgccaacctcccctgtcctcctgtcatgaggctacccgggccctgtcctgcctgagggtgtytaccccgactctatggagcagagctggtcctcccatctttgggctacatgtcccccaaggctctctggcacagggctggaggggccagaggaagtgctga

SEQ ID NO: 51723 - DNA, 201 bp, Homo sapiens
ctcatgcctttccccatgaaccctcgagcctctctgcatcctgccagctcctccactccctcaggcaggctccctactgctgagctgcaggtgtccctccyggcacagctcctgcagcacctgcccctgtggccagcgtgctgttctgtggagctccaggctgtccggcacttggcagggactcccatcctatctctagga

SEQ ID NO: 51724 - DNA, 201 bp, Homo sapiens
cctggggaaggggtctgtgctgggccttggggaggagggtgtgatttaagggtggctgggcgggctgggggaagatccctgggccaggacaggatctaggsctcccgcgaagacacacatctcactcatggggaatggttttggggtgatggactgaaggcctgcagggacccaagccctgcttccctcaccttgagcctg

SEQ ID NO: 51725 - DNA, 201 bp, Homo sapiens
gtattaatcactctgctttttctgcatgtcccccagcccctaacccaccctgccccaggaccatttttttttttctgccagaggactaatcttcattcctyttgtcagatgtcagccttccttttcttttcagaaaaattgcttcgccccacaatgtcctgcgtacgccataatccaggagctgatgttgccaagggatcc

SEQ ID NO: 51726 - DNA, 201 bp, Homo sapiens
cttacaacctggaccaacttgctgcttgcattggaaatcttcctgggctgccttcagtgctcttatggtccctcatccctccgttctgtcagctgcctgascatccgcctctctttatttttctcttccattggaagactccctgcacaccctaggcagggaagggcccctctcctttcaggagtcttctctggcactcaa

SEQ ID NO: 51727 - DNA, 201 bp, Homo sapiens
ttacaacctggaccaacttgctgcttgcattggaaatcttcctgggctgccttcagtgctcttatggtccctcatccctccgttctgtcagctgcctgagsatccgcctctctttatttttctcttccattggaagactccctgcacaccctaggcagggaagggcccctctcctttcaggagtcttctctggcactcaag

SEQ ID NO: 51728 - DNA, 201 bp, Homo sapiens
gggctggaggggccagaggaagtgctgagtctgggaggaggctgaggacaggcgattggagtaatgagaggagttagagagatggggagtgtgtgagtaasagctgagtgaagggctaggtcagggaaaggtgtgcctgggccagtgagtctggagtggggagctggaggaactgggatgctggggatgtctggtgtgtca

SEQ ID NO: 51729 - DNA, 201 bp, Homo sapiens
taagggcctgggcaagaaaaaggagaaatcatgggtaggtgtgcaatgggacagatcctgggtgctggacggacaggggagggggcttccatcatgtacaraggtggtggagggaagaaggccacatgggcctttgaagttccccctaaggccccgggtcctaacctgggctccttccctcaccactgcccatcccctccg

SEQ ID NO: 51730 - DNA, 201 bp, Homo sapiens
agggacccaagccctgcttccctcaccttgagcctgttgagcttgagagtgagctgctcaatggtacggaagatcatgcccacgtccctgagggccaggcytggaggagagcggctggggcgtcttggatcatcgttgcctccctgcagctgaggctgaggctctgtctgccctgcagggaggctgtcaggctgagggggg

SEQ ID NO: 51731 - DNA, 201 bp, Homo sapiens
ggagagagtgaaagggactcacagccagggacagccacagcagccccactggacccttggatgcactcttggccttggagaactgcatctgatactgcacrgtggcgaggaagccctccagccccacctctgtgatgcggttccctggtggaagttacagacaggtggcctcttagcaccacaggcctcattggcacctga

SEQ ID NO: 51732 - DNA, 201 bp, Homo sapiens
ggaatggttttggggtgatggactgaaggcctgcagggacccaagccctgcttccctcaccttgagcctgttgagcttgagagtgagctgctcaatggtayggaagatcatgcccacgtccctgagggccaggcttggaggagagcggctggggcgtcttggatcatcgttgcctccctgcagctgaggctgaggctctgt

SEQ ID NO: 51733 - DNA, 201 bp, Homo sapiens
aggggcaacgtctgcttcagcaggagagagtgaaagggactcacagccagggacagccacagcagccccactggacccttggatgcactcttggccttggkgaactgcatctgatactgcaccgtggcgaggaagccctccagccccacctctgtgatgcggttccctggtggaagttacagacaggtggcctcttagcac

SEQ ID NO: 51734 - DNA, 201 bp, Homo sapiens
tccattcctcttgctggaaaatcagcagtattaatcactctgctttttctgcatgtcccccagcccctaacccaccctgccccaggaccatttttttttttctgccagaggactaatcttcattcctcttgtcagatgtcagccttccttttcttttcagaaaaattgcttcgccccacaatgtcctgcgtacgccataat

SEQ ID NO: 51735 - DNA, 201 bp, Homo sapiens
ctttttctttctttctttcttttctttctttctttctctctcttttttttttttttgatggattctcactctgttgcccaggctggagtgcagaggtgcartcttggctcactgcaacctctgtctcctgggttcaagcagttctcctgccccagcttacccagtagctgggattacaggtgcgtgccaccacgcccagct

SEQ ID NO: 51736 - DNA, 201 bp, Homo sapiens
ctgcagcagctgtctagtatgacagctgataggggcaacgtctgcttcagcaggagagagtgaaagggactcacagccagggacagccacagcagccccartggacccttggatgcactcttggccttggagaactgcatctgatactgcaccgtggcgaggaagccctccagccccacctctgtgatgcggttccctggt

SEQ ID NO: 51737 - DNA, 201 bp, Homo sapiens
gctccccggtgcctgccagggccgcctagtccatcctcagcctcccttcccacgccgggccaaatggagggacgcggggcggtgtgtgtgtgtgagtcggsggtattcgacgaggccggtggggaggtgggggagtctcccgtcttcctttccaacccagcagaggcgcgagtggccggagaggcagagtccgcaggccgg

SEQ ID NO: 51738 - DNA, 201 bp, Homo sapiens
ttcccactatccaatcctaaccagtcttacagggaacaaacaccgtaccttttatcacagcgattccaagaaacacacacaccaccactgaaggatatttracttttcttaaaaaaaaaatcttaaccatgaaaggaagaaaataaaagagtatacattatcttaacagcagaacagtcatttccatatctatattttata

SEQ ID NO: 51739 - DNA, 201 bp, Homo sapiens
ctccagccatttcttttttcttttcttttctttttctttctttctctttctttctttctttttctttctttctttcttttctttctttctttctctctctyttttttttttttgatggattctcactctgttgcccaggctggagtgcagaggtgcaatcttggctcactgcaacctctgtctcctgggttcaagcagttc

SEQ ID NO: 51740 - DNA, 201 bp, Homo sapiens
agctggaggaactgggatgctggggatgtctggtgtgtcaggtgccaatgaggcctgtggtgctaagaggccacctgtctgtaacttccaccagggaaccgcatcacagaggtggggctggagggcttcctcgccacggtgcagtatcagatgcagttctccaaggccaagagtgcatccaagggtccagtggggctgctg

SEQ ID NO: 51741 - DNA, 201 bp, Homo sapiens
ggtactgagctgaaggaggcctaggagcaggccagagagggaattgggaaagggtgtacttgtatgggaaggagcaggagcaaggcatggggcagggtaamtacaggtgtggttgggagtgtaaggggcaaggctgatttggccctgccccttctctaggctcccacagcaccctgcctcttcttgcttcatggtggcggg

SEQ ID NO: 51742 - DNA, 201 bp, Homo sapiens
agagacgctgcggacaacaccagcatgtcgagcgagcagagcgcgccgggggcctcacccagggccccgcgtccggggacccagaagtcttctggcgcggygaccaaaaagggagagcgcgcggccaaagagaagccagcgaccgttctgcctcccgtgggggaggaggagcccaaaagccctggtacgctggcgccgggg

SEQ ID NO: 51743 - DNA, 201 bp, Homo sapiens
cgcctttgtagcctaaacctggaggtgctgtcccatctcttctgccatgttctgttcattagaagtgagtcacttatttccctccaccccaccccccaccycttcttttttttttggagacagagtcttgctatgtcgcccagactagagtgcagtggcacaatcttggctcactgcaacctccgcctcctggattcaagt

SEQ ID NO: 51744 - DNA, 201 bp, Homo sapiens
gtactgagctgaaggaggcctaggagcaggccagagagggaattgggaaagggtgtacttgtatgggaaggagcaggagcaaggcatggggcagggtaacwacaggtgtggttgggagtgtaaggggcaaggctgatttggccctgccccttctctaggctcccacagcaccctgcctcttcttgcttcatggtggcgggg

SEQ ID NO: 51745 - DNA, 201 bp, Homo sapiens
gggcggcttgggcggctcacgcgtccctgcccgcctcttagggcctccggctgaaccgttccctgctctggctgtccctggcccacaaccgcatccaggayaagggcgccctgaagctggctgaggtgggtgtgccgatcaggtggggcaggggcgtgggcgggccgagggagccgaccctgactacccaggcgtccgacc

SEQ ID NO: 51746 - DNA, 201 bp, Homo sapiens
ctctgtgtaaaacaccatgaaacatatttccttccatcatgggaattagctagcagaaaacaactatatgaattcatctgtaaataatgtgtaaaagtaartcatagcaacataaacaaatttaaactgaataatcaagtttatgtgacagacgaggcaggctgaaaggttgaacaaaataagaaatcatgggagcaaatt

SEQ ID NO: 51747 - DNA, 201 bp, Homo sapiens
ctcacgcgtccctgcccgcctcttagggcctccggctgaaccgttccctgctctggctgtccctggcccacaaccgcatccaggacaagggcgccctgaarctggctgaggtgggtgtgccgatcaggtggggcaggggcgtgggcgggccgagggagccgaccctgactacccaggcgtccgaccgctgagcgcccgcct

SEQ ID NO: 51748 - DNA, 201 bp, Homo sapiens
tgcttttcagcaaactggccatccagtttaatctccaccctctgtcctgactgtctttccctccgatttctgcacagacttttgccaagcccctgctgggsgggctctaattgcagaaccacactatgggcagtagagtgtactggttcagagataggacactagattgagaccacctggacctgaaatccggctcatcca

SEQ ID NO: 51749 - DNA, 201 bp, Homo sapiens
aaccgcatccaggacaagggcgccctgaagctggctgaggtgggtgtgccgatcaggtggggcaggggcgtgggcgggccgagggagccgaccctgactayccaggcgtccgaccgctgagcgcccgcctccttcaggtcctgcgcgccttcgagctgacacacaccgaagtggtggagcgccgacgcctcctgctggaaa

SEQ ID NO: 51750 - DNA, 201 bp, Homo sapiens
aggaagatgccacaaaggcaggcaaggggagtaagtgcgggtgcccctgggtggcatcttcctgtgtggaggagggaagagtgccgggccgggtgcaggargctgttctgggcctgggtgcgcctgcctggagctcatctcgccatgcccctctgggcttgatttccttctcacagtgggatgatgtggagagccgcatcc

SEQ ID NO: 51751 - DNA, 201 bp, Homo sapiens
ctggggaaggggtctgtgctgggccttggggaggagggtgtgatttaagggtggctgggcgggctgggggaagatccctgggccaggacaggatctagggstcccgcgaagacacacatctcactcatggggaatggttttggggtgatggactgaaggcctgcagggacccaagccctgcttccctcaccttgagcctgt

SEQ ID NO: 51752 - DNA, 201 bp, Homo sapiens; identical to SEQ ID NO: 11075

SEQ ID NO: 51753 - DNA, 201 bp, Homo sapiens
aactacagagcttgagcttcagaagctgacaatgtgctctgtggtagtatgtgtctatttaggtaacacatcttagaaaagtttttttgtttaattatgartcatggattacctcattggggttttccagaaatagagatctaagaaaaagcccaaacaacatttaattaagttatatctttatttttagttatgtagtta

SEQ ID NO: 51754 - DNA, 201 bp, Homo sapiens
gttactagagacggggaagggaagtggagaggttggagggggagtggggatggttaattggcataaaaaatggaaagaataaacaagatctagcacgtgayagcacacaaaaaataaatttcagtataaacttagatgtaaaagtgtatttttcaaaaaaacacatgaaattagtgttttgatatttgctttctgagttga

SEQ ID NO: 51755 - DNA, 201 bp, Homo sapiens
caccagttttggacacagccattgcactgatgtttactgtacttgctccattcttcaatcccatcatttatagcctgagaaacaaggacatgaacaatgcrattaaaaaactgttctgtcttcaaaaagtgttgaacaagcctggaggttaatacagagccacaggttcccttccgttgcttttgttttgttttgtttttt

SEQ ID NO: 51756 - DNA, 201 bp, Homo sapiens; identical to SEQ ID NO: 11077

SEQ ID NO: 51757 - DNA, 201 bp, Homo sapiens
atgtttagctgtacatcttatttatttttttctctaccctctcatgtgctggactatgccctctccatttacaggtagctctactagaaatatggagagcrgaaaccaatcaacagtgactgaatttatcttcactggattccctcagcttcaggatggtagtctcctgtacttctttcctttacttttcatctatacttt

SEQ ID NO: 51758 - DNA, 201 bp, Homo sapiens; identical to SEQ ID NO: 11079

SEQ ID NO: 51759 - DNA, 201 bp, Homo sapiens; identical to SEQ ID NO: 11080

SEQ ID NO: 51760 - DNA, 201 bp, Homo sapiens
tcatttgaaacaacatggatgtaattgggggtcattatattcagtgaaataagccaggcacagaaagaaaaactttgcatgttctcactcttttgtgggarctaaaaataaaaacaattgaattcatggagatggtagaataatggttactagagacggggaagggaagtggagaggttggagggggagtggggatggtta

SEQ ID NO: 51761 - DNA, 201 bp, Homo sapiens
ctcagcgaagttagacgacttccctacattccctcagctggtgagcagcagagaatgggagggtccaggtggcccggtgctgggcctggaactcagggccytgacccccactgtcctccctactcagaatcctctgtggacacttgctgagggtgatagtcactgatgggtgactgttgtcccacagatgatgcttttgtc

SEQ ID NO: 51762 - DNA, 201 bp, Homo sapiens
aaacaaacttttaacttcatgaataaaaagtcctattcataaaaacaacagaactactgagctataaacttaaagagcaaggtacatatcctgcattaaarccatttttactaagagatatgtgttggagtcagctaccaaaaatagtaattttgctttgaacaacttagcttaagccgttctttgtaatagtagttagat

SEQ ID NO: 51763 - DNA, 201 bp, Homo sapiens
ttgtgcagggcacaatgggagagtatttattgtccatgaaaaatcatatgaagcagctgcaaagaagtctaattgttttcctcatgatatgcccatgactycctgcacacacacacacacacacacacacacacacacacacacacacacgtacacacacaaacacacacacacctcaggagctttggtcccagtttgcta

SEQ ID NO: 51764 - DNA, 201 bp, Homo sapiens
tttcctcttctgtaaacaggcaatgaccaaaacctgccctcgcatatttgtggtgaggtcagaaaataatacatgtaccacgtctagccatctttcctggygtgaagtaggtgctcattcttttttgattcagttttccttgtctgaggtgtgcttttctcttgtctcctgtaagcttcactaagcagaaagtgtcccgtc

SEQ ID NO: 51765 - DNA, 201 bp, Homo sapiens
caattcccctccattgatgattggaggggaatcgcttgttgtcacatcgaatcctagaaccctgtgagactggaaggaatttaatttgaaattgccgtgcrtaccagttctgctctgggctggagaaacaatcctgctgcagatccatctagtgacattaatctttctttgacttaatttggttttcatccctaaagtagg

SEQ ID NO: 51766 - DNA, 201 bp, Homo sapiens
aactccatgcagccattccagcggacactgtaaggtcctcatctaacttggctgttagccagcattcttgaaactgtcttttccattgctttccatggcaygcccactccatgctctcctccttctctgtggccaggcctcaattcccttgctgggccttgctggtcccttccctccctgtctctaaatattggagccatt

SEQ ID NO: 51767 - DNA, 201 bp, Homo sapiens
tgtctggattcacgagttaataagtatagaatgaatactactaactacttaactcatagtaaatgttatgtctgtgtttactatcatcaccatcattactrctaatagtgttaggacgggctccttgatatgcagttggaaggtggttccacattcaaggcagcttaaaggagctcagtcagcatcagcaaatgatggatg

SEQ ID NO: 51768 - DNA, 201 bp, Homo sapiens
gggtttggagtctgatagtcttgggtttgaatctgggctcagccactttactctgggcaagtctctcaacctctcaaaacctgtttcctcttctgtaaacrggcaatgaccaaaacctgccctcgcatatttgtggtgaggtcagaaaataatacatgtaccacgtctagccatctttcctggtgtgaagtaggtgctcat

SEQ ID NO: 51769 - DNA, 201 bp, Homo sapiens; identical to SEQ ID NO: 11087

SEQ ID NO: 51770 - DNA, 201 bp, Homo sapiens
aagaggcaatatatacagaggcctgcctttgtcaaatgtatacatttaaaatctgtggcaattcttatcagttctattgaagcataatttttgagacaggrtcttgctctgttgcccaggctggagtgcagtggcacaatcgtggctcactgcacccttgacctcccacgctcaagccatcctcctgcctcagctgggact

SEQ ID NO: 51771 - DNA, 201 bp, Homo sapiens
actgtcttttccattgctttccatggcacgcccactccatgctctcctccttctctgtggccaggcctcaattcccttgctgggccttgctggtcccttcyctccctgtctctaaatattggagccatttaaggcccagttttggctcttcctctcttcttactctacatttcgtctgtagacaatcttattcacttccat

SEQ ID NO: 51772 - DNA, 201 bp, Homo sapiens
gccacgagtctatgcatgatgagatcacacaactgtattccagaggaggaagtgagggaagagggcaaacgggttctcctcaagaggcttctgttatcaakgaggaaacttattcccagaaatccttccagtggacttctcacatctccctgcccaggactgggccacatgaccaccctcagctctaagggttaggaaagc

SEQ ID NO: 51773 - DNA, 201 bp, Homo sapiens
tctgttgcccaggctggagtgcagtggcacaatcgtggctcactgcacccttgacctcccacgctcaagccatcctcctgcctcagctgggactacaggcrtgtgccacaatgctcagcgcttttttgtttgtttgtttgttttgaggagagatggggatctgagttctccgggctggtcttgaactcctaggatcaagca

SEQ ID NO: 51774 - DNA, 201 bp, Homo sapiens
tgatactcttgttataacgtttgagtgtgaattcaatttaagacatatatgtatacaagataagatgtgtggtgcggatataaatgctgcgttgaagattsagcatgaatgagagttcaggcatttgttgaagatgagttagtgggaatggtttgggatctttcactgtgctcagaattccctaaagataattgaactcca

SEQ ID NO: 51775 - DNA, 201 bp, Homo sapiens
catagctttttttcaaccctttagaaggatggggcctaacagaggagatccccctggcaaactgagagggaagagtacagacaatcatcacagagccccgmagcaagcgctgaacaaacaagataatccacttagaaggtccaagtctcctgtgatagcacttgcaaaattcccagaaattggagagagacaaactaaagg

SEQ ID NO: 51776 - DNA, 201 bp, Homo sapiens
ataacagaagacagagagctgccaggttgtctagactatggctcttcatagggggtgataaggttaccacttcctgcactcccaggttccttttacttagygctcattcccatcagatcccatcatgcgcctgatgcaaaaggagtccactgttggcatgttaattcctataatttcccttctgaacaggacacctggctg

SEQ ID NO: 51777 - DNA, 201 bp, Homo sapiens
catttcactattattgttattttttaggttgacagcataattattccttttggtttacttgttattatagatgagcaataaaactccctttttgaattgcraataaaatgaaggggatgggaagggtcaatgactataaacctagtaaatcttaatttttgtttttcattttaaaattaagaattctgctcacacataaaa

SEQ ID NO: 51778 - DNA, 201 bp, Homo sapiens
tgtaccttaccagacatggtggagggggaaggggtaaggaaagcttcctggaggaagtgatgtccagacaaggtgagggtagagttgagccagacaaagasgatggggatgggtatttcagacagagaccaacctgcatgatggccaggagacaaaaagctttatttgaagaaccagaagagcttctacatggccaaggca

SEQ ID NO: 51779 - DNA, 201 bp, Homo sapiens
tctacaacagggatgggaataataatccaggaaacatttctagaaaagagaggtgaggagagggctcgggtgtgaggcttcacatgttggttccttctagrcactctgcccaccagctccctgccttctctcctgtctggtattttttgtttcttgtttgtgagcagacaggcctttgaaccccttcctagtcggtggctg

SEQ ID NO: 51780 - DNA, 201 bp, Homo sapiens
gaaggtggaaaggggagacggagggaagatagataccaaaggaggcagccaggggaccatgaagggccttgtgaaccgtgaatcctgcgagctgtgatgaracactgaaaggtttaagccggaggctggcagcacaatcagatttttattacagaaaggttccattgtgcattgtctgtctttcctgctggaatgtaagcc

SEQ ID NO: 51781 - DNA, 201 bp, Homo sapiens
tagacatgatggaaaaaaatgctctgctgttttcttgttgcttttcatggttttagcatcatgttcctattctcgctcaaatcaataatccactgtacaargtctggcattttgtactgaagccaagtataagaaagttttaactaatgcacgtatggggtcgctgttttaactaacacacgtatggggtcgctgttttgt

SEQ ID NO: 51782 - DNA, 201 bp, Homo sapiens
cccctatcttggcacccaggttaccagagggaactgaaaccactcatatggttgtttccttgactgtgctgtcatcacctaaattattttacctcttccaraataactgtaaatgctttcctagaagaaatcatgaatattcatttccttgtgatatttccaaatagagttttgtgcctatttggtgcttgaaaaaaagta

SEQ ID NO: 51783 - DNA, 201 bp, Homo sapiens
acagaaaggttccattgtgcattgtctgtctttcctgctggaatgtaagccccatggaggcagggacttggagaagacatcttcactgctgtgcttagaayagtatctggcacaacgtaggcattcacaatcaataaatgtttcttgaatgaatgaatggcttgaaggtggagaatggaccaaagaagggaaagactgaaa

SEQ ID NO: 51784 - DNA, 201 bp, Homo sapiens
attttaaggaatgacagacagtaggatgggccgtgaaggtggccgagaaggtgctcagaaaccagtgaaaaagagtaaatcgcatggcgcgagtttgtcaygagtatggaactgtagagtcttgaggataatagggttgggtgatcctctcacctgcaatccttctagaaggcatcttcagtaaaaagccagcctgctagg

SEQ ID NO: 51785 - DNA, 201 bp, Homo sapiens
acgtaggcattcacaatcaataaatgtttcttgaatgaatgaatggcttgaaggtggagaatggaccaaagaagggaaagactgaaagactgagttccaamagatcacttggaggggtccaagtgagagggaaagtgaaagcggaaagctactggagggtccaggtgagagggaaagtgagagctggaggagaagccaagg

SEQ ID NO: 51786 - DNA, 201 bp, Homo sapiens
taacccagattgccttcggtgcctgagggacttgatattttctcattatgaagactttcccatctagtgaacgctgcaaataaaactgctcagaatcggtytgaactgcctgtttccgtggtagcaggcctctgtctggaggataaatctgcaccatcttcttttttttttttttttttttgggtttcagccagttgtgtt

SEQ ID NO: 51787 - DNA, 201 bp, Homo sapiens
ggggcatcgtgaagctagagatgaccagcttgtctttatagcagtatcattgaagggagagtgggggtgacatcatgggagtgagagcacagaggaggaaraaaagagcacctaggactggtggcaaagcttcattttaaggaatgacagacagtaggatgggccgtgaaggtggccgagaaggtgctcagaaaccagtga

SEQ ID NO: 51788 - DNA, 201 bp, Homo sapiens
cttgaatgaatgaatggcttgaaggtggagaatggaccaaagaagggaaagactgaaagactgagttccaaaagatcacttggaggggtccaagtgagagrgaaagtgaaagcggaaagctactggagggtccaggtgagagggaaagtgagagctggaggagaagccaagggggatggagagaagtggattcaatagatg

SEQ ID NO: 51789 - DNA, 201 bp, Homo sapiens
gctgacagtagctccctttgggctgtggttagcagagcaggtctcaagtgctggggcatcgtgaagctagagatgaccagcttgtctttatagcagtatcrttgaagggagagtgggggtgacatcatgggagtgagagcacagaggaggaagaaaagagcacctaggactggtggcaaagcttcattttaaggaatgaca

SEQ ID NO: 51790 - DNA, 201 bp, Homo sapiens
gagctgttcctggagcaagttactcagcccctctgtgcctcagttccctcactctacaacagggatgggaataataatccaggaaacatttctagaaaagrgaggtgaggagagggctcgggtgtgaggcttcacatgttggttccttctagacactctgcccaccagctccctgccttctctcctgtctggtattttttg

SEQ ID NO: 51791 - DNA, 201 bp, Homo sapiens; identical to SEQ ID NO: 11100

SEQ ID NO: 51792 - DNA, 201 bp, Homo sapiens
ggtaatgaacaggactgttttattcttggggactggagatggccagttacttaaggttggttttctgtgccttcttcaaatgtctattttaatggtgataytttgtactttaaaaaaacatttttttaatgcttctgggttatacatgagaccaaaccaagaacttcatgaactccttaaagacccccagaaatggcctgg

SEQ ID NO: 51793 - DNA, 201 bp, Homo sapiens
gaaagtgttgggggtgctacaggcagtttctgggctccagattgcgagactagatggcgggactcagagtcaccaccctggggctgaaccaggcaagcgayacaggtttcccctgggctcccagggcagccacagcttttatcttgagattggcatttctttgactggaaaataaagaggcagttcaagagggtccagttg

SEQ ID NO: 51794 - DNA, 201 bp, Homo sapiens
caagagatcagagatcactagggaatctacttcctcctccaatccctcacccgtcccatcttcacgctgttcttaagatcttaagatgcagcagggggaamaatgtagctatggagagctcaagtcaaaaagctcaagtaacttcagtatacagcacaaatggggccttttaagagaaggccgattagcccatggttgctt

SEQ ID NO: 51795 - DNA, 201 bp, Homo sapiens
cctgcccttgattcatcctgccagccccctgcagccttatcctctctgcctcctcaatacccaaaaccaccaaatcatgtgacgggacgatgggtaaaacyggtagtgaaaggggaatgcagttacatgttcccaggccgtgtgcagaagaggtggggtttggagtctgatagtcttgggtttgaatctgggctcagccac

SEQ ID NO: 51796 - DNA, 201 bp, Homo sapiens
tttattagccaagaatatggttgaggagacagtgaggtagccagatcatcttcccatgtgggaaaagacctgttcccctgcccttgattcatcctgccagycccctgcagccttatcctctctgcctcctcaatacccaaaaccaccaaatcatgtgacgggacgatgggtaaaaccggtagtgaaaggggaatgcagtta

SEQ ID NO: 51797 - DNA, 201 bp, Homo sapiens
atcctagaggggagtgcaagggaaagtgttgggggtgctacaggcagtttctgggctccagattgcgagactagatggcgggactcagagtcaccaccctsgggctgaaccaggcaagcgatacaggtttcccctgggctcccagggcagccacagcttttatcttgagattggcatttctttgactggaaaataaagagg

SEQ ID NO: 51798 - DNA, 201 bp, Homo sapiens
ccttcttttacagtagctctgccagttaaccctttcttcttctctccaagtgacgcttctgtctgttgcttggtatgtttggctaagcagagttgtatacytcaataacaaggacaaaaacacccgtttacaaactgtgataaacagaccattggcttcatgaatggccctatttgaaaagagattattctctctttgaac

SEQ ID NO: 51799 - DNA, 201 bp, Homo sapiens
tgaatggccctatttgaaaagagattattctctctttgaacagccttcctcttcgcttctgggtaaacatcctgaagaaccctcagtttgtctttgacatyaagaagacaccacatatagacggctgtttgtcagtgattgcccaggcattcatggatgcattttctctcacagagcagcaactagggaaggtaaggccca

SEQ ID NO: 51800 - DNA, 201 bp, Homo sapiens
cgtaggtcagctgtttcaagttttctgccactgccagatgcggctcacttctccatcaaagatggcaccatgcacagctgccatccgagagcgggaagctragctgaaagtcaacacttctcagcgttctgaattgtatcaatacacccatccacatctgagaggccggagagtgggctgcattggttctcaaacttgagc

SEQ ID NO: 51801 - DNA, 201 bp, Homo sapiens
ggtggtgggggttcagctacattggaatattataaattcctccatctttttttttttttttttttactcttttggtgatggttgctttttttttttttttytccccaggaagcaccaactaataagcttctctatgccaaggatatcccaacctacaaagaagaagtaaaatcttattacaaagcaatcagggatttgcct

SEQ ID NO: 51802 - DNA, 201 bp, Homo sapiens
acactgtgcagcctttgtgatgcatttctggttaattttgttcattaaaacgcagaccttgctcacctataaaatatgcctctaaagtatttgagatcacyttgtaaagctagttggttgcttttagcgcctccatccgttgcacccaacccttcacctgccgttttctgaatatcttacatattctgaacgggcaaacaa

SEQ ID NO: 51803 - DNA, 201 bp, Homo sapiens
gatcacacagatgggggcagcctcttcaggagttctgagtcttatcccaagaacagtgggaagccatgggaggtcctgaagcagggaggttagtatttcaraaaatgagtggggctgtgtgtgagatgtagatagaaggggtgcaaacctggaaatagccccattagaagctgtggatttctggtgaggattggtgctgtc

SEQ ID NO: 51804 - DNA, 201 bp, Homo sapiens
gaagttcctctaggtctaatctcccatttaatccaggcctatcccaattctctacgctggcttgctcccttctcttcctgtgttctagcctctttttttttgagacagggtctcactcttgttgcccaggctgcagtgcagtggtgggatctcggttcactgcaacctctgcctactgggctcaagcaattctcccacctc

SEQ ID NO: 51805 - DNA, 201 bp, Homo sapiens
gtctgtttggaggcttgagctgtgcacttcggctgcctgatgcgaatggcctatggggaaggaaccacatactgattgaaatgttagcaaacagctggcaygctcctgcccactatgcagaggaagcaaaaatatttatctttttttgcatttacagctatgcttgactatagcaggactccaccgtaaatgacattttcc

SEQ ID NO: 51806 - DNA, 201 bp, Homo sapiens
gcagacagagctgtggacagctgtttctttcacacccagtgaccgctttgcttatatgcactgagaaacgtgaagttatttggcctggttttagagagatrgaatgcagctgttatttatacggcgtaccaaataggaatttacactttgcatgtcatctgtaattctaccttgcccaaagtgtttcctgtctctctaaat

SEQ ID NO: 51807 - DNA, 201 bp, Homo sapiens
agccgggatggcgccccgcattccagtctgagtgacagagtgagattgtctcaacaaaaagaaggagcgctgctaggttctcttctgattggaatggcttygggaatttgggcggaacgagaagccttgagtgtaggggtaaaaagtcttacttgagaaggacaaggtgaagtccctttcaccaaaagaacatgttcctgc

SEQ ID NO: 51808 - DNA, 201 bp, Homo sapiens
gggttccttaaaaaaattctctattttactttctaccaaaattcccttttgtgtctttggttttttaaccaagtttcacttaattagcgcaatacatcaawggctggacactcacataaaataaattaaaactctgtaattatgaaaaatgatgttgctctggtcgaaataaaattgtaaaggtgactttgcggctcactg

SEQ ID NO: 51809 - DNA, 201 bp, Homo sapiens
cttggcaccctcgttgaaaatcatttcaccatatttgtgagagtgtatttctgggtgttcttttctattctattggtctatgcctgtctttatggcagtamcgcactgtttgattactgtagctttgtaaagtaaattttgaaatcaggaaatgtgaattcttcaactttgttcttctttttcaagattgttttagaaaat

SEQ ID NO: 51810 - DNA, 201 bp, Homo sapiens
acccagtttccttcaatagtactatcctgcaaaactatagcaaaacatcacagtcaggatattgacgttgacagcagtcaagacacagaacagctctatcrtcacaaggctccccaggttgccctttcacagtcgcatccatttccctcctccctcccattctccatctctgatgcctggcaaccactgacctcagctcca

SEQ ID NO: 51811 - DNA, 201 bp, Homo sapiens
tataattttatcatttcaataattttatataaacggaatcatccagatgtaccctttgggggactggctcttttaactcaacataattctctggaaattcwtccaagttcttttatgtatcaataattcattcctttttatcgctgagtcgtggtccaggcagcggctttttaaacttctttaattttaaagataaatatc

SEQ ID NO: 51812 - DNA, 201 bp, Homo sapiens
gcatgagtgacatttcatcagtataatgagaactattgttgttaaaaattattattatttttttgtgcgtttgtgtgcatgttcagaaagaaggggatcarcctgaaagagtccaaccaatcgcatcatctaccttgatccattccgacctgacatccgtttatggcaccgtggtaatgaacaggactgttttattcttgg

SEQ ID NO: 51813 - DNA, 201 bp, Homo sapiens
taggcactaggaatggagcaggtactgtcctaggcgtctaggatcctgaacttgagttgattctttctagaggcatttattgcacacctattagatgcaaktataccgacctccacagattccatgaggaggattcagatgaatcaggcacatctctggccatcagtctcaagaatcttatccatgagtacatgagtaaaa

SEQ ID NO: 51814 - DNA, 201 bp, Homo sapiens
tcggtgacttgttttgttcttatgccttggccaattaaaagctgagatagtgatccctaggagagtatgagatgtaaatgagctgtaaaatggcttcttcmtagtgattattcatgggaggcttggaactcgaggtgggttcagtctgtttggaggcttgagctgtgcacttcggctgcctgatgcgaatggcctatgggg

SEQ ID NO: 51815 - DNA, 201 bp, Homo sapiens
taagtaggcacagaggatgcaggaaattatgagacacaaggttgaaatgaccctggagcctgcatatatagggcctcacataccagtcctgtgagtgctcrctttattcttcagtggcaatggaatgccattcaaggtatcttattttatttttttagtgtatgagtttgctaatccaaggatctggtacttatgaggtag

SEQ ID NO: 51816 - DNA, 201 bp, Homo sapiens
gttttgttcttatgccttggccaattaaaagctgagatagtgatccctaggagagtatgagatgtaaatgagctgtaaaatggcttcttcctagtgattaytcatgggaggcttggaactcgaggtgggttcagtctgtttggaggcttgagctgtgcacttcggctgcctgatgcgaatggcctatggggaaggaaccac

SEQ ID NO: 51817 - DNA, 201 bp, Homo sapiens
tgccagtgcaggtgtgtctgagacgtccacagtctctctgggctgacagtagctccctttgggctgtggttagcagagcaggtctcaagtgctggggcatsgtgaagctagagatgaccagcttgtctttatagcagtatcattgaagggagagtgggggtgacatcatgggagtgagagcacagaggaggaagaaaagag

SEQ ID NO: 51818 - DNA, 201 bp, Homo sapiens
caggaaattatgagacacaaggttgaaatgaccctggagcctgcatatatagggcctcacataccagtcctgtgagtgctcgctttattcttcagtggcartggaatgccattcaaggtatcttattttatttttttagtgtatgagtttgctaatccaaggatctggtacttatgaggtagggtcctggttcagtcccta

SEQ ID NO: 51819 - DNA, 201 bp, Homo sapiens
tttggagaggcaggaactgaagaaaggctgggagcccagtgaggatgctcatgccagtgcaggtgtgtctgagacgtccacagtctctctgggctgacagyagctccctttgggctgtggttagcagagcaggtctcaagtgctggggcatcgtgaagctagagatgaccagcttgtctttatagcagtatcattgaaggg

SEQ ID NO: 51820 - DNA, 201 bp, Homo sapiens
ccaattaaaagctgagatagtgatccctaggagagtatgagatgtaaatgagctgtaaaatggcttcttcctagtgattattcatgggaggcttggaactmgaggtgggttcagtctgtttggaggcttgagctgtgcacttcggctgcctgatgcgaatggcctatggggaaggaaccacatactgattgaaatgttagc

SEQ ID NO: 51821 - DNA, 201 bp, Homo sapiens
caacattcctggtcaggaactgcaccatttctatgactaaagactgagattccttggcttctctgcagccatccatttactctcagctcagatttttaatygagtaatggtagatctgtttccctcaactgatctcccacagataactcgctgtgtgactttaggtgaattgcttaacctctctgagccttcatttcctta

SEQ ID NO: 51822 - DNA, 201 bp, Homo sapiens
ctgggcattttcctagaattaaaataggatctgacctgaatttttatatttatgcatcttgaaacccatgaatttgtggctggtatcctgaaaagattccyaaaattgtcctgtatttgaaattaaaattcattaatttgctctcaaacataattgggtttaatattaaacatgaataaattgatagctttgttcataaat

SEQ ID NO: 51823 - DNA, 201 bp, Homo sapiens
tccaggactgagtgatgatcattaatggagctgagtgggttttatggtgagagctggagttacccaatatcttagtccattctggctgctataacaaaatrccttagactggataatttataaacaatagaaatgtattgcttacagccctggtgactggggagtccaaggtcaaggctccagcagattcagtgtctggta

SEQ ID NO: 51824 - DNA, 201 bp, Homo sapiens
gatagtctgcctcccaattcagcggtgggctgtctcttggcactaaagtggaattcagcttcttatatcagctgaggggtgttagatagatggccagctcrctttggcactcaatacctgttcatacatagtaaacaggggttttctttggttgggcaggtatggtgattttgcaaggtaatgaaaggttgctcccgggga

SEQ ID NO: 51825 - DNA, 201 bp, Homo sapiens
ggaggaggaagacccaaggagaacaaggggaacagaaccaaccaggctttacaggtcagaccctatttttgtgtggttgaggggaaaacctgtctttgaaygaccatgaccacaactcatactactttgggttccttaaaaaaattctctattttactttctaccaaaattcccttttgtgtctttggttttttaaccaag

SEQ ID NO: 51826 - DNA, 201 bp, Homo sapiens
ggggaaaacctgtctttgaatgaccatgaccacaactcatactactttgggttccttaaaaaaattctctattttactttctaccaaaattcccttttgtrtctttggttttttaaccaagtttcacttaattagcgcaatacatcaatggctggacactcacataaaataaattaaaactctgtaattatgaaaaatgat

SEQ ID NO: 51827 - DNA, 201 bp, Homo sapiens
tctttgggggaaatattgggagctatcaaaatgaaaagcagaatcaaccttttcaagatgttccctaagggggagatggaaaccccaaaataaactctccyagataaatccaatatgttaagaaaaacatttatctccctagttgaatttttaaatttattactattatgtattttttgcattttcatgggtacataatac

SEQ ID NO: 51828 - DNA, 201 bp, Homo sapiens
ctcggccagttggagagggaagctttgtcaccaaagggacttgcacccctgggccagacggtggtgtccaagagaaagtgatcaaagagatacagaacccrcatgcctaaatatttatttcagttgttcgtatttcccacacttttcaaatgtgaacttgtgtcctgaaggtggagctttagtacacaagaaaattgggaa

SEQ ID NO: 51829 - DNA, 201 bp, Homo sapiens
agacaagatgctaattatcactcttattcatttactaaagcaccctagtttgagtcactgtatgtgcttaaaagcaaaaaaaaaaaaaaaaaaaaaaaaawttcatttaaaaatagggtctaattcagagttttaagtgaatcagactcacctccctccaattagtccacattagttaggttttaaagttaatctgtagtg

SEQ ID NO: 51830 - DNA, 201 bp, Homo sapiens
gacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccctg

SEQ ID NO: 51831 - DNA, 201 bp, Homo sapiens
gttgagtaccttgaaatttgatgaggaattttttggagcagctcttccagtgtgccacccaaagttgaaaaaacaaaacctcttggatccattttatgtgracattttattctttgtagccttctctttactggtttggtttcagcctccaaaaattaaattactactacatataatggtagtaaaaaagaacaccccaac

SEQ ID NO: 51832 - DNA, 201 bp, Homo sapiens
agacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccct

SEQ ID NO: 51833 - DNA, 201 bp, Homo sapiens
atagacagtagcatctgtaacataaaagtgaaagaactcaggattgttttatcttgaaaagggaaaatgattcttgctatcaaataaagggcttttttttwaaagggagaatttgattagatatcacaaatggagaagtaaggtggcattcacctatatggtatgaagctaggtagcaagggactccaagggacatgttct

SEQ ID NO: 51834 - DNA, 201 bp, Homo sapiens
cagacacagagacacacaaatggaatcagatgctcaggaggaggacaccacaagtcacgtggatgggagggatagtaagatgagggtggggtcaaagatatcagttggggatgactgtgcagatgcctggaggcaggtgctttcctagagaagacaggaggaggagcagcttcccagcacaccgggagggtagggaccccc

SEQ ID NO: 51835 - DNA, 201 bp, Homo sapiens
gcatttagaatttcaccaaacgtcatgtgattaagcatctctggactttggggtcattttcaaatatcaagactgagtatattctgcgatggtagaggatrtaggggaaaaaagagtgtgagtatgatgttcactcttgctgaagttctgctggactttatattgggtagaatcttagaatcttatgtcctgttttggtca

SEQ ID NO: 51836 - DNA, 201 bp, Homo sapiens
gtcagaatcttgtagcctccagctgcatgattcctaaaccacaatcccaatcttgtggctaatttgttagtcctatgaaggcaatctagtccccaggcaaraaggtggttttgggaaagggctgttgttgtctttgttttaaactgtaagttcctcccaaagttagttcagtctacatccagaaatgagcaagagcagctt

SEQ ID NO: 51837 - DNA, 201 bp, Homo sapiens
cccagtggctcaggggcttcttcctggactcggtcctccaagtggatgcactcagcatttagaatttcaccaaacgtcatgtgattaagcatctctggacyttggggtcattttcaaatatcaagactgagtatattctgcgatggtagaggatataggggaaaaaagagtgtgagtatgatgttcactcttgctgaagtt

SEQ ID NO: 51838 - DNA, 201 bp, Homo sapiens
aggttttacaatagtgattttatccccaggagcaatttggggagagtcagaatcttgtagcctccagctgcatgattcctaaaccacaatcccaatcttgkggctaatttgttagtcctatgaaggcaatctagtccccaggcaagaaggtggttttgggaaagggctgttgttgtctttgttttaaactgtaagttcctc

SEQ ID NO: 51839 - DNA, 201 bp, Homo sapiens
aatgcagtcaagtataacagaataattaaagtgaccctttcaggcccttagtgattctattaatacagggctaacgtccttcacaaagtgattaaaataamttctgctaccaaaatcaattctgtgtcatgttacatcattgctgtgatgacattaacaatgaatttacctcaatctgcaaaaccagtccaaagcgctgat

SEQ ID NO: 51840 - DNA, 201 bp, Homo sapiens
gcctgtgcgacagagcaagactccatgtcaggggaaaaaaaaaaaaaaaaaaaaagcagggtttgcaaaatatctcaagcactggtcttaggttttacaakagtgattttatccccaggagcaatttggggagagtcagaatcttgtagcctccagctgcatgattcctaaaccacaatcccaatcttgtggctaatttgt

SEQ ID NO: 51841 - DNA, 201 bp, Homo sapiens
tgatctaaaatattgaatgtgtagaacctttatggggaaatgattctttgctcttttgtctgtactggatttttcaaaatctttattggtaaaaagaaagratgtatttctaagaattgttgcaaccatacagggcagccatggagctgactctacattttgttttaaaaatgttgttttatacctgcactatttatttag

SEQ ID NO: 51842 - DNA, 201 bp, Homo sapiens
ctccagcctgtgcgacagagcaagactccatgtcaggggaaaaaaaaaaaaaaaaaaaaagcagggtttgcaaaatatctcaagcactggtcttaggtttyacaatagtgattttatccccaggagcaatttggggagagtcagaatcttgtagcctccagctgcatgattcctaaaccacaatcccaatcttgtggctaa

SEQ ID NO: 51843 - DNA, 201 bp, Homo sapiens
agtttgctaatccaaggatctggtacttatgaggtagggtcctggttcagtccctactaggccagtagccctcacactgtttcatgaccccaagacctacycctgtatcctgaccctgaaacgtatagcgtcatctgccaagggggctgagttacagaaaagtgtgaccacaatagagaaatgagctcaaaaatctatgta

SEQ ID NO: 51844 - DNA, 201 bp, Homo sapiens
agtgtattaacctcaaagacatgggagaaaggggtggggcagggtgtggtccgagggaaggagtcagacccagacacggctgggcatctgctccaagacarggagagcagaataggcttagtgaggcaactgaggccctggggagaggggagcagcaagaatctcatgcatgagtcgaatcttggccaaagggtggacttt

SEQ ID NO: 51845 - DNA, 201 bp, Homo sapiens
ggaggagtatttcaagctataaaggccagtgtctgaccgtctgtctgtttctttccacatatctagtagttgaaaccttgtcagggaccgttggccctttyaccctgccctgaccacttctccttccatttcttaacattctcatatctggtgccttcactcactgagaccagagatagttcccctctcttttgtgcattc

SEQ ID NO: 51846 - DNA, 201 bp, Homo sapiens
ggtttcaccatgttggccaggttggtctcgaactcctgacctcaggtgatccgcctgcctcagcctcccaaattgccaggattacagccgtgagccaccaygcccagccagttttgtctttttaagatgcatgaaataacagtgcatgtctgcactgttgggaaaattccagaagagaaggagaaatggatgatacaggag

SEQ ID NO: 51847 - DNA, 201 bp, Homo sapiens
ttttagaaaataataaacttttaattttgagataattgtagattcacatgtacttgtgagacaataatacttaatatcttttacccagtttccttcaatartactatcctgcaaaactatagcaaaacatcacagtcaggatattgacgttgacagcagtcaagacacagaacagctctatcatcacaaggctccccaggt

SEQ ID NO: 51848 - DNA, 201 bp, Homo sapiens
tatttatttaggagggtcctcttggtagctctttaacccatttattaagattagaagaggttccaccagcaaacaaaagacaactaatctgagtctgtttraaagcagactgaagcacccactttcacaagacaggccagggctggattccatcctagatggccaagagaaccctctctaaacaataggggtttaaaatgt

SEQ ID NO: 51849 - DNA, 201 bp, Homo sapiens
gtcattatctattgtttcttctttaatgaaaaccaaggtcatactctgtgttagacaaaacagcagaagatcctatccattgtttgttgagttaaaatatygctcttgggattctgttttgcaggctttgctgagctgcagatggataaattggatgtggttgatagttttggaactgttcccttccttgactacaaacat

SEQ ID NO: 51850 - DNA, 201 bp, Homo sapiens
aatgttttctacaaagagccaagacagtaaatattttaggctttgcgggccgtatggtctctgctgcagctactccactcgactgctgcagtgcaacagcrgccagagacactacccagacgaatatttatgggtgctgaaatttgaatttcatgtgtttttatatgtcatgaaatattattcttcttttgacattttgtc

SEQ ID NO: 51851 - DNA, 201 bp, Homo sapiens
acaaagagccaagacagtaaatattttaggctttgcgggccgtatggtctctgctgcagctactccactcgactgctgcagtgcaacagcagccagagacrctacccagacgaatatttatgggtgctgaaatttgaatttcatgtgtttttatatgtcatgaaatattattcttcttttgacattttgtcatggcccata

SEQ ID NO: 51852 - DNA, 201 bp, Homo sapiens
tgtgctggggagcagaatgagaaaatgtctgtttgagcaggatgggcagcccctgtagcccagcaatgccaccccaatgagtgttccatgtacaaaggagsagaggatactcaattgcttcaagaagcaggtgttaggcaggtgttggacatcacggagttctcccagtggctcaggggcttcttcctggactcggtcctc

SEQ ID NO: 51853 - DNA, 201 bp, Homo sapiens
ggtagaggatataggggaaaaaagagtgtgagtatgatgttcactcttgctgaagttctgctggactttatattgggtagaatcttagaatcttatgtccygttttggtcaccgtattatagaagaatacagacttgctgaaaatggtctacaaaagaacagtgaaattatcagaatgatagacagtagcatctgtaacat

SEQ ID NO: 51854 - DNA, 201 bp, Homo sapiens
ttgattcattttcagtaacaaaatcaagtatatggagtagcaaacatcattctttaggtgatgcacttggaaaaatagttgagtaccttgaaatttgatgrggaattttttggagcagctcttccagtgtgccacccaaagttgaaaaaacaaaacctcttggatccattttatgtggacattttattctttgtagccttc

SEQ ID NO: 51855 - DNA, 201 bp, Homo sapiens
agctttaccccagtgggctcctttgtaggaaaggtaggaattctgtattcaagttgctgttttgaatggtgtcagcagtaaagactagtgtctccccgacctcccagggactgcagtagggttcaggatacaggaagctatatcacatagctctatcctgtccccatatccagtcttgaggtatttcctatgtgcttgggc

SEQ ID NO: 51856 - DNA, 201 bp, Homo sapiens
tgtaaatgagctgtaaaatggcttcttcctagtgattattcatgggaggcttggaactcgaggtgggttcagtctgtttggaggcttgagctgtgcacttyggctgcctgatgcgaatggcctatggggaaggaaccacatactgattgaaatgttagcaaacagctggcacgctcctgcccactatgcagaggaagcaaa

SEQ ID NO: 51857 - DNA, 201 bp, Homo sapiens
ccatcttatgaacatagcttccaacagtcttggtagcgatggagagaagaccaacatgggcagtgaccattgcaagtgaggtcctttggaaagccagtggrcccttgctatggcagcaccactcttgacaacacatcagtcctgtcattggatgagagaagggagcaaggagcatatttaagcattttcaaatgcacacgc

SEQ ID NO: 51858 - DNA, 201 bp, Homo sapiens
ctagaaatatttcgttctttccttgatgctattcaatggaatatctgtggagtccaacaccctttggcgataacgtgctgttggtatttgttcttcttgcyaggttggtgccccgtctggtgaggcaagggttcccaagttagtgtgacctagagtgactgacacatcaagcaagccagtgatctcaccactcagcttctg

SEQ ID NO: 51859 - DNA, 201 bp, Homo sapiens
ttttgtgataattccttggctaaaccagaggccagaatggaatctttcatggatcttcagatcctcactttaaatagaagataaacaaagctggtactgcragcccaagcaaaatagctccaaaatagctggctgaatccatccctgtgcctgttcgaacgtcaaagcgttggacacaccattgtctataatcctaatgag

SEQ ID NO: 51860 - DNA, 201 bp, Homo sapiens
gccacagtaatgagaactgtttgtataatagaaggcaacggaagggcagggcctgggcctggctttgtgttttatttcagctcttctctgcagccaaccargtcattatctattgtttcttctttaatgaaaaccaaggtcatactctgtgttagacaaaacagcagaagatcctatccattgtttgttgagttaaaatat

SEQ ID NO: 51861 - DNA, 201 bp, Homo sapiens
ttagtcgtccctcatagaatgcattattttgtcttcagtggctttacttccaggcttatcagggaagaagtggtttgaaacatcagagccctaaacaaacraacaaaacagaactcagaattcaggctaccagtctggctgatgcatctctacaccttcaaacaaagatttaccactttattcaagttttagttatccata

SEQ ID NO: 51862 - DNA, 201 bp, Homo sapiens
tgtcagtgattgcccaggcattcatggatgcattttctctcacagagcagcaactagggaaggtaaggcccagcttgagtatttcttgtatgcagtcttakgagtttgacatacttgtctttctgataagcattcaaataataaacaattggtctaaactacaccagctaaaaagagatagcaagggccactgtcaatttg

SEQ ID NO: 51863 - DNA, 201 bp, Homo sapiens
aaggacaaaaacacccgtttacaaactgtgataaacagaccattggcttcatgaatggccctatttgaaaagagattattctctctttgaacagccttccycttcgcttctgggtaaacatcctgaagaaccctcagtttgtctttgacattaagaagacaccacatatagacggctgtttgtcagtgattgcccaggcat

SEQ ID NO: 51864 - DNA, 201 bp, Homo sapiens
tggtgggggttcagctacattggaatattataaattcctccatctttttttttttttttttttactcttttggtgatggttgctttttttttttttttttycccaggaagcaccaactaataagcttctctatgccaaggatatcccaacctacaaagaagaagtaaaatcttattacaaagcaatcagggatttgcctcc

SEQ ID NO: 51865 - DNA, 201 bp, Homo sapiens
ctgttttattcttggggactggagatggccagttacttaaggttggttttctgtgccttcttcaaatgtctattttaatggtgatattttgtactttaaaraaacatttttttaatgcttctgggttatacatgagaccaaaccaagaacttcatgaactccttaaagacccccagaaatggcctggaagaaaatctggaa

SEQ ID NO: 51866 - DNA, 201 bp, Homo sapiens
gttccttaaaaaaattctctattttactttctaccaaaattcccttttgtgtctttggttttttaaccaagtttcacttaattagcgcaatacatcaatgkctggacactcacataaaataaattaaaactctgtaattatgaaaaatgatgttgctctggtcgaaataaaattgtaaaggtgactttgcggctcactggt

SEQ ID NO: 51867 - DNA, 201 bp, Homo sapiens
ctctgtaattatgaaaaatgatgttgctctggtcgaaataaaattgtaaaggtgactttgcggctcactggtgaagagctggaaggaagtttagcattccrtctgagggatttcaacttgcactttatataattgcgtttctgggggttatgtgtgtggatgggggtctgtgcaaagtgtgcaaactaacctcgattccgt

SEQ ID NO: 51868 - DNA, 201 bp, Homo sapiens
gctgatttatcaagacaggaattgagataaagtaatttggctgtacgggagatgggagttttattattactcaaatcagtctccctgagcgttcagggatsagagtttttaaggacaacttggtgggttgggggaagccagtgagccaggagtgctgattggtcaggtcagagatgaaatcataggaagtcaaagctgtct

SEQ ID NO: 51869 - DNA, 201 bp, Homo sapiens
tgtaatgtaactgcccaacaggttcaccttccccattgcctagacagagctgatttatcaagacaggaattgagataaagtaatttggctgtacgggagaygggagttttattattactcaaatcagtctccctgagcgttcagggatcagagtttttaaggacaacttggtgggttgggggaagccagtgagccaggagt

SEQ ID NO: 51870 - DNA, 201 bp, Homo sapiens
ttagcaataaggaatagttgacaaatgtatcttcacacctaggatcatcaaggcacgctgtcttaaatgaaccccagatcaaagagaaacagatgaaaaamgtcatgtgtttggatgggaataattaatatcataaagacagaaatttttctaacattaaggcatatatttaatacaatttcatttagactcagtcccctc

SEQ ID NO: 51871 - DNA, 201 bp, Homo sapiens
tatccactctgataagagctggggctgcatgggagaggagcaaagaccaggtccctgccctcacagagcctgcagccctggggaaggagtgcaaaaaagggacggagagacaagtagagtcaacaccttgcgtgtagtagtgctgtgtggcttggagaatccaagaggcttcctggaggaggttatgactgaactgagagc

SEQ ID NO: 51872 - DNA, 201 bp, Homo sapiens
gatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtga

SEQ ID NO: 51873 - DNA, 201 bp, Homo sapiens
ctcactattacaaattaatcactgtttatatctggtctggtacatttcaaaactgcttaccacccaaacaaccactggtgttttcttcctcgccctaagtyccactgtggtttaccctaatcttcccagagacttcccacacagccactgcctcactctctccagctcaccaccactctcaaagaagataagaagttcgta

SEQ ID NO: 51874 - DNA, 201 bp, Homo sapiens
tgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgtg

SEQ ID NO: 51875 - DNA, 201 bp, Homo sapiens
agcattaagagccaacaaaaatatttgtactccagtctcttcggaattggcttatttttttttttcttataggcagaggaagtgccttacacaaaccggaktgcccatgagaggcagggagtttttgacagtcatgatctatttcagatacaaccgaaagaaccagcttcgtcattctgtttttcaatccagcagtgcttg

SEQ ID NO: 51876 - DNA, 201 bp, Homo sapiens
ctgatgctaaacaaagcccgggaagtcccaagcctcgcctccctccacaacattcacagtagaccttgtaaccttttgtgtaggtccttgcttcctgaagaagttctaaatttcctgtttgtttgcaatattgagcgatacttcctttggcctcttaacccacatactgggtgagtgccgagggcggtgaggggtgcacgt

SEQ ID NO: 51877 - DNA, 201 bp, Homo sapiens
ctgcttggaaacttcagctccttttcagaggtgggcctccctgttctttatgttggcatgaaaacaattaataatttaagccatgcccattaaaaaaatayaaatgctgtataaatacaatactgtaataataaatttaaaagtcgatccagctgggcgctgttcccacactaccagctgagcagaaacacaaataagtaa

SEQ ID NO: 51878 - DNA, 201 bp, Homo sapiens
gatgcccaaaggggcagaaaatacataaggggtgtcagccgcctgggactacagaaagcagtggagcttgacttaatgggaaaggactcgccatccaaggrgacagtgccatttgcttcagtggttgccatgtggactacagattgtattactagactgttcgattttctttttttaaagaaatcagatatccagtttttt

SEQ ID NO: 51879 - DNA, 201 bp, Homo sapiens
ttaatgccaatcatagaagggcttcaggctgcaaattcagtctctttctcttgttcacatgcgcatgccctcgctctctcttgctcttccacctcctgccrtgggatgattcagcaataaggccctcgccagatgcaggcccctcgaccttggactctccagcctccagaactgtaaaaaataaatttcttgtctttataa

SEQ ID NO: 51880 - DNA, 201 bp, Homo sapiens
atggtggcatgtgcctgtaatcccagctacttgggaggctgaggcaggagaattgcttgaacccaggaggcggaggttgcagtgagccaagatagcaccaytgaactccagcctgggtgacagagcaagactccatctcaaaaaaaaaaaagtgacctctggcatggtcaatatggggacctcgtaaccttccctgtcacc

SEQ ID NO: 51881 - DNA, 201 bp, Homo sapiens
catatgtaagtttaaacataaaataacaaggtatactgtgggtactgcacgtcgctgtgaatgtgcacgcgtgcgcgtgtgcagatgtgcattcgcgatgragagaggaggcggttttctgagttttgcatccaatcccaagtggagcaacgtgtattttcttgggcgtttcatgttgagtgttagaaaaccctgtctcct

SEQ ID NO: 51882 - DNA, 201 bp, Homo sapiens
gaaggccggtactgttattacacccatttttaagttgaggtaggcctgagggttcccatcttccatatgatttgtgttttcatctctcccctgagccctasgcaaatcagacattgcctcctgcagcctctgcatatatacctggctagtgtccacagtacttggggacctcctctttcggctttggagccccccctccct

SEQ ID NO: 51883 - DNA, 201 bp, Homo sapiens
aaatttgtaactttatgcatgcccattaaccttcgtgtaagcataaaagataagaaggcaatgggcaaggaagaataatcgctaacatttctgagctcttmctgtgtgctgggcattagaaccagcatctgcacgggttaactggtttaatccttaccagtcaatactctcaccatccccactttataaatgaaaaaacct

SEQ ID NO: 51884 - DNA, 201 bp, Homo sapiens
tagaaacttatttctcacagttctggaggatgagaagtccaagatcaagagttggtgtcctgtgagagccccctttctcatgatggcgccttcctgctggrtcctcacatggtggaaagggcagggcagctctctgaggcctcttttataagggcactaatcccatttatgaggactctgccctcatgatctaatcccctc

SEQ ID NO: 51885 - DNA, 201 bp, Homo sapiens
tatatcatattctattatttgggtacattattttgaacttaagctaagatactggatcacttttaaagtatctttaaagacatgcattttccaaggaagayggcattacctccaaaggtaagatttcactgataatctgtgaagaaactaaaggctacagtatgccagtacctttactgtcctccttctcttgcctataga

SEQ ID NO: 51886 - DNA, 201 bp, Homo sapiens
tggtgggttgtttttttatatatatataaaaacaaggaatttatgtttagttgcttaacatggttagattttgtttttgccttatgcagaataaaaaatgraaggttcattttatactttcttttccctttttttttcaaaaagtaaaatggaaacctcacccccaatttgtccccagatttaaactttttgcttgtttta

SEQ ID NO: 51887 - DNA, 201 bp, Homo sapiens
gtaaaaagttgcagagtcgtcgggggtgagaggacaacaaagaaaaaattacccctaatcatgtcatgcagaagcaactgctgtcagcattttggattctytatttatgtagttgaggtcaggttttgcatccttttcttcagttagtgagggaaaatgcttacattaaaatgttattgcaaaccctttgtaaaaagtatt

SEQ ID NO: 51888 - DNA, 201 bp, Homo sapiens
gagttttaatataatttggtgcaattttaagcctcatgttatttaaataatttttccttattgtaaaggtaatatatgctcatgtaaaaagttgcagagtygtcgggggtgagaggacaacaaagaaaaaattacccctaatcatgtcatgcagaagcaactgctgtcagcattttggattctctatttatgtagttgagg

SEQ ID NO: 51889 - DNA, 201 bp, Homo sapiens
agagactcttgcactagatcgggaggggaatgaatgggcacttgggctgaatagagcctgtagagatagagaaggtgaatttgagattattgggaaattcgactgagatttttaatgtattggatgtggggagtgacagaaagagaagagttgagggtgattagtggtgctgttgaccatgatgggtagcaggaccagagg

SEQ ID NO: 51890 - DNA, 201 bp, Homo sapiens
ctttgagatatctgcaacaactatcaaataatatgaaaatatctgatttcttttggtgacaaagtcacaggttcagtaaatactgctgtggcctgaatccrtgattaaaggaaatgctaagttccagttagagctccctggaataaagatttttttttttcatccagtttcatggattccctgaattctgttcatgaactg

SEQ ID NO: 51891 - DNA, 201 bp, Homo sapiens
gtttttaagacgtggaggaccaattagaggatgagtttaatttttgttgatttttagatgccttgggacatacaggaagacaggaagagttgctaagtagsgagttggcaatgaagttaggagttggggatccactctataaaccttagagtgtgccaggccctgtgtcaggccccacacatccctgtttgggctatatgt

SEQ ID NO: 51892 - DNA, 201 bp, Homo sapiens
ccattttaaaatgcaaaagctattcttagctcatgggccgtttgaaaaacaggcagcaagccagatttggcccacaggtggtggtttgttgactcctgctrttatagaaagaatgagagtaaaacaaacctttcccatacagtctgatgctcatggcaagagagacgtgaccaaaagctgccgtggaagtcccaaaaagag

SEQ ID NO: 51893 - DNA, 201 bp, Homo sapiens
aaacaatatggttcctggaggagagacactggaaactttctttcttttttttttttttttttaaacagagtctcaccctgtcacctagactggagtgcagkggcatgatcatagcttattgcggcctcaaactcttgggttcaagtgatcctcccacctcagcttcccaagtagctgggactacaggcacacaccaccatg

SEQ ID NO: 51894 - DNA, 201 bp, Homo sapiens
atgtgccaggcactgttctgggtgctgaatatacaaaggtgaacaaaacagacaatgcccttgctctgctggtgggaagaaaaagacagaaaacaagtaartggattaatcagcgataaagacacttcagatagtgctatgaagaaaatacagtgatgggtagagagtgacagaggtgttcagcggagaagtgatcaggga

SEQ ID NO: 51895 - DNA, 201 bp, Homo sapiens
aggcagctctagggatggggaaatgatttgactactccccctgtttcttttattttcaactccactggaggggtgtgagcaaaacaagccaggagctgagrtgacggcgctgcccctggcaggggtgtgggagggcctcgtccctggtcctcctcgtttccacattgagtgccaaactcctgctgacactcctggggcaga

SEQ ID NO: 51896 - DNA, 201 bp, Homo sapiens
attaccggtacgtgccaccatgcccgactaatttttgtatttttagtagagatggggtttcaccatgttggccaggttggtctcgaactcctgacctcagrtgatccgcctgcctcagcctcccaaattgccaggattacagccgtgagccaccacgcccagccagttttgtctttttaagatgcatgaaataacagtgca

SEQ ID NO: 51897 - DNA, 201 bp, Homo sapiens
gaaagagcagagcaggtggagagatgctgaaggctgaaccaggggacagtttgggtttagaaaagagcaggaggaagagaattggtgactgaagggggagrcagccaagagaaatgaagggagagggggaaatgcaatacaagcaagaggtttaggaaacaaatcaaaaatacggggatggaattaattaagagttcacgg

SEQ ID NO: 51898 - DNA, 201 bp, Homo sapiens
tgtgagacagaactttccaaaatgccttttgaagcatggtgtaatgggagataggagagccaccgagctaataagctccgctcgcacattctagccctgastagtaagctggcgctgcgagggagagaaatcccctgtgcttaagtgttcatacccacagggaaatatgtcttcccaggaccgagaggcagccttgaagta

SEQ ID NO: 51899 - DNA, 201 bp, Homo sapiens
cctcgactaaaatcttgttgtgcaatcctaatgaattctcgaaggtgtttccagcggcgtccgtgctatgcaatcactggacccgggagctccccagtctsggggcgggaggggcaggtgtgcagccttcaggagaacgggagagagcaggcaggtttggcttttactttctccagagttcgccaagactcaagagagagg

SEQ ID NO: 51900 - DNA, 201 bp, Homo sapiens
gacagagctgtggacagctgtttctttcacacccagtgaccgctttgcttatatgcactgagaaacgtgaagttatttggcctggttttagagagatggamtgcagctgttatttatacggcgtaccaaataggaatttacactttgcatgtcatctgtaattctaccttgcccaaagtgtttcctgtctctctaaataac

SEQ ID NO: 51901 - DNA, 201 bp, Homo sapiens
tagtcccagctacttgggaggctgaggcagtggaattgcttgaacctgggaggcggaggttgcagtgagccaagatcatgccaatgcattccagcctggcracagagcgagattccgtctcaaaaaaaaaaaaaagtattaaatagaaatcatgtttctctttttgaaaaaaaaaaataggttattcttggtgagaatttg

SEQ ID NO: 51902 - DNA, 201 bp, Homo sapiens
aatggcaaacaatttctattttcaagtttctttgcatatttttttggtgcaaaaccatttataaacttttttttctaacactagtgtctacagcagcattyaaaaaaattctgttaccttttctgtattaggatttaaagtctatttcttattgtatacctgattgaagctgttcttggagatgaatgttttaaatgtcta

SEQ ID NO: 51903 - DNA, 201 bp, Homo sapiens
gtgtctgagacgtccacagtctctctgggctgacagtagctccctttgggctgtggttagcagagcaggtctcaagtgctggggcatcgtgaagctagagwtgaccagcttgtctttatagcagtatcattgaagggagagtgggggtgacatcatgggagtgagagcacagaggaggaagaaaagagcacctaggactgg

SEQ ID NO: 51904 - DNA, 201 bp, Homo sapiens
gcgtaccaaataggaatttacactttgcatgtcatctgtaattctaccttgcccaaagtgtttcctgtctctctaaataacataccattggtaggttaggrgtttgattttgaaaattcttagattgaagtctctttatatagattaaacagtaatcaaacaaaattctgtttagtgaaaccttttcaaggtacagctcct

SEQ ID NO: 51905 - DNA, 201 bp, Homo sapiens
tcatgcactagtcctgctgccctccctaccttggaaatttctgaacttccacttctgccctgcactgaagaggagactcaaggaggtatcacagcagggayagaagctgcagggtggcaggaggtggcaagaggaagcccggggactggggagggcagatattcctgcagcaagtataaaggaagggacagggttggggtg

SEQ ID NO: 51906 - DNA, 201 bp, Homo sapiens
aaaccccgtctctactaaaaaaatacaaaaaattagccgggcgtagtggcgggcgcctgtagtcccagctacttgggaggctgaggcaggagaatggcgtkaacccgggaggcggagcttgcagtgagccgagatcccgccactgcactccagcctgggcgacagagcgagactccgtctcaaaaaaaaaaaaaaaaaaaa

SEQ ID NO: 51907 - DNA, 201 bp, Homo sapiens
gcagtaagccatgatcactgcacttcagcctgggcaacagagtgagaccctgtctattaaaaaagaaagaaagaaaacccttggttttatgtgttggccaragctgggttacatgaccagtccctggtgaaagagaagggagttgctgctgatcatgcctcccaacccaggctggacccactgctgtgcagacctggcctt

SEQ ID NO: 51908 - DNA, 201 bp, Homo sapiens
ccaacagggtgtggtggctcacacctgtaatcccagcactttgggaagccaaggtgggaggatcacttgagctcaggagttcaagactagcctgggcaacmcagcaagaccctgtctctaaaaaaaaaaaaaaaaaaaaaaaaaaaaaaatttagccaagcatggcagtgtgcacctgtagtctctgctatgtgggaggct

SEQ ID NO: 51909 - DNA, 201 bp, Homo sapiens
gatggctgccaccgctccaagcgctactcccccttttgtttggatagaagacttccaacagggtgtggtggctcacacctgtaatcccagcactttgggargccaaggtgggaggatcacttgagctcaggagttcaagactagcctgggcaacacagcaagaccctgtctctaaaaaaaaaaaaaaaaaaaaaaaaaaaa

SEQ ID NO: 51910 - DNA, 201 bp, Homo sapiens
ggagctccaagccggtccctacattccgtggtgtcagagctctgcgtcaccatctcccagtacctcctggccctgccatcctagtcacaagatggctgccmccgctccaagcgctactcccccttttgtttggatagaagacttccaacagggtgtggtggctcacacctgtaatcccagcactttgggaagccaaggtgg

SEQ ID NO: 51911 - DNA, 201 bp, Homo sapiens
atgcctgaaatagtaagagcatgacttgcctcttagagcagaaagtctggagggaaggagctccaagccggtccctacattccgtggtgtcagagctctgsgtcaccatctcccagtacctcctggccctgccatcctagtcacaagatggctgccaccgctccaagcgctactcccccttttgtttggatagaagacttc

SEQ ID NO: 51912 - DNA, 201 bp, Homo sapiens
cagggactctctttcaggtggcaggaggtggttttgggaggcaggcctgggctacaagtcctccacccatacttccacccaaagaaggtgggatttttttstgtagacttcctgacctgatagcctgagtgagtgattgaagcttcctgctcaccagtctaattagagactggaagccaagtgtctccatggtctaggggc

SEQ ID NO: 51913 - DNA, 201 bp, Homo sapiens
cttagaaaacgagcttgccaatctgctgtatctgagagagagcatcttggcaccctggaaaactgttccgacaaaaatattattgccttcattctcctatmtataagaaagttttcaagattattagaaattcttgaaaaagcacaagtacatgcctgcagaaatattaatgcctccaatttgatttattgaaggtttatg

SEQ ID NO: 51914 - DNA, 201 bp, Homo sapiens
gttggctagcctggtcttgaactcctggcctcaagtgatccacctgccttgtcctcccgaagtgctgggattacaggtgtgagcaactgcatccggccgakaataagacctattgctctgctgggtttttttcccctttgcaaaattttgaacatgtttgattttgttgatggagtatctcagactcactcagcttacgtt

SEQ ID NO: 51915 - DNA, 201 bp, Homo sapiens
gatgctccttccttagtctccctgttaacatgacttagcctggctgctttgcaccatcctcctaccaaataacctcctctgcttcctcaaacatctactcyctcccacctgagtatgcctcaggcctgccttgatccccactgtctatcttttttttttttttttcttgaaacagggtctcattctgttgcccaggctaga

SEQ ID NO: 51916 - DNA, 201 bp, Homo sapiens
tgttgattctcattcaccatatggggcaaggactgtagttatcatgatgattagagatgagaaaattaaggcccagagagcttctgttaggttccatagcyggaaaatagcagaggatttagaacctgggtggtccagctctacgacctgagcttttagccaccttacaagtctatattaaggagccctaccctattacta

SEQ ID NO: 51917 - DNA, 201 bp, Homo sapiens
agaaagaggggaaagcaatcatagctactatctactgaatagttattatggccaggttttgtgtgaagcaatttacatgccttattttctgttgattctcwttcaccatatggggcaaggactgtagttatcatgatgattagagatgagaaaattaaggcccagagagcttctgttaggttccatagctggaaaatagca

SEQ ID NO: 51918 - DNA, 201 bp, Homo sapiens
cattgagggtagtacgttttcctgcagtattggtccacaggactctagatcattctagtttgttctctagttcattctaccctttgtagggggacataccrccttcttccacgcctacataattctaaagcctgacataatttaactgtcatgcagacaaccacagaatgctcacatgctgcccaacagagagcaacccaa

SEQ ID NO: 51919 - DNA, 201 bp, Homo sapiens
acagcatttcttgctgctatttatcaagaactcccagtgtgctcagagctgtgtgttctgaaagacagggtctgtaccccctgagcttgtcagccaagttmaataatatactctggttcaaacaatagcatgtcatggctgcacaggtgggagcttggagctttgcatttttttttcatttaagtaaattccttgctgcta

SEQ ID NO: 51920 - DNA, 201 bp, Homo sapiens; identical to SEQ ID NO: 11081

SEQ ID NO: 51921 - DNA, 201 bp, Homo sapiens
tttcttagctttgatctcctgttttaatcttttctttccaataggtcttctacattaagtccattgagccacagaaagtatcgacattagggaaaagcaaygtgatagtaacgggagcaaactttacccgggcatcgaacatcacaatgatcctgaaaggaaccagtacctgtgataaggatgtgtgagtcgaaatactaa

SEQ ID NO: 51922 - DNA, 201 bp, Homo sapiens
cttcctgctcaccagtctaattagagactggaagccaagtgtctccatggtctaggggcctccctcatgaactacagctctttgcgacccaattcaaatgytgcctcctccatgcagccttccttgatttctctgtttgaaaaccccctgccgacctaaaagaggtacctctctaaatccctaaaatgctccgtctgtacc

SEQ ID NO: 51923 - DNA, 201 bp, Homo sapiens
cgtttttcatgccaaaaagttagcacagattctgatttctttcaccgtaggagtctgcatacaattaaatgggaggcaaaagaagcccactcttaagagtrgggcttatggtcccagtagaatggcagggaactgtagccatcaaagccatttatacttcttgtgggtagtatttttaagatgttgtttctttttcaaaat

SEQ ID NO: 51924 - DNA, 201 bp, Homo sapiens
aggtgcggtgaacaaactgattctgtgtgtccttgtgtgctggggaggcgggaggttgggggcagattctttcaaggaaaggaaagtcggaaatcaagagyatcctcacgaaccacttgaaatgacagaacctggtgccaaggcagggacacgtttggaaaaaaggcccccacactcgtgttcagctaaatgctcagaagc

SEQ ID NO: 51925 - DNA, 201 bp, Homo sapiens
tgtttctttcacacccagtgaccgctttgcttatatgcactgagaaacgtgaagttatttggcctggttttagagagatggaatgcagctgttatttatayggcgtaccaaataggaatttacactttgcatgtcatctgtaattctaccttgcccaaagtgtttcctgtctctctaaataacataccattggtaggttag

SEQ ID NO: 51926 - DNA, 201 bp, Homo sapiens
caatcatagctcactgtaacctggaactcctggactcaagtgatccacctgtctcagcctcctaaataggtgggacaacaggtgtgtgccacacatctggstgattttttatctctgtagagatgggggtcttgctatgttgcccaggctggtctccaactcttggcctcaagcgatcctctcgcctcagttacctatact

SEQ ID NO: 51927 - DNA, 201 bp, Homo sapiens
tgattgtcatttcttaaacagtgacttccttttggttccaagtagcagaaaacgcaaccaacagtggcttaaaccatgacaactattgttaacttagtaamatgtttaaaagttgaaggtctgcggctcagtggtgtctccaggaacatagaatctcttttctttcccctgcaccaatcttagcatgttgctttgtatcct

SEQ ID NO: 51928 - DNA, 201 bp, Homo sapiens
aatgatttattggcctcataccccagtgttgctgcatggtggtaataaatgacaagcctaggacatgaaggcttaaaggattctccttatgtttaaaaagytaagccataaggcaaataaaccagagagcctgaaggaaacgggaggtcattgggctccatgttctctatgcctggaccatctcaaaagccctgtttttta

SEQ ID NO: 51929 - DNA, 201 bp, Homo sapiens
gctgggaccacaggcgggtgctatcacgcccagctaattggaataaaatcatttcttaaacaatatggttcctggaggagagacactggaaactttctttyttttttttttttttttttaaacagagtctcaccctgtcacctagactggagtgcagtggcatgatcatagcttattgcggcctcaaactcttgggttcaa

SEQ ID NO: 51930 - DNA, 201 bp, Homo sapiens
ccaggccctgtgtcaggccccacacatccctgtttgggctatatgtgcactgaggggagtagccaggtctggctcatctttctttcccaggcatctatcargttggctaacacatggtgagtgagccctcagtaagtgtttctagaactggaaaaaaggtactcttcatctggtggagaagatagtgattatagcatggtg

SEQ ID NO: 51931 - DNA, 201 bp, Homo sapiens
atgaaggcttaaaggattctccttatgtttaaaaagctaagccataaggcaaataaaccagagagcctgaaggaaacgggaggtcattgggctccatgttytctatgcctggaccatctcaaaagccctgttttttaaaggctgcttggagaaaatcatcccccaccaccctcagccacctacatctatatttgattaagc

SEQ ID NO: 51932 - DNA, 201 bp, Homo sapiens
ccaaataacctcctctgcttcctcaaacatctactccctcccacctgagtatgcctcaggcctgccttgatccccactgtctatcttttttttttttttttcttgaaacagggtctcattctgttgcccaggctagagtgcagtggcacaatctcggctcactgcaactacctcctcctggattcaagcgattctcctgcc

SEQ ID NO: 51933 - DNA, 201 bp, Homo sapiens
ttaagttaccagttcaaagtagtgcagctacttaaaggatggaggcaggatgcaaactcaagcttaagccaccattatacttctctagcactataggattygagtctcccgatggctcttcatacccacacttcaaaccctgccttcttaccatctcctcttgctccttgacccaaagccctgccatggcctcctctctct

SEQ ID NO: 51934 - DNA, 201 bp, Homo sapiens
acagcatgctaagagctttacctatcttttctcatttcatccccttaagggtcctgtgagctaagtgtcttcatgaccattttgtatatgggggaactggmacacagaagagctgtgactctccccagatctcactgctactgtgggacagcaccagggtccgagagctcttagccaccgccctgtgccctgaaaagatgg

SEQ ID NO: 51935 - DNA, 201 bp, Homo sapiens
ctcttcccaggtacttccattcattggaataccaggcttctggtgttgccaatctgagagttacttttgaccatggaaacctagcatggttggaacttctrtggtgtaatttttgattgcctttcaactatgagaggaaagggctttatgctgtaggcagtggtccttaaagtgtggactgtggcccagcagcatgaatat

SEQ ID NO: 51936 - DNA, 201 bp, Homo sapiens
ggaggccgaggcgggtggatcacttgaggtcaggagttagggaccagcctggccaacatggtgaaaccccgtctgtactaaaaatacacaattagccaggsatggtggcgtgcacctgtaatcccagctactcgggaggctgaggcagagaattgcttgaacccgagatcaagaccatcctggctaacacagtgaaacccc

SEQ ID NO: 51937 - DNA, 201 bp, Homo sapiens
gctgggtgtggtggcgcatgtctgtagtcccagctattcaggaggctgaggcaagagaatggcttgaacctgggaagcagaggttgcagtgagccaagatygcaccactgcactccagtctgggcgactgagtaagactccatctcaaaaaaaaaaaaaaaaaaaaatgacatggtccctgcgcaaaaggagcttgcaatc

SEQ ID NO: 51938 - DNA, 201 bp, Homo sapiens
ttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaac

SEQ ID NO: 51939 - DNA, 201 bp, Homo sapiens
aagaccagcctggccaacatggtgaaaccccgtctctactaaaaatacaaaaattagctgggtgtggtggcgcatgtctgtagtcccagctattcaggagkctgaggcaagagaatggcttgaacctgggaagcagaggttgcagtgagccaagatcgcaccactgcactccagtctgggcgactgagtaagactccatct

SEQ ID NO: 51940 - DNA, 201 bp, Homo sapiens
gttcttatcttctaaatttggtaatcaagaacaagatagagtaatgaatgtaaaggaacactgttgcaagttgagtgtttccaaaaaaaaaaaaaaaaaaaagatcccaggaacaatgctaccttattttaggagaagagagatagttgcaaaggaggcaaactgatttaactcagtgttgtgtataatcttgaaaaacaa

SEQ ID NO: 51941 - DNA, 201 bp, Homo sapiens
gcataagtccaggagtttgaggttacagtgagttatgatcgtgccactgcatgccagcctggacaacagaatgaggccctgtgtctaaaaagtaaatgatkttttttaatagaagtgtgatctatgtcatctcttaaagtggtcccgggcccatccacacacagtgagcccatggtggttgctcattggccaaatctggtc

SEQ ID NO: 51942 - DNA, 201 bp, Homo sapiens
aatggggttaataataagttttatttgtttttttagacagagtctcactttgttacccaggcaggagtacagtggcacgatcttggcttacagcaacctcygcttcccagttttaagcaattctcatgcctcagtcacccaagtagctgggattacaggtgcgcaccaccacacctggctagttttttctatttttagtag

SEQ ID NO: 51943 - DNA, 201 bp, Homo sapiens
gaaaccccatctctactaaaaaaaattagctgggtgtggtgcatctatagtcccagctacttgggaggctgaggcagtggaattgcttgaacctgggaggyggaggttgcagtgagccaagatcatgccaatgcattccagcctggcgacagagcgagattccgtctcaaaaaaaaaaaaaagtattaaatagaaatcatg

SEQ ID NO: 51944 - DNA, 201 bp, Homo sapiens
tttaatttccagtctctcttgagacagcactaatgaagctgtcacttgtggcttcctatagggccagacatggtcagaaattgtggtcagccagcttccayatatgaggatactaccccagccctgaagagcggctttttttgtttgttcatttttggtaactttgcctttacaaaagaagaaatattatgcttgttatta

SEQ ID NO: 51945 - DNA, 201 bp, Homo sapiens
ctctgtatctctgtcctaatctccccaattttttttttttttttttttttttttgtgacagtctcactctgtcacccaggctggagtgcagtggcgcaatyttggctcactgcaacctccgcctcccagattcaagtgattctcctgcctcagcctctctagtagctgggataatctcccctttttataaggacatcggtc

SEQ ID NO: 51946 - DNA, 201 bp, Homo sapiens
tatttatgcatcttgaaacccatgaatttgtggctggtatcctgaaaagattcccaaaattgtcctgtatttgaaattaaaattcattaatttgctctcaracataattgggtttaatattaaacatgaataaattgatagctttgttcataaatgcaaaatgcctgtgtgttagctatgaaacccttattgttgctttta

SEQ ID NO: 51947 - DNA, 201 bp, Homo sapiens
gggacgcttgtttggggctgagtctcctcgcgcagcccctctttcccattcgcttctccagacttctctgtgccccttccgtgtagtcccagcaggcgtgkgggtctgaccctcttggtcaacagttagcaacacagtgccctcggcagagaagccattgaacctaaagggctccctgccacaccccagcctttgtggccc

SEQ ID NO: 51948 - DNA, 201 bp, Homo sapiens
catcttctctctatgtcttcacgtggtcttccctctgtatctctgtcctaatctccccaattttttttttttttttttttttttttgtgacagtctcactytgtcacccaggctggagtgcagtggcgcaatcttggctcactgcaacctccgcctcccagattcaagtgattctcctgcctcagcctctctagtagctgg

SEQ ID NO: 51949 - DNA, 201 bp, Homo sapiens
ccttgactggaaaggtgtgtttatgctcgtgagtttctacatgtgctctgatttctccatcttcattttgttctttacagaaagaaaatgacaacttcaayatttccaaaaaagacattgaaattactctcttccatggggaaaatgggcaattaaattgcagttttgaaaatattactagaaatcaagatcttaccacca

SEQ ID NO: 51950 - DNA, 201 bp, Homo sapiens
gaaggcttaaaggattctccttatgtttaaaaagctaagccataaggcaaataaaccagagagcctgaaggaaacgggaggtcattgggctccatgttctytatgcctggaccatctcaaaagccctgttttttaaaggctgcttggagaaaatcatcccccaccaccctcagccacctacatctatatttgattaagcag

SEQ ID NO: 51951 - DNA, 201 bp, Homo sapiens
cacccttcccagcctctgatacccataattctactctctatctccattagaccaactttctcagctcccacatatgggtgagaacctgcaatatttgtctktctgtgcctggcttatttcacttaacataatgtcctgcagttccatctgtgttgttgcaaatgacaggatctcattcttttttgtatgctgaataatact

SEQ ID NO: 51952 - DNA, 201 bp, Homo sapiens
tctccttatgtttaaaaagctaagccataaggcaaataaaccagagagcctgaaggaaacgggaggtcattgggctccatgttctctatgcctggaccatytcaaaagccctgttttttaaaggctgcttggagaaaatcatcccccaccaccctcagccacctacatctatatttgattaagcagcgcctccgcagactc

SEQ ID NO: 51953 - DNA, 201 bp, Homo sapiens
cttgtacatgtttatgggacacgtgatgttttttctatgatcatacagtgaatatgtaatcatcaaatcagggtaattggagtatccatcacctcaagcayttatcatttctttctgttaggaacattccaattccactcttctagctatttttaaatatgcaataaattattgtgagttatagacaccctactatgctac

SEQ ID NO: 51954 - DNA, 201 bp, Homo sapiens
attgggctccatgttctctatgcctggaccatctcaaaagccctgttttttaaaggctgcttggagaaaatcatcccccaccaccctcagccacctacatytatatttgattaagcagcgcctccgcagactcaacatttgggagtaatttgacagggctgggctgaagtttgcttttacccttttgttaaagaaaaaatt

SEQ ID NO: 51955 - DNA, 201 bp, Homo sapiens
ttgatcctgtgataaggacttagcaaaacaacttgcaaagtgagtatgtaaatgatggaagaaaatgttggcatctgtttcatacagattttaccactcayagcatcaggtatgcaaaaaacagaattgtaacgctaaaaccacaatatctaaaataactgttctaattgtcaacagattctaaataaactagaaagagaa

SEQ ID NO: 51956 - DNA, 201 bp, Homo sapiens
tctttcccaaactcatcacatcggtgaaacttggagaaagacttttcaatttctaccgatgtccttgtgcaaatggttactcccccttcgaaaaaaaaaaagtgatgtgataactgcagttattaaataacacaacagattatttgagttttctgcttgttaactcatataagtttgggctaatttgaagtaaaagatgtt

SEQ ID NO: 51957 - DNA, 201 bp, Homo sapiens
tcaccaaacgtcatgtgattaagcatctctggactttggggtcattttcaaatatcaagactgagtatattctgcgatggtagaggatataggggaaaaaagagtgtgagtatgatgttcactcttgctgaagttctgctggactttatattgggtagaatcttagaatcttatgtcctgttttggtcaccgtattataga

SEQ ID NO: 51958 - DNA, 201 bp, Homo sapiens
gctgcagctactccactcgactgctgcagtgcaacagcagccagagacactacccagacgaatatttatgggtgctgaaatttgaatttcatgtgtttttwtatgtcatgaaatattattcttcttttgacattttgtcatggcccatacaaaagcaggtagcgggcaggatctggcccacagactatagtttgccaactc

SEQ ID NO: 51959 - DNA, 201 bp, Homo sapiens
ctgctctctgtccctatctgttttgtttttgtttttgtttttaagaactgtaaagattgctatttgttttcatttttggtttttgagttaccatgtccctctgatgcagcatctctgtctcttagcggccgtgggggtgaccaggcacaaatcgaaggagctgagtcgcaaacagagtcaacaactagaattgctggaaag

SEQ ID NO: 51960 - DNA, 201 bp, Homo sapiens
ctcacctataaaatatgcctctaaagtatttgagatcactttgtaaagctagttggttgcttttagcgcctccatccgttgcacccaacccttcacctgcygttttctgaatatcttacatattctgaacgggcaaacaaatttgcttcccagcctcttgtactcagccagccggtgaccattgccaagcctttatccatg

SEQ ID NO: 51961 - DNA, 201 bp, Homo sapiens
tgaagtttgtttcctttaacttatcctccaagagtaccgaggcaccgagatctaccatttgccacctcatccatttctatggcagaacaccgcctggggaraggaattcgattccccgaatcaggatgactgtgtggggcttctgcaaaggttgcatcacgagtcctatttctgagctatctgagatccccattaagaatt

SEQ ID NO: 51962 - DNA, 201 bp, Homo sapiens
attgtcttggaaaacccattgtgggtctactttctaactttaaacttatatatgattttgtattatactatatatttttttctttttatcagaacagagaygccaacgacaagaatgaaagtctcacagctttggatgccctaatctgtaataaaagctttcttgttactgtcatccacacccttgaaaagcagaagaact

SEQ ID NO: 51963 - DNA, 201 bp, Homo sapiens
agaaaaatggtcaaagaataagaatatgctctttacagaagagcaaaccaaatagccaacaaaacatctattcttttatatttttatttatttatttattkatttatttatttatttatttatttatggaggcagtgtcttgctctgtcacccagaaacatctattctttacatcagctcttctgagaaattctccctcct

SEQ ID NO: 51964 - DNA, 201 bp, Homo sapiens
ccacatcttcactgaagatatgcatgtaagtctctacgttttcatttttagcccagtgactgcctgatgttcatagtgttatcatcatcactatcatctcyattattattactttgaatttttattgtgggttttttttggatcatgaattcaatattgaataattcattgtcttggaaaacccattgtgggtctactttc

SEQ ID NO: 51965 - DNA, 201 bp, Homo sapiens
atcgcttaaatctgggaggtgaaggttgcagtgaaccaagatcgtgccattgcgctctagcctggctgacaagagcaaaactgtgtctcaaaaaaaaaaaagagttaactaaagcacacacttcaggaaaatatttgccactaacaaaatattcatcataatgtaataacactaagaaaaattaaaaagaaaaacatcaat

SEQ ID NO: 51966 - DNA, 201 bp, Homo sapiens
gggtcgctgttttaactaacacacgtatggggtcgctgttttgttgcctcgtttttttaggtgcacttttcaaggagattgtgtacattcagagaacttasaaaactggctggatatttcgtctggagcaaaaaagtgccctaaaattcagataattcgaagcagtaaagaaaaggtaagaggaaagattttaatttgtcc

SEQ ID NO: 51967 - DNA, 201 bp, Homo sapiens
gggaggctgaggcagtggaattgcttgaacctgggaggcggaggttgcagtgagccaagatcatgccaatgcattccagcctggcgacagagcgagattcygtctcaaaaaaaaaaaaaagtattaaatagaaatcatgtttctctttttgaaaaaaaaaaataggttattcttggtgagaatttgacttcaaattgtcca

SEQ ID NO: 51968 - DNA, 201 bp, Homo sapiens
caaaatgccttttgaagcatggtgtaatgggagataggagagccaccgagctaataagctccgctcgcacattctagccctgactagtaagctggcgctgygagggagagaaatcccctgtgcttaagtgttcatacccacagggaaatatgtcttcccaggaccgagaggcagccttgaagtaagtaaagaagaagggac

SEQ ID NO: 51969 - DNA, 201 bp, Homo sapiens
cttggaatggctgtgacataatgcataaagcagggcctaggaagcctggccccatatttgtaagcaaatagttggtatttcttgcgagcttctattttaasccaaggtattgttgatcctgtgataaggacttagcaaaacaacttgcaaagtgagtatgtaaatgatggaagaaaatgttggcatctgtttcatacagat

SEQ ID NO: 51970 - DNA, 201 bp, Homo sapiens
tattttggaaaaaaaaaagaagtcaatttaggcaagaccactcccattagattgcaaacatagatgatagatagatagatagatagatagatagatagatdtcaaaaataatttaatccatgattctggtttaaaaataggaatatagattcatagaatatagtggaaagctcagaaatagatgtaaaaattttaaagaac

SEQ ID NO: 51971 - DNA, 201 bp, Homo sapiens
ttacaggcacatgccaccacgcccggctaattggaataaaagtattccttaaacaatatggttcctagaggagagacactagaaactttttttttttttttgacagggtctccctctgtcatctaggctggagtgcagagacgtgatcataatttactgcagcctcgaacccctgggctcaaaggatcctcccacctcagc

SEQ ID NO: 51972 - DNA, 201 bp, Homo sapiens
tttatggttttaggtctaacatttaagtctttaatccatcttgaattaattttttgtatcaggtgtaaggaagggatccagtttccgctttctacattttktttttttttttgagatggagtcttgctctgtcacccaggctggagtgcagtggcacgttctaggctcactgcaacctccacctcccaggttcaagcgatt

SEQ ID NO: 51973 - DNA, 201 bp, Homo sapiens
ataggtatacatgtgccatgttggtttgctgcacccatcagctcgtcatttacattaggtatttctcctaatgttatccctcccccagccccccacccccyggcaggccccggtgtgtgatgttccccgccctgtgaccaagtgatctcattgttcagttcccacctgtgagtgagaacatgtggtgtttggttttctgtc

SEQ ID NO: 51974 - DNA, 201 bp, Homo sapiens
tccttaccagtcaatactctcaccatccccactttataaatgaaaaaacctgaggcctcgagaggttaggtatctttttcaaggtgctctgaaccaaaatmatctgtcccagagcccgagcttctatcccccaactaaactgcattaactcttacagagcttagtagagtttgagagctggtttttgttatatttctttct

SEQ ID NO: 51975 - DNA, 201 bp, Homo sapiens
ctaatgttgtagaaatacatattgcttttgaaaataaagaaaaaagaggttcagattcatggtcaacgagataccttaaaggtggcttaattgcagaatttgtttagtgtaatggtcccttatcctaatgtgttgaggcttccccagtaaccatcttatgaacatagcttccaacagtcttggtagcgatggagagaagac

SEQ ID NO: 51976 - DNA, 201 bp, Homo sapiens
aatggatttctaagtccagggccgcctgaaattttaacctcttgctagttgtgtggttgtgttgtattcacagctagtgatagaggaaaattagaggcctytcagaatgcccacttctgtgttctcccccaaatccttgctaaccgcttcatcctacagtctctgccttaccttctgtcttctctgtttctggggtcccca

SEQ ID NO: 51977 - DNA, 201 bp, Homo sapiens
caccaacttttagtacactcattgcccacaaaagaaccacatggagcaaaggccacaaacccattttgtgtgagtgtttcagtctgcaaatgtgttttttrtgtgctaaatagctcaaagtttcaagacaaaggctgtttttccaccacgccagtgaacaggccaacctagtgaacaaaaatcaatgaaatgacttctgct

SEQ ID NO: 51978 - DNA, 201 bp, Homo sapiens
tagccgtgtgacacacctgttctcccttcgcttccagcatgattggaagcttcctgagcccctcaccaggagcagacactacccatgcttcctgtacagcstgtaaaatcatgagccaattaaaccccttttctttataaattatccagtctcaggtatttcttcatagctatgcaaaaaatggactaacacagggtcaca

SEQ ID NO: 51979 - DNA, 201 bp, Homo sapiens
ccctcactgggaaattttcttataagatccagctttttaatgctattttctagtttcattctagctcctgctctctgtccctatctgttttgtttttgttkttgtttttaagaactgtaaagattgctatttgttttcatttttggtttttgagttaccatgtccctctgatgcagcatctctgtctcttagcggccgtgg

SEQ ID NO: 51980 - DNA, 201 bp, Homo sapiens
tgctgggaggggtcgggtcatgggaacggatccctcatgaatggcttggtgctgtccttggcaatagtgagcgagttctcactctgagttcacaggagatstggttgtttaagagagtgtggcacctgccccctcacagtcttgctcccaccctagccgtgtgacacacctgttctcccttcgcttccagcatgattggaa

SEQ ID NO: 51981 - DNA, 201 bp, Homo sapiens
ctacgcttccttaccgggctgtttccgtcagagtcactggcagacaaacgaagcaagggccagaaaaatgctcatgaataattcactgatcacgaacgggrtttgtttgttgcacactcagtgagcagtcttgccataatcttttagatccattcatttatgtagcatccctgtctgtatttgtagagctgtgtacaggag

SEQ ID NO: 51982 - DNA, 201 bp, Homo sapiens
aatcctgttcggagtgtttaacagccacagaccctcactgcggttggtgccattcgctacaaaggtatctcctgaattctttctcaccaactcgcattttygaaaaagtgtcatgcggcagaacacttgttgccctactttaacgatccattccagtgacctgagggaactgatctcttcctcgactaaaatcttgttgtg

SEQ ID NO: 51983 - DNA, 201 bp, Homo sapiens
aaggaaagaaaggaggaggaagtgatccactgggtcagattcagctgagaggtcaagcaggagaagaaaagaatggatcctttgcacttagcaggtgacartgggtgactgctgggaatgccatggttaggagtggcgctaaatccacaagagacaatgggaaaataagaccttaagaagggacagcttagagaagcttta

SEQ ID NO: 51984 - DNA, 201 bp, Homo sapiens
tatcttctctggagaaatgtctaatcaagtcctttgcccatttttaaaattgggttatttttgttgttgttgagttgtaggagttctttatgtattctggrtatcaaccccctatcagatatatcatttgcaaatattttctaccattccataggtttccttttcattccgttgactgtgtcctgtaatacacagagtttt

SEQ ID NO: 51985 - DNA, 201 bp, Homo sapiens
catctctacaaaaataaaaataaaaatcttagccaggtgtagtggcacatatttgtagtccaactgcttgggagtctgagacagggagatcgcttgagccygggagttaaaatccagcctgaacaacgtaacacgaccctgtctcttgagaaaaattatcattgacttggttctttttgtaagaccaattaccaagcgctg

SEQ ID NO: 51986 - DNA, 201 bp, Homo sapiens
attaatacagggctaacgtccttcacaaagtgattaaaataaattctgctaccaaaatcaattctgtgtcatgttacatcattgctgtgatgacattaacratgaatttacctcaatctgcaaaaccagtccaaagcgctgatgagtgatggggacgactgtgccgtgtagcacctgtgtgtgctggggagcagaatgaga

SEQ ID NO: 51987 - DNA, 201 bp, Homo sapiens
ttatcttgctctcctgtcttgagggttcttctccaagtgacactccttcctcaagccccccaggcctatcattaacctgctgggatccttcccaccaggastgtgattgccctgaaacttgaccagtataatccatggtgcacagtaatttatggccatattcttcagtagcctgagttagtctgttctgtcatcatgaga

SEQ ID NO: 51988 - DNA, 201 bp, Homo sapiens
catctgaatgctaaacatatttgtccccaacaccccagagtaacaaatgaaaagaattacatgagttgcttgtggacacgtcccagctcctttttttatcktgctctcctgtcttgagggttcttctccaagtgacactccttcctcaagccccccaggcctatcattaacctgctgggatccttcccaccaggactgtga

SEQ ID NO: 51989 - DNA, 201 bp, Homo sapiens
ggattcagaaataaattacacataataaactagacagaataggctgagagcaacattagcgattatgccctaaggggagagaagggcaagatagaaaatakgcccgaaaaaaagagagaaagaataatctctggacacagggggctgactgcactgtttcccccttcttctgcctggctccctgggtattaacctcacttt

SEQ ID NO: 51990 - DNA, 201 bp, Homo sapiens
gggaataacagaagggtatttttaacacatgagagaaaactgccatctgaatgctaaacatatttgtccccaacaccccagagtaacaaatgaaaagaatyacatgagttgcttgtggacacgtcccagctcctttttttatcttgctctcctgtcttgagggttcttctccaagtgacactccttcctcaagccccccag

SEQ ID NO: 51991 - DNA, 201 bp, Homo sapiens
gaggctgggattcagaaataaattacacataataaactagacagaataggctgagagcaacattagcgattatgccctaaggggagagaagggcaagatakaaaataggcccgaaaaaaagagagaaagaataatctctggacacagggggctgactgcactgtttcccccttcttctgcctggctccctgggtattaacc

SEQ ID NO: 51992 - DNA, 201 bp, Homo sapiens
agtcttcctatcagactttctgaagggttgggaataacagaagggtatttttaacacatgagagaaaactgccatctgaatgctaaacatatttgtccccmacaccccagagtaacaaatgaaaagaattacatgagttgcttgtggacacgtcccagctcctttttttatcttgctctcctgtcttgagggttcttctcc

SEQ ID NO: 51993 - DNA, 201 bp, Homo sapiens
aggctgaggcagtagaatcacttgaacccaggagacggaggttgcagtgagccaagatccagcctgggtgacagagtgaaactccatctcaaaaaaaaaaagggaataggcatctagtataagtagataaaaagcaattagataaacaatgagctctaaaaagtctagtattttattgttggaacctcagatccaacctgt

SEQ ID NO: 51994 - DNA, 201 bp, Homo sapiens
tctggaaccatctcagccccggtcagctgtgtgtccctgggcatggctttttccatctgggcatctgttttcaatccaccaaatgacaggcgtgtgtgggcgttgcctttaaatccctttccagctctttctactggatcttgtgattcttaactctgagctttcaagggctgctcttgggcattagaggggtgagatgtt

SEQ ID NO: 51995 - DNA, 201 bp, Homo sapiens
atggcaacccagtactggggctcttgctggagaagcaaaggaggagagagccttcgctgcagctcaggcaggaaagagagagagagagagagaaaaaaaaacccataacagtgtctgtcagtttggtgctttcagtttttaaaggtgaaaaggataagaaagagcagagcaggtggagagatgctgaaggctgaaccaggg

SEQ ID NO: 51996 - DNA, 201 bp, Homo sapiens
agaagatgttcatgcctttactttaagacgttttagaagccccaaaggtctccaaagagaaatatttgcaaatgattatagtcgggaatcctccagcattycagtcatgagacaacaccggacccaaacaggaaagacaggaaaggagaagatgggttggaatcaggaagaggtcagatgtctgaggcaacttttgaggtt

SEQ ID NO: 51997 - DNA, 201 bp, Homo sapiens
ttgttattccctaatactcatttccaaaatgccattggccacatatggactgtctctgtatgaaaaccaggcaacctgattccatgatccgtatggaaatmatcattagcagatcggaaacccaactgggtgtcagactcacctgagagagagctcttaaaatacagattcctggccagacacagtggtgcacgcctgcaa

SEQ ID NO: 51998 - DNA, 201 bp, Homo sapiens
aggctggagtgcagtggtgtgatcttggctcactgcaacctccacctcctgagttcaagagattctcctgcctcagcctcctgactagctgggattacagrcgcccaccactatgcccagctaaattttgtatttttagtagagacagagttggccagactggtctccaactccaggcctgaagtgatctgtccacctcag

SEQ ID NO: 51999 - DNA, 201 bp, Homo sapiens
tatggagatgtaggcattgatatggaatagtcactacggtctgttattaaattagagggcaggtctaatgtagtatttttagtgtcctctctctctctctcttttttttttttatggagtcttgctctgtcacccagcctggagtgcagtggcgcaatctcagctcactgcaacctccgcctccacaggttcaagcagttc

SEQ ID NO: 52000 - DNA, 201 bp, Homo sapiens
tcccagccagcaggatgtaagcagggctgtagaaaggagggcagatggtcaccagccatcttttaaggaagtgccacataacatatccacttaatgtcatyggccaggacttagtcataaccagaacatgtcctgactctgagctgcgaagccaagaggccagctctgggtcaccatctcccagtgcctcctggccctgcc

SEQ ID NO: 52001 - DNA, 201 bp, Homo sapiens
caaaactgccggtcagagtactgactgtgttcccacatggagctgataaaattccaacccaaagcaaagaaacttgatatcttccttaatccatgcgtgtktttccattcagctgtctgaaatattgcaaatagctcataagcccccattacttccttcatggatagtaatggaaccccagaactcaggaccccaggctgg

SEQ ID NO: 52002 - DNA, 201 bp, Homo sapiens
gagaaatgtctaatcaagtcctttgcccatttttaaaattgggttatttttgttgttgttgagttgtaggagttctttatgtattctgggtatcaaccccytatcagatatatcatttgcaaatattttctaccattccataggtttccttttcattccgttgactgtgtcctgtaatacacagagtttttaattttgatg

SEQ ID NO: 52003 - DNA, 201 bp, Homo sapiens
cccagagaaatgggatgattgttgttcaaggtcacacaggggcagagcagggatttgaacctggaatgacttcagagactgcactaagatcccctatgctrcactgactttgcaacctctgccgcacacattggtactactctctgaggattccgggggcacatgggagacatgcagatagggttccatgccgtggctggg

SEQ ID NO: 52004 - DNA, 201 bp, Homo sapiens
tggggaagggtaaatacccatccatcattctacacaagtcactgggtgacgtctgtagctccaccaacctggtcaggcttattggacccatttgcctggcrggagtttccatcaagcctttctgggcctcctcaccaattatctcttcagatttgggatgtttttgatgagtgttttgacaagaacactgtttccccaaag

SEQ ID NO: 52005 - DNA, 201 bp, Homo sapiens
cttttaaaatatacattgatcatctttcctgttgtgttagctttatttcctggggaagggtaaatacccatccatcattctacacaagtcactgggtgacrtctgtagctccaccaacctggtcaggcttattggacccatttgcctggcgggagtttccatcaagcctttctgggcctcctcaccaattatctcttcaga

SEQ ID NO: 52006 - DNA, 201 bp, Homo sapiens
gttgctcccggggaatctagtctaagagaatatatgtggggcccagaagtgagatcctgcctaggagggcatgagtgacatttcatcagtataatgagaastattgttgttaaaaattattattatttttttgtgcgtttgtgtgcatgttcagaaagaaggggatcaacctgaaagagtccaaccaatcgcatcatctac

SEQ ID NO: 52007 - DNA, 201 bp, Homo sapiens
tacctgttcatacatagtaaacaggggttttctttggttgggcaggtatggtgattttgcaaggtaatgaaaggttgctcccggggaatctagtctaagaraatatatgtggggcccagaagtgagatcctgcctaggagggcatgagtgacatttcatcagtataatgagaactattgttgttaaaaattattattattt

SEQ ID NO: 52008 - DNA, 201 bp, Homo sapiens
agtctgcctcccaattcagcggtgggctgtctcttggcactaaagtggaattcagcttcttatatcagctgaggggtgttagatagatggccagctcgctytggcactcaatacctgttcatacatagtaaacaggggttttctttggttgggcaggtatggtgattttgcaaggtaatgaaaggttgctcccggggaatc

SEQ ID NO: 52009 - DNA, 201 bp, Homo sapiens
ccttcaacttggttcctccttagctctgtggctcgatcctacccatcgtccacaactgtatctttaccttttcaccccctcaactagctaccctgtctttrggcttcctgtggtcccttttggtaaatctagaatccctcctttctgccatcacacccaacaggatcgtccgtgtcacatcttgggaaatgtttgtgttta

SEQ ID NO: 52010 - DNA, 201 bp, Homo sapiens
atccaggactcccacccatttcctggaatgacttgcagatcgatcgtgtctggggctgaagttttctttcgttgcttgtgcagacaagcccatgaagggckctcacagtgtacttgtcacgtattcccttctcagaaggctatgattttctatctcctgaactctctccaccctgaggttcagcagaaaagaacctaggaa

SEQ ID NO: 52011 - DNA, 201 bp, Homo sapiens
ttttttccttaacttcaattttcacaggacagctcctcatcttcccatattgcatgaaaagtatctttcaacaagggaaaaagaaactctaatgagctttycctaaatcttcttaaaccgagttcactatagaatattttatgcaaaaacattgccttctcttaggttatgacatcttttccttgaaaagtgatcagggca

SEQ ID NO: 52012 - DNA, 201 bp, Homo sapiens
aaaaggaaacataaatgtaagtctccagctgctttgtaataatagttgttttcaaggatggttctattttcatcacactatgctatgttgggggtattttytgtttctgtgactttggtgttataaacttttacctatgctatcatatattctatccatgctagaatggaaataataagaccttatccttgtagctgagta

SEQ ID NO: 52013 - DNA, 201 bp, Homo sapiens
cgaacaagcagaggctgggattcagaaataaattacacataataaactagacagaataggctgagagcaacattagcgattatgccctaaggggagagaarggcaagatagaaaataggcccgaaaaaaagagagaaagaataatctctggacacagggggctgactgcactgtttcccccttcttctgcctggctccctg

SEQ ID NO: 52014 - DNA, 201 bp, Homo sapiens
tctcaaaactgccggtcagagtactgactgtgttcccacatggagctgataaaattccaacccaaagcaaagaaacttgatatcttccttaatccatgcgygtttttccattcagctgtctgaaatattgcaaatagctcataagcccccattacttccttcatggatagtaatggaaccccagaactcaggaccccaggc

SEQ ID NO: 52015 - DNA, 201 bp, Homo sapiens
ccagggtttatttatcaagggcgtctcaaaactgccggtcagagtactgactgtgttcccacatggagctgataaaattccaacccaaagcaaagaaactygatatcttccttaatccatgcgtgtttttccattcagctgtctgaaatattgcaaatagctcataagcccccattacttccttcatggatagtaatggaa

SEQ ID NO: 52016 - DNA, 201 bp, Homo sapiens
acctcctctttcggctttggagccccccctccctctgtctctgtatgggcgagcatcttccttctgtcttctcccttccttcttgcctgttagactctccrctccttaaaaccaaaaaaacaaaacaaaattcccattacttgatcattttacattccctcgttaagccaggctcaaaacattaaataattgtgcatttca

SEQ ID NO: 52017 - DNA, 201 bp, Homo sapiens
tgaatctgtttgcaaatgagtggatactaatgccaacaatagtaattgtacaggttttattgccgatactatcgtcaagcctttcccagcagcctggcccygtgctaagcccttgaatgcatgatcacatttaatctccctaacaatgctagaaggccggtactgttattacacccatttttaagttgaggtaggcctgag

SEQ ID NO: 52018 - DNA, 201 bp, Homo sapiens
catcttcctctgctaatcacatcctgtattaagtatatgctccgtcctcccccagtgtgcagcagcatctgctatgaattcattttcgggctctactggtmtactgcaaaggagagcatatgcgtgagcaagctaacagggccccacttccctcaaatgttcatcaacattttaaagttgagctccgtgcagtcctcccag

SEQ ID NO: 52019 - DNA, 201 bp, Homo sapiens
ctccctgccttctctcctgtctggtattttttgtttcttgtttgtgagcagacaggcctttgaaccccttcctagtcggtggctggcccagaacataaagkttctctgagagcaggcaagggagtgactctgttgtaggagggaaactcgtacaggccagacggagatcaccggcttacctcagagttcagattccactga

SEQ ID NO: 52020 - DNA, 201 bp, Homo sapiens
ggaccagtgtacatttcacagctctttagcctttcatgggtattttctgggtattatgccatcccatcgatttggaccatgcttactttacaaaacattcytgtacttccaaaggcaggatcaccgagtgtttaagaacacggagcttgagtacccggttctaccatcttcttgctggctgaccttgtgccatttatttaa

SEQ ID NO: 52021 - DNA, 201 bp, Homo sapiens
gtagctggaactacaggtgcatgccaccacacccagctaatgttttgttgttgttgtagtagagatggggtcttgctatattgcccaggctggtctcaaaytcctgacctcaggtgatctgcctgctttagactcctaaagtgctgggattataggcgtgaaccaccatgcccggcccataaattcttaataaaaaaagca

SEQ ID NO: 52022 - DNA, 201 bp, Homo sapiens
cagatgtttttcactgttcacctttcagatgtctttcactgttatagttttgcaatggcgatttcagtatttcgccccattctatcctatagcagtcctaygagataggtactattattaaccccactttatagatgggtacgatgaggctctgggaggtctggtaacagctagtcagtggcagggccagattcggacctg

SEQ ID NO: 52023 - DNA, 201 bp, Homo sapiens
aggaaaaatactactggtcaaaagggaggaaagtagacatggatggaattggagttgaaaacaggcatttttagccatgtagagttcttatggttctcttyggtagtttttctttagctggtcagtttgtattgtcctcatttagtagacgtagatgcacgaactgattaattcatttgttctagggctctgaggagtcgt

SEQ ID NO: 52024 - DNA, 201 bp, Homo sapiens
ccttggtacaagctgtgtctatgctatcttaatgcctgagcacagcactagcagcgggctgttgccagctcttgaggagacatttgaacttttggcagcgytccttatcagaaggcccatccgaggtatttgtgattatagagtaagggtgctcgcttttggcaaaacaaagcgtctgacagtagtgaagtactggctcaa

SEQ ID NO: 52025 - DNA, 201 bp, Homo sapiens
attttccatctgatgaacacagaggagggtgcatttctgttccagtgtcattctgtcctgtgcagacaaagggttaagcgtgtctttacacatgaagccasaggagtctttctcccctataattaaaccctcccggtgcgcttccttaactggatgtcattctgtgtgcgttgactatgaaggggactgtgctttgctctg

SEQ ID NO: 52026 - DNA, 201 bp, Homo sapiens
taagatccagctttttaatgctattttctagtttcattctagctcctgctctctgtccctatctgttttgtttttgtttttgtttttaagaactgtaaagrttgctatttgttttcatttttggtttttgagttaccatgtccctctgatgcagcatctctgtctcttagcggccgtgggggtgaccaggcacaaatcgaa

SEQ ID NO: 52027 - DNA, 201 bp, Homo sapiens
gcctcctaaatgacttgctgttgccgtacacatataatgtaatatttgattcctgtctttattagatctttataatctaacggtttaagtttggtaaaatyatcgtttcctacttctctgttgaaagacttgaaagtacccccgaaatattactttgtgtcaagctttagacacacttagtctctggggttaatgacaagc

SEQ ID NO: 52028 - DNA, 201 bp, Homo sapiens
ctgcaaagcacatcttaccaaatattagccctatgagccagggagaaaaaaaccaggaggtcttttgcaaggcttcttagaacggtcacttgctgctgctkctttgcctgtcaagctgtgtgctgggacacacacattaaggccttcattttgttactggtataatttttaaaaatatgtaaaaacacatatttgcctcct

SEQ ID NO: 52029 - DNA, 201 bp, Homo sapiens
cggtgccgtggctctgctcagggtgcgctgtggtcgccagccgccgggagaggctgggcgggaggtggccttgtggtaaaagcctcatcctagaggggagygcaagggaaagtgttgggggtgctacaggcagtttctgggctccagattgcgagactagatggcgggactcagagtcaccaccctggggctgaaccaggc

SEQ ID NO: 52030 - DNA, 201 bp, Homo sapiens
gagctctggcagtttggcacatgcagctataagtaagagaaaattgaactaaggatgcctgaaatagtaagagcatgacttgcctcttagagcagaaagtytggagggaaggagctccaagccggtccctacattccgtggtgtcagagctctgcgtcaccatctcccagtacctcctggccctgccatcctagtcacaag

SEQ ID NO: 52031 - DNA, 201 bp, Homo sapiens
acagaacaagactccgtctcagaaaaaaaaaaaaaaaaaaaaaaaaaaagcactttgtatttcctgatttaacataggtattgactttctgaaatttgacrgctagtacaggcagttgccagtgtctccttctatacactcatttattcactcattcatccctgcatctatttaccttatgttcattgagcacctgttatg

SEQ ID NO: 52032 - DNA, 201 bp, Homo sapiens
gatgagaaaattgatgttctgggaggttacaagtcttgcctgaaaccacacaaagtagcagaattatgatttctgatttgtccaactctttctgtcaactmctgctgctaattatttgtatcatagtaagcacttcataaatctgtctttgcaactagattgtaagcttctcaagggcagccactagtctttatcattgta

SEQ ID NO: 52033 - DNA, 201 bp, Homo sapiens
tatattaaacagcaaccagagcaacaaatggcaaacaatttctattttcaagtttctttgcatatttttttggtgcaaaaccatttataaacttttttttytaacactagtgtctacagcagcattcaaaaaaattctgttaccttttctgtattaggatttaaagtctatttcttattgtatacctgattgaagctgttc

SEQ ID NO: 52034 - DNA, 201 bp, Homo sapiens
tgggacactgaggcgggcggatcgccttgaggtcaggagttcaagaccagcctggccaacatggcaaaaccccgtctctactaaaaatacaaaaattagcygggcgtgatggcaggtgcctgtaatcccagctactcaggagactgaggtaggaagaattgcttgaacccgggaggcggaggttgcagtgagccgagatca

SEQ ID NO: 52035 - DNA, 201 bp, Homo sapiens
acagtccccaactcaattgggtctaatgacattctttgtcccatcaggtcaagctgggaaacctggagctctacgtcgagcaggagtcagttccttccacrtggtattttctgattgtgctccctgtcttgctagtgattgtcatttttggtaagtgccctgtttaattttgtcagagaaattattccctggggcctctcg

SEQ ID NO: 52036 - DNA, 201 bp, Homo sapiens
agaagtcaccctttatagtattcatgccgtatgaggctctgtacagcctatataaattcttcttgatctatcatcataaataattggataaaagacaatgmaaaagaacttcagactggaaggcaacaacaaaaatgtgttcatgtcccactggcaccagttaatagctctgtggccttaggtaaatcacttgagtttcct

SEQ ID NO: 52037 - DNA, 201 bp, Homo sapiens
agccccttgggtcagaatcttcccctttccctagcctactgctttcagcctagtctcttttcccatggcataaccttccagctgctttcattgtcactcaygatattaatcataatattaactagcatgttttgagtgcttactgtgtgccgggccctgatctaagcatgtataatctcagttaacgtagccctcatttaa

SEQ ID NO: 52038 - DNA, 201 bp, Homo sapiens
tatttatgttatgtatttactaactttttaaattttattttttatatatatagagagagacagggtctcactgtgttacccaggctgatctccaactcccrggctcacgtaaccctcctccctccgtttcccacagcgctgggattacaggcgtgagccactacgcccagcctatttatgtgttgttgtttttttttaatc

SEQ ID NO: 52039 - DNA, 201 bp, Homo sapiens
tccttctgtacacctaaacaggacaatatatttatgttatgtatttactaactttttaaattttattttttatatatatagagagagacagggtctcactrtgttacccaggctgatctccaactcccgggctcacgtaaccctcctccctccgtttcccacagcgctgggattacaggcgtgagccactacgcccagcct

SEQ ID NO: 52040 - DNA, 201 bp, Homo sapiens
gtcaccttctcttacctttcgtctccccacaggagaaatggtaggaggggtctggtttccacctttgcccgattctcccactggtgcctccagatggggaycctctagagcaggggtgtcaaccttttggcttcctgtggccacattggaagaagaattgtcttgggccacacataagatacaccaacactaacgatagct

SEQ ID NO: 52041 - DNA, 201 bp, Homo sapiens
ctagtttgagtcactgtatgtgcttaaaagcaaaaaaaaaaaaaaaaaaaaaaaaaattcatttaaaaatagggtctaattcagagttttaagtgaatcaractcacctccctccaattagtccacattagttaggttttaaagttaatctgtagtgacggccagttcctcctactatctaaacaaagtccctgctgttgg

SEQ ID NO: 52042 - DNA, 201 bp, Homo sapiens
aagcaccctagtttgagtcactgtatgtgcttaaaagcaaaaaaaaaaaaaaaaaaaaaaaaaattcatttaaaaatagggtctaattcagagttttaagkgaatcagactcacctccctccaattagtccacattagttaggttttaaagttaatctgtagtgacggccagttcctcctactatctaaacaaagtccctg

SEQ ID NO: 52043 - DNA, 201 bp, Homo sapiens
agtgtggcgcctgcctttctgccacctcactcatccgacccggggaaacccacaccctgtcacaggggcgccttggtccccggagtctccggctcggccaygtctcccgcgcgcctccccggggcctccctctcgccgctccacacctgtcagccgctctcgcagcagccctgtggcccgagcccggggcctcagctgcaa

SEQ ID NO: 52044 - DNA, 201 bp, Homo sapiens
cagcatccacaaaatgagctctggcagtttggcacatgcagctataagtaagagaaaattgaactaaggatgcctgaaatagtaagagcatgacttgcctyttagagcagaaagtctggagggaaggagctccaagccggtccctacattccgtggtgtcagagctctgcgtcaccatctcccagtacctcctggccctgc

SEQ ID NO: 52045 - DNA, 201 bp, Homo sapiens
aggaagtgccacataacatatccacttaatgtcatcggccaggacttagtcataaccagaacatgtcctgactctgagctgcgaagccaagaggccagctytgggtcaccatctcccagtgcctcctggccctgccatcctagtcacaagatggctgccaccgctccaagcactactctcccttttgttcggatcgaagac

SEQ ID NO: 52046 - DNA, 201 bp, Homo sapiens
gggcagatggtcaccagccatcttttaaggaagtgccacataacatatccacttaatgtcatcggccaggacttagtcataaccagaacatgtcctgactytgagctgcgaagccaagaggccagctctgggtcaccatctcccagtgcctcctggccctgccatcctagtcacaagatggctgccaccgctccaagcact

SEQ ID NO: 52047 - DNA, 201 bp, Homo sapiens
tcatttactaaagcaccctagtttgagtcactgtatgtgcttaaaagcaaaaaaaaaaaaaaaaaaaaaaaaaattcatttaaaaatagggtctaattcaragttttaagtgaatcagactcacctccctccaattagtccacattagttaggttttaaagttaatctgtagtgacggccagttcctcctactatctaaac

SEQ ID NO: 52048 - DNA, 201 bp, Homo sapiens
tccagcagggagaatgaagaaccaccacagctgtctgcaaggcaaggtgaaggcctgtcgggagagatagaacatcagtcttcactgcagacatcggccgkgctagacacctatctgcttaaggatgataatgaaattaatccggcctgtagtcacttcccgtccaaatgatttattggcctcataccccagtgttgctgc

SEQ ID NO: 52049 - DNA, 201 bp, Homo sapiens
tcttgaatgtgtttttgaaaaggcatgctgaattataggtgcctaaaacaggagcaggacttgaaacactctagagggaacctcaatagattccaacagcrattcctttagagcagacacagtaattttaacagtaatccacaggctgcaaggcacaagcggctggatttgcttgccttctttctccctctcctcctagct

SEQ ID NO: 52050 - DNA, 201 bp, Homo sapiens
accttccttacctctttaaccacccacgtctctaaatacagtcccattctgaggcactgggagttagggcttcaacatacattttatggggacacattttwtggggacacagttcagtccataatagtaagataaggagaactgaaatttcaaaaccaaggctctagcatgacatcccccactctaggaccaattccattc

SEQ ID NO: 52051 - DNA, 201 bp, Homo sapiens
tatggtgttgaaatctccactcagttaatttcagcagtgtagttgggagttttatatgcaacaaaaatcccaaggctcgttaatagtctaccatgaggctkcaggaagacatcaacagaaacaatatgttgacacgaactgaaattctccatcagagaaaatttgttttctacacaggcttcagctggaaaaagctgaaga

SEQ ID NO: 52052 - DNA, 201 bp, Homo sapiens
ggtaaattttatcacaagtcatggcggagatagaaagcattttccagatttgtcttgttgctattgtcaaagttagcattccatttgaaggtactgttatytagagcagggaccagcaaacaacagcctgtgggccaaatgtggcccctctgcctatttttataaagttctattggaacacctgttcatttccttattgtc

SEQ ID NO: 52053 - DNA, 201 bp, Homo sapiens
aatagttgttttcaaggatggttctattttcatcacactatgctatgttgggggtattttttgtttctgtgactttggtgttataaacttttacctatgckatcatatattctatccatgctagaatggaaataataagaccttatccttgtagctgagtatttctagttgcagcaatgaggaaagagaaatgaacttggt

SEQ ID NO: 52054 - DNA, 201 bp, Homo sapiens
agggctctcacagtgtacttgtcacgtattcccttctcagaaggctatgattttctatctcctgaactctctccaccctgaggttcagcagaaaagaaccyaggaaaaaagtctaggaaagccagagaagagttatcctttagccttcactgggtgacaagcgtgctgatgctaaacaaagcccgggaagtcccaagcctc

SEQ ID NO: 52055 - DNA, 201 bp, Homo sapiens
gttaaaaatgttacatatgaccgctgtgatggggtgtttacaacctgtggcagacagtatcccattgggcagatgtgaacaggagacgaccgtgataaccygtgagaggctgatggctgacatgctacaaaggggccaggcctttccagcctggccctcttcccgggccttctggaccatacattttccaatagtcttttc

SEQ ID NO: 52056 - DNA, 201 bp, Homo sapiens
tgaggagacagtgaggtagccagatcatcttcccatgtgggaaaagacctgttcccctgcccttgattcatcctgccagccccctgcagccttatcctctytgcctcctcaatacccaaaaccaccaaatcatgtgacgggacgatgggtaaaaccggtagtgaaaggggaatgcagttacatgttcccaggccgtgtgca

SEQ ID NO: 52057 - DNA, 201 bp, Homo sapiens
gttgaggagacagtgaggtagccagatcatcttcccatgtgggaaaagacctgttcccctgcccttgattcatcctgccagccccctgcagccttatcctytctgcctcctcaatacccaaaaccaccaaatcatgtgacgggacgatgggtaaaaccggtagtgaaaggggaatgcagttacatgttcccaggccgtgtg

SEQ ID NO: 52058 - DNA, 201 bp, Homo sapiens
acaagatgggctcggccagttggagagggaagctttgtcaccaaagggacttgcacccctgggccagacggtggtgtccaagagaaagtgatcaaagagayacagaacccgcatgcctaaatatttatttcagttgttcgtatttcccacacttttcaaatgtgaacttgtgtcctgaaggtggagctttagtacacaaga

SEQ ID NO: 52059 - DNA, 201 bp, Homo sapiens
gagaccctgtctccaaaaaaaacaaaaacaaaaccaaaaaaaagaaatccaacaccagaagcagctatgcttggagctcttacagcagagactcaaaaacrcagatgcccaaaggggcagaaaatacataaggggtgtcagccgcctgggactacagaaagcagtggagcttgacttaatgggaaaggactcgccatccaa

SEQ ID NO: 52060 - DNA, 201 bp, Homo sapiens
tgtgtaatggggtcatgggatcagtgtgcccctggctgtcactcagaagaatgatgtcatttgattgcatttgttctgcattttattttcaggtcttgaaygtgtttttgaaaaggcatgctgaattataggtgcctaaaacaggagcaggacttgaaacactctagagggaacctcaatagattccaacagcaattcctt

SEQ ID NO: 52061 - DNA, 201 bp, Homo sapiens
ttttcttgttgcttttcatggttttagcatcatgttcctattctcgctcaaatcaataatccactgtacaaagtctggcattttgtactgaagccaagtayaagaaagttttaactaatgcacgtatggggtcgctgttttaactaacacacgtatggggtcgctgttttgttgcctcgtttttttaggtgcacttttcaa

SEQ ID NO: 52062 - DNA, 201 bp, Homo sapiens
tccagtgacctgagggaactgatctcttcctcgactaaaatcttgttgtgcaatcctaatgaattctcgaaggtgtttccagcggcgtccgtgctatgcaytcactggacccgggagctccccagtctcggggcgggaggggcaggtgtgcagccttcaggagaacgggagagagcaggcaggtttggcttttactttctc

SEQ ID NO: 52063 - DNA, 201 bp, Homo sapiens
gccgtgagccaccacgcccagccagttttgtctttttaagatgcatgaaataacagtgcatgtctgcactgttgggaaaattccagaagagaaggagaaayggatgatacaggagagagaagggttgtggagtgttcagtctttcagcaggtggaagaaaatatgacttggtgtgccagtagggaggccagcctcagacag

SEQ ID NO: 52064 - DNA, 201 bp, Homo sapiens
tgttgattcatataatgatggcacttgggctctaaggagggaaataaggacctgataggggtagggatgtgaaaaggtggcagggtctgtgttggaagttsaagttgagtttaaagattgttaggggcaggcgcggtgactcacgcctatattcccagctttttgggaggccaaagtgggtggatcacttgagcccaagag

SEQ ID NO: 52065 - DNA, 201 bp, Homo sapiens
taaggacctgataggggtagggatgtgaaaaggtggcagggtctgtgttggaagttgaagttgagtttaaagattgttaggggcaggcgcggtgactcacrcctatattcccagctttttgggaggccaaagtgggtggatcacttgagcccaagagtttgagaccagcctgggcaacatggcaaagaccccatctctaca

SEQ ID NO: 52066 - DNA, 201 bp, Homo sapiens
ctatgctaagcatgttcctgccccagggcctttgcatgtgctgtttcctcagtctagtacattcttccccacatctttctatggcagactctttcttgackgtctggtcctagagcacacatctctctgcacctgcctacccagtcttcagtagcctccccttactcacagtgacattactgttttattttcttcatggcc

SEQ ID NO: 52067 - DNA, 201 bp, Homo sapiens
gctctcagggtggaccttactagcgggtgctgggaactcatgacagggttttaagcagaggccttccagcgccatatttgtgttttaaaaagattatcccrctggcagtgtggaagatgaaccacgttaatccaagtctctcccggcctcccaccccacccttcctgggtcactttcctctggtgtgttttgtaaagagag

SEQ ID NO: 52068 - DNA, 201 bp, Homo sapiens
atggaaatcatcattagcagatcggaaacccaactgggtgtcagactcacctgagagagagctcttaaaatacagattcctggccagacacagtggtgcaygcctgcaacctcagcacttttgggaggagtgctttgagcccagaagttcaaaaccagcctgggcaacgtagtgagaccctgtgtctttaagaaaaaaatc

SEQ ID NO: 52069 - DNA, 201 bp, Homo sapiens
agggggcgctaaatttaaacgggagccctggaaggcctcagtgagaaggggcatctgagccaagacccaaagggacccactcagttttggggctatccgcyttcatgggctattgcactattgagtggaatggccgacaatttgagacagaagagccttcctcctttccttccaatccgggatgtgtccttgtgcagatct

SEQ ID NO: 52070 - DNA, 201 bp, Homo sapiens
tactgggtggctcagactctgggtgttaactctagcctgctagaaaggtcatcttcctctgctaatcacatcctgtattaagtatatgctccgtcctcccycagtgtgcagcagcatctgctatgaattcattttcgggctctactggtatactgcaaaggagagcatatgcgtgagcaagctaacagggccccacttccc

SEQ ID NO: 52071 - DNA, 201 bp, Homo sapiens
gtttgttggcctttaatctagagcttgacatagtagagaataggaaccagaatcctccctcccacaaacccacaaacaggttggcctctttcctccccttytgggacacagcaatggaaatgccttgccactatttacaagtctgaaactcatggggctctttgccaacacacaacacccacccccacccccaaccctgca

SEQ ID NO: 52072 - DNA, 201 bp, Homo sapiens
aaatacctctattctggttaattccggctcaggatcacgggctgccagctgcatctgtcagcagtgttggggactatgaaatggaagggcgtggttatccyccatgaagtcaacttggaactgaaggatccagctcaggatagtccttgttttcctcacaaaatagagaaaaatagagaggtcccttctagaactccttat

SEQ ID NO: 52073 - DNA, 201 bp, Homo sapiens
gaaggcctcagtgagaaggggcatctgagccaagacccaaagggacccactcagttttggggctatccgccttcatgggctattgcactattgagtggaayggccgacaatttgagacagaagagccttcctcctttccttccaatccgggatgtgtccttgtgcagatctcaagcttgacgtctgtgcggtgacacttct

SEQ ID NO: 52074 - DNA, 201 bp, Homo sapiens
cctctggcatggtcaatatggggacctcgtaaccttccctgtcacctagaactgcacttctgggactctgtggtcctattaataaaaaagataatcaccartctgcctcatctactgtggaacccttccaattcttttttttctttttcttttgaggagaaattagaaatcaccaaattaccatttttagactatttatgt

SEQ ID NO: 52075 - DNA, 201 bp, Homo sapiens
ttttataaagttctattggaacacctgttcatttccttattgtctatagctgctttcctgctacagtgcagagtggagtagttgtcacagagatcatatgrgttttaagtcttaaatactttctggccctttgcagaaagtttgttggcctttaatctagagcttgacatagtagagaataggaaccagaatcctccctcc

SEQ ID NO: 52076 - DNA, 201 bp, Homo sapiens
ccattttacagatgaggaaacaaggttagagagattgcatgacacttattaaaatccatcagtgttacagaggcatttgtgaactacaaggaaatacctcyattctggttaattccggctcaggatcacgggctgccagctgcatctgtcagcagtgttggggactatgaaatggaagggcgtggttatcctccatgaagt

SEQ ID NO: 52077 - DNA, 201 bp, Homo sapiens
gcctaatttttgtatttttagtagagatggggtttcaccatgttggccagtatggtctctatctcttgacctcgtgatccccctaccttggcctcccaaaytgctgggattacaggcgtgagccaccatgcccagccaggtttgttttttgtttagtggagctagtaactgacgttctcggacctcagcctccgtgctact

SEQ ID NO: 52078 - DNA, 201 bp, Homo sapiens
cctgcaccatctctaatggatgctctctgacttccaacaagcaccattaagaacatcccttttagtaaatatatgttgtaatggaatagatttttttgaartgaccttatctcaggcagcatgcactttcataagaatgtattgattggcctttaaatattcctcaaatgttttcacttgtctctgtgacctaatatttgt

SEQ ID NO: 52079 - DNA, 201 bp, Homo sapiens
acagagacgccaacgacaagaatgaaagtctcacagctttggatgccctaatctgtaataaaagctttcttgttactgtcatccacacccttgaaaagcaraagaacttttctgtgaaggacaggtattagtccattctttgatgttttaaaagcctttaagaaaaaatcaggccgggcatggtggctcatggctgtaatc

SEQ ID NO: 52080 - DNA, 201 bp, Homo sapiens
cagaatggaatctttcatggatcttcagatcctcactttaaatagaagataaacaaagctggtactgcgagcccaagcaaaatagctccaaaatagctggytgaatccatccctgtgcctgttcgaacgtcaaagcgttggacacaccattgtctataatcctaatgagtcttgatagcttttgttctagccacacattta

SEQ ID NO: 52081 - DNA, 201 bp, Homo sapiens
tgtccctatctgttttgtttttgtttttgtttttaagaactgtaaagattgctatttgttttcatttttggtttttgagttaccatgtccctctgatgcakcatctctgtctcttagcggccgtgggggtgaccaggcacaaatcgaaggagctgagtcgcaaacagagtcaacaactagaattgctggaaagcgagctcc

SEQ ID NO: 52082 - DNA, 201 bp, Homo sapiens
cccagattcaagtgattctcctgcctcagcctctctagtagctgggataatctcccctttttataaggacatcggtcatgttggattagggcccaccccartgacttcgtttaaccttccttacctctttaaccacccacgtctctaaatacagtcccattctgaggcactgggagttagggcttcaacatacattttatg

SEQ ID NO: 52083 - DNA, 201 bp, Homo sapiens
cgccaagagggtcagctgggacttcaagacggccgagagccactgcgtaagtcctgcccccggggcgccgcggagagcgctgctgccggggagccgccgcmgccgccgaggcagaacgagctgggggcgagcggcggggcgggggtacagccgggtgacatttaccaggtctcaggttcacaccgcgggcggccgtccgaa

SEQ ID NO: 52084 - DNA, 201 bp, Homo sapiens
agagctgtggacagctgtttctttcacacccagtgaccgctttgcttatatgcactgagaaacgtgaagttatttggcctggttttagagagatggaatgyagctgttatttatacggcgtaccaaataggaatttacactttgcatgtcatctgtaattctaccttgcccaaagtgtttcctgtctctctaaataacata

SEQ ID NO: 52085 - DNA, 201 bp, Homo sapiens
gatgagggaatcgaggcccagagaaatgggatgattgttgttcaaggtcacacaggggcagagcagggatttgaacctggaatgacttcagagactgcacraagatcccctatgctgcactgactttgcaacctctgccgcacacattggtactactctctgaggattccgggggcacatgggagacatgcagatagggtt

SEQ ID NO: 52086 - DNA, 201 bp, Homo sapiens
catttttatttccatgctgctgtttttttaaatggctcccctaaattatttagttcatggtttgcatttggaaataaacaccaacttttagtacactcatygcccacaaaagaaccacatggagcaaaggccacaaacccattttgtgtgagtgtttcagtctgcaaatgtgttttttatgtgctaaatagctcaaagttt

SEQ ID NO: 52087 - DNA, 201 bp, Homo sapiens
tgggaataatttcaatacactgtgtaaaatgctctaatagctggtactcaaggtatgaaaggactccaaagaaccctttaatatttaggaggaaacagagytgtgattaagaatcccccaagaagcctcgaattgtgtctgcctccttacatagaaaaggcatgttgggcattgagctggtgtgtgagcaatgccaaaggg

SEQ ID NO: 52088 - DNA, 201 bp, Homo sapiens
gacagggtttcaccaggttggccaggatggtcttgagctcctggcctcaagtgatctggcctcccaaagtgctgggattacaggcataagccactagcacyggcctcttcctactactcttgacccgactacatggttctcacccttgaatgcttagctgaaatgccatctttcttcactagcctgtctaaagtgggttcc

SEQ ID NO: 52089 - DNA, 201 bp, Homo sapiens
ttctttttatcagaacagagacgccaacgacaagaatgaaagtctcacagctttggatgccctaatctgtaataaaagctttcttgttactgtcatccacmcccttgaaaagcagaagaacttttctgtgaaggacaggtattagtccattctttgatgttttaaaagcctttaagaaaaaatcaggccgggcatggtggc

SEQ ID NO: 52090 - DNA, 201 bp, Homo sapiens
tgtttgccctgtatgtgtttatcaaatgcctgctctccacgaggcactatggaatagataccagggatgggtgtttttaggagcttgcagtctagagagayagactcatcaaccaaacttacctggggatgagtttgaagaggaaggcaggggccagatcacagtgttggggtcagagatgggcatggaaacatgtattgc

SEQ ID NO: 52091 - DNA, 201 bp, Homo sapiens
ttgtgggttttttttggatcatgaattcaatattgaataattcattgtcttggaaaacccattgtgggtctactttctaactttaaacttatatatgattktgtattatactatatatttttttctttttatcagaacagagacgccaacgacaagaatgaaagtctcacagctttggatgccctaatctgtaataaaagc

SEQ ID NO: 52092 - DNA, 201 bp, Homo sapiens
agtcaccttaggtagctagtgaacacttgaaatgttgctagtgtttttaattaaatgtaaatttttaattaaatttaaatagccattatgtggctagcggmtgtcatatttgatagtgcagctataaagtcgttttaaaatgacttgagacacacacctttcccacctcccttaggacctaactgcttctgttttaaaaag

SEQ ID NO: 52093 - DNA, 201 bp, Homo sapiens
tacctggggatgagtttgaagaggaaggcaggggccagatcacagtgttggggtcagagatgggcatggaaacatgtattgcagactgaggtgctgaaagkcatgtagacaggagagtctggtatgggagaaagggtgtcatgagagatttttaagcagggagtaacatcatcagctctgtgcgtaagagtaacccagatg

SEQ ID NO: 52094 - DNA, 201 bp, Homo sapiens
gccagtcaccttaggtagctagtgaacacttgaaatgttgctagtgtttttaattaaatgtaaatttttaattaaatttaaatagccattatgtggctagyggctgtcatatttgatagtgcagctataaagtcgttttaaaatgacttgagacacacacctttcccacctcccttaggacctaactgcttctgttttaaa

SEQ ID NO: 52095 - DNA, 201 bp, Homo sapiens
gggtttgttttttgccctttgtacccacacacaccacagagaggttagagatctaaaatcctttgagactcctcttgacttttatctcagaggactatttyttctccactgtgtggacacaccccggtcaagtgcaggtttttattcacttaggagaggggaagaggggaggaggagaaaataaaatcagagataccaaat

SEQ ID NO: 52096 - DNA, 201 bp, Homo sapiens
ggggtaagcatgggttgtagaggatgcttagaattcgtttgggtacaagagttacccaaactagccaaagtaggcacaaagttttgtaatttgatccgccrtgaggattattgctcattaaaccagaccaggtagtggttcccaacatgtgtgactagaatttctcatccctcagaacatccttcaacaaaaaagctggaa

SEQ ID NO: 52097 - DNA, 201 bp, Homo sapiens
atcaaatcatgtgaaaagacatcgcctggcatgttagatgtttttgcttaaaaaaaatcttttaattgtctctgttattagcataattttatcatgtagaytgactttcagcttcagtgatgaagatccaatttttgagctttcccagcaagttattttggtcttatgttttggcattcccctcttaaagagtctggaggc

SEQ ID NO: 52098 - DNA, 201 bp, Homo sapiens
tgggcgtcctagctgtccaatgtgggctgaatctgtttgcaaatgagtggatactaatgccaacaatagtaattgtacaggttttattgccgatactatcrtcaagcctttcccagcagcctggccccgtgctaagcccttgaatgcatgatcacatttaatctccctaacaatgctagaaggccggtactgttattacac

SEQ ID NO: 52099 - DNA, 201 bp, Homo sapiens
aaatcatgtgaaaagacatcgcctggcatgttagatgtttttgcttaaaaaaaatcttttaattgtctctgttattagcataattttatcatgtagactgrctttcagcttcagtgatgaagatccaatttttgagctttcccagcaagttattttggtcttatgttttggcattcccctcttaaagagtctggaggcctt

SEQ ID NO: 52100 - DNA, 201 bp, Homo sapiens
tttagcccagtgactgcctgatgttcatagtgttatcatcatcactatcatctctattattattactttgaatttttattgtgggttttttttggatcatsaattcaatattgaataattcattgtcttggaaaacccattgtgggtctactttctaactttaaacttatatatgattttgtattatactatatatttttt

SEQ ID NO: 52101 - DNA, 201 bp, Homo sapiens
agtaatgtttcctccatgccagtctgtggtggggtaattattcagggatattatgggttacacatatttctatgaacccaggaagcaaacccactgtatakaaagactttctaagttttcaaacagtgaacttagaaacaagtgtctgggaccttcctgtttatgacttggggccggagtaggtttggaactttttttttt

SEQ ID NO: 52102 - DNA, 201 bp, Homo sapiens
ggttgatagttttggaactgttcccttccttgactacaaacattttgctctgagaactttcttccctgaggtaaaagagcattgatcatattccgaaggtygagtcttgaataataatgaaggtgcttgttgctgttgtcaaaacgagtgtttgcttccaaggcagctataatgtgcttggtacaaaaataatggcttaag

SEQ ID NO: 52103 - DNA, 201 bp, Homo sapiens
acatttggaaacgtctcttgaaaatgtgaaagatttggatcattggatcccaaatttccatagcatcagtttattagagctgagtagcagctacgccctaragagagggaatgtgctccctaggttttgaccacagtcgccaccactccatattgtctccacctaggccatttaactcatctatgtacctgatatctgtag

SEQ ID NO: 52104 - DNA, 201 bp, Homo sapiens
cgacatacacagaggttacacagctggttagggatgggctcagaggtcacccagctggcttgcggtggactgggatgaaagccaggagtctactggcttcyactgggttcattgctggcagcctcctccttattcagagatactgagcatggagtgggcgtcctagctgtccaatgtgggctgaatctgtttgcaaatgag

SEQ ID NO: 52105 - DNA, 201 bp, Homo sapiens
ccagatgctgttctaagaactgtgcggttactgttgttatgccctctttgcagatgagaaagcgacatacacagaggttacacagctggttagggatgggytcagaggtcacccagctggcttgcggtggactgggatgaaagccaggagtctactggcttctactgggttcattgctggcagcctcctccttattcagag

SEQ ID NO: 52106 - DNA, 201 bp, Homo sapiens
aaaacaacttgcaaagtgagtatgtaaatgatggaagaaaatgttggcatctgtttcatacagattttaccactcacagcatcaggtatgcaaaaaacagrattgtaacgctaaaaccacaatatctaaaataactgttctaattgtcaacagattctaaataaactagaaagagaacgagggctggaagaagctcagaaa

SEQ ID NO: 52107 - DNA, 201 bp, Homo sapiens
atgtagcgtgtttgtcaatcctccagtgaaaagcactatctagatcacattttggatcacattagccaaatgcagtaaatggccaaattagatgtgtgctraagacaatcagtcactgggtctatattaaacagcaaccagagcaacaaatggcaaacaatttctattttcaagtttctttgcatatttttttggtgcaaa

SEQ ID NO: 52108 - DNA, 201 bp, Homo sapiens
agtctttttaaattaactttttggtttgggggattttttttttttccttcaggcaatcttttctttgcatttgggcaggttctgtattctaatttgcaaayaggcttgtgtctgcctgcaggctttatcatgaaagtattagctctaagtggaaataaggactagaaaaataaaatactgactgggagtctgaggactttg

SEQ ID NO: 52109 - DNA, 201 bp, Homo sapiens
gaaccagcttcgtcattctgtttttcaatccagcagtgcttgtctctccgttgcaaactctctctgacattgacaggcggtttaatttgaacttaatgtcyttgacggatgagctagccatcaagggtcagataaatttatggctttggagaattgccgatgaaaatccccatggttataatgttggagaagaaactgaca

SEQ ID NO: 52110 - DNA, 201 bp, Homo sapiens
agcgagttctcactctgagttcacaggagatctggttgtttaagagagtgtggcacctgccccctcacagtcttgctcccaccctagccgtgtgacacacstgttctcccttcgcttccagcatgattggaagcttcctgagcccctcaccaggagcagacactacccatgcttcctgtacagcctgtaaaatcatgagcc

SEQ ID NO: 52111 - DNA, 201 bp, Homo sapiens
tttagcatcatgttcctattctcgctcaaatcaataatccactgtacaaagtctggcattttgtactgaagccaagtataagaaagttttaactaatgcaygtatggggtcgctgttttaactaacacacgtatggggtcgctgttttgttgcctcgtttttttaggtgcacttttcaaggagattgtgtacattcagaga

SEQ ID NO: 52112 - DNA, 201 bp, Homo sapiens
acaagcatttgtccacgtcctggtccctgcagctggggaagaactgcagtttagtgtccgctccaacaagttgtgattgtcatttcttaaacagtgacttscttttggttccaagtagcagaaaacgcaaccaacagtggcttaaaccatgacaactattgttaacttagtaaaatgtttaaaagttgaaggtctgcggct

SEQ ID NO: 52113 - DNA, 201 bp, Homo sapiens
aatgtgacctccagtactggaggtgggcctgctgggaggggtcgggtcatgggaacggatccctcatgaatggcttggtgctgtccttggcaatagtgagmgagttctcactctgagttcacaggagatctggttgtttaagagagtgtggcacctgccccctcacagtcttgctcccaccctagccgtgtgacacacctg

SEQ ID NO: 52114 - DNA, 201 bp, Homo sapiens
ctcccaccctagccgtgtgacacacctgttctcccttcgcttccagcatgattggaagcttcctgagcccctcaccaggagcagacactacccatgcttcstgtacagcctgtaaaatcatgagccaattaaaccccttttctttataaattatccagtctcaggtatttcttcatagctatgcaaaaaatggactaacac

SEQ ID NO: 52115 - DNA, 201 bp, Homo sapiens
agagtgaatagatttggtggaaaagattcttaggcatctaaacataggtatatccaaattctaatttctctcatcagtctgaaaaatagccaaatttggcrctaatagagaatagtagaaagtagaataccataatccttgaatatacccaggactctgataagtggttaaaattctggaagattttttttcttatgttat

SEQ ID NO: 52116 - DNA, 201 bp, Homo sapiens
cacacacgtacacacacaaacacacacacacctcaggagctttggtcccagtttgctatatcaggcccaaagctctttctctctttcagcccaaacatcgyttgagccaaggtagctttctcctccaactgagaaaagtttccctcttagagccggcaaacgtgtaggcgtgacgttatgcttagacacggcaggaaggag

SEQ ID NO: 52117 - DNA, 201 bp, Homo sapiens
tgcttatacaacttccgtacctagctaggggctcactattacaaattaatcactgtttatatctggtctggtacatttcaaaactgcttaccacccaaacraccactggtgttttcttcctcgccctaagtcccactgtggtttaccctaatcttcccagagacttcccacacagccactgcctcactctctccagctcac

SEQ ID NO: 52118 - DNA, 201 bp, Homo sapiens
ggcttaaacaacagaaatttctttctccccggttctggaggctgaaatcatggtgttggtaagattggtttctcctgaggcccttacaccttggcttgtaratggtcatcttctctctatgtcttcacgtggtcttccctctgtatctctgtcctaatctccccaattttttttttttttttttttttttttgtgacagtc

SEQ ID NO: 52119 - DNA, 201 bp, Homo sapiens
aggccccacctccaagtaccatcaccttgggggttgggatttcaatacctggagttagggggacatcaatattcagatcatagcagcattaaagacaagawacacccctgagaacctcccgaaatttcagaagccccacatccacgtcagtggtccataagtcacgggctcacatgccagatgctgttctaagaactgtgc

SEQ ID NO: 52120 - DNA, 201 bp, Homo sapiens
gcgattctcctgcctcagcctcccaaatagctaggattacaggcacatgccaccacgcccggctaattggaataaaagtattccttaaacaatatggttcytagaggagagacactagaaactttttttttttttttgacagggtctccctctgtcatctaggctggagtgcagagacgtgatcataatttactgcagcct

SEQ ID NO: 52121 - DNA, 201 bp, Homo sapiens
aataaatatttaaatatcaataaccttactacatgttaaataaaacaaacttttaacttcatgaataaaaagtcctattcataaaaacaacagaactactsagctataaacttaaagagcaaggtacatatcctgcattaaaaccatttttactaagagatatgtgttggagtcagctaccaaaaatagtaattttgcttt

SEQ ID NO: 52122 - DNA, 201 bp, Homo sapiens
aatatttaaatatcaataaccttactacatgttaaataaaacaaacttttaacttcatgaataaaaagtcctattcataaaaacaacagaactactgagcyataaacttaaagagcaaggtacatatcctgcattaaaaccatttttactaagagatatgtgttggagtcagctaccaaaaatagtaattttgctttgaac

SEQ ID NO: 52123 - DNA, 201 bp, Homo sapiens
aattcagggttccatagctgagaaacagagcaggtggcagagctggtatggagagcttcagctatccgggtccaaatccatcctccagctactgtgctcaratgcctccacgggggcagcatgagtccaaggatggaaacacgccttaatacttgtatgtacatcagtgaaataattaagcttcatgtagagtttttccct

SEQ ID NO: 52124 - DNA, 201 bp, Homo sapiens
ccaccagcctcctctgcctgtccttctgtacacctaaacaggacaatatatttatgttatgtatttactaactttttaaattttattttttatatatatakagagagacagggtctcactgtgttacccaggctgatctccaactcccgggctcacgtaaccctcctccctccgtttcccacagcgctgggattacaggcg

SEQ ID NO: 52125 - DNA, 201 bp, Homo sapiens
ggaaggttgtgcttgtccaaatctcagctctttacatcatattttcccaccaattgcctcttcctattgtcttttttatgctctagtatcagggggtggcrggggtgggggaaaaatagtttttcccacctgataaatttctttttatgagttataattgcttttctgtagaatgtttgccatcctcccctaacccaccag

SEQ ID NO: 52126 - DNA, 201 bp, Homo sapiens
cctgggcaacacagcaagaccctgtctctaaaaaaaaaaaaaaaaaaaaaaaaaaaaaaatttagccaagcatggcagtgtgcacctgtagtctctgctaygtgggaggctgaggtgggaggattgcctgagcctgggaggtcgaggctgcagtaagccatgatcactgcacttcagcctgggcaacagagtgagaccctg

SEQ ID NO: 52127 - DNA, 201 bp, Homo sapiens
cctcttttataagggcactaatcccatttatgaggactctgccctcatgatctaatcccctccaaaggccccacctccaagtaccatcaccttgggggttrggatttcaatacctggagttagggggacatcaatattcagatcatagcagcattaaagacaagatacacccctgagaacctcccgaaatttcagaagccc

SEQ ID NO: 52128 - DNA, 201 bp, Homo sapiens
gtaattcttgataaatatttgatttaataagtgacagcatgtaagatccatccagccatctaattcctgggtgaagttgagaaatccattaaattttgaamactcatatatcttttatctttggtttcagatatcaaatggatccactataaaagtctttaagaagatagcaaattttacttcaggtaaccaatataatat

SEQ ID NO: 52129 - DNA, 201 bp, Homo sapiens
gtggtgggggttcagctacattggaatattataaattcctccatctttttttttttttttttttactcttttggtgatggttgcttttttttttttttttyccccaggaagcaccaactaataagcttctctatgccaaggatatcccaacctacaaagaagaagtaaaatcttattacaaagcaatcagggatttgcctc

SEQ ID NO: 52130 - DNA, 201 bp, Homo sapiens
tcagtgagaagagctgagggagaagacgatactgacggagggagagcaatattggcacgtggctgctgggacagcatgtggaatagaattctgttttcacrtaatattgtttcagcagaaaaggtgatttcaggaatgagagatttcaatcagagtttctgtgtagtgatttgattctcatgttttcagatttttttcttt

SEQ ID NO: 52131 - DNA, 201 bp, Homo sapiens
aggagagcatatgcgtgagcaagctaacagggccccacttccctcaaatgttcatcaacattttaaagttgagctccgtgcagtcctcccaggagactgtygtgggattttatagcagataatgggacagaaatgaagaatagaatcatggtggtgacagacagtgtaacgaggttcacttccccttgatgtacagttata

SEQ ID NO: 52132 - DNA, 201 bp, Homo sapiens
ggtcccagtagaatggcagggaactgtagccatcaaagccatttatacttcttgtgggtagtatttttaagatgttgtttctttttcaaaatgaagcagcratgaactgagtagtgatcaaaatgccgcaccacagagtatgtttaatccaaatagctcccaagatggtctgtgactgattgtaccaactctacgggactt

SEQ ID NO: 52133 - DNA, 201 bp, Homo sapiens
tgtgtgtttccagcacaaaagaatccatttccattcagccagagcagcccctagagttttcatgaggtccaagcctcctctcctgttttcttccaggctcrctgttgtaataggctgcaaaatcctgactgtggccagggtcctccaggctggtgagaggaacaagcatttgtccacgtcctggtccctgcagctggggaa

SEQ ID NO: 52134 - DNA, 201 bp, Homo sapiens
acacccctgagaacctcccgaaatttcagaagccccacatccacgtcagtggtccataagtcacgggctcacatgccagatgctgttctaagaactgtgcrgttactgttgttatgccctctttgcagatgagaaagcgacatacacagaggttacacagctggttagggatgggctcagaggtcacccagctggcttgcg

SEQ ID NO: 52135 - DNA, 201 bp, Homo sapiens
tgcctcccattcatctttccctttagaaactgaagtagcttaactgcaattacccgccaccatgagaagatcaccttgcagagaaataaggcaagaccccracaagatcgtaggtggtggcaccagcattgaccccttcacacccacccctcccactggtgtggggaatttagcttaggacattgcttacagcctgagcta

SEQ ID NO: 52136 - DNA, 201 bp, Homo sapiens
aaaactattaaacaagctgagattgctgaagctccgattaaaaggtgcctcccattcatctttccctttagaaactgaagtagcttaactgcaattacccrccaccatgagaagatcaccttgcagagaaataaggcaagaccccaacaagatcgtaggtggtggcaccagcattgaccccttcacacccacccctcccac

SEQ ID NO: 52137 - DNA, 201 bp, Homo sapiens
acaaggactatgtcataacatctctctgacatcccagccctaatactaaatagggcaggagaacatgctggttaaatgggctttggtgggagtgtgggagscggagagatggcgcttccatcgaggtgtctcccccgatggggtacagtggctgagggcagacgctgtgatgtcacgctgtctgacatggcacaggcatct

SEQ ID NO: 52138 - DNA, 201 bp, Homo sapiens; identical to SEQ ID NO: 11130

SEQ ID NO: 52139 - DNA, 201 bp, Homo sapiens
ccacgtgacctcaggggtgatgctgaagggctgtgtggtaaaaccccggccaccagctccccttgacatcaggtgaaggggcttcctcccaggaagtggaygaggtcctacccatgtgtgggtggcctcagggggaccgagagaccccgtgctcagagcggcagctacaggcaccgggaaggagctatgggtgaaacaggc

SEQ ID NO: 52140 - DNA, 201 bp, Homo sapiens
aaggaacagaagcacctcgataacttgatggccgtcccaaaacccagcctccagcccgacccagggctcagcctcctccgcagactgtttgtcgagaacaytagatgccagcggcccaccgagcactcccctcagcctgcagggctggcccttccctgcctgtgtctctgcagagctcctcactaatgcccctctctcctc

SEQ ID NO: 52141 - DNA, 201 bp, Homo sapiens
ggaaaccgggtaagggccgtttgcacccctccttcagcctcggcccagggggtgtgggtgcctgaccgggtgggagggtagttgctgctgcagtgggagcrtgggttctcccggcagcccagcagccccagcccagcagccccagcccagcattctgccgggtcggagtcatgtgaggaactccccctgggagctcctggc

SEQ ID NO: 52142 - DNA, 201 bp, Homo sapiens
gtacctcatacccaccctcagccccagccccccatcctgccctgaaggacccaggttgtggagtcaggggcaaggcagtgggcctgaggtcctggatgggycacagggaaaggaggagctgggaccctcaagacagaggtccacggcccccacaggcagcaggaggagctgcggccatgtggcctggtggtcagggctgga

SEQ ID NO: 52143 - DNA, 201 bp, Homo sapiens
tgggttctcccggcagcccagcagccccagcccagcagccccagcccagcattctgccgggtcggagtcatgtgaggaactccccctgggagctcctggcrgatccccgtggcctggagacctgatgcatcccaaacttcggtgtcactggacagctccatttccctgagcagcagatccaggcctggcctcttggtcact

SEQ ID NO: 52144 - DNA, 201 bp, Homo sapiens
ctggaaacactggtcagtgaggagccaatggccgtgggatgtggtggagggtgccctgcccgttgcttcatcagcttctaaccagggcttgggcggccccrccgctgctcaccgaggcctcagcaacaaacccacctcctcccaggtggagccccagggagccccacccacacctcctggagctccccatgggaacgttgg

SEQ ID NO: 52145 - DNA, 201 bp, Homo sapiens
cggcaaggtaagtggccttgtcagggtacggggcaggcggggtcaccagcttccaggggcctcctggaggcagccccagctgagaagctgagcagagaggrcctttctggaaacactggtcagtgaggagccaatggccgtgggatgtggtggagggtgccctgcccgttgcttcatcagcttctaaccagggcttgggcg

SEQ ID NO: 52146 - DNA, 201 bp, Homo sapiens
tctcagggccccgacggttacccgggggaagcagggagtccaggggagcgaggagaccaaggcggcaaggtaagtggccttgtcagggtacggggcaggcrgggtcaccagcttccaggggcctcctggaggcagccccagctgagaagctgagcagagagggcctttctggaaacactggtcagtgaggagccaatggcc

SEQ ID NO: 52147 - DNA, 201 bp, Homo sapiens
acccttcagggccctctcctggcagcgcctcccctagtcccggtgcttggacactcctcccatctgcaccgaggagagggcggcactccaatccctgcatyacccctggaactgcacgctctgaaccaggcccggtgccctttctgcccagctgcccggctgctgccagccccactctgcggagccagcagcacagtgagg

SEQ ID NO: 52148 - DNA, 201 bp, Homo sapiens; identical to SEQ ID NO: 11140

SEQ ID NO: 52149 - DNA, 201 bp, Homo sapiens; identical to SEQ ID NO: 11141

SEQ ID NO: 52150 - DNA, 201 bp, Homo sapiens
caggcggatcctggtccccctggtgagccaggccctcgggggccaagaggagtcccaggacccgaggtaggttggtggccagtccccatgccctccccccracctgccaggccaacacacacccaagcctcgtggttctgcccacggtggacccacgtatcagtgggcagtggcctgggagagactcagccacccagcctt

SEQ ID NO: 52151 - DNA, 201 bp, Homo sapiens
tttatatcttacactgggaagattgttgctggctctcagtctgcttccagtctgctcatattgcttttgttgtaatgatggtcatatgtgggagctcagtrtcaagagggcagacttgagcccacactgccaggcttcagacctcagctattagctgagtgccctgggcaagttacctcactgggccttggtttcctcatc

SEQ ID NO: 52152 - DNA, 201 bp, Homo sapiens
ggccaccatgtcatagcctaagttctcgtgtgttgttatgcccatggttgtgtggagtgttggcctgttccagcaccaaaaccaaaactgtaattttatcrtttcatttgatagcacaagctttctcatcactctattttttattttgctcaactcttcttgctttttctaccaagtaaaacttggattcattttgcaaac

SEQ ID NO: 52153 - DNA, 201 bp, Homo sapiens
aactggttgttagaaaatgtttcttctaactgatagaagaaaatcaataactttttgtatgttgaggactaagctctgatttttttatcttgcctatattsttatctaaggggtctggggagtcatgccctacaaaccataaattctcatcagatggttttatctaaccctatatgctgtgacttactttccatctgactc

SEQ ID NO: 52154 - DNA, 201 bp, Homo sapiens
atgtttcttctaactgatagaagaaaatcaataactttttgtatgttgaggactaagctctgatttttttatcttgcctatattcttatctaaggggtctrgggagtcatgccctacaaaccataaattctcatcagatggttttatctaaccctatatgctgtgacttactttccatctgactctggcatgacactacac

SEQ ID NO: 52155 - DNA, 201 bp, Homo sapiens
ctcactcctctctcagggccccgacggttacccgggggaagcagggagtccaggggagcgaggagaccaaggcggcaaggtaagtggccttgtcagggtayggggcaggcggggtcaccagcttccaggggcctcctggaggcagccccagctgagaagctgagcagagagggcctttctggaaacactggtcagtgagga

SEQ ID NO: 52156 - DNA, 201 bp, Homo sapiens; identical to SEQ ID NO: 11155

SEQ ID NO: 52157 - DNA, 201 bp, Homo sapiens
agcagcccccagccagcatctggcatcccaggtgccccgtggacatcagggaggtgcagtcccaagcccgaccgtgggtcctgcccccgcagcgggcatcstgcaccccccttcccctgccaaaagacgtgaggctgattctgcaaacccttccagggggaccctggccgcccaggacgcagagggcccccgggagaaatc

SEQ ID NO: 52158 - DNA, 201 bp, Homo sapiens
cacggtcagagagcaagatcagtggaggaggtcagagggcaaggtcagagagcaagcttggttggggaaggtcacagggcaaggttggtggggggaggagrgtggcagcgaggttggtagggacaggacccgccagcctccccgcatggctgcctccacacgtgggctggaatgtcccgggacccccaggccaggaccttg

SEQ ID NO: 52159 - DNA, 201 bp, Homo sapiens
agttccagtcttcagcccagcttgctgggcagcaacctccgacccccactgcccacggccagtcggcaatcaccctgaggctgtgaatccaggcccccacrtggggtccgggcaccacacctgcctcctgctcacctggtccttaaatgcctcgtctgtgatgtccctcaggttgatgagcacgttgaaatatgcgccaaa

SEQ ID NO: 52160 - DNA, 201 bp, Homo sapiens
gtgagcccctctgcctcttcgcctgcagctgagctggccacactcacgcccatggcccagatgaacagtcacgctggccaccatctctgctgtcaccatgktgccgcattgggctctggggacacggggagggacaggaagaacaggccatgtgccctgagccaccagcccctctgacctgtgccctcctcacgaggctga

SEQ ID NO: 52161 - DNA, 201 bp, Homo sapiens
ggtccgggcaccacacctgcctcctgctcacctggtccttaaatgcctcgtctgtgatgtccctcaggttgatgagcacgttgaaatatgcgccaaacacrcccatctccagggctttggccgccacctgcaaggaccccagggagcccctacatggatcaaggctgagcaaactgccggaaggagggtctctgcctgacg

SEQ ID NO: 52162 - DNA, 201 bp, Homo sapiens
gcttttttctgggagcttggacttagggcttcccactttctgtccaccttccctcagcccaagcccaagtctggctgagtcctctgtgcagatgcacaggygtcctgcccgtgacacacactctgccctcagctggcacggaggttccagcagcccccagccagcatctggcatcccaggtgccccgtggacatcagggag

SEQ ID NO: 52163 - DNA, 201 bp, Homo sapiens
cttttttctgggagcttggacttagggcttcccactttctgtccaccttccctcagcccaagcccaagtctggctgagtcctctgtgcagatgcacaggcrtcctgcccgtgacacacactctgccctcagctggcacggaggttccagcagcccccagccagcatctggcatcccaggtgccccgtggacatcagggagg

SEQ ID NO: 52164 - DNA, 201 bp, Homo sapiens
ggtgactgtgctgtcctctccttcttcaggggtatcaaggcaacaatggagccccaggaagtcctggtgtgaaaggagccaagggcgggcctgggccccgyggacccaaaggcgagccggtgagtccctcctgcccctgcctcagggccccgctctgggcatcctccttgcagcttgaggaggaccatgggggaagggcac

SEQ ID NO: 52165 - DNA, 201 bp, Homo sapiens
cacacctgcctcctgctcacctggtccttaaatgcctcgtctgtgatgtccctcaggttgatgagcacgttgaaatatgcgccaaacacgcccatctccarggctttggccgccacctgcaaggaccccagggagcccctacatggatcaaggctgagcaaactgccggaaggagggtctctgcctgacgggctctgggac

SEQ ID NO: 52166 - DNA, 201 bp, Homo sapiens
gccccaggaagtcctggtgtgaaaggagccaagggcgggcctgggccccgcggacccaaaggcgagccggtgagtccctcctgcccctgcctcagggcccygctctgggcatcctccttgcagcttgaggaggaccatgggggaagggcacctgggctgtaggcaggatcccctgctggcaaggcacagccaggcccccat

SEQ ID NO: 52167 - DNA, 201 bp, Homo sapiens
aactcagccccaacagctgcttcctgctttgcggcaggaggcctggggtcccccgggcccccctacctggaggtctgaccggcaggccaggttcccacacygggccagttcctgcagcgccggccacagcgaggccaccgtctccgccagcgtcagcggcacagagactgcccgcctcagaccctcctgtagggccgccgt

SEQ ID NO: 52168 - DNA, 201 bp, Homo sapiens
tgttctctgcaggggcgcaggggagaccccggcaccaagggcagcccaggcagcgatggccccaagggggagaaggtgagtcctcgtgtggaggcagcccrgggtctcactgtggtgcccatgggccctgctgacgagggccccaaccccattcctcccagagaacaacagaaccccagggcctcactctccagagttcac

SEQ ID NO: 52169 - DNA, 201 bp, Homo sapiens
cagcccggggtctcactgtggtgcccatgggccctgctgacgagggccccaaccccattcctcccagagaacaacagaaccccagggcctcactctccagmgttcactctctgcagagtctgggaatgcagccctgagatccccacaccccattctctgctgaggaagctccactacccacccaggcacaccccgcacagc

SEQ ID NO: 52170 - DNA, 201 bp, Homo sapiens; identical to SEQ ID NO: 11157

SEQ ID NO: 52171 - DNA, 201 bp, Homo sapiens
ctacacccagaacccagcctactccactcagtgtgctcagggctgaaggtcaagtggagccacagcctccggggagggtcataggggccggggccagaccygtcttacccccgaggccctgcagtgtccacaggattgatactggggactccagggtgctgctgtcagtcaagagaaccccaaattcctcccctttcttcc

SEQ ID NO: 52172 - DNA, 201 bp, Homo sapiens
caacccaagataggggtgcttaggcaggggctacacccagaacccagcctactccactcagtgtgctcagggctgaaggtcaagtggagccacagcctccsgggagggtcataggggccggggccagacccgtcttacccccgaggccctgcagtgtccacaggattgatactggggactccagggtgctgctgtcagtca

SEQ ID NO: 52173 - DNA, 201 bp, Homo sapiens
gatttttttatcttgcctatattcttatctaaggggtctggggagtcatgccctacaaaccataaattctcatcagatggttttatctaaccctatatgcygtgacttactttccatctgactctggcatgacactacacgaccaagaagaaaataaaaatattttaccccaaaacatgtttctttgccacattttgaaat

SEQ ID NO: 52174 - DNA, 201 bp, Homo sapiens
tgcttcctgctttgcggcaggaggcctggggtcccccgggcccccctacctggaggtctgaccggcaggccaggttcccacaccgggccagttcctgcagsgccggccacagcgaggccaccgtctccgccagcgtcagcggcacagagactgcccgcctcagaccctcctgtagggccgccgtgcgcctgaaaggagcaa

SEQ ID NO: 52175 - DNA, 201 bp, Homo sapiens
tctgtaaggaatctctgttaacatagctagctctttttcttccaggccctcccaattctgaagagattaaccgagagtctagcagcttttaaaggtctcartaggaaacacttgtcattgattgtctctaagggcagccactatgagacttcagaagaaccttggtctccacagtcttttatcttaacctgagcatttcct

SEQ ID NO: 52176 - DNA, 201 bp, Homo sapiens
aggtacacagacaagtggagggtgtgcaagacagagaagctttattgagtgttaggggagctcacaggagacccgcagggggcagcccctctctgtaggcrggttgtcttgtcggcgggttgtcttgtcaaatgttcagctctcagcagagagaaggccctggagtgggtggctcctctctgcaggcaggtcatcccattg

SEQ ID NO: 52177 - DNA, 201 bp, Homo sapiens
tctgacggtggccactcatggcctttctagctctggtgccagcatagggaaggaggaggcacagccttgtcttactccttgcacctgttagctccccccccgccaagggaggacccgtggttggggacagcacagggggccctgctgtgtgcagggactgtccctggggccactgaagcgcacctgttcttgttccttctc

SEQ ID NO: 52178 - DNA, 201 bp, Homo sapiens
ttctctcctgccctcagggatctcggggagaccccggtgatgcaggaccccgtggagactcaggacagccaggccccaaggtacgtgcccctcccccagcrggacgtattaggggttcggggcagctgcctgaggagcaggacagggggccggcctgggggaccctgttgccggcagacgtgcctcaggacgggcctgtgc

SEQ ID NO: 52179 - DNA, 201 bp, Homo sapiens
acccaccctcagccccagccccccatcctgccctgaaggacccaggttgtggagtcaggggcaaggcagtgggcctgaggtcctggatgggccacagggaraggaggagctgggaccctcaagacagaggtccacggcccccacaggcagcaggaggagctgcggccatgtggcctggtggtcagggctggacggggcatg

SEQ ID NO: 52180 - DNA, 201 bp, Homo sapiens; identical to SEQ ID NO: 11115

SEQ ID NO: 52181 - DNA, 201 bp, Homo sapiens
tcaggaaggggagcaggcatctgagatctcccccgtgaggcttcctgcaaaaacgtgccctgcctcagaatcgctgctcagtaacagtggtttcattgccrtgtacaaatggtgcctccctcaccagtgccccttgctcttccatccttttgtaaaatttattcttttatatttgtttttttagagacagggtctttctct

SEQ ID NO: 52182 - DNA, 201 bp, Homo sapiens
ctacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatgct

SEQ ID NO: 52183 - DNA, 201 bp, Homo sapiens
caggacagggcacagctgtgatgttccagaagcctctgcccacctcatcccctgccctgagtttcctcccttttcttccttttgacctcttaattcttccyctttcctctgctcctctttgcacttaaattgggagcatatcaataaatagatgaatttatttaataaagttctgtatcataggttaaaattttaattcca

SEQ ID NO: 52184 - DNA, 201 bp, Homo sapiens
actacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatgc

SEQ ID NO: 52185 - DNA, 201 bp, Homo sapiens
cactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgatg

SEQ ID NO: 52186 - DNA, 201 bp, Homo sapiens
ccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtgat

SEQ ID NO: 52187 - DNA, 201 bp, Homo sapiens
gggtcccccgggcccccctacctggaggtctgaccggcaggccaggttcccacaccgggccagttcctgcagcgccggccacagcgaggccaccgtctccrccagcgtcagcggcacagagactgcccgcctcagaccctcctgtagggccgccgtgcgcctgaaaggagcaagaggagagcctgagcacagcggcacaca

SEQ ID NO: 52188 - DNA, 201 bp, Homo sapiens
tccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggtga

SEQ ID NO: 52189 - DNA, 201 bp, Homo sapiens
acaccgggccagttcctgcagcgccggccacagcgaggccaccgtctccgccagcgtcagcggcacagagactgcccgcctcagaccctcctgtagggccrccgtgcgcctgaaaggagcaagaggagagcctgagcacagcggcacacacaggcaggcagtggacacactgcaccccaacagggctgagcaggctgcaga

SEQ ID NO: 52190 - DNA, 201 bp, Homo sapiens
gggtcggggcccatgcaccgggtggagggcgggagtgcagcagggctgggtcatcgctgggtcctgcatgtgcacgtgaccctagggtctgaggtctcccyggtaccccccgatgaccctgccacccccccagactgtgagaagcgctgtggcgccctggacgtggtcttcgtcatcgacagctccgagagcattgggtac

SEQ ID NO: 52191 - DNA, 201 bp, Homo sapiens
aggggacccaggcgggtgctgcaccccaaggtaagggaccaaggcaagggctgcaccccaaagtagggaacccaggtgagggctgcaacccaagatagggktgcttaggcaggggctacacccagaacccagcctactccactcagtgtgctcagggctgaaggtcaagtggagccacagcctccggggagggtcataggg

SEQ ID NO: 52192 - DNA, 201 bp, Homo sapiens
ccacaggaagcatttctctaaaggtgagcagcttcctctgcaggtgacacggcctccacccaaacccagaggctctggctctcccactgcggcttgccgcrgccccacacttgcctgctcccacactgacacctccaacaccacaggggctgctgggtcacgtggcccagatggcagggctgctcagacagtcattttctg

SEQ ID NO: 52193 - DNA, 201 bp, Homo sapiens
tggtggtcagggctggacggggcatgtcaggtgacccctgggcatggccagtccctgcctgtgctgacttctgaatttctctcctgccctcagggatctcrgggagaccccggtgatgcaggaccccgtggagactcaggacagccaggccccaaggtacgtgcccctcccccagcaggacgtattaggggttcggggcag

SEQ ID NO: 52194 - DNA, 201 bp, Homo sapiens
ctctgctcacagccagaactcgacggcacccctagcccacttccaccccagtgtgcaccttgcgccctgttgagcacagccccccagccccaccccgtccyatgaccatgctgaccgactcaacgtcctcctccagggagaccccggcaggcctggattcagctacccaggaccccgaggagcacccgtgagtcacagcct

SEQ ID NO: 52195 - DNA, 201 bp, Homo sapiens
acgcagcacagtggcctcacccagagtgtgaatgagcgagggagggaaacggggctgcagaaagctgcccagagggaggaaggagcactgggatctgaggytgagtcaccctggcttctgtttgcttcacagggagaaaaaggcgagcccggcccacgcggccccgaggtatgtgtgggtcctggccacctgtgcccaccc

SEQ ID NO: 52196 - DNA, 201 bp, Homo sapiens
tcactgacaggaccacccctgtcttgagatggtcctggctccccaaggcccagccatgtcacctatgctgagctctgggggagctgtcagccactggctgrtcccttttcaaccaaagttcaggctttgccaaaaaaaccacatagatgctcccgtttaaaggaccccaaaatgccagatcgatttttccacataaaaatc

SEQ ID NO: 52197 - DNA, 201 bp, Homo sapiens
ttgtcttactccttgcacctgttagctccccccccgccaagggaggacccgtggttggggacagcacagggggccctgctgtgtgcagggactgtccctgkggccactgaagcgcacctgttcttgttccttctcaggcggatcctggtccccctggtgagccaggccctcgggggccaagaggagtcccaggacccgagg

SEQ ID NO: 52198 - DNA, 201 bp, Homo sapiens
ggggcaagagggcgcaagccccccagtccagatgctggtgacggtgtgtgctgggcgcagaccccgcttccttgaagactgagggcagtgcccccaatccygctgacctgctgtgcgtgcgcctgccatgggggagggtgccaggggagaggcactgggggtgtctgagcgacccccacccctgttgcaggacttcagggc

SEQ ID NO: 52199 - DNA, 201 bp, Homo sapiens
aggaccacccctgtcttgagatggtcctggctccccaaggcccagccatgtcacctatgctgagctctgggggagctgtcagccactggctggtccctttycaaccaaagttcaggctttgccaaaaaaaccacatagatgctcccgtttaaaggaccccaaaatgccagatcgatttttccacataaaaatctcactggt

SEQ ID NO: 52200 - DNA, 201 bp, Homo sapiens
gtttaaaggaccccaaaatgccagatcgatttttccacataaaaatctcactggtgtccctggtagagacagctcctctgtcccaggctaacatgtgttcyctgtcacagggaggccgaggcgactttggcttgaaaggagaacctgggaggaaaggagagaaaggagagcctgtgagtgtcgccgtcccgaagcccacag

SEQ ID NO: 52201 - DNA, 201 bp, Homo sapiens
tggctgccatttctgggacacccagctctgccaggcccctacccctctggtgggccaggctctgacggtggccactcatggcctttctagctctggtgccrgcatagggaaggaggaggcacagccttgtcttactccttgcacctgttagctccccccccgccaagggaggacccgtggttggggacagcacagggggcc

SEQ ID NO: 52202 - DNA, 201 bp, Homo sapiens
agaggagtcccaggacccgaggtaggttggtggccagtccccatgccctccccccaacctgccaggccaacacacacccaagcctcgtggttctgcccacrgtggacccacgtatcagtgggcagtggcctgggagagactcagccacccagccttggccccagagtctcagcctcatccttccttccccagggtgagccc

SEQ ID NO: 52203 - DNA, 201 bp, Homo sapiens
gggagagactcagccacccagccttggccccagagtctcagcctcatccttccttccccagggtgagcccggcccccctggagaccccggtctcacggtargtgtcacatggggcagaaccagtgtccttctcctgccaaaactagacaccaagagcagcaggggtgggggaaggtcagctggcacggtcagagagcaaga

SEQ ID NO: 52204 - DNA, 201 bp, Homo sapiens
ttctgcccagctgcccggctgctgccagccccactctgcggagccagcagcacagtgaggcccgtcctgatggcctccagctccactctgcggagtcagcrgcacagtgaggcccgtcctgatggcctcctggagctggagcttaggccaagccacagggcatcagggaggatggacgttcaagggctggatctgtttgcc

SEQ ID NO: 52205 - DNA, 201 bp, Homo sapiens
acccaggcatcgctggagaatcagagcccagtgttggccacagtcacagctactgggtgcagaagggacccccacgggccaggcacccccaccccaggggkctcttctggctccattttgcaggtggctttgtgggaagcttccctcagagctgggagaaatgggtcaaagcaaacccttgtctgacagaggctggccctt

SEQ ID NO: 52206 - DNA, 201 bp, Homo sapiens
gggctcctggggggtcctgtggccttgagtttggcccaagggctttgccccccagaggcagcagtgcccatgatgctttgaggcaccgagctcactgcgcyggctttcctcctacacagggtgaatttggagccgacggtcgcaaggtaggctggctgggtaggcagagcccctccttcctgctgctcagggcagaaggac

SEQ ID NO: 52207 - DNA, 201 bp, Homo sapiens
gctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcaggggt

SEQ ID NO: 52208 - DNA, 201 bp, Homo sapiens
ggtgccccaggggctctgccctcctgggccgcctgcagtgtcgccccgcccctggcggccccaggatccccaagggcttttttctgggagcttggacttarggcttcccactttctgtccaccttccctcagcccaagcccaagtctggctgagtcctctgtgcagatgcacaggcgtcctgcccgtgacacacactctgc

SEQ ID NO: 52209 - DNA, 201 bp, Homo sapiens; identical to SEQ ID NO: 11147

SEQ ID NO: 52210 - DNA, 201 bp, Homo sapiens
ggctccacaccacacaccgcacaggcgtgaccatgcctcagggcccctgcctctgggtgactgtgctgtcctctccttcttcaggggtatcaaggcaacartggagccccaggaagtcctggtgtgaaaggagccaagggcgggcctgggccccgcggacccaaaggcgagccggtgagtccctcctgcccctgcctcagg

SEQ ID NO: 52211 - DNA, 201 bp, Homo sapiens
agctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgacctcagggg

SEQ ID NO: 52212 - DNA, 201 bp, Homo sapiens
gctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtgac

SEQ ID NO: 52213 - DNA, 201 bp, Homo sapiens
tcccaagggccctgaagattcctagtagttccctcaaggcctcctctgtgcagaagaaagtgtgaggtccctcctgcgggacagagtggtgagaaggcttygggtgactcagtgaaggataggtccagcccagcatcaggaaaagagcacagctcagaacgcagcacagtggcctcacccagagtgtgaatgagcgaggga

SEQ ID NO: 52214 - DNA, 201 bp, Homo sapiens
tgctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcacccacgtga

SEQ ID NO: 52215 - DNA, 201 bp, Homo sapiens
ccaggctaacatgtgttccctgtcacagggaggccgaggcgactttggcttgaaaggagaacctgggaggaaaggagagaaaggagagcctgtgagtgtcrccgtcccgaagcccacagcagctgggcagaggcagggaggggccctgaggctgagcgtgtgcatctatgagtacaggagaacgccaggcagcttggcccc

SEQ ID NO: 52216 - DNA, 201 bp, Homo sapiens
tgggcgaatgggcgaatgggtggatgggtgggcgtggagttggtgggtacatgataatggggtggaatacccatggattggaatgagctgttttggctgcyatttctgggacacccagctctgccaggcccctacccctctggtgggccaggctctgacggtggccactcatggcctttctagctctggtgccagcatagg

SEQ ID NO: 52217 - DNA, 201 bp, Homo sapiens
attctctgctgaggaagctccactacccacccaggcacaccccgcacagctgtgcaggcaccattcacccccggcccactgaggcaccactcacaccccccggcccccactgaggtaccgctcaccccccagcccccactaggcaccgctcacacccccgctacacctcttacccccagcccactgaggcattgctcaccc

SEQ ID NO: 52218 - DNA, 201 bp, Homo sapiens
gggcaagagggcgcaagccccccagtccagatgctggtgacggtgtgtgctgggcgcagaccccgcttccttgaagactgagggcagtgcccccaatcccrctgacctgctgtgcgtgcgcctgccatgggggagggtgccaggggagaggcactgggggtgtctgagcgacccccacccctgttgcaggacttcagggcc

SEQ ID NO: 52219 - DNA, 201 bp, Homo sapiens
ttcctcccaggcccccttccccaacccccggccacacccgcctctcacatgggacccaggccggaggcctcagctgagacccgtggggcctcccttccctycccacagggggaccctggccctgaggggccccgcggcctggctggagaggttggcaacaaaggagccaaggtaggggagcagggtgggccgcaccccaag

SEQ ID NO: 52220 - DNA, 201 bp, Homo sapiens
ccagacagtggtgctccattcccttccatgccgacgcgcccagctacccactccacccagccctggaggacatggaagggcctcaaccatccaaatcccamccaaaactgagcccagaggcacccactaaacatctgtgaccccacccagggtggggcaagagggcgcaagccccccagtccagatgctggtgacggtgtg

SEQ ID NO: 52221 - DNA, 201 bp, Homo sapiens
tgtctttccaatatatttctcaaaaatttttttgagtttttttcataagtcctgcacatttttattcagttgattccttgggtttatgttgtttttcttamtagtgtaaatagcatttttctgcaacattttctaactggttgttagaaaatgtttcttctaactgatagaagaaaatcaataactttttgtatgttgagg

SEQ ID NO: 52222 - DNA, 201 bp, Homo sapiens
gtctgttctccattttgtttatctttgctctgatctttattttttccttctttctgctagcttgttctttttctagttccttacattgtaaggttaagctsctatttgagacctgtcttttttaatataagcatgtatagccatcagtttcccccttagcactgctttcactgtcgaacaagtttttaaatttgtgttttc

SEQ ID NO: 52223 - DNA, 201 bp, Homo sapiens; identical to SEQ ID NO: 11106

SEQ ID NO: 52224 - DNA, 201 bp, Homo sapiens
caggccaacacacacccaagcctcgtggttctgcccacggtggacccacgtatcagtgggcagtggcctgggagagactcagccacccagccttggccccrgagtctcagcctcatccttccttccccagggtgagcccggcccccctggagaccccggtctcacggtaggtgtcacatggggcagaaccagtgtccttct

SEQ ID NO: 52225 - DNA, 201 bp, Homo sapiens; identical to SEQ ID NO: 52147

SEQ ID NO: 52226 - DNA, 201 bp, Homo sapiens
ggtaggttggtggccagtccccatgccctccccccaacctgccaggccaacacacacccaagcctcgtggttctgcccacggtggacccacgtatcagtgrgcagtggcctgggagagactcagccacccagccttggccccagagtctcagcctcatccttccttccccagggtgagcccggcccccctggagaccccgg

SEQ ID NO: 52227 - DNA, 201 bp, Homo sapiens
taaaagtaagggagaaattaacacattcttagatcaacaaaagctgagaatgttccttaccactagacctgccctataggaaacgccaaagggagtcctgygggttgaaataaagggtgatagacagtaattcaagtgaagaagtaaagatctcagccaggcatagtggctcatgcttgtaaccccatcactttgggaggc

SEQ ID NO: 52228 - DNA, 201 bp, Homo sapiens
acctgcgggtgctgcggtgaggcactgcccacggcagggtcggggcccatgcaccgggtggagggcgggagtgcagcagggctgggtcatcgctgggtccygcatgtgcacgtgaccctagggtctgaggtctccccggtaccccccgatgaccctgccacccccccagactgtgagaagcgctgtggcgccctggacgtg

SEQ ID NO: 52229 - DNA, 201 bp, Homo sapiens; identical to SEQ ID NO: 11108

SEQ ID NO: 52230 - DNA, 201 bp, Homo sapiens; identical to SEQ ID NO: 11109

SEQ ID NO: 52231 - DNA, 201 bp, Homo sapiens
tgcacctgttagctccccccccgccaagggaggacccgtggttggggacagcacagggggccctgctgtgtgcagggactgtccctggggccactgaagcscacctgttcttgttccttctcaggcggatcctggtccccctggtgagccaggccctcgggggccaagaggagtcccaggacccgaggtaggttggtggcc

SEQ ID NO: 52232 - DNA, 201 bp, Homo sapiens
caggatccccaagggcttttttctgggagcttggacttagggcttcccactttctgtccaccttccctcagcccaagcccaagtctggctgagtcctctgwgcagatgcacaggcgtcctgcccgtgacacacactctgccctcagctggcacggaggttccagcagcccccagccagcatctggcatcccaggtgccccg

SEQ ID NO: 52233 - DNA, 201 bp, Homo sapiens; identical to SEQ ID NO: 11112

SEQ ID NO: 52234 - DNA, 201 bp, Homo sapiens
agcctccccgcatggctgcctccacacgtgggctggaatgtcccgggacccccaggccaggaccttgctgtggaaactcttctggggccccggggggactrccctgcctgccgtgtgcattgcaggagtgtgacgtcatgacctacgtgagggagacctgcgggtgctgcggtgaggcactgcccacggcagggtcggggc

SEQ ID NO: 52235 - DNA, 201 bp, Homo sapiens
ctggcaacgacctcacgcgtgcggcttgcagggacgcgtgtgggcgtggtgcagtacagccacgagggcacctttgaggccatccagctggacgacgaacrtatcgactccctgtcgagcttcaaggaggctgtcaagaacctcgagtggattgcaggtggcacctggacaccctcagccctcaagtttgcctacgaccgc

SEQ ID NO: 52236 - DNA, 201 bp, Homo sapiens
gggcgtgggaggcgatgagatgggagaagtccagacgcgtccctccaacgagggcctctgcatggctggggatgccccagaccccgaggcctctggcaacsacctcacgcgtgcggcttgcagggacgcgtgtgggcgtggtgcagtacagccacgagggcacctttgaggccatccagctggacgacgaacatatcgact

SEQ ID NO: 52237 - DNA, 201 bp, Homo sapiens; identical to SEQ ID NO: 11116

SEQ ID NO: 52238 - DNA, 201 bp, Homo sapiens
acctggtcgctgagaagttcatcgatgacatggaggacgtcctctgcccgggtgagcgtgtgggcgcggggcagtcggccgaggagcagcaggccccagcygctgtctagcgtgagccccagggacacccctcacctgagggatgaatgtgcagcccaggatcttgggctgtgggtgggaaggggtcgggccctctcgggg

SEQ ID NO: 52239 - DNA, 201 bp, Homo sapiens; identical to SEQ ID NO: 11118

SEQ ID NO: 52240 - DNA, 201 bp, Homo sapiens
gtcgctgagaagttcatcgatgacatggaggacgtcctctgcccgggtgagcgtgtgggcgcggggcagtcggccgaggagcagcaggccccagccgctgyctagcgtgagccccagggacacccctcacctgagggatgaatgtgcagcccaggatcttgggctgtgggtgggaaggggtcgggccctctcggggctgca

SEQ ID NO: 52241 - DNA, 201 bp, Homo sapiens; identical to SEQ ID NO: 11120

SEQ ID NO: 52242 - DNA, 201 bp, Homo sapiens
ctgcccgggtgagcgtgtgggcgcggggcagtcggccgaggagcagcaggccccagccgctgtctagcgtgagccccagggacacccctcacctgagggaygaatgtgcagcccaggatcttgggctgtgggtgggaaggggtcgggccctctcggggctgcagggcagaggccagctgcaccctgagcctgtctaggcag

SEQ ID NO: 52243 - DNA, 201 bp, Homo sapiens
ggcgcggggcagtcggccgaggagcagcaggccccagccgctgtctagcgtgagccccagggacacccctcacctgagggatgaatgtgcagcccaggatmttgggctgtgggtgggaaggggtcgggccctctcggggctgcagggcagaggccagctgcaccctgagcctgtctaggcagatcagtgaacggccgctga

SEQ ID NO: 52244 - DNA, 201 bp, Homo sapiens
tcttgaaggcccaccatgggccttgcagtctccctcagctgccgcccagctcccatgggctggccgtgcatgtgccactcggaggaagccctggattcagkgagtgaaaccatcccggggtggaagcactgacaccccccagcaccagcaggtcttgctccaaccctggcctgcctcggagctgcagctgcggctctcatc

SEQ ID NO: 52245 - DNA, 201 bp, Homo sapiens
ggagctgggggtgccgtccaggctctgctggacgtggtgctgcccccatggtgcactgctgcaccgtacctgggcccacaggaggtccccgggggcgttakgagctgagtccccctcagtgagccgtcccctccaggagtgtgagggtggggatgccatggagacagggtgggagggtccgacctggaggaccacagggag

SEQ ID NO: 52246 - DNA, 201 bp, Homo sapiens
tggtgcactgctgcaccgtacctgggcccacaggaggtccccgggggcgttaggagctgagtccccctcagtgagccgtcccctccaggagtgtgagggtrgggatgccatggagacagggtgggagggtccgacctggaggaccacagggaggaaacctcagggtctgcggtacgaagtcagcgcttcctcagcacgcgg

SEQ ID NO: 52247 - DNA, 201 bp, Homo sapiens
tggcaacaaaggagccaaggtaggggagcagggtgggccgcaccccaaggtaggggatctgagggggtgcaggggggctgcaccccaaggtagggtggccrggactgcaccccaaggtaggggacccgggtgggtgctgcaccccaaggtaaggggggcccaggtgagggctatacctcaaggtaggggacccaggcgggt

SEQ ID NO: 52248 - DNA, 201 bp, Homo sapiens
ggggggcccaggtgagggctatacctcaaggtaggggacccaggcgggtgctgcaccccaaggtaagggaccaaggcaagggctgcaccccaaagtagggracccaggtgagggctgcaacccaagataggggtgcttaggcaggggctacacccagaacccagcctactccactcagtgtgctcagggctgaaggtcaag

SEQ ID NO: 52249 - DNA, 201 bp, Homo sapiens
ggccaggctctgacggtggccactcatggcctttctagctctggtgccagcatagggaaggaggaggcacagccttgtcttactccttgcacctgttagcyccccccccgccaagggaggacccgtggttggggacagcacagggggccctgctgtgtgcagggactgtccctggggccactgaagcgcacctgttcttgt

SEQ ID NO: 52250 - DNA, 201 bp, Homo sapiens
tgtgaccccacccagggtggggcaagagggcgcaagccccccagtccagatgctggtgacggtgtgtgctgggcgcagaccccgcttccttgaagactgasggcagtgcccccaatcccgctgacctgctgtgcgtgcgcctgccatgggggagggtgccaggggagaggcactgggggtgtctgagcgacccccacccct

SEQ ID NO: 52251 - DNA, 201 bp, Homo sapiens
gagcccagaggcacccactaaacatctgtgaccccacccagggtggggcaagagggcgcaagccccccagtccagatgctggtgacggtgtgtgctgggcrcagaccccgcttccttgaagactgagggcagtgcccccaatcccgctgacctgctgtgcgtgcgcctgccatgggggagggtgccaggggagaggcactg

SEQ ID NO: 52252 - DNA, 201 bp, Homo sapiens
cgtcatgacctacgtgagggagacctgcgggtgctgcggtgaggcactgcccacggcagggtcggggcccatgcaccgggtggagggcgggagtgcagcarggctgggtcatcgctgggtcctgcatgtgcacgtgaccctagggtctgaggtctccccggtaccccccgatgaccctgccacccccccagactgtgagaa

SEQ ID NO: 52253 - DNA, 201 bp, Homo sapiens
agtcaatttttaagtattttattatttttgatactatagtaaatagaattgttttcttaatttcctttggattgttcattgttagtgaatagaaatacaastgatttttatgtgtttactatgtattctgctattttgctgaatttgtttattagttgtaacagtttttgtggaatttttagggttttctacatacaagat

SEQ ID NO: 52254 - DNA, 201 bp, Homo sapiens
ttgccaggtaactaatcctatgtgccaagcaagtgcctccgcctcaatagttcttctgtccccctggataaagcaccctggaaatctaataccgggggtgytccctggctcctgcaggcacatgctggctgcctcgtgcagttcctggacatgcaacctctctactccctggtcaggcctagcaggtccccatccaggtta

SEQ ID NO: 52255 - DNA, 201 bp, Homo sapiens
aaacgcccccgcagagcccagtggtctgtgaggttgcaggcagggtgcgaatggaagggcacaggtgcggggctggcacctgcccggtcctgcccacctcycctccgcccagcccgcacctgcgtctccccacagagctgtccgtggcacagtgcacgcagcggcccgtggacatcgtcttcctgctggacggctccgagc

SEQ ID NO: 52256 - DNA, 201 bp, Homo sapiens
gtgggaaggggtcgggccctctcggggctgcagggcagaggccagctgcaccctgagcctgtctaggcagatcagtgaacggccgctgagggttcgctagrgactgaccctggcctggcccggcctctctcctctcttccagaccctcagatcgtgtgcccagaccttccctgccaaacaggtaatgcagggcaccctgag

SEQ ID NO: 52257 - DNA, 201 bp, Homo sapiens; identical to SEQ ID NO: 11144

SEQ ID NO: 52258 - DNA, 201 bp, Homo sapiens
aaattataaaaacaagaaaaaccagcaaactctggggaagaaagagattttgatttcacaaggcatacaaagaaactttcctatttcaaaggaaaaaaaaacaacagaaactgtcactgaaaaagacttggtggtagatctactagacaaaggctttgaaagaactatcttaaagatactcaaataactaagggaaaatgt

SEQ ID NO: 52259 - DNA, 201 bp, Homo sapiens; identical to SEQ ID NO: 11146

SEQ ID NO: 52260 - DNA, 201 bp, Homo sapiens; identical to SEQ ID NO: 11148

SEQ ID NO: 52261 - DNA, 201 bp, Homo sapiens
cgggtcgcggtgtgcgttcgggcgttccatggggagctcccggtgggtgagctgggccactgagcacattcacaggccctgaggctgccccaggggaggarccgtggactcagagccgaggttccccatacgtgctgcgacagagaacctagggcttgcacctgggtctggctgcccttcagcaggcgggcagcctctggc

SEQ ID NO: 52262 - DNA, 201 bp, Homo sapiens; identical to SEQ ID NO: 11149

SEQ ID NO: 52263 - DNA, 201 bp, Homo sapiens
gagtggccgctatggcttcccctccactccaggttctatcgtgagtgggtgggtgctgcgtctgtggatgtcacgtgacctttcctctttagcctatcatygtagttgggagttagttagcccgttgagcgtcattgaatttccagtgttgagccagccctgcgtgcccgggataaacccacctggccgtggtgtgtggcc

SEQ ID NO: 52264 - DNA, 201 bp, Homo sapiens; identical to SEQ ID NO: 11150

SEQ ID NO: 52265 - DNA, 201 bp, Homo sapiens; identical to SEQ ID NO: 11119

SEQ ID NO: 52266 - DNA, 201 bp, Homo sapiens
gaatgagctgttttggctgccatttctgggacacccagctctgccaggcccctacccctctggtgggccaggctctgacggtggccactcatggcctttcyagctctggtgccagcatagggaaggaggaggcacagccttgtcttactccttgcacctgttagctccccccccgccaagggaggacccgtggttggggac

SEQ ID NO: 52267 - DNA, 201 bp, Homo sapiens; identical to SEQ ID NO: 11122

SEQ ID NO: 52268 - DNA, 201 bp, Homo sapiens
tccttccaggggctctggggcagctcccagcctcttcccatgctggtggccaccgtgtcccttgctgcggctgcatcttccagtctctcctccgtcttccwgtggccgctctctttataagaaccctggtcattgaatttaaggcccaccccaagtccagaatgacctcgcaagacccttaactcactcccgtctgcagag

SEQ ID NO: 52269 - DNA, 201 bp, Homo sapiens; identical to SEQ ID NO: 11151

SEQ ID NO: 52270 - DNA, 201 bp, Homo sapiens
tcctgatggggcagggaagtctcgggaccccatgatgggcgacatggcgatggtcactgtgggtgctttgctatcaggtggggggccttcctctccactcygggtccagtgtgagtggccgctatggcttcccctccactccaggttctatcgtgagtgggtgggtgctgcgtctgtggatgtcacgtgacctttcctctt

SEQ ID NO: 52271 - DNA, 201 bp, Homo sapiens; identical to SEQ ID NO: 11152

SEQ ID NO: 52272 - DNA, 201 bp, Homo sapiens; identical to SEQ ID NO: 11153

SEQ ID NO: 52273 - DNA, 201 bp, Homo sapiens; identical to SEQ ID NO: 11154

SEQ ID NO: 52274 - DNA, 201 bp, Homo sapiens
atcccaggagctgaggtcttggtgaggccacagggccaggtccacgcaaggactgtccgtgtcctgtcctgtggtctctggccccacgtgacacccacacrtgtggtaggcagcctggcctgggttgtggctatggccaggcccccaagctgtccccgatgcccagggctggtgaccacccaggcaggtgggggccccact

SEQ ID NO: 52275 - DNA, 201 bp, Homo sapiens
aattgcatcaaattataccaaatttagtttactattaatagtattttgtttaggatttttgcatcaatgttcataaggaagactggattgtagttttcttytcttgcaatatctttgtctggtattggtatcagagtaatgctggcctcgtaagaatgagttaaatagtgttcccttctcttcaagttttttgaaaatttt

SEQ ID NO: 52276 - DNA, 201 bp, Homo sapiens
ttaaagggaatggagccaggctggagagagagtgcctagctctgcaggggagccggtctggggaagctgggatctctctcccgccctcccctctgcactgyttccagggcagccccaggcagtggggggcgccagacagtggtgctccattcccttccatgccgacgcgcccagctacccactccacccagccctggagga

SEQ ID NO: 52277 - DNA, 201 bp, Homo sapiens
aggtgagcgcctcccggaccccgcaccctggaagccgctcggcccgcggggggtgaccccgagtcctgggaaggcggcggcggcggctccgtccctcgggyccccgggaagggggactccagccccagggacggcggggggctcggcgggttcggggctcctcctcgcggggctggggccgcgcctgcccctgtggctccg

SEQ ID NO: 52278 - DNA, 201 bp, Homo sapiens
atgggctgccgctgccatcagtaatatttatagtgatatttatctgtagagttacttttagggacttttttttttatcaagctttggtcacaggttatgcmacatttaaaaatgaattgggaaaaagtttatctttttatgttctaaaacaagttaaatagcatgaagtgcttgtccttgaagctgtgaaactcacccaca

SEQ ID NO: 52279 - DNA, 201 bp, Homo sapiens
tccaccgagatcgaccaggacaccatcaaccgcatcatcaaggtcatggtgagccgcgggcgggagcaccgtccacgcgccaggggtggccacggtgggcygtccacccactccgggcctcactttacccctctgtgagtgcggaggccgaaggaggaagctccgggcagggcctgggccactcaggtgtccctccatccc

SEQ ID NO: 52280 - DNA, 201 bp, Homo sapiens; identical to SEQ ID NO: 11107

SEQ ID NO: 52281 - DNA, 201 bp, Homo sapiens
aggggttgggggccgggggctctggcattcgggggcagtgaggtcaaacccacaaacaggcacggggccaggaaacggggctccaacagcagtccctcctraggctggctcgtgacaggtcctgtgccccacagagaagaccgactgccccatccacgtgtacttcgtgctggacacctcggagagcgtcaccatgcagtc

SEQ ID NO: 52282 - DNA, 201 bp, Homo sapiens; identical to SEQ ID NO: 11111

SEQ ID NO: 52283 - DNA, 201 bp, Homo sapiens
tcgccgtggcccccaaccagaacctgaaggagcagggcctgcgggacatcgccagcacgccgcacgagctctaccgcaacgactacgccaccatgctgccygactccaccgagatcgaccaggacaccatcaaccgcatcatcaaggtcatggtgagccgcgggcgggagcaccgtccacgcgccaggggtggccacggtg

SEQ ID NO: 52284 - DNA, 201 bp, Homo sapiens
ccagaacctgaaggagcagggcctgcgggacatcgccagcacgccgcacgagctctaccgcaacgactacgccaccatgctgcccgactccaccgagatcraccaggacaccatcaaccgcatcatcaaggtcatggtgagccgcgggcgggagcaccgtccacgcgccaggggtggccacggtgggctgtccacccactc

SEQ ID NO: 52285 - DNA, 201 bp, Homo sapiens
cgcacgagctctaccgcaacgactacgccaccatgctgcccgactccaccgagatcgaccaggacaccatcaaccgcatcatcaaggtcatggtgagccgygggcgggagcaccgtccacgcgccaggggtggccacggtgggctgtccacccactccgggcctcactttacccctctgtgagtgcggaggccgaaggagg

SEQ ID NO: 52286 - DNA, 201 bp, Homo sapiens
tgggcctgcagcaggcctgtggagttctcagttgcgtggggaccagagggtgctggagaaacaaaccagacgcagctgaaggcagtcagggcagggcgcamtcagcgataagagctgcataggggccacagcgtaacctgagctccagtcggtggaaagaaaaggcagagacgttgcagaggccaggtctgctcaggggaa

SEQ ID NO: 52287 - DNA, 201 bp, Homo sapiens
gactacgccaccatgctgcccgactccaccgagatcgaccaggacaccatcaaccgcatcatcaaggtcatggtgagccgcgggcgggagcaccgtccacrcgccaggggtggccacggtgggctgtccacccactccgggcctcactttacccctctgtgagtgcggaggccgaaggaggaagctccgggcagggcctgg

SEQ ID NO: 52288 - DNA, 201 bp, Homo sapiens
ggggtttgggaagcccagcggtacctgaggagtttctggacatttaagccggttcctaggtgtggccttaacagggaggctgcccttcctttcactgaatragctgcgtcactcataagctcactgagggaaccccatctgccagctcgtgcgtgctcagacggcgtccatgtctcaagcgttctgtgaaggctgcggtgc

SEQ ID NO: 52289 - DNA, 201 bp, Homo sapiens
atcgaccaggacaccatcaaccgcatcatcaaggtcatggtgagccgcgggcgggagcaccgtccacgcgccaggggtggccacggtgggctgtccacccrctccgggcctcactttacccctctgtgagtgcggaggccgaaggaggaagctccgggcagggcctgggccactcaggtgtccctccatccccacccagac

SEQ ID NO: 52290 - DNA, 201 bp, Homo sapiens
gttcctaggtgtggccttaacagggaggctgcccttcctttcactgaatgagctgcgtcactcataagctcactgagggaaccccatctgccagctcgtgygtgctcagacggcgtccatgtctcaagcgttctgtgaaggctgcggtgcagcgtgaggtcaccctgctgtgttcagagctttgctcactgcctgcggggc

SEQ ID NO: 52291 - DNA, 201 bp, Homo sapiens
agacttctccacttgggcaggggaatcagtaacctctgctgtgtcacctctcagaggagctgtggcagggtccccagctgcctaccgcccaccctaccctrcctcgatgtactcttttctctgcttttagggtgccaagggcaacatgggtgagccgggagagcctggccagaagggaagacaggtgagtgtccttgcccc

SEQ ID NO: 52292 - DNA, 201 bp, Homo sapiens
tgtggcagggtccccagctgcctaccgcccaccctaccctgcctcgatgtactcttttctctgcttttagggtgccaagggcaacatgggtgagccgggaragcctggccagaagggaagacaggtgagtgtccttgccccacgcccgccccgcctgcagcccagcgccccagggctgggctcacactgctgcgttgtcct

SEQ ID NO: 52293 - DNA, 201 bp, Homo sapiens
tccccccagttaccaaggaacagaagcacctcgataacttgatggccgtcccaaaacccagcctccagcccgacccagggctcagcctcctccgcagactrtttgtcgagaacactagatgccagcggcccaccgagcactcccctcagcctgcagggctggcccttccctgcctgtgtctctgcagagctcctcactaat

SEQ ID NO: 52294 - DNA, 201 bp, Homo sapiens
cattgcaagcccttctccgtctggttgaagtgacttccaggagatttaaagggctggcacccttttctcccttcatttttctctttttcctcttttgagasgtagacattgaagactagcacattcaaaagcaaccatatatgtggagaaaataaaaaagtcattgcacatgctcaggggaagtcacgggcttagaaaaga

SEQ ID NO: 52295 - DNA, 201 bp, Homo sapiens
gagctgaaaagtacaataactgaaatttaaaattcactagagaaatgcaaaggcagatttcagcaggcagaataaagaatcagggaacttgaagatacaamaatggaaattattgagtctgaggagcagaaataaaaagattgaataaaggtgatcagagcctaaggggtctgtgggataccatcaagcaaaccaacataa

SEQ ID NO: 52296 - DNA, 201 bp, Homo sapiens
tgcccgactccaccgagatcgaccaggacaccatcaaccgcatcatcaaggtcatggtgagccgcgggcgggagcaccgtccacgcgccaggggtggccayggtgggctgtccacccactccgggcctcactttacccctctgtgagtgcggaggccgaaggaggaagctccgggcagggcctgggccactcaggtgtccc

SEQ ID NO: 52297 - DNA, 201 bp, Homo sapiens
atcccacccaaaactgagcccagaggcacccactaaacatctgtgaccccacccagggtggggcaagagggcgcaagccccccagtccagatgctggtgayggtgtgtgctgggcgcagaccccgcttccttgaagactgagggcagtgcccccaatcccgctgacctgctgtgcgtgcgcctgccatgggggagggtgcc

SEQ ID NO: 52298 - DNA, 201 bp, Homo sapiens
gggcctgtgcctcctgttctcagctctggagtgaggggatgcctccggggtccaggaagcccccctggctctcctcttcagcagtgacccttgggtgtgcrtggcacatccttcctgaggcagggcctgagggcagctacgtggcctgagtagggtcctccccgcgtgtgggcaggcttcgggtctctaggcacgtccagc

SEQ ID NO: 52299 - DNA, 201 bp, Homo sapiens; identical to SEQ ID NO: 11142

SEQ ID NO: 52300 - DNA, 201 bp, Homo sapiens; identical to SEQ ID NO: 11143

SEQ ID NO: 52301 - DNA, 201 bp, Homo sapiens
ggccgtcccaaaacccagcctccagcccgacccagggctcagcctcctccgcagactgtttgtcgagaacactagatgccagcggcccaccgagcactccyctcagcctgcagggctggcccttccctgcctgtgtctctgcagagctcctcactaatgcccctctctcctcctgcccccagggcgttcctggcttcaaag

SEQ ID NO: 52302 - DNA, 201 bp, Homo sapiens
tgaatgagctgcgtcactcataagctcactgagggaaccccatctgccagctcgtgcgtgctcagacggcgtccatgtctcaagcgttctgtgaaggctgyggtgcagcgtgaggtcaccctgctgtgttcagagctttgctcactgcctgcggggctggaccgttgcacctccagggcccccagaaaccgagtttcgggt

SEQ ID NO: 52303 - DNA, 201 bp, Homo sapiens
agacggcgtccatgtctcaagcgttctgtgaaggctgcggtgcagcgtgaggtcaccctgctgtgttcagagctttgctcactgcctgcggggctggaccrttgcacctccagggcccccagaaaccgagtttcgggtcagggtcctctgtgtgcattcctgggggtccatgtaccagctgtgacgacgtccaggggttgg

SEQ ID NO: 52304 - DNA, 201 bp, Homo sapiens
agcgttctgtgaaggctgcggtgcagcgtgaggtcaccctgctgtgttcagagctttgctcactgcctgcggggctggaccgttgcacctccagggccccsagaaaccgagtttcgggtcagggtcctctgtgtgcattcctgggggtccatgtaccagctgtgacgacgtccaggggttgggctgagaagcagacaccct

SEQ ID NO: 52305 - DNA, 201 bp, Homo sapiens
agtgcctagctctgcaggggagccggtctggggaagctgggatctctctcccgccctcccctctgcactgtttccagggcagccccaggcagtggggggcrccagacagtggtgctccattcccttccatgccgacgcgcccagctacccactccacccagccctggaggacatggaagggcctcaaccatccaaatccca

SEQ ID NO: 52306 - DNA, 201 bp, Homo sapiens
cctcccaggagggcagcctgtgcagggatggtgctcagcaggtggacagggcctggggcctgtgtcagggtctcaggcctgggagcaccagcagaggagayggcggctcccagcagtgccgcctgaaagtgtcttgggctaaggacccacacccagggctgccctgcagaaacgcccccgcagagcccagtggtctgtgag

SEQ ID NO: 52307 - DNA, 201 bp, Homo sapiens
gctcagcaggtggacagggcctggggcctgtgtcagggtctcaggcctgggagcaccagcagaggagatggcggctcccagcagtgccgcctgaaagtgtyttgggctaaggacccacacccagggctgccctgcagaaacgcccccgcagagcccagtggtctgtgaggttgcaggcagggtgcgaatggaagggcacag

SEQ ID NO: 52308 - DNA, 201 bp, Homo sapiens; identical to SEQ ID NO: 11180

SEQ ID NO: 52309 - DNA, 201 bp, Homo sapiens
acccagtgacagagtttagtcctcttttctcagaatgagctcacctcagaagaaaccccaagccatcactgtcgctccttttccttccttcttcctcacarcaggtctataacagtcacccttggagcccataacataacagaggaagaagacacatggcagaagcttgaggttataaagcaattccgtcatccaaaatat

SEQ ID NO: 52310 - DNA, 201 bp, Homo sapiens
tgccctgaatttttcttaggacttggctataacatgaagctactcaccctgtccctccctgatcacctccaactgtccagagcccatttcgaggactgacrgtccttcattcccttcacagttgaaggagaaagccagcctgaccctggctgtggggacactccccttcccatcacaattcaactttgtcccacctgggag

SEQ ID NO: 52311 - DNA, 201 bp, Homo sapiens
caggtttgttacatacgtatacatgtgccatgttggtgtgctgcacccattaactcttcatttaacattaggtatatctcctaatggtatccctccccccmcccaaccccacaacaggccctggtgtgtgatgttccccttcctgtgtccatgtgttctcattgttcaattcccacctatgagtgagaacatgcggtgttt

SEQ ID NO: 52312 - DNA, 201 bp, Homo sapiens
taagtggcagaaccaagattcaaactcaccccatctaactgcagagcaaactgcatgccttaaatgtcaaagtgaatactagcacagttaatacaatgttyggaaactcagagaaggaatgatccctctgcattatagttactaaggaatcattgccattatttaaatgccagtgcttctacatcaggcccaaattttctg

SEQ ID NO: 52313 - DNA, 201 bp, Homo sapiens
ggagaggtacaggaggagatgaccttcctggttctgaagtccttctactgctttcacaatcatcctactccaaaggcgcaaacatcaaggggcctccaacrgctccctccctgcttgcctcagagcttgggaatcccaactccaaatctagttataagtacaatatagtgcgaattgaagaaaaaagaatattcaaaaatg

SEQ ID NO: 52314 - DNA, 201 bp, Homo sapiens
tcctggatcctgagccagcctgaaagggaagctggaactggacctgagcagcaaagtgtgtgccactcattctggtctacccttggtccctcagccacaaycctaagcctccagaagtatcctacaggtcacagaactctcaataaacctcagtgaagacacagcttctagtcgtgagtgtgtgtcccctctctgctgctc

SEQ ID NO: 52315 - DNA, 201 bp, Homo sapiens
catcaggcccaaattttctgtcctactaactgtgaatcaagacttgattcaacctctacttgagtatctgccgcaatgagaaatcacttacctccactaaycacacatttattttataacaacagattgttagtaagtcctttcttatacatactcaacagctgcttcccaagatgctgtaggattatgtctagagtcaaa

SEQ ID NO: 52316 - DNA, 201 bp, Homo sapiens
gagcatcacaggaattgctgtcctcccgtggtccaagacagcctctgaccatccattccagtctactgcactgggggcatggggtgatgtggagaatgtgratgacggtcccaagaaaggaagaaggggcatcagaactagatgtataagtgaggagctccacctcctgggtctgactttaggtctcactgtgactccaag

SEQ ID NO: 52317 - DNA, 201 bp, Homo sapiens
aactaaaagtcttctgcacaaccaaggaaacaatcaacagagtgaagaaacaatcaatagaatgggagaaaatatttgcaaatcacacatctaataagggkttaatattcaaaacaaataaagaagtcaattcaatagcaagaaagcaaataacccaattttaaaatgggcaaagaacctaatagacctctctcaaaaaat

SEQ ID NO: 52318 - DNA, 201 bp, Homo sapiens
aacgtgcaggtttgttacatacgtatacatgtgccatgttggtgtgctgcacccattaactcttcatttaacattaggtatatctcctaatggtatccctccccccccccaaccccacaacaggccctggtgtgtgatgttccccttcctgtgtccatgtgttctcattgttcaattcccacctatgagtgagaacatgcg

SEQ ID NO: 52319 - DNA, 201 bp, Homo sapiens
ttgggagttcagggctcaagttcctttctagaaaaacactgggtgattctaggggaacttctgatcagaaacagccaattcagagtgagagaagaaaacgygaccatgcagttcctgtggttaccagccttgcccctctcttgccttctgggagttataaaacccaagactggaaaggaaaaccagcatttgctcaggcag

SEQ ID NO: 52320 - DNA, 201 bp, Homo sapiens
acccgaattgattttggtgaaagagagtgtccatgttcttggacccattcatggcatctattcaacctccatgaccactctactctgaccatggcccattrttccagcagcgaggtgatcaagaagagaatatggttgacatccacaagccatatcacccctttacctggttgggagtctctgtgagtccatgtggtccag

SEQ ID NO: 52321 - DNA, 201 bp, Homo sapiens
gtccagagcccatttcgaggactgacagtccttcattcccttcacagttgaaggagaaagccagcctgaccctggctgtggggacactccccttcccatcmcaattcaactttgtcccacctgggagaatgtgccgggtggctggctggggaagaacaggtgtgttgaagccgggctcagacactctgcaagaggtgaagc

SEQ ID NO: 52322 - DNA, 201 bp, Homo sapiens
gaacttctgatcagaaacagccaattcagagtgagagaagaaaacgtgaccatgcagttcctgtggttaccagccttgcccctctcttgccttctgggagwtataaaacccaagactggaaaggaaaaccagcatttgctcaggcagcctctctgggaagatgctgcttcttcctctccccctgctgctctttctcttgtg

SEQ ID NO: 52323 - DNA, 201 bp, Homo sapiens
cgcccctacatggcctacctggaaattgtaacttccaacggtccctcaaaattttgtggtggtttccttataagacggaactttgtgctgacggctgctcrttgtgcaggaaggtgagacaacagggtctatttatctccaaatgggagatgaacaaccagagtagcatccaggaatacacctgcactggggactgaagag

SEQ ID NO: 52324 - DNA, 201 bp, Homo sapiens
gcaaagcaagcagtcaatgcaagtggaatccagggaagctggagtggtgtataaactggaccaggtgcactggtccttacccagagatgtagttgggactytccataaacaagctcacctttgttctgctgataattagatcattctgagcaaaggtatattgtcaacagtggacctaattatgtatgtaaatgtcatcta

SEQ ID NO: 52325 - DNA, 201 bp, Homo sapiens
cagtgacagggtgagcatcacaggaattgctgtcctcccgtggtccaagacagcctctgaccatccattccagtctactgcactgggggcatggggtgatrtggagaatgtggatgacggtcccaagaaaggaagaaggggcatcagaactagatgtataagtgaggagctccacctcctgggtctgactttaggtctcac

SEQ ID NO: 52326 - DNA, 201 bp, Homo sapiens
tcccaggaagacaaaatctgcatttaaggtgatcctccaactaggtttcctctccaaaactcactgttcagggaccagaatgctcttagaaggagatgggktcagaaggttgtcagtcagtgacagggtgagcatcacaggaattgctgtcctcccgtggtccaagacagcctctgaccatccattccagtctactgcact

SEQ ID NO: 52327 - DNA, 201 bp, Homo sapiens
aaccctggggtgctctgttccaggggagatcatcgggggcacagaatgcaagccacattcccgcccctacatggcctacctggaaattgtaacttccaacsgtccctcaaaattttgtggtggtttccttataagacggaactttgtgctgacggctgctcattgtgcaggaaggtgagacaacagggtctatttatctcc

SEQ ID NO: 52328 - DNA, 201 bp, Homo sapiens
actgggggcatggggtgatgtggagaatgtggatgacggtcccaagaaaggaagaaggggcatcagaactagatgtataagtgaggagctccacctcctgsgtctgactttaggtctcactgtgactccaagctggctggcagacaggagtggaggacttcccgggctcaccttcttctctctctcctccccctacaggga

SEQ ID NO: 52329 - DNA, 201 bp, Homo sapiens
taactaaaagtcttctgcacaaccaaggaaacaatcaacagagtgaagaaacaatcaatagaatgggagaaaatatttgcaaatcacacatctaataaggrgttaatattcaaaacaaataaagaagtcaattcaatagcaagaaagcaaataacccaattttaaaatgggcaaagaacctaatagacctctctcaaaaaa

SEQ ID NO: 52330 - DNA, 201 bp, Homo sapiens
catggctccaccagtggataagcacatataaccatcttcagaattccattgctcagggttttctgcatgggaacaaagcatccttccatttccaggtcgcrtcactcagcccattcaggaagctaccagagaagctaagccctacaggttccctcaggttagtgagcagtctttcctggcaattggtgtcaatggccaatt

SEQ ID NO: 52331 - DNA, 201 bp, Homo sapiens
tggttttttgtccttatgatagtttgaatctcagcattttcaataacaaaaatctggaatcccagacatggagaaaagcttctatgataaacttgtatgaytgaatattctgaattcatgaaaatttgtgttaaaaacatttagtatggaaaaattcaagaaaattcaatatattcaatataatgtaatgcttttacaaag

SEQ ID NO: 52332 - DNA, 201 bp, Homo sapiens
agaaggaaatgtgagcagatagtgcagtcctcgtttctgaaattggtcccctgactggggctatacctattccatttcctcaccctcagccaggcaggtgragcaaaacttaagtcttggtggatctgaatcttgatgctgtggagctgtcttactagccccagactacctgcctctcaatttctaattatatcagtgaaa

SEQ ID NO: 52333 - DNA, 201 bp, Homo sapiens
agacatgcagtgtggccggctgggggcagacggcccccctgggaaaacactcacacacactacaagaggtgaagatgacagtgcaggaagatcgaaagtgygaatctgacttacgccattattacgacagtaccattgagttgtgcgtgggggacccagagattaaaaagacttcctttaaggtaagactatgcacctgcc

SEQ ID NO: 52334 - DNA, 201 bp, Homo sapiens
tggtggacatcagccctccttgcccacttctgggtccttaaacagccaacggtcccacatacctccgatctcaggatctgggggacatgacggaggctggsccctgggatgaggtgaagcagtaacaatgtccagggccagagcttggcagctgggggccaccagcggcctgccctgccctctggtctcccacatgtaggc

SEQ ID NO: 52335 - DNA, 201 bp, Homo sapiens
tggtcctccatggtggacatcagccctccttgcccacttctgggtccttaaacagccaacggtcccacatacctccgatctcaggatctgggggacatgayggaggctggcccctgggatgaggtgaagcagtaacaatgtccagggccagagcttggcagctgggggccaccagcggcctgccctgccctctggtctccc

SEQ ID NO: 52336 - DNA, 201 bp, Homo sapiens
tggtccagttggttccactccccctggaatgccggcccttccctcctttccatcctggcctcttggttagttcctatgcctcagaggagagggaagattgygcagccccatcactgtgtcggggcccagaagttcgttggctgacctggactttcttgcctcttccccaccagctggagagaaaggccaagcggaccagag

SEQ ID NO: 52337 - DNA, 201 bp, Homo sapiens
cgtggttaatgggctggtcctccatggtggacatcagccctccttgcccacttctgggtccttaaacagccaacggtcccacatacctccgatctcaggayctgggggacatgacggaggctggcccctgggatgaggtgaagcagtaacaatgtccagggccagagcttggcagctgggggccaccagcggcctgccctg

SEQ ID NO: 52338 - DNA, 201 bp, Homo sapiens
acctccgatctcaggatctgggggacatgacggaggctggcccctgggatgaggtgaagcagtaacaatgtccagggccagagcttggcagctgggggccrccagcggcctgccctgccctctggtctcccacatgtaggctgtgcaagttggccttttctaaaagggggcttgagatggaagagagggcaggacccggag

SEQ ID NO: 52339 - DNA, 201 bp, Homo sapiens
tgcctccacgagcctgcaccaaagtctcaagctttgtacactggataaagaaaaccatgaaacgctactaactacaggaagcaaactaagcccccgctgtratgaaacaccttctctggagccaagtccagatttacactgggagaggtgccagcaactgaataaatacctcttagctgagtggaaaagctggtttcttgt

SEQ ID NO: 52340 - DNA, 201 bp, Homo sapiens
ttcactgtctctgggctgtataccctgtgactccacccccatcctcactctgctctctgtgcagctccataaatgtcaccttgggggcccacaatatcaargaacaggagccgacccagcagtttatccctgtgaaaagacccatcccccatccagcctataatcctaagaacttctccaacgacatcatgctactgcagg

SEQ ID NO: 52341 - DNA, 201 bp, Homo sapiens; identical to SEQ ID NO: 11195

SEQ ID NO: 52342 - DNA, 201 bp, Homo sapiens
ggggactccttcacccactagactgtgatatttctctctggaaagagaagaggggactagactgagctggggagaaattagggcctctgcaaacttaccargaggcttatggtggatggtgcttctttggaaggatgaatttgcaacactccacccactccaggtcacagatattaggaaactgtgcccactgggggtgca

SEQ ID NO: 52343 - DNA, 201 bp, Homo sapiens
atttacagaaaatctgtgatgagacaccacaaaaccagaggggaacatgaagtcactgagcctgctccacctctttcctctcccaagagctaaaagagagyaaggaggaaacaacagcagctccaaccagggcagccttcctgagaagatgcaaccaatcctgcttctgctggccttcctcctgctgcccagggcagatgc

SEQ ID NO: 52344 - DNA, 201 bp, Homo sapiens
agaattccaattcctggggaccgactgtccccttaatttcccctcagctgcagccctgccccagctgtcacctgctcttcactgtctctgggctgtatacmctgtgactccacccccatcctcactctgctctctgtgcagctccataaatgtcaccttgggggcccacaatatcaaagaacaggagccgacccagcagtt

SEQ ID NO: 52345 - DNA, 201 bp, Homo sapiens
ttgggagaaagatgtttggggaatatctgagacctggagactcaagtagtgggggactccttcacccactagactgtgatatttctctctggaaagagaaraggggactagactgagctggggagaaattagggcctctgcaaacttaccaggaggcttatggtggatggtgcttctttggaaggatgaatttgcaacact

SEQ ID NO: 52346 - DNA, 201 bp, Homo sapiens
cagaaaatctgtgatgagacaccacaaaaccagaggggaacatgaagtcactgagcctgctccacctctttcctctcccaagagctaaaagagagcaaggrggaaacaacagcagctccaaccagggcagccttcctgagaagatgcaaccaatcctgcttctgctggccttcctcctgctgcccagggcagatgcaggtg

SEQ ID NO: 52347 - DNA, 201 bp, Homo sapiens
atcgggggacatgaggccaagccccactcccgcccctacatggcttatcttatgatctgggatcagaagtctctgaagaggtgcggtggcttcctgatacragacgacttcgtgctgacagctgctcactgttggggaaggtgaggagcagaaaacagcccacaccctcctggaaacactccacagagacccctgccttct

SEQ ID NO: 52348 - DNA, 201 bp, Homo sapiens
tgggggcccacaatatcaaagaacaggagccgacccagcagtttatccctgtgaaaagacccatcccccatccagcctataatcctaagaacttctccaaygacatcatgctactgcaggtgaggcacactcctgccactcttgctcttcttggtccagttggttccactccccctggaatgccggcccttccctcctttc

SEQ ID NO: 52349 - DNA, 201 bp, Homo sapiens
aatttcaaaacttacaagctacagtaattaaaacagcatggcaaaggcataaggatagacatatggatcaatggaatagattcagagtccagaaataaacwcaacatttatggccatttgatttttgataaggattgtcaagggggtcttgaacattcagtggggaaagaataatatcttcaacaagtggtgctggaacaa

SEQ ID NO: 52350 - DNA, 201 bp, Homo sapiens
atcctcactctgctctctgtgcagctccataaatgtcaccttgggggcccacaatatcaaagaacaggagccgacccagcagtttatccctgtgaaaagasccatcccccatccagcctataatcctaagaacttctccaacgacatcatgctactgcaggtgaggcacactcctgccactcttgctcttcttggtccagt

SEQ ID NO: 52351 - DNA, 201 bp, Homo sapiens; identical to SEQ ID NO: 11197

SEQ ID NO: 52352 - DNA, 201 bp, Homo sapiens
tcttattgcttttcttctagctcacctttgtggattttctcacctatgatatcttggatcagaaccgtatatttgaccccaagtgcctggatgagttcccraacctgaaggctttcatgtgccgttttgaggtgacgtttcctgcacctttctcttataaaaacactcacaggctcccctgggacctgcaggatcccatag

SEQ ID NO: 52353 - DNA, 201 bp, Homo sapiens; identical to SEQ ID NO: 11199

SEQ ID NO: 52354 - DNA, 201 bp, Homo sapiens
cttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatcttgg

SEQ ID NO: 52355 - DNA, 201 bp, Homo sapiens; identical to SEQ ID NO: 11200

SEQ ID NO: 52356 - DNA, 201 bp, Homo sapiens
acttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatcttg

SEQ ID NO: 52357 - DNA, 201 bp, Homo sapiens
gggccccgcccccttatgtcgggtataaagcccctcccgctcacagtttccctagtcctcgaaggctcggaagcccgtcaccatgtcgtgcgagtcgtctmtggttctcgggtactgggatattcgtggggtgagtgccgtctcaacggtagagccgctcggtcaaagagactgacgcggagagggcgggtctctgggtcc

SEQ ID NO: 52358 - DNA, 201 bp, Homo sapiens
tcacctttgtggattttctcacctatgatatcttggatcagaaccgtatatttgaccccaagtgcctggatgagttcccaaacctgaaggctttcatgtgycgttttgaggtgacgtttcctgcacctttctcttataaaaacactcacaggctcccctgggacctgcaggatcccatagtggaggattcttccccggctt

SEQ ID NO: 52359 - DNA, 201 bp, Homo sapiens
aagatcacccagagcaatgccatcttgcgctacatcgctcgcaagcacaacatgtgtgagtggggtagggctggtgagggaccccaggctggtagtttgtctgagagtggatgatgccaagggtgatttgttgtcatttggcctacaggtggtgagactgaagaagaaaagattcgagtggacatcatagagaaccaagta

SEQ ID NO: 52360 - DNA, 201 bp, Homo sapiens
tgaggtgagaggatcagttgaggccaggagtttaagaccagcctgggcaacatagtgagacccctgtctcccaaaaattttttttaattagctgtgcgcarttgctcatgcatagtcccagctacccaggaggctgaggtgggaggatcacttgagcccaggaatttgaagctgcagtgagctgtgttcttgccactgcac

SEQ ID NO: 52361 - DNA, 201 bp, Homo sapiens
ccatagtggaggattcttccccggcttttgcctaatgggatcaatggttggacacctctagacctttaagtcttgggaagagcctaacttctataccttgraggcactgtctacaaaaaaatggaggaggtagacgcaggcaacacgtgaatgttgctgttctggtatgcatctgttggactgggttggggtcgttataag

SEQ ID NO: 52362 - DNA, 201 bp, Homo sapiens
gtgcttttcgcgtcttcactggcaccattaatgaatgaagtctggctcccacccgcggggaagggaggagcctcaacctcgggtcctttgctctcctgcascactcctgcccgggtcccgcctcggggtcgccaggccctgaaccccaacgccggcattagtcgcgcctgcgcacggccctgtggagccgcggaggcaagg

SEQ ID NO: 52363 - DNA, 201 bp, Homo sapiens
tttagtagaggtggcgggcagaagggaaagccttcaagtatatccatccttgcctctctcctgcctggtacagaaggatgcaaaataggggatcttaaccyggatagaataaatagaattcaggggtccttgaactggatggatatgtattttcattcccattaaccactagcaaaagttatttccttttattgtgaagag

SEQ ID NO: 52364 - DNA, 201 bp, Homo sapiens
catctgtctctcacttacctgtgacctggaagcccaaccccctcccccctgctttgagttgtccccacctttctggatggaaccaatgtaccacttacatrtattgattgacgtctcgtgtctccctaaaatgtataaaactaagccgtgccccaaccacctggggcacatgtcatcagggcttcctgaggctatgtcaca

SEQ ID NO: 52365 - DNA, 201 bp, Homo sapiens; identical to SEQ ID NO: 11202

SEQ ID NO: 52366 - DNA, 201 bp, Homo sapiens; identical to SEQ ID NO: 11203

SEQ ID NO: 52367 - DNA, 201 bp, Homo sapiens; identical to SEQ ID NO: 11205

SEQ ID NO: 52368 - DNA, 201 bp, Homo sapiens; identical to SEQ ID NO: 11207

SEQ ID NO: 52369 - DNA, 201 bp, Homo sapiens
ttcctttcaggctttggagaaaatcgctgcctacttacagtctgatcagttctgcaagatgcccatcaacaacaagatggcccagtggggcaacaagcctrtatgctgagcaggaggcagacttgcagagcttgttttgtttcatcctgtccgtaaggggtcagcgctcttgctttgctcttttcaatgaatagcacttat

SEQ ID NO: 52370 - DNA, 201 bp, Homo sapiens
taccttggaggcactgtctacaaaaaaatggaggaggtagacgcaggcaacacgtgaatgttgctgttctggtatgcatctgttggactgggttggggtckttataagatttggtgtattttcctttcaggctttggagaaaatcgctgcctacttacagtctgatcagttctgcaagatgcccatcaacaacaagatggc

SEQ ID NO: 52371 - DNA, 201 bp, Homo sapiens
acatcatagagaaccaagtaatggatttccgcacacaactgataaggctctgttacagctctgaccacgtgagtttccttagcacacatctgctgaatggmgtatcagaaaaaggggtatttaggaacccaagggttatctctgttccattctgctgctgctaccttcccaccaatccagattgttagaataagaaacaga

SEQ ID NO: 52372 - DNA, 201 bp, Homo sapiens
tacttggaagagctacctggacaactgaaacaattctccatgtttctggggaaattctcatggtttgccggggaaaaggtaggaagaagggaaaagaagaggatacttctctatctctgcaggctactactcctcagacctaagcatcttattgcttttcttctagctcacctttgtggattttctcacctatgatatctt

SEQ ID NO: 52373 - DNA, 201 bp, Homo sapiens
ggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacttt

SEQ ID NO: 52374 - DNA, 201 bp, Homo sapiens
ccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccct

SEQ ID NO: 52375 - DNA, 201 bp, Homo sapiens
cctcagttctggtaagctggaggggttatgggtgggaatatctccatccccagagaaggtcaagtgctggagggagcgggtggagaacctggcctaggggrcctgctgctgggtgcgtttctgcagggagcaagggtagaagaattgggaggtggagtagagaggaaaagttagggtcagtggcagagccaggcagatgct

SEQ ID NO: 52376 - DNA, 201 bp, Homo sapiens
aaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggagcccctgggcccccaatctct

SEQ ID NO: 52377 - DNA, 201 bp, Homo sapiens
ttatttccattctttctgtctgtctcttcaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 52378 - DNA, 201 bp, Homo sapiens
tatttccattctttctgtctgtctcttcaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 52379 - DNA, 201 bp, Homo sapiens
tcttccgcacccagcgcgtcgacctttaccagcaggtgaaggagaaacccttgtggccccaactctaaattcgagttgccacctgatttcctgtccttccrtctcatcgctgacctctcactgtgactcactctttaacacatgcctgtcccctaggcctccccaccagatgccctgcgctggatacctaagccttgggag

SEQ ID NO: 52380 - DNA, 201 bp, Homo sapiens
gaatggactgagagacctgtcgtccggcttgcttagggagctggaggtatcgagtaaagaaacactggtgatggacatttttaatgaggataggaaaacgragatggctctggccttggccctctgttttctggcccatggttacagggtgctaaggtggctccataatgctttttctcagttcttcatatggtaaaacag

SEQ ID NO: 52381 - DNA, 201 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaa

SEQ ID NO: 52382 - DNA, 201 bp, Homo sapiens
taccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattg

SEQ ID NO: 52383 - DNA, 201 bp, Homo sapiens
atggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggca

SEQ ID NO: 52384 - DNA, 201 bp, Homo sapiens
gaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttc

SEQ ID NO: 52385 - DNA, 201 bp, Homo sapiens
agaaaaccagagctgctacaggaggtaagggatgggtttgagattgtgcttcactgcactcttactcgtgaaaattcttctgggttatgttttctctgttytctttcctgtttctttcactgtgtttttactccagaattctcagtattagtctcccatgtgtctcccttgttgtccccacaccctgtgtcaccccactct

SEQ ID NO: 52386 - DNA, 201 bp, Homo sapiens
tactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaa

SEQ ID NO: 52387 - DNA, 201 bp, Homo sapiens
caggtgaaggagaaacccttgtggccccaactctaaattcgagttgccacctgatttcctgtccttccgtctcatcgctgacctctcactgtgactcactstttaacacatgcctgtcccctaggcctccccaccagatgccctgcgctggatacctaagccttgggagcggacagggccgccacctcgagaagggccctc

SEQ ID NO: 52388 - DNA, 201 bp, Homo sapiens
tcgtgtcgagccactcccactctagaatcctgcttttatcccagcatctttgctttctatgttgctcagtcgccctatgtctgctttttcatttttcctgktcctcgtctcctttctcccccaaccccgtttttcttcttgggcctctgcccccttacttcgttgtctacatcctttttttttttgccattcctgtttcca

SEQ ID NO: 52389 - DNA, 201 bp, Homo sapiens
cccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 52390 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcgg

SEQ ID NO: 52391 - DNA, 201 bp, Homo sapiens
ggtctcaaagaagaccaggataatgagtttgtcaccacccagagagatcaaccccaaagcctgggtcgttgcatcctgcaagtagcgacagttgatttgtygtaaaagagatgatagaaagcatagtaactgattcccctggccctgctgggtcttgccaattgacaggatcgtgggggtcctccctgcaagcccccagca

SEQ ID NO: 52392 - DNA, 201 bp, Homo sapiens
tactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatc

SEQ ID NO: 52393 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttgg

SEQ ID NO: 52394 - DNA, 201 bp, Homo sapiens; identical to SEQ ID NO: 11274

SEQ ID NO: 52395 - DNA, 201 bp, Homo sapiens; identical to SEQ ID NO: 11275

SEQ ID NO: 52396 - DNA, 201 bp, Homo sapiens; identical to SEQ ID NO: 11276

SEQ ID NO: 52397 - DNA, 201 bp, Homo sapiens
caggcattgtggctcacgcctgtaatcccagcacttagggaggccgaggtgggcagatcaactgagttcaggagttcgagaccaccatggctaacgtggtraaaccccatttctactaaaaatacaaaaaagtagccggcgtggtggcgctcgcctgtagtcccagctactcgggagactgaggcaggagaaacgcttgaa

SEQ ID NO: 52398 - DNA, 201 bp, Homo sapiens; identical to SEQ ID NO: 11248

SEQ ID NO: 52399 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaaggtgggtaggaacaaacaaatttattgt

SEQ ID NO: 52400 - DNA, 201 bp, Homo sapiens; identical to SEQ ID NO: 11252

SEQ ID NO: 52401 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagg

SEQ ID NO: 52402 - DNA, 201 bp, Homo sapiens; identical to SEQ ID NO: 11253

SEQ ID NO: 52403 - DNA, 201 bp, Homo sapiens
atggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttcc

SEQ ID NO: 52404 - DNA, 201 bp, Homo sapiens; identical to SEQ ID NO: 11256

SEQ ID NO: 52405 - DNA, 201 bp, Homo sapiens; identical to SEQ ID NO: 11254

SEQ ID NO: 52406 - DNA, 201 bp, Homo sapiens
atgcataggaacccttagaaggactcaaaaacacctggactttaatagggaagagaataggttgtaagcagaagttgggaaacataacttgtgggaaaaartaacgatttagtggatactggagctaatgctctgttttctccagtcgtcctccagaggagcgtcccccggggcttcccctgcctcccccacctcccagca

SEQ ID NO: 52407 - DNA, 201 bp, Homo sapiens
tatgtattcattgctggttctttgctttccagtctgtgcatctgtatgcataggaacccttagaaggactcaaaaacacctggactttaatagggaagagrataggttgtaagcagaagttgggaaacataacttgtgggaaaaagtaacgatttagtggatactggagctaatgctctgttttctccagtcgtcctccag

SEQ ID NO: 52408 - DNA, 201 bp, Homo sapiens
gttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatctt

SEQ ID NO: 52409 - DNA, 201 bp, Homo sapiens
ctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtg

SEQ ID NO: 52410 - DNA, 201 bp, Homo sapiens
ctagaagctagtggacttaaggcattgctaggactctggcttcctaacagcttttctccccacaatttattttcagatcacagcccctatacctacccccsggcccagcccctccctcagcactgctctctggggtagctctcaagggccagtttctggatttctccacaatgcaagctacagagctggggaagttgccgg

SEQ ID NO: 52411 - DNA, 201 bp, Homo sapiens
cctttccctcccccaatgcactttactgtgtgcccaatccaggagctgccccgggagcagcctctgccccctggccccattggcacagaacgatcacagcrtacagaccgaggcacagagcctggccccattcggccatcccatcgacctggtcccccagtccagtttggcactagtgacaaggtctgtgtgggctggatc

SEQ ID NO: 52412 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggtaagggatgggtttgagattgtgcttcactgcactcttactcgtgaaaattcttctgggttatgtttt

SEQ ID NO: 52413 - DNA, 201 bp, Homo sapiens
actggaaagcggttggtagggtgttagagtcaagaacacccacctatgtattcattgctggttctttgctttccagtctgtgcatctgtatgcataggaayccttagaaggactcaaaaacacctggactttaatagggaagagaataggttgtaagcagaagttgggaaacataacttgtgggaaaaagtaacgatttag

SEQ ID NO: 52414 - DNA, 201 bp, Homo sapiens
gacctctcactgtgactcactctttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 52415 - DNA, 201 bp, Homo sapiens
cgcgtctactgccttcccacggtgttccagcagaacggcacaactaacccacagccaaacacacacacacacacacacacacacacacacacacacacacmcaccaccccgcggctccgcccccgacttccccacggaccgtcacttccggtctcccccaaacctgccaccgacggccacttccgtttccccgatagtatt

SEQ ID NO: 52416 - DNA, 201 bp, Homo sapiens
ggctaaggcaactggaaagcggttggtagggtgttagagtcaagaacacccacctatgtattcattgctggttctttgctttccagtctgtgcatctgtaygcataggaacccttagaaggactcaaaaacacctggactttaatagggaagagaataggttgtaagcagaagttgggaaacataacttgtgggaaaaagt

SEQ ID NO: 52417 - DNA, 201 bp, Homo sapiens
ttacacaactccagcaaccgggccccaaatccactatctgtgggcaaaatacaaggagggaatgctggcacgtggcagccctgcacatgcaacaggccccmcttgcccccgcctggccagcccctgacctgtgcaatgcagcacatgcgcagcaatgctattaaactgctcttggagaaattccaggtttgtccggatgat

SEQ ID NO: 52418 - DNA, 201 bp, Homo sapiens
ttatttcttaaatactgtgaaggaagaggggggaaacggtcccctgatgaggaagggccatagagcaaagagctaaggatcatcagcaaaggcccgctggscattggggaagcgctggggactgtagttggggtcttcctgcagtcgtttttgtatatcagaccggagctaaagagaaaaagtaagcaggttggagaaacg

SEQ ID NO: 52419 - DNA, 201 bp, Homo sapiens
gcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggaggga

SEQ ID NO: 52420 - DNA, 201 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgattttttt

SEQ ID NO: 52421 - DNA, 201 bp, Homo sapiens
gatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcc

SEQ ID NO: 52422 - DNA, 201 bp, Homo sapiens
aaagttgccattgcccggcgtatgccacctccagccaaccttccaagcctgaaagccgagaacaaaggcaatgaccccaatgtctcactagtgccaaaagwcggaacaggatgggcaagcaaacaggagcagtccgaccccaagaggtagacagaggcttgggggacctagagtgatgggtattttaacttgaacttcagg

SEQ ID NO: 52423 - DNA, 201 bp, Homo sapiens
caagaggtagacagaggcttgggggacctagagtgatgggtattttaacttgaacttcagggagcattggggcttggtttagtccagccacgtctgagccrgagacgaagaggtccctttcttacctattgcaggttccttgttaaatgactaaggaatggtactaaactttagctttttgtcttggagagagagcatgaa

SEQ ID NO: 52424 - DNA, 201 bp, Homo sapiens
ctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatg

SEQ ID NO: 52425 - DNA, 201 bp, Homo sapiens
ccccgcgcacccggccaggtgagtctgggtgaaccgtgcgctgacgcccttttccggcgcgggagaggtggtggcggtggcggtggcggcggcggcggcgktggtgggccggggggaggagaagctgccattagccgccgccattttgtcctcctgctgccgggcctgcttgcccctccccctccggtacctctactccgg

SEQ ID NO: 52426 - DNA, 201 bp, Homo sapiens
ttcgtgtcgagccactcccactctagaatcctgcttttatcccagcatctttgctttctatgttgctcagtcgccctatgtctgctttttcatttttcctkttcctcgtctcctttctcccccaaccccgtttttcttcttgggcctctgcccccttacttcgttgtctacatcctttttttttttgccattcctgtttcc

SEQ ID NO: 52427 - DNA, 201 bp, Homo sapiens
ccctcctggtgtgcatccctctggtaagggggcatgggaggagtgagaaacaggaaagtcccctcagtcttaggcattggatattagggtcttactgtgaytctggtacgataggttttgcccatcatagtgatgagggaagggcatatgcttggcactgctgagatagctctgttgcaaaaatgggcttagttaagaaat

SEQ ID NO: 52428 - DNA, 201 bp, Homo sapiens
cctctcccaagaaccgaaggtgggtaggaacaaacaaatttattgtggtttaaaaattggaggagggggaaaaagcctgagggaaagataagtttgggtgkagtggagattgtggcctgaggggccatgggctctagaatgtcagtaggatttccatgtctggctaaggcaactggaaagcggttggtagggtgttagagt

SEQ ID NO: 52429 - DNA, 201 bp, Homo sapiens
gggccaggacgaggcgacaagaggagctggccctctcccaagaaccgaaggtgggtaggaacaaacaaatttattgtggtttaaaaattggaggagggggraaaagcctgagggaaagataagtttgggtggagtggagattgtggcctgaggggccatgggctctagaatgtcagtaggatttccatgtctggctaaggc

SEQ ID NO: 52430 - DNA, 201 bp, Homo sapiens
gagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttg

SEQ ID NO: 52431 - DNA, 201 bp, Homo sapiens
tacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatg

SEQ ID NO: 52432 - DNA, 201 bp, Homo sapiens
tgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagt

SEQ ID NO: 52433 - DNA, 201 bp, Homo sapiens
gaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagg

SEQ ID NO: 52434 - DNA, 201 bp, Homo sapiens
aactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgag

SEQ ID NO: 52435 - DNA, 201 bp, Homo sapiens
ttgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaa

SEQ ID NO: 52436 - DNA, 201 bp, Homo sapiens
gaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactcc

SEQ ID NO: 52437 - DNA, 201 bp, Homo sapiens
accaggataatgagtttgtcaccacccagagagatcaaccccaaagcctgggtcgttgcatcctgcaagtagcgacagttgatttgttgtaaaagagatgrtagaaagcatagtaactgattcccctggccctgctgggtcttgccaattgacaggatcgtgggggtcctccctgcaagcccccagcacctgaagatgagg

SEQ ID NO: 52438 - DNA, 201 bp, Homo sapiens
ttgagagctctatgctagtgtgcacctggaatatgctcccaactcaaaatacaggttttttatttatatataaagtgctttcgcacaaaaaatacaaacarcaggctgggcgcggtggcccacgcctgtaattccagcactttgggaggccaaggcgggtggatcacaaggtcaggagttcgagaccagcctggccaatat

SEQ ID NO: 52439 - DNA, 201 bp, Homo sapiens
agtgtgcacctggaatatgctcccaactcaaaatacaggttttttatttatatataaagtgctttcgcacaaaaaatacaaacatcaggctgggcgcggtygcccacgcctgtaattccagcactttgggaggccaaggcgggtggatcacaaggtcaggagttcgagaccagcctggccaatatggtgaaaccctgtctc

SEQ ID NO: 52440 - DNA, 201 bp, Homo sapiens
gaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcggcctcccagaaaaccagagctgctacaggaggtaagggatggg

SEQ ID NO: 52441 - DNA, 201 bp, Homo sapiens
ccccctaaacgtcgggagcggcctcccagaaaaccagagctgctacaggaggtaagggatgggtttgagattgtgcttcactgcactcttactcgtgaaawttcttctgggttatgttttctctgttttctttcctgtttctttcactgtgtttttactccagaattctcagtattagtctcccatgtgtctcccttgttg

SEQ ID NO: 52442 - DNA, 201 bp, Homo sapiens
tggactgagagacctgtcgtccggcttgcttagggagctggaggtatcgagtaaagaaacactggtgatggacatttttaatgaggataggaaaacgaagrtggctctggccttggccctctgttttctggcccatggttacagggtgctaaggtggctccataatgctttttctcagttcttcatatggtaaaacagtat

SEQ ID NO: 52443 - DNA, 201 bp, Homo sapiens
  misc_feature (1)...(201): n = A,T,C or G, or insertion/deletion polymorphism (see Tables 1-2)
cacagcaaccctgctggcatccaacaggctctggcccagcttagtagccgtcaagggagtgtaactgcaccagggggtcatccaaggcacaagcctgggcntccccaagcccctcagggcccctctcctaggcccccaacccgatacgagccccagagggtcaacagcggcctcagttctggtaagctggaggggttatgg

SEQ ID NO: 52444 - DNA, 201 bp, Homo sapiens
ggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctttctaccctgacttaactagctccttctccactcctct

SEQ ID NO: 52445 - DNA, 201 bp, Homo sapiens
ggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtagg

SEQ ID NO: 52446 - DNA, 201 bp, Homo sapiens
attattacttgtagggaattactctttgtagacaggcacaaagggcagagtgtttatactaggaggatgctggatttttacttagatttccttgacaaagktgtctgggggaaaggagggaacatggcatttgagctatgagggagctaagtagatcatggttgcttaagaagagtgggcagtttacatagactggaggaa

SEQ ID NO: 52447 - DNA, 201 bp, Homo sapiens
attggcacagaacgatcacagcgtacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaat

SEQ ID NO: 52448 - DNA, 201 bp, Homo sapiens
cgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttc

SEQ ID NO: 52449 - DNA, 201 bp, Homo sapiens
agggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaa

SEQ ID NO: 52450 - DNA, 201 bp, Homo sapiens
agagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgaggtaagtgggagtaagagtttggtggaaaggcccaagatttctgggga

SEQ ID NO: 52451 - DNA, 201 bp, Homo sapiens
ccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagtaagcaggttggagaaacgctggccaagtccctatgatcccagcaagcacacaaggccat

SEQ ID NO: 52452 - DNA, 201 bp, Homo sapiens
tcagcaaaggcccgctgggcattggggaagcgctggggactgtagttggggtcttcctgcagtcgtttttgtatatcagaccggagctaaagagaaaaagyaagcaggttggagaaacgctggccaagtccctatgatcccagcaagcacacaaggccatccctcagaagctaacatttccccccccaagcacactgtcaa

SEQ ID NO: 52453 - DNA, 201 bp, Homo sapiens
gtgctttgggagtgttaggtgagaggatcgcttgaagccaggagttcaagaccagcctgggcaacacagcaagaccccccacctctacaaaaaaaaaaaawttttttagttgggtgtggactgtgcatctgtggtcccagctactctggaggttgtggtgggaggatcagttgagcccaggagttggaggtcacagtgagc

SEQ ID NO: 52454 - DNA, 201 bp, Homo sapiens
aatgtctcctgccttcttgtgatcacaggactcagacttacgcctagtggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgag

SEQ ID NO: 52455 - DNA, 201 bp, Homo sapiens
ggcattggggaagcgctggggactgtagttggggtcttcctgcagtcgtttttgtatatcagaccggagctaaagagaaaaagtaagcaggttggagaaasgctggccaagtccctatgatcccagcaagcacacaaggccatccctcagaagctaacatttccccccccaagcacactgtcaaatagcccggggtggcac

SEQ ID NO: 52456 - DNA, 201 bp, Homo sapiens
cagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaagg

SEQ ID NO: 52457 - DNA, 201 bp, Homo sapiens
tctggcttcctaacagcttttctccccacaatttattttcagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 52458 - DNA, 201 bp, Homo sapiens
acatgaggtcaggagttcaagatcagcctggccaacatagtgaaacccgtctctactaaaaatacaaaaattagccaagtgtggtggcatgtgcttgtagycccagctgcttgggaggctgaggtagtagaatcgctttaacccgggaggcagagatttctgtgagccaagaccatgccattgcactccagcctgggtgac

SEQ ID NO: 52459 - DNA, 201 bp, Homo sapiens
caacatagtgaaacccgtctctactaaaaatacaaaaattagccaagtgtggtggcatgtgcttgtagtcccagctgcttgggaggctgaggtagtagaaycgctttaacccgggaggcagagatttctgtgagccaagaccatgccattgcactccagcctgggtgacagagcaagactctgtctcaaaaaaaaatcctg

SEQ ID NO: 52460 - DNA, 201 bp, Homo sapiens
acatagtgaaacccgtctctactaaaaatacaaaaattagccaagtgtggtggcatgtgcttgtagtcccagctgcttgggaggctgaggtagtagaatcsctttaacccgggaggcagagatttctgtgagccaagaccatgccattgcactccagcctgggtgacagagcaagactctgtctcaaaaaaaaatcctgtc

SEQ ID NO: 52461 - DNA, 201 bp, Homo sapiens
aatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctg

SEQ ID NO: 52462 - DNA, 201 bp, Homo sapiens
tctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaag

SEQ ID NO: 52463 - DNA, 201 bp, Homo sapiens
acacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtc

SEQ ID NO: 52464 - DNA, 201 bp, Homo sapiens
gaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacaccca

SEQ ID NO: 52465 - DNA, 201 bp, Homo sapiens
cttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgagg

SEQ ID NO: 52466 - DNA, 201 bp, Homo sapiens
ttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctg

SEQ ID NO: 52467 - DNA, 201 bp, Homo sapiens
ccttgttaaatgactaaggaatggtactaaactttagctttttgtcttggagagagagcatgaaaaaatagacaacagcctacaaaggatgacaaaattawtttgtccttatatttgtaaatggtagcaatgggcatgatttcagtcctgagtctccaccagttggagaagtcagggaggcatctcaggtgtgaataacct

SEQ ID NO: 52468 - DNA, 201 bp, Homo sapiens
ctaccagatgtcagatcactgcttcaaggtgcttaaaggtgcagggtggtaaggctggggataaatgaagtagaaggcagttgttttggtttattggactrtcagtgatagtgttctatcatttgtatatctgaaggagggaaggttttgtctggaatcttaggttgtagtctaataccatttcttggcagagtactgtag

SEQ ID NO: 52469 - DNA, 201 bp, Homo sapiens
taaagggggtgtgggctctgggtgaacaccagttatcctcctacaaaggcgtgtctgtggttccctgtctttggacacgtaagaattggaggaaaataaakgtggatttgggaaactttgaggccagcttgcttcttgcaggctcatgatcaaccaatctcacataaaagtattgaatgttacatatctcagccttcttga

SEQ ID NO: 52470 - DNA, 201 bp, Homo sapiens
gctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcc

SEQ ID NO: 52471 - DNA, 201 bp, Homo sapiens
tgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgtta

SEQ ID NO: 52472 - DNA, 201 bp, Homo sapiens
cctcctctttatgcaaataacctccgcatgctccgcgcgcccggcccttttttttttttttttaaactaaagacagccctggaagtagagggttagggtakaaagtgccccgccctttatgcaaattaaggggcgtgtctaggcgcggagggaggtgggaggtgggagggggtgctcccgggggcggcggttgcccggatg

SEQ ID NO: 52473 - DNA, 201 bp, Homo sapiens
ctccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggat

SEQ ID NO: 52474 - DNA, 201 bp, Homo sapiens
tagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcaaagggatgcgagagctggaactcttaccaggc

SEQ ID NO: 52475 - DNA, 201 bp, Homo sapiens
ccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctg

SEQ ID NO: 52476 - DNA, 201 bp, Homo sapiens
aaaatacaaaaattagccaagtgtggtggcatgtgcttgtagtcccagctgcttgggaggctgaggtagtagaatcgctttaacccgggaggcagagattyctgtgagccaagaccatgccattgcactccagcctgggtgacagagcaagactctgtctcaaaaaaaaatcctgtctcacaagaaatacataaataaaaa

SEQ ID NO: 52477 - DNA, 201 bp, Homo sapiens; identical to SEQ ID NO: 11268

SEQ ID NO: 52478 - DNA, 201 bp, Homo sapiens
gcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgag

SEQ ID NO: 52479 - DNA, 201 bp, Homo sapiens
cacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgaga

SEQ ID NO: 52480 - DNA, 201 bp, Homo sapiens
acttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagat

SEQ ID NO: 52481 - DNA, 201 bp, Homo sapiens
aaacggagcttctcaagtcagcggccaggcatggaacggcagaatcggcgccctggcccagggggcaaggctggcagcagtggcagcagcagtggaggagscggtgggggtcctggaggaaggaccgggccaggacgaggcgacaagaggagctggccctctcccaagaaccgaaggtgggtaggaacaaacaaatttatt

SEQ ID NO: 52482 - DNA, 201 bp, Homo sapiens
acctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttg

SEQ ID NO: 52483 - DNA, 201 bp, Homo sapiens
tggctgcataagaagctgccccacaaggccgctcaccatctgggccaacgaggcattggtacccagaccggcgccctgctggatagagagcaagggagaayttcagacctgcccttccatgcaccaccacaggagtctctccctagactgttacgcactagaactccccgacccttgctcaccagtgtcccagagactggg

SEQ ID NO: 52484 - DNA, 201 bp, Homo sapiens
cactggtgatggacatttttaatgaggataggaaaacgaagatggctctggccttggccctctgttttctggcccatggttacagggtgctaaggtggctycataatgctttttctcagttcttcatatggtaaaacagtatttcatctggaggcgattttttccaggagccaatacaggagcaagtttaggaaaagatgg

SEQ ID NO: 52485 - DNA, 201 bp, Homo sapiens
ccacatgaggcattttcgaccctctctccgtcttgttctccagttgcccctcgccatggcctgcagagtctcgggaaagttgccattgcccggcgtatgcsacctccagccaaccttccaagcctgaaagccgagaacaaaggcaatgaccccaatgtctcactagtgccaaaagacggaacaggatgggcaagcaaacag

SEQ ID NO: 52486 - DNA, 201 bp, Homo sapiens
tcccaactttacactgggtcctttaaagggggtgtgggctctgggtgaacaccagttatcctcctacaaaggcgtgtctgtggttccctgtctttggacaygtaagaattggaggaaaataaatgtggatttgggaaactttgaggccagcttgcttcttgcaggctcatgatcaaccaatctcacataaaagtattgaat

SEQ ID NO: 52487 - DNA, 201 bp, Homo sapiens
tgactaaggaatggtactaaactttagctttttgtcttggagagagagcatgaaaaaatagacaacagcctacaaaggatgacaaaattaatttgtccttrtatttgtaaatggtagcaatgggcatgatttcagtcctgagtctccaccagttggagaagtcagggaggcatctcaggtgtgaataaccttcccattctg

SEQ ID NO: 52488 - DNA, 201 bp, Homo sapiens
tagaaggcagttgttttggtttattggactatcagtgatagtgttctatcatttgtatatctgaaggagggaaggttttgtctggaatcttaggttgtagyctaataccatttcttggcagagtactgtagctcacgcctataatcccaacacttagggaggcttggggtggaggatcgcttgagcctagggagtttgaga

SEQ ID NO: 52489 - DNA, 201 bp, Homo sapiens
ccttttgaggatgtggctggcacagaagtgagtgagggtgggagggtgtgtctgagctgggacttttttgagcactggtcataccccccacctgctctggkttgagtctggagctgttctctcacttggctgtcccctttctgcagtttgtatgtgtgcatcagtcaggtattggggtgctttctaccctgacttaactag

SEQ ID NO: 52490 - DNA, 201 bp, Homo sapiens
ccaatgcactttactgtgtgcccaatccaggagctgccccgggagcagcctctgccccctggccccattggcacagaacgatcacagcgtacagaccgagscacagagcctggccccattcggccatcccatcgacctggtcccccagtccagtttggcactagtgacaaggtctgtgtgggctggatctgggtatcctga

SEQ ID NO: 52491 - DNA, 201 bp, Homo sapiens
gggttgatatatttctccctgtttcccgacaggtacgccaggatctgccatccccttcggatttttattctactcctctgcagcctggtggccaaagtggmtttctcccttcaggggctcctgcccagcaggtatattgtatcttcacacttccccttcatttgatttctctgtccagttgctggctttgattttccctgg

SEQ ID NO: 52492 - DNA, 201 bp, Homo sapiens
gccattgcactccagcctgggtgacagagcaagactctgtctcaaaaaaaaatcctgtctcacaagaaatacataaataaaaatgaaaactatttcctatrggccaagactgaagaaagtactgttgttctaatggtttcatagaaagttaatgccaccaccataggctcatgagaggccatgaagtgctttaatgggtct

SEQ ID NO: 52493 - DNA, 201 bp, Homo sapiens
gcctcagttctggtaagctggaggggttatgggtgggaatatctccatccccagagaaggtcaagtgctggagggagcgggtggagaacctggcctagggrccctgctgctgggtgcgtttctgcagggagcaagggtagaagaattgggaggtggagtagagaggaaaagttagggtcagtggcagagccaggcagatgc

SEQ ID NO: 52494 - DNA, 201 bp, Homo sapiens
tttgtccagttgtctccattgtcacgccaatttcccctagtccaagttttttctttgctgattcctttgtccatgtgtgctttgagcctctctcatcttgyctttcctcctttcctaggagcagctcctgaagcagcagcagcagcaccagtggcagcagcatcaacagggctctgcccctcctaccccagtgcccccatc

SEQ ID NO: 52495 - DNA, 201 bp, Homo sapiens
tggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggc

SEQ ID NO: 52496 - DNA, 201 bp, Homo sapiens
gtgtgcatccctctggtaagggggcatgggaggagtgagaaacaggaaagtcccctcagtcttaggcattggatattagggtcttactgtgactctggtaygataggttttgcccatcatagtgatgagggaagggcatatgcttggcactgctgagatagctctgttgcaaaaatgggcttagttaagaaataagcagtg

SEQ ID NO: 52497 - DNA, 201 bp, Homo sapiens
ttctggtaagctggaggggttatgggtgggaatatctccatccccagagaaggtcaagtgctggagggagcgggtggagaacctggcctaggggccctgcygctgggtgcgtttctgcagggagcaagggtagaagaattgggaggtggagtagagaggaaaagttagggtcagtggcagagccaggcagatgctgaccct

SEQ ID NO: 52498 - DNA, 201 bp, Homo sapiens
ccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctc

SEQ ID NO: 52499 - DNA, 201 bp, Homo sapiens; identical to SEQ ID NO: 11266

SEQ ID NO: 52500 - DNA, 201 bp, Homo sapiens
gattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagac

SEQ ID NO: 52501 - DNA, 201 bp, Homo sapiens
taccccccacctgctctgggttgagtctggagctgttctctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccc

SEQ ID NO: 52502 - DNA, 201 bp, Homo sapiens
gaaaaagtaagcaggttggagaaacgctggccaagtccctatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatcc

SEQ ID NO: 52503 - DNA, 201 bp, Homo sapiens
tctactaaaaatacaaaaaagtagccggcgtggtggcgctcgcctgtagtcccagctactcgggagactgaggcaggagaaacgcttgaacccaggaggtkgaggttgtagtgagccgagattgtgccatcgcactccagcttaggcaacgagcgaaactccgtctcaaaaatgaatgaatgaatagcacaactccatctc

SEQ ID NO: 52504 - DNA, 201 bp, Homo sapiens
ggccaggacgaggcgacaagaggagctggccctctcccaagaaccgaaggtgggtaggaacaaacaaatttattgtggtttaaaaattggaggagggggaraaagcctgagggaaagataagtttgggtggagtggagattgtggcctgaggggccatgggctctagaatgtcagtaggatttccatgtctggctaaggca

SEQ ID NO: 52505 - DNA, 201 bp, Homo sapiens
ctggggactgtagttggggtcttcctgcagtcgtttttgtatatcagaccggagctaaagagaaaaagtaagcaggttggagaaacgctggccaagtcccyatgatcccagcaagcacacaaggccatccctcagaagctaacatttccccccccaagcacactgtcaaatagcccggggtggcactgtcaagccttccca

SEQ ID NO: 52506 - DNA, 201 bp, Homo sapiens
tctgccatccccttcggatttttattctactcctctgcagcctggtggccaaagtggctttctcccttcaggggctcctgcccagcaggtatattgtatcktcacacttccccttcatttgatttctctgtccagttgctggctttgattttccctggttttctgacattcctccctgcccccaacatgcacacccaaatt

SEQ ID NO: 52507 - DNA, 201 bp, Homo sapiens
cagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagac

SEQ ID NO: 52508 - DNA, 201 bp, Homo sapiens
acaggctgtcagaaagcagtgacactaattactatactttctttttctaaacctcattttcttcatctttaaaatgaaaggttcagagtcaatgaattccyagggccccttcccctaacatgtcactaggggctcttacccagtggttatgtaatggcaagaaggtaccactgcctggctgggccgggggacaggaagatg

SEQ ID NO: 52509 - DNA, 201 bp, Homo sapiens
tttccaagtgcttccttactttggaaccagggtctggatcctaggcttgccttagacgcccttcttcccttaggtccttctctggcctcaattcccgtctsaaggccacgccttccacctacagtggagtcttccgcacccagcgcgtcgacctttaccagcaggtgaaggagaaacccttgtggccccaactctaaattc

SEQ ID NO: 52510 - DNA, 201 bp, Homo sapiens
gactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccga

SEQ ID NO: 52511 - DNA, 201 bp, Homo sapiens
actgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgat

SEQ ID NO: 52512 - DNA, 201 bp, Homo sapiens
ccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaag

SEQ ID NO: 52513 - DNA, 201 bp, Homo sapiens
cttccacctacagtggagtcttccgcacccagcgcgtcgacctttaccagcaggtgaaggagaaacccttgtggccccaactctaaattcgagttgccacytgatttcctgtccttccgtctcatcgctgacctctcactgtgactcactctttaacacatgcctgtcccctaggcctccccaccagatgccctgcgctgg

SEQ ID NO: 52514 - DNA, 201 bp, Homo sapiens
cgaacccggcgccatccgccgccatcctcccccgccccaccgccatcccgtcccggggagcccctaggcccgggtcccggatccccgcgcacccggccagktgagtctgggtgaaccgtgcgctgacgcccttttccggcgcgggagaggtggtggcggtggcggtggcggcggcggcggcggtggtgggccggggggagg

SEQ ID NO: 52515 - DNA, 201 bp, Homo sapiens
cgccatcctcccccgccccaccgccatcccgtcccggggagcccctaggcccgggtcccggatccccgcgcacccggccaggtgagtctgggtgaaccgtkcgctgacgcccttttccggcgcgggagaggtggtggcggtggcggtggcggcggcggcggcggtggtgggccggggggaggagaagctgccattagccgc

SEQ ID NO: 52516 - DNA, 201 bp, Homo sapiens
ccatcctcccccgccccaccgccatcccgtcccggggagcccctaggcccgggtcccggatccccgcgcacccggccaggtgagtctgggtgaaccgtgcsctgacgcccttttccggcgcgggagaggtggtggcggtggcggtggcggcggcggcggcggtggtgggccggggggaggagaagctgccattagccgccg

SEQ ID NO: 52517 - DNA, 201 bp, Homo sapiens
gaaaaccctccagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccac

SEQ ID NO: 52518 - DNA, 201 bp, Homo sapiens
atccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcac

SEQ ID NO: 52519 - DNA, 201 bp, Homo sapiens
cagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatgggga

SEQ ID NO: 52520 - DNA, 201 bp, Homo sapiens
cctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtgggga

SEQ ID NO: 52521 - DNA, 201 bp, Homo sapiens
tcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcact

SEQ ID NO: 52522 - DNA, 201 bp, Homo sapiens
gtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtggga

SEQ ID NO: 52523 - DNA, 201 bp, Homo sapiens
cagaccggcgccctgctggatagagagcaagggagaacttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggtt

SEQ ID NO: 52524 - DNA, 201 bp, Homo sapiens
tggggaagaatgaaaactcacccacaaggactggctgcataagaagctgccccacaaggccgctcaccatctgggccaacgaggcattggtacccagaccrgcgccctgctggatagagagcaagggagaacttcagacctgcccttccatgcaccaccacaggagtctctccctagactgttacgcactagaactccccg

SEQ ID NO: 52525 - DNA, 201 bp, Homo sapiens
gaaacggaatagggatgtggactttccaagtgcttccttactttggaaccagggtctggatcctaggcttgccttagacgcccttcttcccttaggtcctyctctggcctcaattcccgtctcaaggccacgccttccacctacagtggagtcttccgcacccagcgcgtcgacctttaccagcaggtgaaggagaaaccc

SEQ ID NO: 52526 - DNA, 201 bp, Homo sapiens
cactgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagc

SEQ ID NO: 52527 - DNA, 201 bp, Homo sapiens
caaggccacgccttccacctacagtggagtcttccgcacccagcgcgtcgacctttaccagcaggtgaaggagaaacccttgtggccccaactctaaattygagttgccacctgatttcctgtccttccgtctcatcgctgacctctcactgtgactcactctttaacacatgcctgtcccctaggcctccccaccagatg

SEQ ID NO: 52528 - DNA, 201 bp, Homo sapiens
gggccaggagctgcaggtgttagaaggatatgtgtatgtttgcgtgtagctgtgcgtgctccatctgtagctgtctcttccaatttgggtttagaagttcytgcgcaagacagttccggatgtagatgcatttggttgttttataatcaagatgcgtataatcaagaagtatatgttgcagatgtcggagttcaaagtaca

SEQ ID NO: 52529 - DNA, 201 bp, Homo sapiens
atttccttgataagtttaacattttctcatcaatgggtggtggaaaattctagtcttaactgaccgcgctttacaaaaatcttaccccaacctgtttagayctagatacccacagaaaaagacatgggcaagaatttgctctcaggagggcaatctgtaaagtcaagcaaggacaaaaaaaatattgaagaaattgttaga

SEQ ID NO: 52530 - DNA, 201 bp, Homo sapiens; identical to SEQ ID NO: 11410

SEQ ID NO: 52531 - DNA, 201 bp, Homo sapiens
cctggggaggggaagtgactacttcctgagtaggagttcagtcttgattcctccagcctttcctcccagttcgaagctcttctccccacccccaaccccargcaggccagcctattcctcgaagggttaatggtttgtgcacacgtgggaaatgtcagaggacagggataagcagggactggggcaggcctggaggcctgt

SEQ ID NO: 52532 - DNA, 201 bp, Homo sapiens
gtcattcactgattttttgatagtaattagaatatgttccagctgtgagttttaatgttactttttacttttaaaaagttaatttgcaatcgaatggggaratgcatgtgaaatctgccactgtaggaactcaaaaaaagaagtaaaattcattaaaataagaagagctactgattaggggattgtccatctaagggaaag

SEQ ID NO: 52533 - DNA, 201 bp, Homo sapiens
ccagcactcgacctgtgaaaaccacgcctatgcagcaacacaattggtccgaaagcgtcaaagagccaatcaagaggcctccggctccccgcagcccacarcgcagcccgaccttctagagccgccgagcagacgcccggtgaattctagaggcggcggagggtggcgaggagctctcgctttctctcgctccctccctct

SEQ ID NO: 52534 - DNA, 201 bp, Homo sapiens; identical to SEQ ID NO: 11411

SEQ ID NO: 52535 - DNA, 201 bp, Homo sapiens
agagcgagcgagcgagctcaggggctgcagcgatctctcgataagccacctagaggcgactctgtgcgcgcgcgctccccagtggctcccgcccgccctcygatcatgttgacatattcacaggacaggcagtagtaccgatgcggcgctgcgacgttacagtttccgacaccttctttttataactcagctctatccccc

SEQ ID NO: 52536 - DNA, 201 bp, Homo sapiens
gcttctccaagctagacaactttcagtcttctctctctgaaacatgctacagacgcttgcaccaaattgcccagatcaataatttagaggaatgtcagagkataggggaaatgtgtgttacaggaaagctccgtgctgctggggcaagtaggaagctgggagctgggggctatagagcttaacttgcagctcctcacccta

SEQ ID NO: 52537 - DNA, 201 bp, Homo sapiens
caaggtatgaatgatccttagatggtgagggtggggggggccctttggcaactgaggagcaatttggattctccagaagataacatctgtggagcgaaacktacccagggggtactccaaggaggtgggctcggtacaagcgtggtaccctgcggtggggaagatttcagcctggcaggggtcctaagatcccgtttgttc

SEQ ID NO: 52538 - DNA, 201 bp, Homo sapiens; identical to SEQ ID NO: 11412

SEQ ID NO: 52539 - DNA, 201 bp, Homo sapiens
tggtaaggccgaccccgaaatgccaaagaggatgtacattcacccggacagccccgctactggggaacagtggatgtccaaagtcgtcactttccacaaaytgaaactcaccaacaacatttcagacaaacatggatttgtaagtttcattgctctcttcagtaaaattttctcctccttcactcagtcaaaggcagtgct

SEQ ID NO: 52540 - DNA, 201 bp, Homo sapiens; identical to SEQ ID NO: 11415

SEQ ID NO: 52541 - DNA, 201 bp, Homo sapiens
agtctcttggcctagggtgacacagctaagatttgtacctagagatttctgagtgttgacttctctcctgcccccacctatctccccccccaaaaaaaaamacacaacaacaacaacaacagaacataccagggattcatggcttgcccaatgttggagggggagaagagaggagagggatgagataagctcctcccaccc

SEQ ID NO: 52542 - DNA, 201 bp, Homo sapiens
gcctgcctatagagatatattcacagttcaaaagtcaggtgctgagagatggtttaaagacaaattcatgaaggtatattttgtgttatagttgttgatgrgttctttggttttctgtatttttccccctctctttaaaacatcactgaaatttcaataaatttttattgaaatgtctttgggccttgtgttaaatgtttt

SEQ ID NO: 52543 - DNA, 201 bp, Homo sapiens
tgacaacacacttcattttgaactcactgtcattgtcactgtccttgggtcctctgtggacttcatgatggggatgttccagctaaatttctttagtgtgwataccaaaacatgatcttctctccctgtgaaacctgaagtcttcaatagagcaatttattccaagaacatgaatccaaccaagggtccccctttccacct

SEQ ID NO: 52544 - DNA, 201 bp, Homo sapiens
tgactaggtaggaacaatgctgagcaaaaaaacgccatactaattttgccacagagaaactcctagaactgctgtcattgatgccacccactcctcccccmctcttgggctttgtcctgtctgttttaaggttcatcttcttccccttggggaagaaggatcaagaagtcacattcaaaaggaaccagctaaaaatttaag

SEQ ID NO: 52545 - DNA, 201 bp, Homo sapiens
gggtttatcacccaccgggaggggggcgcgccgggcacgcagagacaaagaggagttcgcaccttcccgcttttgatcccagaattacggcggcctccctscctaatacgagcctcctggggccgagtctgggaggtcagtcataattggcggaagtttgcagaccattagcaagatgtcgacattttcgattcgaacccc

SEQ ID NO: 52546 - DNA, 201 bp, Homo sapiens
gttaatcaaagtctcttggcctagggtgacacagctaagatttgtacctagagatttctgagtgttgacttctctcctgcccccacctatctccccccccmaaaaaaaaaacacaacaacaacaacaacagaacataccagggattcatggcttgcccaatgttggagggggagaagagaggagagggatgagataagctc

SEQ ID NO: 52547 - DNA, 201 bp, Homo sapiens
gttgcctcactctgaaacatgtaagcttatcagtcacaatataaagtcttagacttggtttcaatattatgtgatacataggaaatcaaacccaagattaygggtggtttatctttctttttcttttctattctttcgttttataggcgaatgtttcctccatttaaagtgagatgttctgggctggataaaaaagccaaa

SEQ ID NO: 52548 - DNA, 201 bp, Homo sapiens
agtggccaccaggccgcttttgtttgttcgcaaattaatcacccagcgcatggccggcgccagagtgggtttatcacccaccgggaggggggcgcgccggrcacgcagagacaaagaggagttcgcaccttcccgcttttgatcccagaattacggcggcctccctgcctaatacgagcctcctggggccgagtctgggag

SEQ ID NO: 52549 - DNA, 201 bp, Homo sapiens; identical to SEQ ID NO: 11423

SEQ ID NO: 52550 - DNA, 201 bp, Homo sapiens
cctcctcccttctctccccccgcccccgatttggggaccctgctcagacgtgtgtccagcctctcttactggcgttcctctttttttttttttttttttttaatctcctgtgtatctcatttgtatattgtgatgttaatgagtaactcctgtagcgctgatgggcggggggtggaggggatgaacggctcgcagtctctc

SEQ ID NO: 52551 - DNA, 201 bp, Homo sapiens
acctcctcccttctctccccccgcccccgatttggggaccctgctcagacgtgtgtccagcctctcttactggcgttcctctttttttttttttttttttttaatctcctgtgtatctcatttgtatattgtgatgttaatgagtaactcctgtagcgctgatgggcggggggtggaggggatgaacggctcgcagtctct

SEQ ID NO: 52552 - DNA, 201 bp, Homo sapiens
agttaatcaaagtctcttggcctagggtgacacagctaagatttgtacctagagatttctgagtgttgacttctctcctgcccccacctatctccccccccaaaaaaaaaaacacaacaacaacaacaacagaacataccagggattcatggcttgcccaatgttggagggggagaagagaggagagggatgagataagct

SEQ ID NO: 52553 - DNA, 201 bp, Homo sapiens; identical to SEQ ID NO: 11424

SEQ ID NO: 52554 - DNA, 201 bp, Homo sapiens
ttgactaggtaggaacaatgctgagcaaaaaaacgccatactaattttgccacagagaaactcctagaactgctgtcattgatgccacccactcctccccmcctcttgggctttgtcctgtctgttttaaggttcatcttcttccccttggggaagaaggatcaagaagtcacattcaaaaggaaccagctaaaaatttaa

SEQ ID NO: 52555 - DNA, 201 bp, Homo sapiens
ttggggaccctgctcagacgtgtgtccagcctctcttactggcgttcctctttttttttttttttttttttaatctcctgtgtatctcatttgtatattgkgatgttaatgagtaactcctgtagcgctgatgggcggggggtggaggggatgaacggctcgcagtctctctggattttgctgcctattactcacctggcg

SEQ ID NO: 52556 - DNA, 201 bp, Homo sapiens
ctagacttgttgagttgggaaaaacaccctcaaaacattctagaaaatgagaacaatgtctctgtcttgcttgtgtctcttccaatagataacccagttawaaatagacaacaacccttttgcaaaaggtttccgggacactggaaatggccgaagagaaaaaaggtgagttgaaacaattatttattagatagtttagaa

SEQ ID NO: 52557 - DNA, 201 bp, Homo sapiens
tgttttttttgttttgttttgttttgtttggagaaacttctaggattggggtgggaggatgggggttggggaagaagaaagatttaaaaaattattcctamtaatttatgtcctccggcttccccttggttacctctgtggggtaaactgaatctgtatccccatttaacaggtgcaaggagatttcctgggggctgcaca

SEQ ID NO: 52558 - DNA, 201 bp, Homo sapiens
tttgcagacttaaggagccagtgaggagacacacaccttttttttaatgtgtgaatattatcaaccatattttacataatgtttaaaggtccttgcctgaycaaaacctgcctggaagagaagatcctgtaatagtcatttaaaatcactgattttttttttgtaatagcattgaagcctgtaaaggcataaagttgatac

SEQ ID NO: 52559 - DNA, 201 bp, Homo sapiens
acccaccaccccaaccgacacccggcttcccccccgcccaccccgcccccagggcacccactcctccagagccggcacccttgagctaattggggattagkcccagggctaggacttctaacaggaagagagggctcaggacttcccgtgaatctcctgaaatcatacgcaagtttgttattgtgcagaggcgcacatttc

SEQ ID NO: 52560 - DNA, 201 bp, Homo sapiens
gggacatcgaacctcaaaggtaaaccatgtcacctttgtgatcactggactccagtccctcgtggcctggaagagttgaagggggatggggcaccaaccarggcacttgccctttaaaagctagaagccttctaaacatccttaaacagaagccagagttcaaaaagggctatcaggtgtgtctccccttccccgctaagg

SEQ ID NO: 52561 - DNA, 201 bp, Homo sapiens
agtcaccctcaacctccaaccctcccaacccaggcatacagccgcagtgggagcctgttagaagcaccagcgctgaatatgtatctgccaaatggcgcacscaccaccccaaccgacacccggcttcccccccgcccaccccgcccccagggcacccactcctccagagccggcacccttgagctaattggggattagtcc

SEQ ID NO: 52562 - DNA, 201 bp, Homo sapiens
cgcgcgcgctccccagtggctcccgcccgccctctgatcatgttgacatattcacaggacaggcagtagtaccgatgcggcgctgcgacgttacagtttcsgacaccttctttttataactcagctctatcccccagcactcgacctgtgaaaaccacgcctatgcagcaacacaattggtccgaaagcgtcaaagagcca

SEQ ID NO: 52563 - DNA, 201 bp, Homo sapiens
aattaacagcaatgtggtggcacagtcttgcggttttggactggcctaagaagtgggggaatgtgttagcagctccacgggcagatcggttatcaggcccrggagtgcaccgaagtctgcaaaattcgttctgggaactcactgaagtccagtttcacttcgcccacagcgggattgctattctgcagcagggaggggtgc

SEQ ID NO: 52564 - DNA, 201 bp, Homo sapiens
aggtcgccgcagctggctcggcaccccagcgcctcccgggttccggaacttgggcgcttcgccttcgccccttctcatccccaccactcccagccccactmccctcctcctccgtccccagccccattctcagcctcggaagaagctgccttcccctctttcctggatatcactttcactcccgtttgtgcctcagatgag

SEQ ID NO: 52565 - DNA, 201 bp, Homo sapiens
agagaaagacagactgaaagggaaagaaaggggcgagatggcgagccagacggagttcgcagaaccacactattctctctggtgacttcagggaattctcracgctggcgccaagctctcttaaccatgtgcgtcaaaaatgcgaggctggagaagcctgtcgcctcaaaagatcctcccctatctcagcgtggttggccc

SEQ ID NO: 52566 - DNA, 201 bp, Homo sapiens; identical to SEQ ID NO: 11413

SEQ ID NO: 52567 - DNA, 201 bp, Homo sapiens
taaggctggcagtccagctgtctctgactagatccagcctcttctcctgcttttaaataaaatttcacagcccaagcaaatgccttttcctaatgaaaccycatcttgaataaatgcaactgaagcctccttcctttctccctaaccctctgccacactcttcagcccagttagagggtcaaggacaaagcttgggtctat

SEQ ID NO: 52568 - DNA, 201 bp, Homo sapiens
gaggacgccagagaaagacagactgaaagggaaagaaaggggcgagatggcgagccagacggagttcgcagaaccacactattctctctggtgacttcagrgaattctcaacgctggcgccaagctctcttaaccatgtgcgtcaaaaatgcgaggctggagaagcctgtcgcctcaaaagatcctcccctatctcagcgt

SEQ ID NO: 52569 - DNA, 201 bp, Homo sapiens
acaaataccagccccggttccacattgtaagagccaatgacatcttgaaactcccttatagtacatttcggacatacttgttccccgaaactgaattcatygctgtgactgcataccagaatgataaggtaaactcaaggggctttcctttttaatggtgatattttgccttccccttaaaagctgctttaagtcaggatg

SEQ ID NO: 52570 - DNA, 201 bp, Homo sapiens
aagatcctcccctatctcagcgtggttggcccacaagagcacttcattttcacccttcccttggtgccacgttggggtttcggggttgctgggggttgcgsgggtgcacaaggcaaaatgcgagagaggcctgtgctggcctacagagacacacacatccaaagccctgagtctcttaaacccctaagcccccagatcagc

SEQ ID NO: 52571 - DNA, 201 bp, Homo sapiens
cgataagccacctagaggcgactctgtgcgcgcgcgctccccagtggctcccgcccgccctctgatcatgttgacatattcacaggacaggcagtagtacmgatgcggcgctgcgacgttacagtttccgacaccttctttttataactcagctctatcccccagcactcgacctgtgaaaaccacgcctatgcagcaaca

SEQ ID NO: 52572 - DNA, 201 bp, Homo sapiens
caaagcaaacgaccccgcctacccaccatccttttaccctcctccccgccctttttgtaaactccagataaacaccatttgatcacaaaagggtcggtttrtcccctttatagtttgaggcaggcagtgcggcagggaaaagtggcgtgggctaagcttccgtctcgggcaaggccagcttctttgctggcaccgtggcct

SEQ ID NO: 52573 - DNA, 201 bp, Homo sapiens
aggtgtccgttctgccattatcaattcagatgtcagggttcttgccaaacaaatccttccagagtaattcacaaatttgtggaaggtgctgctctctgtcrttcactgattttttgatagtaattagaatatgttccagctgtgagttttaatgttactttttacttttaaaaagttaatttgcaatcgaatggggaaatg

SEQ ID NO: 52574 - DNA, 201 bp, Homo sapiens; identical to SEQ ID NO: 11418

SEQ ID NO: 52575 - DNA, 201 bp, Homo sapiens
aaaagctgctttaagtcaggatgagaaagttacaagagagtggagacgagagtcttgagttgtcttttgtgatttgtggagcatttggggggaaaggacartgacacctcgaggagacagaaaaacaccttgactaggtaggaacaatgctgagcaaaaaaacgccatactaattttgccacagagaaactcctagaactg

SEQ ID NO: 52576 - DNA, 201 bp, Homo sapiens
gagataacgcccttctgccttggttttttccttcgcctgtggtagatttatgtcccagcgagggtgagagcgacgccgaggccgagagcaaagaggagcayggccccgaggcctgcgacgcggccaagatctccaccaccacgtcggaggagccctgccgtgacaagggcagccccgcggtcaaggctcaccttttcgctg

SEQ ID NO: 52577 - DNA, 201 bp, Homo sapiens; identical to SEQ ID NO: 11420

SEQ ID NO: 52578 - DNA, 201 bp, Homo sapiens; identical to SEQ ID NO: 11421

SEQ ID NO: 52579 - DNA, 201 bp, Homo sapiens
ggtggtttatctttctttttcttttctattctttcgttttataggcgaatgtttcctccatttaaagtgagatgttctgggctggataaaaaagccaaatmcattttattgatggacattatagctgctgatgactgtcgttataaatttcacaattctcggtggatggtggctggtaaggccgaccccgaaatgccaaag

SEQ ID NO: 52580 - DNA, 201 bp, Homo sapiens; identical to SEQ ID NO: 11425

SEQ ID NO: 52581 - DNA, 201 bp, Homo sapiens; identical to SEQ ID NO: 11426

SEQ ID NO: 52582 - DNA, 201 bp, Homo sapiens; identical to SEQ ID NO: 11427

SEQ ID NO: 52583 - DNA, 201 bp, Homo sapiens; identical to SEQ ID NO: 11428

SEQ ID NO: 52584 - DNA, 201 bp, Homo sapiens; identical to SEQ ID NO: 11430

SEQ ID NO: 52585 - DNA, 201 bp, Homo sapiens
gagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgagaacc

SEQ ID NO: 52586 - DNA, 201 bp, Homo sapiens
atgtttcagaaatcaggaaagggatgtgtagaaaacttcatggcagggcagtggattgaggatggacatatgtatctggaagcaccaaaaataatgttcgrtctagctaaggttttcttcatcattgagatacgtaaataggcagaaagtttcattattgtgtttaacagaggaatctatgtgtgagaaacacgtttgact

SEQ ID NO: 52587 - DNA, 201 bp, Homo sapiens
aaacttcatggcagggcagtggattgaggatggacatatgtatctggaagcaccaaaaataatgttcggtctagctaaggttttcttcatcattgagataygtaaataggcagaaagtttcattattgtgtttaacagaggaatctatgtgtgagaaacacgtttgacttaacacttcactccccattgccttggaaggct

SEQ ID NO: 52588 - DNA, 201 bp, Homo sapiens
ctcttgtttgacagataatagcagacttcatctctttttaaaaataaaccatcagtttatgtcattgagtatatttgatccttctaaaaagaggttctctytcatatttattttttgtctatgatgtagttttctaaaagttcgtctctattggctacttcatttctgttctaaatgtagtaagttcttggaagtgtactt

SEQ ID NO: 52589 - DNA, 201 bp, Homo sapiens
acataaaaattgcctatggtgctttaaaaaaatacagagtctggggacacatgttctcgggatctcctaagggctgtcacagaccataaagtttaagaagaaaaaaaaaaaatacagagtttgggacctcacccaaaacctaccaaaatgaaacttgtggagatgaggctcaacaatttgcattttcaaaagctctgtggg

SEQ ID NO: 52590 - DNA, 201 bp, Homo sapiens
attttatcttaagcctgctgacttgtgtagttgagtggatgctagtttttggtcagttgttctatttcatacctgtaacataaggatattgagggtgactraattttacaatgctttgcattttgtacatctttatatgtgtctgcttcttgaaatcattgctttttgtgataaagacccatctatggttatttcaatttg

SEQ ID NO: 52591 - DNA, 201 bp, Homo sapiens
acatgatcaggggaattagggaccaagtttattaggaatgaaactaaagaataaaaggcactgtagcaaaatgaaggattggaggggtttttttgtttttygtttttgagatggagccttgctctgtcacccaagctggagtacagtaacacgatctcagctcactgcaacctctgcctcccgattcaagtgattctcctg

SEQ ID NO: 52592 - DNA, 201 bp, Homo sapiens
agaaacacgtttgacttaacacttcactccccattgccttggaaggcttgattattaccagtagctggtactaatgaacttccagagagaacagactgccycaagccattcttctgtcaagggagggtaattttgtaaggctaatatcacttaggggtgttggaaaggaacatgttgtaggcaaatggttcttttgatcat

SEQ ID NO: 52593 - DNA, 201 bp, Homo sapiens
taaggatattgagggtgactgaattttacaatgctttgcattttgtacatctttatatgtgtctgcttcttgaaatcattgctttttgtgataaagacccrtctatggttatttcaatttgcttggcaggtgtatatttaagtctggttttgtttcttctagacagttatttgataatagagattcatattgttttctgtc

SEQ ID NO: 52594 - DNA, 201 bp, Homo sapiens
aggggtttttttgtttttcgtttttgagatggagccttgctctgtcacccaagctggagtacagtaacacgatctcagctcactgcaacctctgcctcccgattcaagtgattctcctgcctcagcctcctgagaagctaggattacaggcacctgccaccacacccagctaatttttatatttttactagagacggggtt

SEQ ID NO: 52595 - DNA, 201 bp, Homo sapiens
ccttggaaggcttgattattaccagtagctggtactaatgaacttccagagagaacagactgcctcaagccattcttctgtcaagggagggtaattttgtraggctaatatcacttaggggtgttggaaaggaacatgttgtaggcaaatggttcttttgatcatgattttgctgctctccggtacactaaactttatgta

SEQ ID NO: 52596 - DNA, 201 bp, Homo sapiens
tctcacagaagattttcttgcaagatgactatgatatgacaggctctgtttttgttatgcataggcagttgcttctattgtgttccctgcagcctagtgcktgtgtattttcttagactcatctggtagtgaagtggcctctagctcaggtcttcacaggcagaacatccatgctttgaggaggctgtattagcaaaataa

SEQ ID NO: 52597 - DNA, 201 bp, Homo sapiens
gttgtgctgatctaaatatactttctaagggattgtcctcttgcactgttggcatttgactgattgacaagggggaggccatgaaaagggagtacagaaattaggggaaaggaacaggataataagtttttaaaaacaaacaattttgaagataagttttagccaatagaaactagcccttcaacaggcaataatgaggac

SEQ ID NO: 52598 - DNA, 201 bp, Homo sapiens
aagtcttaaagggcctggagacccatttagaaagttagcatatatttgcttttgtatcttttaattaagcttttgctgaagtaccagcattaagaataaaygtactttttattcaactttagttttaattaatagtataagtacagtactaacatacgccgccagttttcattgcacacaacatttccacaatgcacatca

SEQ ID NO: 52599 - DNA, 201 bp, Homo sapiens; identical to SEQ ID NO: 11510

SEQ ID NO: 52600 - DNA, 201 bp, Homo sapiens
attgctcccactgggaggcagatatgttaactttgggtcatggttgattaaaaggtcaaaagagatcttagagtttacctctaacatcactttttactatraaatgttttatgcttggacttggttttgctgaaattttcctcaacttttggtaatattcttgctaaatgaaattcataaaactatgagtttaaaacttgt

SEQ ID NO: 52601 - DNA, 201 bp, Homo sapiens
gggtgaggagagtgcagttcaggctgggatcgtgtgtggcatattcgtaggaaaccacagaatctgaagttagttaggtttggatttcatttaccacttayaaactacgtgcatcagagtaagaaatttaatttctctgactgtaggttccttgattatagagatgttgtaaagattaaatgagatgacacgttggaagtt

SEQ ID NO: 52602 - DNA, 201 bp, Homo sapiens
actccaaggcaaaccgcggcttcatcaggacaggaggggacgagcagcaggccttgtgtactgatgaattcagtgacatttctcccctcactgggggcaaygtggccttttctaccctggaaggaaggcccagcgcctataactttgacaatagccctgtgctgcaggtaaattctcacaggttggcctgaagccagctag

SEQ ID NO: 52603 - DNA, 201 bp, Homo sapiens
aatgaaattcataaaactatgagtttaaaacttgtaagttaaaagttaaagtattttcttacaagcattgtgattaactgtaaaaatatgtactttaaacytctagtttaaactaacttgactaggatacttgacttgttcttggatcagaaatgacatcctggaagaaatcatgcatagtggaggaggtgggaaggggga

SEQ ID NO: 52604 - DNA, 201 bp, Homo sapiens
gcatagagctgagcatagatttgtgcccaacaaattcttgttgaccaaactgggatcttcactataacatagaagtagcaaagtatagatattgttagagttagcaagacccaatgtgtgaatgaatggtgattttatattttacccatgtgaagacacactggctggcaaccaagccatcctgaccataagaccacactc

SEQ ID NO: 52605 - DNA, 201 bp, Homo sapiens
cacatgtgtatataaaattataggatcattttaactgatactttttgggaggctgaggcgtattttaacagatggcaaatacaaatctgattattgtgccygtatcatcacttgctgtacaaaagccaggaaaatcagtgttgattctgaaaacagcgctctcttaagcaccatacacagtcatccagggtgcagggtgca

SEQ ID NO: 52606 - DNA, 201 bp, Homo sapiens
aacatgcgaggtgtgggaagattattgtagtggggcttgtggtcccacttctgaggtacggggtcagagtagaatacttgagcaacacagacagagagctygattctgctctctgtgtactattaataagtgaaggaaagtagttttgttcctgctgcctggttgatgtttgttcttatgcacttgcagatctattctggg

SEQ ID NO: 52607 - DNA, 201 bp, Homo sapiens; identical to SEQ ID NO: 11513

SEQ ID NO: 52608 - DNA, 201 bp, Homo sapiens
tatataaaattataggatcattttaactgatactttttgggaggctgaggcgtattttaacagatggcaaatacaaatctgattattgtgcctgtatcatyacttgctgtacaaaagccaggaaaatcagtgttgattctgaaaacagcgctctcttaagcaccatacacagtcatccagggtgcagggtgcagtgcatcc

SEQ ID NO: 52609 - DNA, 201 bp, Homo sapiens
aataaaatgtattttttaaaattagcaaaggggaaccgttgaagcaagatatttaagaatgccatcttctttcatttttacacaagaaaattttgattagrtttgtctggcacgattgctgatcattaaagaaactcctcatcacctaaaatggatgatgttagtaacaggatatggatgttagtaacaggatattaattt

SEQ ID NO: 52610 - DNA, 201 bp, Homo sapiens
aataccagcactttgggaggcggaggcaggtggatcacttgaggtcaggcattcaaaacccacctggccaacatggtgaaaccctgtctctactaaaaatmcaaaaaaaaaaaaaaagttagttaagcatggtggcaggtgcctgtaatcccagctaccctggctgggaggctgaggcgggagaatcacttgaacccggga

SEQ ID NO: 52611 - DNA, 201 bp, Homo sapiens; identical to SEQ ID NO: 11515

SEQ ID NO: 52612 - DNA, 201 bp, Homo sapiens
gcgtattttaacagatggcaaatacaaatctgattattgtgcctgtatcatcacttgctgtacaaaagccaggaaaatcagtgttgattctgaaaacagcsctctcttaagcaccatacacagtcatccagggtgcagggtgcagtgcatcctcggataaaaagagttaaagttgctatgggaaccagaattgcactttct

SEQ ID NO: 52613 - DNA, 201 bp, Homo sapiens
tcacctaaaatggatgatgttagtaacaggatatggatgttagtaacaggatattaatttaggtacccatagcactgtacttaaacattgtgatagaaacmtttccctgtttgagaaggatttcttttttctcctgaattctacatgcatattccttatacaccataatacggaattcttctatgttgctcatatttctgt

SEQ ID NO: 52614 - DNA, 201 bp, Homo sapiens
agccaggactctttgtagcaaggcattatattttaatttgccagcctttaaagactggtgcattttgttttggtggggggctacaggggtattttttatcrgtctcaaatgtcaagaataagttatgtgccaacagatggatataaaatgaaagtaagctagaagagaaagctttttgtggaacagccagacttttaacat

SEQ ID NO: 52615 - DNA, 201 bp, Homo sapiens
caggatattaatttaggtacccatagcactgtacttaaacattgtgatagaaacctttccctgtttgagaaggatttcttttttctcctgaattctacatscatattccttatacaccataatacggaattcttctatgttgctcatatttctgtgaacttttcatatgtcctggctatttgattatggaaaagctggtga

SEQ ID NO: 52616 - DNA, 201 bp, Homo sapiens
agtgtatttacctttgtttggtttttaaaatgtaaattatattgccccaataaatgagtatgtgtgtcagggggactgtggctgggtcattgcatgtggarggggagtttacagaagagaactcctagaagagctttacttaactatgaaaattttcaaagaataggacatttctaataagtccctaagagtgtcctgaag

SEQ ID NO: 52617 - DNA, 201 bp, Homo sapiens
gcactgtacttaaacattgtgatagaaacctttccctgtttgagaaggatttcttttttctcctgaattctacatgcatattccttatacaccataatacrgaattcttctatgttgctcatatttctgtgaacttttcatatgtcctggctatttgattatggaaaagctggtgagcctcatgctgtactcagcacttta

SEQ ID NO: 52618 - DNA, 201 bp, Homo sapiens
caatcacggtaatgacatacacgaacttgtggttacttgctcactttcagtggcaaagaagaggccatcgttcactgctgccagaaaacatagtccctcastgtgggtcattttcatcttgggatggaaaaaagaagtacaaagcctgttaatctcagtaaaaactctagggaagtgataaaggaaactatctctgtgcaa

SEQ ID NO: 52619 - DNA, 201 bp, Homo sapiens
tgtaagaattgtgatgtttgttgctctttatgccgtagaaactagtgagactatatgaggtaatgagactgtgtggtaaaaatgctatgggttatgacctygcatttaaaaaaaaaaatgctgtgggcatctgcatagacgtggtcagtcagtttcattatgcagtaacatgagttacgtgtctctggatgtaagagctct

SEQ ID NO: 52620 - DNA, 201 bp, Homo sapiens
ttataacccaaattgataatgtaagtcatgagatagtataaatcaatatattattatttctggattatatttttaagacattttataaattataaaaggarcgggagcatacttgagaaaaaggaaagcttttttaaaaaaagtacaattttcttttgtgcctagaatgccaccagcaccaaggcagaagctgaaagaact

SEQ ID NO: 52621 - DNA, 201 bp, Homo sapiens
cactcctaggagagacttcccatagctgccattgctaggattctttgaagtcatcttcaagaataatgttttttagtttggctttctcttatttcaaggtmaatctgtttgttttatttaaaagagagattggagcaattttagaattaggtatttaagaatcagagaaacctcttagtttccttagaacagttggctttt

SEQ ID NO: 52622 - DNA, 201 bp, Homo sapiens
tggcccagtcccctctgctgctgcccagtgctgctgaaagggcagtgtggtgcagtggttagagcatgggctgtggaggcagatggatctcaggccagccrtgcttcagctgcctgctgccatgtgtcaggcctccttggatataaagttccataatttcctcaggtattaaaagtgagccatagtgtttcccttatggga

SEQ ID NO: 52623 - DNA, 201 bp, Homo sapiens
acttcagtaaaattgtcttaaaccatatttgtctttttttttttcttttgactaggcatgagagtaggtatccacattgaggaggggaactcagtaaaagsgtgctttactctaaaatttctactatgtctcagtgtgaggtctggcttcagaggtctatagagcccattcccacaaaaaatcagactttttctaaataaa

SEQ ID NO: 52624 - DNA, 201 bp, Homo sapiens
aagccaatgaaaagaccagagaagcccagcaggccctgggcagtgctgcggcggatgccacagaggccaagaacaaggcccatgaggcggagaggatcgcragcgctgtccaaaaggtgtgcgtttcctcttctccaagagtccctgcccatatctttctctggtcactttccagtttctttccagaccctcagagccctt

SEQ ID NO: 52625 - DNA, 201 bp, Homo sapiens
aaaaaaatacaaaaattagccgggcatggtggcatgcgcctgtaatcccagctgcttgggaggctgagacaggagaattgcttgaacccaggaggcggagrttgcagtgagtcgagattgcaccactgcactccagcctgggagacggagtgagactccatctcaataaataaatatatatataaacaaacaaataaatta

SEQ ID NO: 52626 - DNA, 201 bp, Homo sapiens
atgccactgcactccagcctgggcaacagagtgagactccatctcaaaaaaaaaaaaaaaaaaaaaagaaagaaagaaaagaaaagaaaaagcagaagacygaatgcccagtggagaggtgacctacaaatactctttaagttgatcagctagcaaacatttgccagacttctttctttcctacagcaaattattgcattt

SEQ ID NO: 52627 - DNA, 201 bp, Homo sapiens
actctttaagttgatcagctagcaaacatttgccagacttctttctttcctacagcaaattattgcattttcctgtcctgatgaggcaacaatagaaagamcagagaaagaacagtgtagtcagtagaaaatgcagtgatacaaagttgtaactgtggttttctggcacctttgctaactgtacacccagtcagcctgtct

SEQ ID NO: 52628 - DNA, 201 bp, Homo sapiens
cttgctgtacaaaagccaggaaaatcagtgttgattctgaaaacagcgctctcttaagcaccatacacagtcatccagggtgcagggtgcagtgcatcctyggataaaaagagttaaagttgctatgggaaccagaattgcactttctgcttgttgtggggagaaatctccaccagccacttttctaagaagaagtctttt

SEQ ID NO: 52629 - DNA, 201 bp, Homo sapiens
tgccagacttctttctttcctacagcaaattattgcattttcctgtcctgatgaggcaacaatagaaagaacagagaaagaacagtgtagtcagtagaaartgcagtgatacaaagttgtaactgtggttttctggcacctttgctaactgtacacccagtcagcctgtcttgagccatttccccaactgtaagaattgtg

SEQ ID NO: 52630 - DNA, 201 bp, Homo sapiens
attgtgatgtttgttgctctttatgccgtagaaactagtgagactatatgaggtaatgagactgtgtggtaaaaatgctatgggttatgaccttgcatttaaaaaaaaaaatgctgtgggcatctgcatagacgtggtcagtcagtttcattatgcagtaacatgagttacgtgtctctggatgtaagagctctgtctctg

SEQ ID NO: 52631 - DNA, 201 bp, Homo sapiens
aatcaaagtttatgaaactcctaaaattaacactgaaaccagattagtttccaagctcctcataaactgtaggaaccaatagtgattaaatgaagcttttraatctgcatctgcatatcttttttgtgtgtttaagttagaataattgatatataaggctattgccttttattctctttggtcctctgctgagtgtgtatg

SEQ ID NO: 52632 - DNA, 201 bp, Homo sapiens
cactcccctgttggagaggtgggtagctttgggaagaagaataggtcctagtattcctagaaaaaggtaaaaatgaaaaaaaagtaaaatgaaaaaacttraaacattgtttatcccttcataatgtcatggtttattctgaacagatagagaaagaaatctcaggagaaaggaaccttttaatcatgattttaaagcaga

SEQ ID NO: 52633 - DNA, 201 bp, Homo sapiens
ttctccattctaagggcattcaaaaaagaatttacacattaggggagaagttggagctataaggcattcctccccccccccacctcttccatttgtcattkgtcacatttgtgggaggaatcaagttttgactatttcagttctaaataattttagaaaattgggtgtgccttttgctatgcactccttcctcctgtgcat

SEQ ID NO: 52634 - DNA, 201 bp, Homo sapiens
aatctcagcatttgggaggcctatggggttggatcacctgaggtcaggagttcgagaccagcctggccaacatggtgaaaccccgtctctactaaaaatasaaaaattagccaggtgtggtggtgcacgcctgtaatcacagctactcacttgggaagctgaggcaggagaattgcttgaacctgggaggcggaggttgca

SEQ ID NO: 52635 - DNA, 201 bp, Homo sapiens
aaggcaaagatgcctaaggttgtgatttgcctaaagtcatgtgggagataggtctttgactacctagttgattgcattcgttcttgcagcttgcagcttcyctaacgagtctctcgaaagaaagtctactttattctaagccacttttaaaatttcatgtataccctggttcagagataccagactcctttggttttcctt

SEQ ID NO: 52636 - DNA, 201 bp, Homo sapiens
agtttgaggctgtagtacaccataattgcgcctgttgaatacccactacaccccagcctggacgacgtagaccctatctcaaaaattaaataaataaaatrtatatattcacatgtacattgttgaaatagattcttaaagggaattattaagcagctgaggggaaaggttacaatgaaatatttgcttgttgtatatagc

SEQ ID NO: 52637 - DNA, 201 bp, Homo sapiens
aaaaaaatgctgtgggcatctgcatagacgtggtcagtcagtttcattatgcagtaacatgagttacgtgtctctggatgtaagagctctgtctctgatayccagttgccaaggaggttgagctaatttgacttttagctgatctgacaatgagagagaactcttgcctctcttcctctcttcattgctccctaaacctcc

SEQ ID NO: 52638 - DNA, 201 bp, Homo sapiens
atttttttcctttaaaaatggacataagcaaattttatttaaagtatatatattctgtagtttcagctacttgggaggctgaggcagagggatcattcgakctaagaagtttgaggctgtagtacaccataattgcgcctgttgaatacccactacaccccagcctggacgacgtagaccctatctcaaaaattaaataaa

SEQ ID NO: 52639 - DNA, 201 bp, Homo sapiens
ccccatggtcgatccaccctctgcttccttttcattttctctgatacttgacgcttgccatatatgggctcctcttgctcccagtttctgtttcttccctstatgaccttaccaaatctggtgtgtttattatccaccagtcacgtcccactgtctttcaaggcctgacctgagccatcttcatccttgaagagttcttcc

SEQ ID NO: 52640 - DNA, 201 bp, Homo sapiens
tgtctctgatacccagttgccaaggaggttgagctaatttgacttttagctgatctgacaatgagagagaactcttgcctctcttcctctcttcattgctycctaaacctccctgcagaagctgtaatctcccagatggggaaggagaccctttttggtttcaccatattataagtattactaagcatgtgttgatttatg

SEQ ID NO: 52641 - DNA, 201 bp, Homo sapiens
aacctgggaggcggaggttgcagtgagtcaagattgcgccactgcactccagcctgggcaacagagtgagactccgtctcaaaaaacaaaaacaaacaaamaaattattggcagaaaccccgagaagggaccactatcttaactcacgactgtttccactgaactgccgagaggagattttcttattcatcttttcaacaa

SEQ ID NO: 52642 - DNA, 201 bp, Homo sapiens
ctgacctcattcttagatgaggtgtagatgcagagacccatgtctctcgatttgggggtaggcaaatgatggccttcttagccaagtccagtccagtcctkcctatttttgtatgggctgtgaactaagaatggtttgtacatttttaattggttagaaaaaatcagaagaataatattttgtgacatgtgaaaatttcat

SEQ ID NO: 52643 - DNA, 201 bp, Homo sapiens
tctgacaatgagagagaactcttgcctctcttcctctcttcattgctccctaaacctccctgcagaagctgtaatctcccagatggggaaggagacccttyttggtttcaccatattataagtattactaagcatgtgttgatttatggtaataatttacatttattaaagcacttactatagcatactataatgtgacaa

SEQ ID NO: 52644 - DNA, 201 bp, Homo sapiens
tctccaaaaaacaaacaaatcaaaatgtgttcatgattttggttagaagaagtctgcattaaaaaagaaaaatatattccaaaaaagatgtattcgaatattttttttaaacaacatcctgttcgatttgaaaccaaataaaacttctttttatttactcttcaagatactgtctacattttgggaagaatcaataactca

SEQ ID NO: 52645 - DNA, 201 bp, Homo sapiens
aaaacaaaatccagttggaactccctgaaaggccccctttttacttgttgggagtttagctcaaatgtgtccttgaacttgtttcagattttgataggcgygtgaacgataacaagacggccgcagaggaggcactaaggaagattcctgccatcaaccagaccatcactgaagccaatgaaaagaccagagaagcccagc

SEQ ID NO: 52646 - DNA, 201 bp, Homo sapiens
gtttcaccatattataagtattactaagcatgtgttgatttatggtaataatttacatttattaaagcacttactatagcatactataatgtgacaagcastgttctaagccctttgattttctacctcagttaaccctcacagtaaccctgtaaggtagatacttttattgtctccattttacagatgaggaatcagagg

SEQ ID NO: 52647 - DNA, 201 bp, Homo sapiens
cctgtaatcccaacactttgggaggccaaggtggctggatcacgaggtcaggagatcaagaccatggtgaaaccccgtctatactaaaaatacaaaaaaawttagccaggcgtggtggcgggcagcagtagtcccagctactcgggaggctgaggcaggagaatggcgtgaacctgggaggtggagcttgcagtgagccga

SEQ ID NO: 52648 - DNA, 201 bp, Homo sapiens
taaagatgcccattaggaaaaaaaaatggcttagctttttgagaagctcttattcaaagagagctgtgataaggtcgaagccttgtagaagatataataarcattaaacacagaaatatgtttagctatttacattacagatgactaaaagattcctactgttgtggccatgagtaggagttgttattggagttccaagtt

SEQ ID NO: 52649 - DNA, 201 bp, Homo sapiens
tactaaaaatacaaaaaaaattagccaggcgtggtggcgggcagcagtagtcccagctactcgggaggctgaggcaggagaatggcgtgaacctgggaggyggagcttgcagtgagccgagatcgcgccactgcactccagcgtgggtgacagagcgagactctgtctcaaaaaaaaaaaaaatgactttagggtccattt

SEQ ID NO: 52650 - DNA, 201 bp, Homo sapiens
gaagtaagaattctatttccagaaacggaacatttctataacactaactgggagacctattctgtagagatgtgtaatttctaaaatttcagcccatgctstcttccattttttaccctgacttccattgttcataaaacaaaatccagttggaactccctgaaaggccccctttttacttgttgggagtttagctcaaat

SEQ ID NO: 52651 - DNA, 201 bp, Homo sapiens
tcattatacaggtgaggaagctgaggtccagggagatagcaattgcttaagatcaggtttcccatttctagactagagctttctccaccaccctatgtacygtttctgtttttaagcctgtaaaacaacaaacaccacaataaacaccaaaacctggaaataggagattatgtatgcagacttgtacttcatgggacagag

SEQ ID NO: 52652 - DNA, 201 bp, Homo sapiens
aaaaattttttttttaattagccgggcatgctggcacatacctgtagtcctagctacttgagaggctgaggtgggaggatcccttgggcccaggaggtcamggctgcactaagcagtgattgtgccactgcattccagccagggtgacagagtgaaaccttgtctctcaaaaaaaaaaaaaaaaaaagtagtagttcaaaa

SEQ ID NO: 52653 - DNA, 201 bp, Homo sapiens
gtagcaatgttagataaggtggccagggaaggcctcagagagaaggtgatattgtggggagggtcaagacaaacacagacaacatcctattggttcaagcytaagtaatgatttattagcgagtacttgagcatctccctcagatctgtcagtaggggattgggttggcagggaggaatagatgctataaaatgggcaggg

SEQ ID NO: 52654 - DNA, 201 bp, Homo sapiens
tctctataaaaaaaaattttttttttaattagccgggcatgctggcacatacctgtagtcctagctacttgagaggctgaggtgggaggatcccttgggcycaggaggtcaaggctgcactaagcagtgattgtgccactgcattccagccagggtgacagagtgaaaccttgtctctcaaaaaaaaaaaaaaaaaaagta

SEQ ID NO: 52655 - DNA, 201 bp, Homo sapiens
ccatctctataaaaaaaaattttttttttaattagccgggcatgctggcacatacctgtagtcctagctacttgagaggctgaggtgggaggatcccttgrgcccaggaggtcaaggctgcactaagcagtgattgtgccactgcattccagccagggtgacagagtgaaaccttgtctctcaaaaaaaaaaaaaaaaaaa

SEQ ID NO: 52656 - DNA, 201 bp, Homo sapiens
taatcccaacacttcgggaggaaggatcactggaggccaggagttgaacaccagttcctcactggggaatatagtgagaccccatctctataaaaaaaaawtttttttttaattagccgggcatgctggcacatacctgtagtcctagctacttgagaggctgaggtgggaggatcccttgggcccaggaggtcaaggctg

SEQ ID NO: 52657 - DNA, 201 bp, Homo sapiens
aggatgctttacagggtactagttgaaaatatgggccaggcacggtggcctgtaatcccaacacttcgggaggaaggatcactggaggccaggagttgaasaccagttcctcactggggaatatagtgagaccccatctctataaaaaaaaattttttttttaattagccgggcatgctggcacatacctgtagtcctagc

SEQ ID NO: 52658 - DNA, 201 bp, Homo sapiens
ccctgcatacttcagtatggatttttttttaaagatgttttcttattaggcaaactcacataaccaagatgcctatttagagaacttatataggtaaatgragattatctttcattttctctgccagtggcatctgattctttgttgttgtttttttttcttcaccccagatagaagagaaatgtgaccaattcactgagc

SEQ ID NO: 52659 - DNA, 201 bp, Homo sapiens
aatcccagagctcctgtcattttatccctgcatacttcagtatggatttttttttaaagatgttttcttattaggcaaactcacataaccaagatgcctayttagagaacttatataggtaaatggagattatctttcattttctctgccagtggcatctgattctttgttgttgtttttttttcttcaccccagatagaa

SEQ ID NO: 52660 - DNA, 201 bp, Homo sapiens
aaagtaacaaattaaagaagggaagagtcaagaaggagaaaaatattagaaaattaaagaagtcattgagtattataatagatttagtgctaaagagggcrtaagttaaatgataataagttagtgatttagaacattttgtcacatttatatcattttcagtccctccacttctcttttatgtttctatttttgcttcct

SEQ ID NO: 52661 - DNA, 201 bp, Homo sapiens
tgaggcaggagaatggcgtgaacctgggaggtggagcttgcagtgagccgagatcgcgccactgcactccagcgtgggtgacagagcgagactctgtctcaaaaaaaaaaaaaatgactttagggtccattttgttctatgtgtatttcttttaaaaaagtctgttggctgggcgcctgtggctcacgcctgtaatcccag

SEQ ID NO: 52662 - DNA, 201 bp, Homo sapiens
cactgcactccagcgtgggtgacagagcgagactctgtctcaaaaaaaaaaaaaatgactttagggtccattttgttctatgtgtatttcttttaaaaaartctgttggctgggcgcctgtggctcacgcctgtaatcccagcactttgggaagccgaggcaggcggatcacaaggtcaagagatcaagaccatcctggcc

SEQ ID NO: 52663 - DNA, 201 bp, Homo sapiens
tgggtgtggtggcgtgcgcctgtagtcccagctactcaggaggctgaggcaggagaatctcttgaaccctggaggcggaggttgcagtgagctgagatggygccactgcactccatcctgggcgacagtgtgagactctgtctcaaaaaaaaaaaaatctgttaacatgtaaaacaaagggctgacttgaagagtggaagt

SEQ ID NO: 52664 - DNA, 201 bp, Homo sapiens
ctgagtagctaggactacaggcatatgccaccatgcctagctaatttaatttttttgtagagatggggtctctctgtgttgtccagactggacccgaactyctggcctcgagcaatcctcctgccttggcctcccaaagtgctggggttacaggtgtaagccaccatgcccagctgaggattgttttcagtggaagaattt

SEQ ID NO: 52665 - DNA, 201 bp, Homo sapiens
tgaggcaggagaatctcttgaaccctggaggcggaggttgcagtgagctgagatggcgccactgcactccatcctgggcgacagtgtgagactctgtctcaaaaaaaaaaaaatctgttaacatgtaaaacaaagggctgacttgaagagtggaagttttctcccttctctgattgttttatccatttttcattgaatagg

SEQ ID NO: 52666 - DNA, 201 bp, Homo sapiens
ctgagggcaggaggatgcatgaacccaagaggtcaagctcgcagtgagctgtgatcatgccgttgcacaccagcctgagtttacagagtggatctatctcaaaaaaaaaaaaaaaaaaaaaaaggtggcggggtggtgttgaaactgaaagatcacagtgctttaagaagtaatttgaagttgagtaagtaaaataaagaa

SEQ ID NO: 52667 - DNA, 201 bp, Homo sapiens
ttcttatagaaatggaaaagcattgagctttggagtaattgtatacttgtcagaagtaaccctgagtattagaactttacttgagagtttttgttttttgttttttggggggttttttggctgttttacagagggcagaaattatgtaacctgagtattacctgttgacaggtgctttcccttctgtcttacccttgaact

SEQ ID NO: 52668 - DNA, 201 bp, Homo sapiens
cttgtcagaagtaaccctgagtattagaactttacttgagagtttttgttttttgttttttggggggttttttggctgttttacagagggcagaaattatrtaacctgagtattacctgttgacaggtgctttcccttctgtcttacccttgaactctgtagtgcctgcttttgtagcaaaagaatgaaaacactccttaa

SEQ ID NO: 52669 - DNA, 201 bp, Homo sapiens
tgttttttgttttttggggggttttttggctgttttacagagggcagaaattatgtaacctgagtattacctgttgacaggtgctttcccttctgtcttayccttgaactctgtagtgcctgcttttgtagcaaaagaatgaaaacactccttaatggctgtagacataaactcttcttttccccccacactcttgttcat

SEQ ID NO: 52670 - DNA, 201 bp, Homo sapiens
catctctgattttgctgtaggtggcaggtaagtaaactattaaattagtcttgaaagtgtttggagcttttgcatagaggtgaatctagcaacttgtttayaactatgttaataccgttgttagatgttttctttaccaagaataggagcggcagtccttcctgtgtgataatgcttagctgaaaagacagacagcagcct

SEQ ID NO: 52671 - DNA, 201 bp, Homo sapiens
ctcactccaaatgattgtctgatgcttttcatttttcacattggtggggactgtaaaattcagcaaatctaggggtacatgtgtgtgttttaaaaaaaatwagtttgggccgggcatggtggctcaagcctgtaatcccagcactttgggaggccaaggtgggctgatcacctaaggtcaggagttcgagaccagcctggc

SEQ ID NO: 52672 - DNA, 201 bp, Homo sapiens
accttctggagaaaggcaagactgaacagcaggttggtttgatttgcaggtcgcttcatttcttgaggcaacatttgaacagtccaaatgggtctgtgatratgccgtactttcagagacagcagaccccagtgctgagagagcagcctaacagattttatgctggcaagtctcagggtggcacctctggagagccttgtc

SEQ ID NO: 52673 - DNA, 201 bp, Homo sapiens
ctctgattttgctgtaggtggcaggtaagtaaactattaaattagtcttgaaagtgtttggagcttttgcatagaggtgaatctagcaacttgtttacaaytatgttaataccgttgttagatgttttctttaccaagaataggagcggcagtccttcctgtgtgataatgcttagctgaaaagacagacagcagcctagg

SEQ ID NO: 52674 - DNA, 201 bp, Homo sapiens
gcctgtaatcccagcactttgggaggccaaggtgggctgatcacctaaggtcaggagttcgagaccagcctggccaacatggtgaaaccctgtctcttctaaaaaaaaaaaatacaaaaattagccgggcatggtggcatgcgcctgtaatcccagctgcttgggaggctgagacaggagaattgcttgaacccaggaggc

SEQ ID NO: 52675 - DNA, 201 bp, Homo sapiens
accacatgattgttctaaatgctgttttctaattctcttctccagggtgtagacgtggatatctcgtttagtgtatcagagcccagttaagcaaatggctrattttctctggaatttggggtctagttactttttagtgttactgactttacacaaggtttggaaaacaagccagttcagtgattttcttttcctcactat

SEQ ID NO: 52676 - DNA, 201 bp, Homo sapiens
ggtggaaagggagaaaagggagcttcttgggtgatggaaatctgtattttgattggggtgttggttatgcagaaatgcatttgtcaaaactcatcaaactrtatgtggattctgtgaacttcagtgggtgtaaagtatatctcattttttaaaaaagtccataaaatcttgatctgtgcagttcttttaaaaatatcattg

SEQ ID NO: 52677 - DNA, 201 bp, Homo sapiens
aaaagacagacagcagcctaggatattttcactgtgagatcttcttgttgttctggaaactaagcatgtaggttttccaaaaccttgtcaaatccacacayttagtgaattcttattgacaatttaagtgcaagggcactgtgaagcacttgaggaagggtaagactcaccttatcctacggagaagtcctgaccttctcg

SEQ ID NO: 52678 - DNA, 201 bp, Homo sapiens
ataaaaatcagaacaatggcaggcacagtgttggaaaggtagagtagagatcgggtggaaagggagaaaagggagcttcttgggtgatggaaatctgtatyttgattggggtgttggttatgcagaaatgcatttgtcaaaactcatcaaactatatgtggattctgtgaacttcagtgggtgtaaagtatatctcatttt

SEQ ID NO: 52679 - DNA, 201 bp, Homo sapiens
aactgtacccaatgagaaatcaggcagaatttttggagtaggactctggtaagaaaacagtgggccaggaggattaatgtgcaaacagggtaaaaatagtrtacaattgagggaatttatattcctgttatgatgctggattaggcaacaaatacatgacattaagctggtggcagcagaatggaaaggaacatatagatg

SEQ ID NO: 52680 - DNA, 201 bp, Homo sapiens
cctcccgggttcaagcgattctcctgcctcggcctcctgagtagctgggattacaggtgcctgccaccacacccagctaatttttgtattttcagtagagwcggggtttcactatgttggccaggctggttttgaactcctgacctgaagtgatctgctcacctcagcctcccaaagtgctgggattacaggcgtgagcca

SEQ ID NO: 52681 - DNA, 201 bp, Homo sapiens
tatttagtgatcaggagaatggttggtaccattaacaaaataaagaagatgagctaaactgaagagtttggttatacatatgtaaaatttcaggtcatggkggacatcaaagtttgtgcagcagtcaaggataagagcttgagagaagatgagagctggagatctaaatttgggacttgtcctgccacactatcaatgatt

SEQ ID NO: 52682 - DNA, 201 bp, Homo sapiens
agcacataaataaagcactccttgatcttcccaataaccttatgaaataggcattgtcatcatccctgttttacaggcgaggcacagaggttaagttacaytggtaagtgacagggaagggtttcaaacccaggcagcctggcttcagagtccatgcttttctgaaccactatattctgctacctcttgacacacaggttt

SEQ ID NO: 52683 - DNA, 201 bp, Homo sapiens
aagccaagatcacgccactgcacaccagcctgggtgacagagcgagactccatttcaaataataataataataataataataataaagtaagcattacctraattttacttatgtccctatcagatggttgtttcatggcttattttttgttttatctgtatagtcataaacaggaagctgatgacattgttcgagtggca

SEQ ID NO: 52684 - DNA, 201 bp, Homo sapiens
caaacccaggcagcctggcttcagagtccatgcttttctgaaccactatattctgctacctcttgacacacaggtttgacttcaggaattgatcctacagrtagcctcagaaattgttagggactttcttttcatacctggttaatccctacccctgttaagtaaagctaccttgtttaattttttttatccttaaaaatt

SEQ ID NO: 52685 - DNA, 201 bp, Homo sapiens
cccagctcatttttgtaattttagtagagacggggtttcaccatgttggccaggctggtctgaaactcctgaccccaagtgatccacctgccttggcctcygagagtgctgggatgacaggcgtgagccaccatgccaagccaaaagtgtctgttttcttatctccttaaataccatactctcccattctcaccaaactaa

SEQ ID NO: 52686 - DNA, 201 bp, Homo sapiens
cagactgggattaaacaagtctaggcttctagacaaagaagaaacagtgttttcttatctttttgagtgtactgaagcagaagttaactctttgctttcasatgtgtcccttatcatcgagaattgctggtggtcctgtatcattttattataggaaggaaggatggacaccagagagggtggggaatttggtttacaggg

SEQ ID NO: 52687 - DNA, 201 bp, Homo sapiens
atgtaagtgttttggcactgacttttttaaattatgaaaatgaaacatgacattgtaaattcaaacagtaagtgtaatgacaagtgagtttctttatcacyagctgctaagctccatgccctagagaccacccttcacaatttcttacattaatatgaccctctagaaatttttcatgcatacacatgtgtatataaaatt

SEQ ID NO: 52688 - DNA, 201 bp, Homo sapiens
gggaagggatagcattaggagaaatacctaatgtagatgacaggttgatgggttaatgggtgcagcaaaccaccatgcacatgttgtgtacctatgtaacraacctgcacattctgcacatgtatctgagaacttaaagtataatttaaaaaaaaatgtaaagaaaagcatctgccacagagcttgggccaataagtttgg

SEQ ID NO: 52689 - DNA, 201 bp, Homo sapiens
ttggtatatagcttttctgaagttatgcattacagttaattacattctaagagtgcattataaggttaatttcttgttttgataccagggtttgttaaaawggaacaatattttctagaaaagctttaaagtagtcatattcttacagattttaaatctaggactttgtctaactattgatgatttattgagtagctctgg

SEQ ID NO: 52690 - DNA, 201 bp, Homo sapiens
agcacatatgggagctcacagagaaggaggagggtgaggacagagtatttatcccatggccccttctctatggggttctctggatcgatgacctcaaatcygtcattgatgagccaaatcagctcctggtaggccttctccaaacagctctttttgcctttaggttctgctagctgccccacccaccacctgaggcccagg

SEQ ID NO: 52691 - DNA, 201 bp, Homo sapiens
caatgagaggtttcaatttcctaagttagaaaagggaagaaaatctggaaattagatttgttgggtcattgggaaaaaagatttaaagaagatgaaaacawacagtcaagactctttgcctcatttttcccttacaggcttcacaggctgctcaagaagccgagatcaatgccagaaaagccaaaaactctgttactagcc

SEQ ID NO: 52692 - DNA, 201 bp, Homo sapiens
tctgaaccactatattctgctacctcttgacacacaggtttgacttcaggaattgatcctacaggtagcctcagaaattgttagggactttcttttcatayctggttaatccctacccctgttaagtaaagctaccttgtttaattttttttatccttaaaaattcagacatccattacttaatcttgctcagttccccag

SEQ ID NO: 52693 - DNA, 201 bp, Homo sapiens
atacctggttaatccctacccctgttaagtaaagctaccttgtttaattttttttatccttaaaaattcagacatccattacttaatcttgctcagttccycagtttacacttttgaatggtaaaacttacttctttgtgtacatagtttttctgtgtgcatttctgggactttgcagctgttccattttttggagtatct

SEQ ID NO: 52694 - DNA, 201 bp, Homo sapiens
gctaggctggagtgagtgatctcaactcactgcaacttccacctcctgggttcaagtgattgtcttgcctcagcctcctgagtagctgggattacaggtgyatgccaccatgcccagctaacttttgtgtttttagtagagacggggtttcaccatgttggccaggctggtctcgaactcctgacctcaggtgatccacct

SEQ ID NO: 52695 - DNA, 201 bp, Homo sapiens
caaactacgtgcatcagagtaagaaatttaatttctctgactgtaggttccttgattatagagatgttgtaaagattaaatgagatgacacgttggaagtktctggcactgtgtaggggacatcacatgttccatgatggcagctgttattgttctggtacctgaagtgggaaggggagcaaggaaggaaacgtgaggatt

SEQ ID NO: 52696 - DNA, 201 bp, Homo sapiens
ctaggctggagtgagtgatctcaactcactgcaacttccacctcctgggttcaagtgattgtcttgcctcagcctcctgagtagctgggattacaggtgcrtgccaccatgcccagctaacttttgtgtttttagtagagacggggtttcaccatgttggccaggctggtctcgaactcctgacctcaggtgatccacctg

SEQ ID NO: 52697 - DNA, 201 bp, Homo sapiens
ggcgggtggatcacctaaggtcaggagtttgagaccagcctggccaacatggcgaaacccatctctactaaagatgcattagctgggcatggtgtgtatgygtgtaataccagctactcaggagactgaggtaggagaattgcttgaaccgggaggcggaggttgcaataagccaagatcacgccactgcacaccagcctg

SEQ ID NO: 52698 - DNA, 201 bp, Homo sapiens
attaaatttaaaagtagtttttctgaagaattataaacattttctcttataaatgtataccaataatttttttggaaaatattctcatctcagttttagartgctattcataaattcagccccactgaaatgatcacaaaattccaaatgaatgacgttttctaatatttgtagaattgttgcccatgttagtatatgtac

SEQ ID NO: 52699 - DNA, 201 bp, Homo sapiens
cacctgccttggcctcctaaagtgctgggattacaggtgggagccactgcgcctggccgcacaagattttttctcaaaactattttttctttatctcactraagagtacaacggggagaattttcccactcccctgttggagaggtgggtagctttgggaagaagaataggtcctagtattcctagaaaaaggtaaaaatg

SEQ ID NO: 52700 - DNA, 201 bp, Homo sapiens
aaatatcaaatgtaaataaaagtgttgatagtagctgaaattttgaaatttgctttcaaccatcttttcctaaatgtgaatagctattactgtgtctaccytgtttcttcttacggaacaatgaaatcactaagagtaagtgaacattttacaaggaaacatgctgataaagttggcagagatacgtcattgtccctcagt

SEQ ID NO: 52701 - DNA, 201 bp, Homo sapiens
tgagaatctaatgcctgatgatctgtcactgtctcccattgcccccagatggggccgtctagttgcaggaaaacaagctcagggctcccactgattctacwttatggttagttgcataattatttcattatatattacaaatgtaataataatagaaataaagtgcacaataaatgtaatgtgcttgaatcatcctgaaac

SEQ ID NO: 52702 - DNA, 201 bp, Homo sapiens
  misc_feature (1)...(201): n = A,T,C or G, or insertion/deletion polymorphism (see Tables 1-2)
atggagaaaccccgtctctactaaaaatacaaaattagccgggtatggtggtgcatgcctgtaatcccggctacttgggaggctaaggcaggagaaccacntgaacccaggaagcagaggttgcggtgaactgaaattgtgccattgcccttctgcctgggcaacaagagtgaaactatctcaaaaaaaaaaaaaaaaaaa

SEQ ID NO: 52703 - DNA, 201 bp, Homo sapiens
aacatttgtacacatgcagaagaaaaatctcttagagaccccactgtgtctccccttaccatctaataccttgtcctaaatacttaaacacagaaaaataktgtaactttatacccaggtacttaaagaaggacctcttgattttagttgttacctagtgacttttcactgcggtctcttgaagtagccaagattgcgttt

SEQ ID NO: 52704 - DNA, 201 bp, Homo sapiens
gtggtggtgcacgcctgtaatcacagctactcacttgggaagctgaggcaggagaattgcttgaacctgggaggcggaggttgcagtgagtcaagattgcrccactgcactccagcctgggcaacagagtgagactccgtctcaaaaaacaaaaacaaacaaacaaattattggcagaaaccccgagaagggaccactatc

SEQ ID NO: 52705 - DNA, 201 bp, Homo sapiens
aagggagtacagaaattaggggaaaggaacaggataataagtttttaaaaacaaacaattttgaagataagttttagccaatagaaactagcccttcaacrggcaataatgaggactgagtttttcagcatctggagtgactgcactgtaccagaccatcttggtatattccttatgtgcttagttgttctgtagtgcttc

SEQ ID NO: 52706 - DNA, 201 bp, Homo sapiens
ctgtaatcacagctactcacttgggaagctgaggcaggagaattgcttgaacctgggaggcggaggttgcagtgagtcaagattgcgccactgcactccarcctgggcaacagagtgagactccgtctcaaaaaacaaaaacaaacaaacaaattattggcagaaaccccgagaagggaccactatcttaactcacgactg

SEQ ID NO: 52707 - DNA, 201 bp, Homo sapiens
aggcccctggggtttgtagcaagtctgttactggcagtggagtgcttcttcaactaaattgactccatgcatctttttatttgtccctaaatatggggcaraaaagccacattgctcatagttggcatgaaacagttattaaaaactggataaaaaccaagggacatctgggttatttctctagctttgttccttctatgg

SEQ ID NO: 52708 - DNA, 201 bp, Homo sapiens
cagccctggcacctctcctgagctacctacttgccatttccacttggatggtgggctagaagccttccacttgcctttccacatccctgttcacctttctscaccctgactgagacctgcatgcactacatcaaatgtcaggctccatttgcattcagacagcagaaagcacatatgggagctcacagagaaggaggaggg

SEQ ID NO: 52709 - DNA, 201 bp, Homo sapiens
cgtgcccatgtagagaacacagagcggttgattgaaatcgcatccagagaacttgagaaagcaaaagtcgctgctgccaatgtggtaagtgattgcaaacrtctgaggtggggatgggggaggcccctggggtttgtagcaagtctgttactggcagtggagtgcttcttcaactaaattgactccatgcatctttttatt

SEQ ID NO: 52710 - DNA, 201 bp, Homo sapiens
ggatgttaagtttgagatacctatcagagagctgagtggaggtatcacgaaggtaatctgacactcaagggagaggtcagagctgaagtctcatcagcatrcagtctttaaagtcaaaggaatggctctgaaggttttttttgaagctggaaaaataaactagccacgtcttctcttcagaagtagacatgcatggagtgg

SEQ ID NO: 52711 - DNA, 201 bp, Homo sapiens
cttctgcaaaccattttagatgttgaccagaatttgatggatcgcctacagagagtgaataacactctgtccagccaaattagccgtttacagaatatccrgaataccattgaagagactggaaacttggctgaacaagcgcgtgcccatgtagagaacacagagcggttgattgaaatcgcatccagagaacttgagaaa

SEQ ID NO: 52712 - DNA, 201 bp, Homo sapiens
ggtgcccagctattcaggaggctgaggcaggagaactgcttgaacctgggcagcagagattgcagtgagccaagatcgcgccactgcactccagcctgggygacacagtgagactccatctcaaaaaaaaaaaaaaaaattaccctttctttctaagagtaatcagttgatcctgtcagggtcaacaacttattaaggaaa

SEQ ID NO: 52713 - DNA, 201 bp, Homo sapiens
agggcagttttgtgagatgtgcctctcaggttacagaagagaaactcctaatcttggaccatacagtccatgtgtgctttgcgcctgcaatggacacagcragacctgtgatcctgagacaggtgagatgatctttggcagctcttagacctaacttctctttagcaattgtgtagaaagtgctcattgtcttatatactt

SEQ ID NO: 52714 - DNA, 201 bp, Homo sapiens
tttctctttagtttccccagagtgttgccgagctaaggttcaatcagaggactcttagataccttaattttttttggctttatttttgaagaaagggatcrtcgttcccattaggacatgtatttacaatgtgttttcttttgcttgcccaccacactctaccactacttctagaacttaaaattctaggattgttttttt

SEQ ID NO: 52715 - DNA, 201 bp, Homo sapiens
gaccgaatgcccagtggagaggtgacctacaaatactctttaagttgatcagctagcaaacatttgccagacttctttctttcctacagcaaattattgcwttttcctgtcctgatgaggcaacaatagaaagaacagagaaagaacagtgtagtcagtagaaaatgcagtgatacaaagttgtaactgtggttttctggc

SEQ ID NO: 52716 - DNA, 201 bp, Homo sapiens
ttgttatacattctagtatagtaatccctgagctattacctattaaaaggcgtgtatttccttttaacttctgctttatgttatagttagagctacacacrtgtacaccacccaccccacttgtaagttatatatgttgtagattatataatttatgagttttattttgggatggtaaaggagaagcattttaaaatattt

SEQ ID NO: 52717 - DNA, 201 bp, Homo sapiens
tcacgctaagccttcaaaatccagtgtgtatctcacgtttatagcacatctcaattcagactcaccagccacatttaaagtgctcagtagccacatgtgacagcagctaccaacctggcaacacaggtctaaagaatctctttaggttgtttatattttagtatttctctcaggtgatttgtgtcttttgccatctctgtc

SEQ ID NO: 52718 - DNA, 201 bp, Homo sapiens
aattctgttgtcacctaggctaataattaccaagtgctcaccagtaacaactagaatcttctcagtaggttttttttttttggctttttttgttttaaatrtatatggccagttgattagtatgaattattgttttgtacttgcaagtcaatacaaggtaaaatagataattgtttatgcagccaagtattctgttttagt

SEQ ID NO: 52719 - DNA, 201 bp, Homo sapiens
tccagcctgggcaacagagtgagactccgtctcaaaaaacaaaaacaaacaaacaaattattggcagaaaccccgagaagggaccactatcttaactcackactgtttccactgaactgccgagaggagattttcttattcatcttttcaacaaatcctaagatttgcaagtaaaatttacagcctcctctaacatttgta

SEQ ID NO: 52720 - DNA, 201 bp, Homo sapiens
tgcatgacaccatgcccagctaatttttgtatttttagtagagtcggggttttaccatgttgatcaggcttgtctcgaactcctgacctcgtgatctgccygcctcggcctcccaaagtgctgggattacaggcgtgagccaccgcgcccagcccagttgaaactttttaaattgttaggagaatacctacagagcatttt

SEQ ID NO: 52721 - DNA, 201 bp, Homo sapiens
tggtgtctcaatgcttaaaaaaaaaaaaagatccactaaagccttcttcttgtcatttgaaggttattaaaatgtaatacttcccttgtacattcttaatrctgatttccagtgaacccagggattatttctcagagaggaaattctgttgtcacctaggctaataattaccaagtgctcaccagtaacaactagaatctt

SEQ ID NO: 52722 - DNA, 201 bp, Homo sapiens
gttgggacagtgtggacagtggtgttattctgctttaccgtctcagaacatcagatcttcaggtgggttgggcttggtggattgagggataagctagggcrtcttgagggaagagaaatagctaatgaaggaaggaaaagggcactttaaaactaacttaacaaaactctaatttttggtggcaataactcaagtttctaa

SEQ ID NO: 52723 - DNA, 201 bp, Homo sapiens
ctgatagaccactgctttaggatctctggatttcgactgcttctgttaaaagggctttacacttaagaacagaggattttttttttaattaaaaaaatatrtatgttttagacagggtcttgctctgtcatccaggttggggtgcagtggcacgatcctatttcattgcagcctcaaacacctgggctcaaacaaacctcc

SEQ ID NO: 52724 - DNA, 201 bp, Homo sapiens
ggactaaattaaaaaaatatatccaggccatggctttggaagggtgtttggaagagctgtgttcactaatcattggagaaaggccacggagctatttcctsaagatttaagacatcccccttttgtggacagtagtaatagaagacctgtctgttctgttgaactttcctttaagaactggaaaataactgaaaccaacca

SEQ ID NO: 52725 - DNA, 201 bp, Homo sapiens
aggaaggaaaagggcactttaaaactaacttaacaaaactctaatttttggtggcaataactcaagtttctaaaaaagttttcagttgtaatactgtactrtgaaataactgatcataagaaagagagaaaaagaacaaaaggggctgagtatggtggctcacacttgcagtcccagcacttgggaggccaaggtgggaga

SEQ ID NO: 52726 - DNA, 201 bp, Homo sapiens
gtgttttaaaccattaggtcagtaacttagagctgggtacttgactcgtaaaacgataggcatttaaatattctttggctcttttgatgaatcagaagatkcaattctaaactgacagagaaacctaggactaaattaaaaaaatatatccaggccatggctttggaagggtgtttggaagagctgtgttcactaatcatt

SEQ ID NO: 52727 - DNA, 201 bp, Homo sapiens
cacctgtagtcccagctacttgggaggctaaggcaggaggaggatcacgtgagctcaggaatttgaggctgcaatgagttatggtgacaccactgcactcmagagtgagaccctgtctccaaaaaacaaacaaatcaaaatgtgttcatgattttggttagaagaagtctgcattaaaaaagaaaaatatattccaaaaaa

SEQ ID NO: 52728 - DNA, 201 bp, Homo sapiens
ggttatctaaataagcagataaagtttaataggaaatttcatttcattgaaagggtgaattttgacatgttctaacaatttgagtgaatggattatgaaaytatggtaacaatatttagaactacagatagggcattacataaatgtttaaaagaagaaaagaaatagggttgaattctgataaaaagtgacctattagaa

SEQ ID NO: 52729 - DNA, 201 bp, Homo sapiens
tatagctacttaacagatcacccatttggagttgaggcttccctgtacatggatgtttctggaggatctagatttctttttaattctgctttcatctgtcstggcactaattttgacccatatgtctcaagttaccccagtctagatatataaataatctggcactttggaagttagtgtcttaatgtatttgactcatct

SEQ ID NO: 52730 - DNA, 201 bp, Homo sapiens
tgtattgttgtcacacattatgaaaatctcctgctgtttagggctttttgaattgagaatcacagatgaaggattatggacttatatcacatttgattacrtaagttatatcacttttacagatagtgataaaactactgaagactatataaaaatgtgaacaataggcatctggtaaattggttatctaaataagcagat

SEQ ID NO: 52731 - DNA, 201 bp, Homo sapiens
tttattgacatcctgttgggttttgttggtggtggttttttgtttgtttgtttttgagacagagttttagctcttgtcgcccaggctggtgcccagtggcrtgatctcagctcactgcaacctccgcctctcaggctcaagcgattctcttgcctcagcctaccaagtggctgggattacaggcatctgctaccacacccg

SEQ ID NO: 52732 - DNA, 201 bp, Homo sapiens
gatttaggaagatgggtgtatgttacataacaccctcagcaggacccccatctccaagcaattgaatatatctgcagtaaaatgtattcgtacgaaacagrctgatgaaaggctatcatagcctcacactaggtcatgtattgttgtcacacattatgaaaatctcctgctgtttagggctttttgaattgagaatcacag

SEQ ID NO: 52733 - DNA, 201 bp, Homo sapiens
ctttgactgtaaaaggttaactgctttgtgagttcttccttgttgatgattttgtttagtctaatctccttagagtgctgaaatattcttagcatgtttgygtgtgtacagagatgcacagcattcttagtctagcccattcttcaagagtttaacctttatatttgtcatttaggcctatatatacttaaattctagaca

SEQ ID NO: 52734 - DNA, 201 bp, Homo sapiens
tggtttttattacctttgtgaccatcaggagattgcatactggttctcaggcattgcttttaattaccagttatctttctttaacacattgattttacttrcgtatctggccgaatttttgtttgacaataggcattttacattttaggctctctaagcacacagtgtgatagttacggcagatgcagctgtaagccagga

SEQ ID NO: 52735 - DNA, 201 bp, Homo sapiens
ggtttttattacctttgtgaccatcaggagattgcatactggttctcaggcattgcttttaattaccagttatctttctttaacacattgattttacttamgtatctggccgaatttttgtttgacaataggcattttacattttaggctctctaagcacacagtgtgatagttacggcagatgcagctgtaagccaggag

SEQ ID NO: 52736 - DNA, 201 bp, Homo sapiens
cctctctacagaattcatctaaggtgagatctgatggatacaaaggaatgagccgagtgaaaagtaatggtaggtttgttccaggcagaaggaacctggtrtacagaggcctgaaagctggagagtggctggagcctgctgagtgcagagggtgtgttctgttttttaagacgggagaggttggtacggacaggttatatg

SEQ ID NO: 52737 - DNA, 201 bp, Homo sapiens
tcctaaagatagatttattcgtaatgtatttgagatcagacaaaaacattgacctgtaggcaaaataattcagttgaaacttttttctgagatggagtctyactctgttgcccaggctggagtgcagtggcatgatctaagctcactgcaacctccgcctcccgggttcaagtgattctcctgcctcagcctcctgagtag

SEQ ID NO: 52738 - DNA, 201 bp, Homo sapiens
ctttctttttcttacattttcatctctttatccctcctgctcatgtcccttcctctccctcaccttaagcacagcctgcttgggtttttgggtgtgtgtcytataataatatatcacttagtaaattataagcagcttgagaataaagaaggttctattcagtcataatgcttaagagtgttcatcaaattatttgggtta

SEQ ID NO: 52739 - DNA, 201 bp, Homo sapiens
aaactctgctaattgatattctggtcatactaaaaggctaatctatctatctttcttttgttctttcttttcttttttttttgacacagtctcgctctgtygcccaggctgagtgcagtggcatgatctcggctcaatgcaacctctgcctcctgggttcaagcagttctcatgcttcagcctcccgagtagctgggatta

SEQ ID NO: 52740 - DNA, 201 bp, Homo sapiens
tcctgctcatgtcccttcctctccctcaccttaagcacagcctgcttgggtttttgggtgtgtgtcttataataatatatcacttagtaaattataagcarcttgagaataaagaaggttctattcagtcataatgcttaagagtgttcatcaaattatttgggttaaataaaaccctttatttccattttcttctccctt

SEQ ID NO: 52741 - DNA, 201 bp, Homo sapiens; identical to SEQ ID NO: 11505

SEQ ID NO: 52742 - DNA, 201 bp, Homo sapiens
atttcctttttctctaattcctggaaatcatcccagtaaatttcaatcaaccaattaatttggtgttttatcctgtttgcatgtgcactttagcaagcctygtaattaatactggccatgaagttattatttatgattaactcagtatagtttgcttatttctataaaaagtcaagcatcaggcacttgatcaagaatgtg

SEQ ID NO: 52743 - DNA, 201 bp, Homo sapiens
atctggataatgaggtgaacaatatgttgaagcaactgcaggaagcagaaaaagagctaaagagaaaacaagatgacgctgaccaggacatgatgatggcmgggatggtaagaggttttggtatatttgctcattggcagaaagtgaacagtgtttaataataaagatcccccacttgttgagaagagtcttttttatatt

SEQ ID NO: 52744 - DNA, 201 bp, Homo sapiens
tttaacacattgattttacttacgtatctggccgaatttttgtttgacaataggcattttacattttaggctctctaagcacacagtgtgatagttacggmagatgcagctgtaagccaggagtgatgggggacaaatgtgaccgttgccagcctggattccattctctcactgaagcaggatgcaggtaaaatattttca

SEQ ID NO: 52745 - DNA, 201 bp, Homo sapiens
tgtgttcggaaaagtaagatgataatacaagttgaaagtggcatggatggatatggtggaacttgaaccaaatctggaaagatggatagggcttggaaggrgtgaagactagagaatggcttaaaggtgagacgtggcatatggataatagggatggcaagactggaacagaggtttcagtttacattagagaactgtagg

SEQ ID NO: 52746 - DNA, 201 bp, Homo sapiens
agaagctcttattcaaagagagctgtgataaggtcgaagccttgtagaagatataataagcattaaacacagaaatatgtttagctatttacattacagaygactaaaagattcctactgttgtggccatgagtaggagttgttattggagttccaagtttggatatggtgaaatcgtcgtctcttttcctttctaattat

SEQ ID NO: 52747 - DNA, 201 bp, Homo sapiens
gtaattctgaggtcagtggttcaggacagcagggtagttctccacgctgacattcagggactcatgagtgtttcctggaaataatctgggatcctttaggrtatcattcttatgtgcctggttgaggctgggtgataggcccctgtgctttccaattgggaagatattgaggagtgtgtgcctaaatcttaacacttgaaa

SEQ ID NO: 52748 - DNA, 201 bp, Homo sapiens
aaggcagtggttccaaatcagagctgtgcctcccagactcacctggagccttctgaaaacatagatgtctgcacctctgcacttgcttgttacgtctccaraggtgattttgttgtgcagtccctaggaaagacttaaaatggaaatgctgtctttgagtggttatatgtaatacaccaccccaaaacctaatggttttag

SEQ ID NO: 52749 - DNA, 201 bp, Homo sapiens
tgaagagtggaagttttctcccttctctgattgttttatccatttttcattgaataggccatgctcttgtgatccctctggcagcatagatgaatgtaatrttgaaacaggaagatgtgtttgcaaagacaatgtcgaaggcttcaattgtgaaaggtagtgcattctttctctagctgcattgtgttttctgttaccata

SEQ ID NO: 52750 - DNA, 201 bp, Homo sapiens
tgtgagactctgtctcaaaaaaaaaaaaatctgttaacatgtaaaacaaagggctgacttgaagagtggaagttttctcccttctctgattgttttatccrtttttcattgaataggccatgctcttgtgatccctctggcagcatagatgaatgtaatattgaaacaggaagatgtgtttgcaaagacaatgtcgaaggc

SEQ ID NO: 52751 - DNA, 201 bp, Homo sapiens
tcaactatcaccaacctggttcaaacctctgttatctctcacctgggattgcctaattgttctccctgcctcacctgctcccctacaatggctccaatctyaacatgaaagccaaaatggtcctttcaaaatgtacctcagattacaccacttttaaaccctccaatagcttcttgatacactaaaaccaaatcctttact

SEQ ID NO: 52752 - DNA, 201 bp, Homo sapiens
acttctttctttcctacagcaaattattgcattttcctgtcctgatgaggcaacaatagaaagaacagagaaagaacagtgtagtcagtagaaaatgcagygatacaaagttgtaactgtggttttctggcacctttgctaactgtacacccagtcagcctgtcttgagccatttccccaactgtaagaattgtgatgttt

SEQ ID NO: 52753 - DNA, 201 bp, Homo sapiens
aaaaaattagccaggcgtggtggcgggcagcagtagtcccagctactcgggaggctgaggcaggagaatggcgtgaacctgggaggtggagcttgcagtgrgccgagatcgcgccactgcactccagcgtgggtgacagagcgagactctgtctcaaaaaaaaaaaaaatgactttagggtccattttgttctatgtgtat

SEQ ID NO: 52754 - DNA, 201 bp, Homo sapiens
gcagtgagccgagatcgcgccactgcactccagcgtgggtgacagagcgagactctgtctcaaaaaaaaaaaaaatgactttagggtccattttgttctaygtgtatttcttttaaaaaagtctgttggctgggcgcctgtggctcacgcctgtaatcccagcactttgggaagccgaggcaggcggatcacaaggtcaag

SEQ ID NO: 52755 - DNA, 201 bp, Homo sapiens
ccaaagtgctgggaggcaattcaccttcctcagcctcccaagtagctgggattacaggtgtgagccactgcacgtgcccagccctctaatctggtcttctktgaggacttgtcctgtgcagatatctattcccattgttttaacaaaaatagctttcattgaaattttacatatgattgtttatggtatttaaattagttt

SEQ ID NO: 52756 - DNA, 201 bp, Homo sapiens
aatatttttaaaaataaaatcagtgactctttgagggctttttgatggttggcaacactttgtattatttagcatgcatagtttttgtagtttggcctttyaatttaatgaaaatgtacttttggctttagaatttatctcaatgaatagtgattacaaatgttatataaatagtaataaagtaaaatatagtttgagtgg

SEQ ID NO: 52757 - DNA, 201 bp, Homo sapiens
aatgcttatctttctctccgtcctctttgtctctgccttactgtaagttccttactgtaagttcccattgcatttcacctggattgttgccacagcctccwaataaactggtgggctttctgcctccagttttgccctttatatttgggcagccatcctttggactgagtgatgattctaaaatgcaaatctgatcataca

SEQ ID NO: 52758 - DNA, 201 bp, Homo sapiens
agccttctgaaaacatagatgtctgcacctctgcacttgcttgttacgtctccaaaggtgattttgttgtgcagtccctaggaaagacttaaaatggaaaygctgtctttgagtggttatatgtaatacaccaccccaaaacctaatggttttagataactgtgatttatgatttctcatgattctgtgttagcctgggtc

SEQ ID NO: 52759 - DNA, 201 bp, Homo sapiens
gaatcagacccttcagggttgcagcctgggaacttctgttttcaaagctgctacttagtgtccatacagtcccaggctggagagcactggtagcagttaarttaggaaaagaggttctgaatagcactcatgaaaattacttgaaccttaggggcttaataacccttaacattccatcttagtaacccttaccattcagtt

SEQ ID NO: 52760 - DNA, 201 bp, Homo sapiens
tgcctgcctcagccttccaaagtgctgggattataggcatgagccactgcacctgaccttcttgttgttgttaatgaacagtgcatctggtaatcattctyagtctaccaccatctgtctgtctcagagatgtgggaaattatgtttggttttaagtcttaaaatgctcttcttaaaggtacccagatctgatgtaactcg

SEQ ID NO: 52761 - DNA, 201 bp, Homo sapiens
tattgcaggtctctaattgcatatccagcactcaaggcaagaggtgtttcacaattcatgacttttttaggtttttagaaaagtgacacatgggctgggcrcggtagctcatgcctgtaatcccagcactttggaaggctgaggtgggtggatccatgaggtcaggagattgagaccatcctggctaacatggtgaaaccc

SEQ ID NO: 52762 - DNA, 201 bp, Homo sapiens
cagctatttttttttgtagttttagtagagatagggttttactgtattggccaggctggtgtcaaactcctgacctcgttatccacctgccttggcctccyaaagtactgggattacagatgtgagccaccacgcctggccacttgtcaatatatttaaaaatttttttatttttggcttgtcagtattgaccttaatatt

SEQ ID NO: 52763 - DNA, 201 bp, Homo sapiens
caggttcaagtaattctcctgcctcagcctcctgagtagctgggactacaagcgcacgccaccacatccagctatttttttttgtagttttagtagagatrgggttttactgtattggccaggctggtgtcaaactcctgacctcgttatccacctgccttggcctcccaaagtactgggattacagatgtgagccaccac

SEQ ID NO: 52764 - DNA, 201 bp, Homo sapiens
tctgtattccagcaaagttcttgggcaagcaggtgttgagttatggtcagaacctctccttctcctttcgagtggacaggcgagatactcgcctctctgcmgaagaccttgtgcttgagggagctggcttaagagtatctgtacccttgatcgctcagggcaattcctatccaagtgagaccactgtgaagtatgtcttca

SEQ ID NO: 52765 - DNA, 201 bp, Homo sapiens
aaaaagttttcagttgtaatactgtactatgaaataactgatcataagaaagagagaaaaagaacaaaaggggctgagtatggtggctcacacttgcagtyccagcacttgggaggccaaggtgggagactcatttgggaccaacctgggcaatatagtgaaaccctgtctctgcaaaaataaaaaataaaataattagca

SEQ ID NO: 52766 - DNA, 201 bp, Homo sapiens
agtgtataacaactcacattatacatgaattatatataaagacaatgcattttttaacggctttcaaggacctggaaaaaatttggtaaaattagtaaatwgtattatttactaattgattactcaattgatcagtaggtcaattgaggttacattgtatataaatagattttctaaaaaacctaattataggctaggcgc

SEQ ID NO: 52767 - DNA, 201 bp, Homo sapiens
ctcgaactcctgacctcaggtgatccacctgccttggcctcctaaagtgctgggattacaggtgggagccactgcgcctggccgcacaagattttttctcraaactattttttctttatctcactgaagagtacaacggggagaattttcccactcccctgttggagaggtgggtagctttgggaagaagaataggtccta

SEQ ID NO: 52768 - DNA, 201 bp, Homo sapiens
ggtcggttctgggtagctataacttcacccgtttctttcccaccaatcgttactataatctgtccaagactctactcttaccttctatatccagacactaygtgtcttgaatgcttatctttctctccgtcctctttgtctctgccttactgtaagttccttactgtaagttcccattgcatttcacctggattgttgcca

SEQ ID NO: 52769 - DNA, 201 bp, Homo sapiens
ctacagttcactgctttttctccaaattccttctccattctaagggcattcaaaaaagaatttacacattaggggagaagttggagctataaggcattcctccccccccccacctcttccatttgtcattggtcacatttgtgggaggaatcaagttttgactatttcagttctaaataattttagaaaattgggtgtgcc

SEQ ID NO: 52770 - DNA, 201 bp, Homo sapiens
aagcgatttgactgctaatcctggtgcagaatgaacaaaaggaagtgcactcactgtaattgctgggcatagccttgtccctgggtaaaaaggctctcctytactgtcttcccttttgctttcattcaaagcaactgtagaaacacgtgtaagtgatgtttcagaaatcaggaaagggatgtgtagaaaacttcatggcag

SEQ ID NO: 52771 - DNA, 201 bp, Homo sapiens
gtgcagggtgcagtgcatcctcggataaaaagagttaaagttgctatgggaaccagaattgcactttctgcttgttgtggggagaaatctccaccagccayttttctaagaagaagtcttttttgtttcaccttcaacttctggatggattattcagttgctgttaaaaagtttgggttttatgtcttataagttatagta

SEQ ID NO: 52772 - DNA, 201 bp, Homo sapiens
ttcaaagcaactgtagaaacacgtgtaagtgatgtttcagaaatcaggaaagggatgtgtagaaaacttcatggcagggcagtggattgaggatggacatrtgtatctggaagcaccaaaaataatgttcggtctagctaaggttttcttcatcattgagatacgtaaataggcagaaagtttcattattgtgtttaacag

SEQ ID NO: 52773 - DNA, 201 bp, Homo sapiens
ttcacagcctttgggggtctccttgtctttattttgattgttggaaatagagacccacgctttggccactatataacaaagtactaaaaatgtataataaygcaaattcactaatatgtttattaaaatataaacaagtttattacaaatctgtagctttattcacaactaacatccttatttttgtcctatatgcccacg

SEQ ID NO: 52774 - DNA, 201 bp, Homo sapiens
tcttcttagtaacagaatcctttatcccatgaaatcagactcccaatatataaaacaggtaagaatagtgttcagttatatacgtttattgtatttggtaygttaaatttaaggtggaaatctatgtttcaatcttcacttggtttcatcttaaaacttatttctatatattttgtttgcaaaattaaaaaagttcaaagt

SEQ ID NO: 52775 - DNA, 201 bp, Homo sapiens
tgccaaggttcccagcccccatactcccttcaaaaataaagtcctttccattttagtctttggttattagtgtgtgaaaactctgcctaaatcctgaactytctactctgatttgtcagaggaacagttctttcagttttaatttttgtctttagattttttggttggtgttttttttttcttcccctaggctcatctgta

SEQ ID NO: 52776 - DNA, 201 bp, Homo sapiens
atatgaagctgaccaattgagatgtgttaggaagggtagccattttagtttttttgtcagaagtgacatggttagatagcagagttgcaggaaaattagtmtaatggtagtaggttaagttattgtagcaatccagatgtgagttaatgagggataggactagggtgatgtcgatcagaaaggcaaaaggagagacactga

SEQ ID NO: 52777 - DNA, 201 bp, Homo sapiens
caggtttcccatttctagactagagctttctccaccaccctatgtactgtttctgtttttaagcctgtaaaacaacaaacaccacaataaacaccaaaacstggaaataggagattatgtatgcagacttgtacttcatgggacagagagctgcttctgggtttgtactctgctcagaaggtgtatgctttattttacttt

SEQ ID NO: 52778 - DNA, 201 bp, Homo sapiens
acagtaggaatattctttttccagttgggtgtagcaatcacggtaatgacatacacgaacttgtggttacttgctcactttcagtggcaaagaagaggccrtcgttcactgctgccagaaaacatagtccctcactgtgggtcattttcatcttgggatggaaaaaagaagtacaaagcctgttaatctcagtaaaaactc

SEQ ID NO: 52779 - DNA, 201 bp, Homo sapiens
ggtttgttccaggcagaaggaacctggtatacagaggcctgaaagctggagagtggctggagcctgctgagtgcagagggtgtgttctgttttttaagackggagaggttggtacggacaggttatatgggaacatgatgaccatagtaagaagtttagattttatcccaaatccaataagaatgcattgaagaaactctt

SEQ ID NO: 52780 - DNA, 201 bp, Homo sapiens
tttaattgagttatgagcccattttcattgaagtacctgcagagccctctcatacaatcaagcttggtagacgcctcaggcagtggagcatgggaaacctsgggaagagctgtcctctgttctcacctcactttaagcaggtagtggttttggttgatgcttcatcgtttgatgtggtaaaatggtaagtctgtgggtttt

SEQ ID NO: 52781 - DNA, 201 bp, Homo sapiens
aggaacctggtatacagaggcctgaaagctggagagtggctggagcctgctgagtgcagagggtgtgttctgttttttaagacgggagaggttggtacggrcaggttatatgggaacatgatgaccatagtaagaagtttagattttatcccaaatccaataagaatgcattgaagaaactcttaaaatctgggaaatcca

SEQ ID NO: 52782 - DNA, 201 bp, Homo sapiens
tactctttcctaaattttggggtcatttccagtattctaatggcaacgatactataacacagcccctaggatactgatattctgttatattgagaagaaascaggggtaaataaggtcttttgacattttaatgaactgattgcttagggtttcaagattaacccaccccgtatattgcaaggtcgcttctcagcctgaag

SEQ ID NO: 52783 - DNA, 201 bp, Homo sapiens
tctgtcctgaatttctccagtaatacctgtttggcacttaactagtccatgagggggcataaagggacctcgtagaccttggaagtcatttagtcgaccaygctcattatacaggtgaggaagctgaggtccagggagatagcaattgcttaagatcaggtttcccatttctagactagagctttctccaccaccctatgt

SEQ ID NO: 52784 - DNA, 201 bp, Homo sapiens
aattcattgatctgtcctgaatttctccagtaatacctgtttggcacttaactagtccatgagggggcataaagggacctcgtagaccttggaagtcattyagtcgaccacgctcattatacaggtgaggaagctgaggtccagggagatagcaattgcttaagatcaggtttcccatttctagactagagctttctccac

SEQ ID NO: 52785 - DNA, 201 bp, Homo sapiens
tgtgtaaaaaaaaaaacctactttataggattgatgtgaggattaaatgaaataaaggcattaggccgggtgcagtggctcatgcctgtaatcccagcatyttgagaggccaaggcgggcagatcacaaggtcaagagattgagaccatcctggccaacatggtgaaaccccatctgtactaaaaatacaaaaatgagatg

SEQ ID NO: 52786 - DNA, 201 bp, Homo sapiens
taaaatgccttctatacaacgtggctgtaaccttaacttctggggactggtatcacttgttactctttcctaaattttggggtcatttccagtattctaayggcaacgatactataacacagcccctaggatactgatattctgttatattgagaagaaagcaggggtaaataaggtcttttgacattttaatgaactgat

SEQ ID NO: 52787 - DNA, 201 bp, Homo sapiens
gcactctcccagtttacggaggaggaagccgaggcatagaagccacacagctatttgtgaggattcaggctgtgcactctagggtctggttatagaggctrttctctgaatcacactgtgctctgcctcagaataaaatgccttctatacaacgtggctgtaaccttaacttctggggactggtatcacttgttactcttt

SEQ ID NO: 52788 - DNA, 201 bp, Homo sapiens
gtgtttcttgcaatggagataagttgtgttcaaaataaatggccgagagaatagctgattttgatagatgaaaaagcagggccaggcgcagtggctcatgsctgtaataccagcactttgggaggcggaggcaggtggatcacttgaggtcaggcattcaaaacccacctggccaacatggtgaaaccctgtctctactaa

SEQ ID NO: 52789 - DNA, 201 bp, Homo sapiens
ccctgtccgtgtcctggaggttcaagttgtgctgttgttcccaagacaaaggaggtggtgtgcaccaactgtcctactggcaccactggtaagtctgctcrcttcatctgctttcagtgttcccttctataaaaagacctaggggaaaggggcttcggagttgttttggatctttgtgtttggttcagtttcagtggttat

SEQ ID NO: 52790 - DNA, 201 bp, Homo sapiens
tttttatttagtgctgcaaaaaagaaaaatgaaactttacctgaatactaggtaactgaatagacataacggaaacctcttccatttatctaccttgggtrtatatattggccttcatctcatttagtttttacttcctcccaaattcagacacaacctcaatcccacttaagactaaaagaattatactgaaacaagatt

SEQ ID NO: 52791 - DNA, 201 bp, Homo sapiens
gagacctgtgatcctgagacaggtgagatgatctttggcagctcttagacctaacttctctttagcaattgtgtagaaagtgctcattgtcttatatactygtacatttgcctgttttctcacgcctgccttccaaataggtgtttgtaactgcagagacaatacggctggcccgcactgtgagaagtgcagtgatgggta

SEQ ID NO: 52792 - DNA, 201 bp, Homo sapiens
tgtatgtctgttttaaaatacagtgtccagcacatagtcaaagatggttaggcacattaaaaaatagggctataaatgaaagaaaacctagcaaaataatrgacaagagaagcagatacccaaatttcaggtatagaaattacagctgtgtttagtatgcttaacagaaaaaaggacaagtttgaagatcaggccactgga

SEQ ID NO: 52793 - DNA, 201 bp, Homo sapiens
tgattggggtgttggttatgcagaaatgcatttgtcaaaactcatcaaactatatgtggattctgtgaacttcagtgggtgtaaagtatatctcatttttwaaaaaagtccataaaatcttgatctgtgcagttcttttaaaaatatcattgagtattaggtgttacagagttcctaagcctaccttttcattagtttaaa

SEQ ID NO: 52794 - DNA, 201 bp, Homo sapiens; identical to SEQ ID NO: 11512

SEQ ID NO: 52795 - DNA, 201 bp, Homo sapiens
aggcatggggacatttaattcaagtgttcgttgcagggtctgcagacagctctttgaatatcttaaactccaagggtcctgtctgacttatgtatctgtckgcttccttagaggccagcttcatagagagccctctttcctcagattttcaacattgtattccgtttgcaaagacccttctttatgggtgtggtcacttct

SEQ ID NO: 52796 - DNA, 201 bp, Homo sapiens
cacgtgactggccaggactgtggtgcttgtgaccctggattctacaatctgcagagtgggcaaggctgtgagaggtgagacataggtgcctttggtgaaartaatctttgctttttctgttataaaaaatgaatttttataagtacatttaataattgactgttcagaaattactggagcgcctaatgtaggcaaggcatc

SEQ ID NO: 52797 - DNA, 201 bp, Homo sapiens
ttcaccacttcaactatcaccaacctggttcaaacctctgttatctctcacctgggattgcctaattgttctccctgcctcacctgctcccctacaatggmtccaatctcaacatgaaagccaaaatggtcctttcaaaatgtacctcagattacaccacttttaaaccctccaatagcttcttgatacactaaaaccaaa

SEQ ID NO: 52798 - DNA, 201 bp, Homo sapiens
agcagtactgcctattgaggtgggttgatttgttgttctgaatagttctgccacctccaatttcattttaaagtcattgattttcaggtgcatttgtaagrctagcatcattaatatcagcacttaatagctaacatttattaactactatgtgctatgcatggtgttgagtgcttttcttagattaatttaatcctcagc

SEQ ID NO: 52799 - DNA, 201 bp, Homo sapiens
ccaaggagggagagatccgtcattctgaatttatttgtttgaatttatgggacaaaaatgctataaatcaaatcccttgttagggttttccagtgcgttawatgtaaaaacttgaaaagtttgctgaaaaacttggtttccgtgtccatatttaatagatcatattttccccagatattttcgactatagccattataaga

SEQ ID NO: 52800 - DNA, 201 bp, Homo sapiens
aagggtatgtgggtttccttatccaaacacaggtaaatgagggaagagatgtaaacaacgattactctgttcttcctagtgttggttggagttctctgtamttctgtttcctgtccaaggagggagagatccgtcattctgaatttatttgtttgaatttatgggacaaaaatgctataaatcaaatcccttgttagggtt

SEQ ID NO: 52801 - DNA, 201 bp, Homo sapiens
ctctcccaaactctgctaattgatattctggtcatactaaaaggctaatctatctatctttcttttgttctttcttttcttttttttttgacacagtctcrctctgtcgcccaggctgagtgcagtggcatgatctcggctcaatgcaacctctgcctcctgggttcaagcagttctcatgcttcagcctcccgagtagct

SEQ ID NO: 52802 - DNA, 201 bp, Homo sapiens
agtagtattttgagggtgatagggaaagagaattgtctttttggcttaaactttaattttgatacttcatcgaaaaatctaatttccatagagattacggrtttatcttctccaaaatcatactgtctatttcagaacttttgttttcctcttagctccatagtgataatcataccattatttttataatagcttttgata

SEQ ID NO: 52803 - DNA, 201 bp, Homo sapiens
ataaaaatggtggttgttttaagccactgagctttggagtagcttgttgtgcagcagtagataactggaacacttactgagtctctgggattattgagttrgagtgcctatgctgctcttcccaaggggaatcagccttttttccttcctggaatggttgcttagaagaacctgtagacacccagaggaagttacactttt

SEQ ID NO: 52804 - DNA, 201 bp, Homo sapiens; identical to SEQ ID NO: 11528

SEQ ID NO: 52805 - DNA, 201 bp, Homo sapiens
tgagatgatctttggcagctcttagacctaacttctctttagcaattgtgtagaaagtgctcattgtcttatatacttgtacatttgcctgttttctcacrcctgccttccaaataggtgtttgtaactgcagagacaatacggctggcccgcactgtgagaagtgcagtgatgggtactatggagattcaactgcaggca

SEQ ID NO: 52806 - DNA, 201 bp, Homo sapiens
gtttttcaaaaaaattataatgacagtatagtcagcttatagtcagcttattgttatcagtctgaattaagagatatactcttccttcttttgctaattaygtattattttctccttattctgcagcctgtgactgtcatcctgagggatctctttcacttcagtgcaaagatgatggtcgctgtgaatgcagagaaggct

SEQ ID NO: 52807 - DNA, 201 bp, Homo sapiens
tcggtcttggcctggctgccaggaatgtccagcttgttaccggctggtaaaggataaggtaagctgtcaatagtgcattcattcattcatccagcagacgytgagtggcaacttactgtgcactaatctctatagaaaaagtggtgaacaagatagatgtggtccctgttcttaaagacttatgtttcagttgggaggcaa

SEQ ID NO: 52808 - DNA, 201 bp, Homo sapiens
cagatcaagccttcgaggatagactaaaggaagcagagagggaagttatggacctccttcgtgaggcccaggatgtcaaaggtacgcatgattgaacagtrcatgacttctgtgagatggaccaatctttagatgtggctcctaaagcaaggttattagtatagttttataaaattctttctcagtttttaaactactcat

SEQ ID NO: 52809 - DNA, 201 bp, Homo sapiens
tgttttttagtttggctttctcttatttcaaggtcaatctgtttgttttatttaaaagagagattggagcaattttagaattaggtatttaagaatcagasaaacctcttagtttccttagaacagttggcttttggattaattatattttataaaatactcatatttcaggattgtggtctttttgtacattatgatgaa

SEQ ID NO: 52810 - DNA, 201 bp, Homo sapiens
cttagggcctatacttgattcatcttcctttcaagtcctagaaacagtcagcaaatcttactgatgttatctcagatctgaccacttttcaccacttcaastatcaccaacctggttcaaacctctgttatctctcacctgggattgcctaattgttctccctgcctcacctgctcccctacaatggctccaatctcaaca

SEQ ID NO: 52811 - DNA, 201 bp, Homo sapiens
gtgtcttaggtatgaacaagcgaagaacatctcacaggatctggaaaaacaagctgcccgagtacatgaggaggccaaaagggccggtgacaaagctgtgragatctatgccagcgtggctcagctgagccctttggactctgagacactggaggtatgggggcagcctgtacgcacagccccaccccgtctctcccccaa

SEQ ID NO: 52812 - DNA, 201 bp, Homo sapiens
tgacaaagctgtggagatctatgccagcgtggctcagctgagccctttggactctgagacactggaggtatgggggcagcctgtacgcacagccccacccygtctctcccccaagtctatgtgagagccgactgctctgcacctccctctgtcctcccactgactcgctggtaaagttgagtcttatttcacatacgctaa

SEQ ID NO: 52813 - DNA, 201 bp, Homo sapiens
ccattttctgctgtgattttgattcacatagccaaaggaactcaaatttaaacaaatccaagttaaatatttgatttcctccctttttcttcgaccctttrtttctcctccagtcttgttcatcttagtaaatatgctgccattagcctagttgctcaagctgaaaccttagggcctatacttgattcatcttcctttcaa

SEQ ID NO: 52814 - DNA, 201 bp, Homo sapiens
ttccattttttaccctgacttccattgttcataaaacaaaatccagttggaactccctgaaaggccccctttttacttgttgggagtttagctcaaatgtrtccttgaacttgtttcagattttgataggcgtgtgaacgataacaagacggccgcagaggaggcactaaggaagattcctgccatcaaccagaccatcac

SEQ ID NO: 52815 - DNA, 201 bp, Homo sapiens; identical to SEQ ID NO: 11524

SEQ ID NO: 52816 - DNA, 201 bp, Homo sapiens
acatattcatgcagcacaccaacatggcacatgtatacatatgtaacaaacctgcatgttgtgcacatgtatcctaaaacttaaagtataataataatttwaaaaaaaaaagaactacatattcatggagtgcccatgattcctgcaggaagtgtgattgagttcttcaggaatacttgtgtgtcctacctttcccttttc

SEQ ID NO: 52817 - DNA, 201 bp, Homo sapiens
aggcgcagttgcttacacctgtaatcctagcactttgggaggctgaggcgagcagatcacttgaggccaggagtttgagaccagcctggccaacatggtgraaccccgtctctattaaaaatacaaaaattagccaggtggggtggcaaaagcctgtaatcccagctacttgggtggctgagggatgagattcgcttaaac

SEQ ID NO: 52818 - DNA, 201 bp, Homo sapiens; identical to SEQ ID NO: 11529

SEQ ID NO: 52819 - DNA, 201 bp, Homo sapiens; identical to SEQ ID NO: 11531

SEQ ID NO: 52820 - DNA, 201 bp, Homo sapiens; identical to SEQ ID NO: 11535

SEQ ID NO: 52821 - DNA, 201 bp, Homo sapiens
atgaaaagaccagagaagcccagcaggccctgggcagtgctgcggcggatgccacagaggccaagaacaaggcccatgaggcggagaggatcgcgagcgcwgtccaaaaggtgtgcgtttcctcttctccaagagtccctgcccatatctttctctggtcactttccagtttctttccagaccctcagagcccttgcagat

SEQ ID NO: 52822 - DNA, 201 bp, Homo sapiens
gccaagaacaaggcccatgaggcggagaggatcgcgagcgctgtccaaaaggtgtgcgtttcctcttctccaagagtccctgcccatatctttctctggtyactttccagtttctttccagaccctcagagcccttgcagatttttttcctgaacttcagtaaaattgtcttaaaccatatttgtctttttttttttcttt

SEQ ID NO: 52823 - DNA, 201 bp, Homo sapiens; identical to SEQ ID NO: 11519

SEQ ID NO: 52824 - DNA, 201 bp, Homo sapiens
tttcttgtatataagaaatttttgaagatggcattgtctaccaccccaccaaaacatatgaaacttacatctagtttaatttttcacgttttgtgataatktgtatgcaaggtactatttgtaacaaaattgacttgtcaatggatggcccaaggaagaactaaggtccatttttctgttctatgctatattttgctttga

SEQ ID NO: 52825 - DNA, 201 bp, Homo sapiens
ggtttcaccatgttggccaggctagtctcgaactcctgacctcaagtgatctgcctgcctcggcctcccaaagtactgggattacaggccttagctactgmgcccggcccattctcaattccaaccactgccatcttgtccctggcactgcttttggtgcagctgtgacctctgtggcttgaagctgatggatacttctta

SEQ ID NO: 52826 - DNA, 201 bp, Homo sapiens
gaggatcccacagtcagtattaagttggccttgggtcgtcttaatcagtgaggctctatttgtgcaatccatccgctgaggtggaacaataacagctggtktgcagctggatatgttgtcctgggaactcttgtttcagccagcagttatgctaacaaaattgaaaacattttcaaatagttgctttctgtgactactgtt

SEQ ID NO: 52827 - DNA, 201 bp, Homo sapiens
ctgtaatcccagcactttgggaggccaaggtgggctgatcacctaaggtcaggagttcgagaccagcctggccaacatggtgaaaccctgtctcttctaawaaaaaaaaatacaaaaattagccgggcatggtggcatgcgcctgtaatcccagctgcttgggaggctgagacaggagaattgcttgaacccaggaggcgg

SEQ ID NO: 52828 - DNA, 201 bp, Homo sapiens
cctccttcgtgaggcccaggatgtcaaaggtacgcatgattgaacagtgcatgacttctgtgagatggaccaatctttagatgtggctcctaaagcaaggttattagtatagttttataaaattctttctcagtttttaaactactcatagattataaatcatttcattttttaaacactaattcaaaaagcaacctgaca

SEQ ID NO: 52829 - DNA, 201 bp, Homo sapiens
tttatacaaaactgtaaaggttatttgtctgcatttttaagttgtgctgatctaaatatactttctaagggattgtcctcttgcactgttggcatttgacygattgacaagggggaggccatgaaaagggagtacagaaattaggggaaaggaacaggataataagtttttaaaaacaaacaattttgaagataagtttta

SEQ ID NO: 52830 - DNA, 201 bp, Homo sapiens
ctccttcgtgaggcccaggatgtcaaaggtacgcatgattgaacagtgcatgacttctgtgagatggaccaatctttagatgtggctcctaaagcaaggttattagtatagttttataaaattctttctcagtttttaaactactcatagattataaatcatttcattttttaaacactaattcaaaaagcaacctgacaa

SEQ ID NO: 52831 - DNA, 201 bp, Homo sapiens
gaaaaagtaaactattggtcaactttttgtgactttgtgggattattggagttgaccttagtctattactataccaccgtgactaggtattagaatcttgkttttctaattagattttctctttttaaaaaaactatttttcactcttctgttatagataaaagccaaactatagccagctttcaatagtatatgaatatc

SEQ ID NO: 52832 - DNA, 201 bp, Homo sapiens
tccttcgtgaggcccaggatgtcaaaggtacgcatgattgaacagtgcatgacttctgtgagatggaccaatctttagatgtggctcctaaagcaaggttattagtatagttttataaaattctttctcagtttttaaactactcatagattataaatcatttcattttttaaacactaattcaaaaagcaacctgacaaa

SEQ ID NO: 52833 - DNA, 201 bp, Homo sapiens
ggacctgagtatgagatttaagttgaatgagcatactaataaagaataatttgaagaactattcaaaaacagagatcagtttgaaagaaattacactgataatgctggcacatgggggtggcaaaagagtctatttagtttaaaatacaaaatgagtttaatttgtcatacttcaacttatgttttaaacctagttttttc

SEQ ID NO: 52834 - DNA, 201 bp, Homo sapiens
acctgaggtcgagagttcgagaccagcttgaccaacatggagaaaccccgtctctactaaaaatacaaaattagccgggtatggtggtgcatgcctgtaawcccggctacttgggaggctaaggcaggagaaccacttgaacccaggaagcagaggttgcggtgaactgaaattgtgccattgcccttctgcctgggcaac

SEQ ID NO: 52835 - DNA, 201 bp, Homo sapiens
ccagccggcccggctaatttttgtaattttagtagtgtcagggtttcaccatattggttaggctggtctcgaactcctggcctcaagtaatcccctgcctsggcttcccaaagtgctggaattacaggcgtgagccaccgcgcccggctgataatgaaatgtctaagcacttaagaacgtgcattcaaaagactggagttt

SEQ ID NO: 52836 - DNA, 201 bp, Homo sapiens
cccaaacaacatgactcttttggcagaagaggctcgaaagcttgctgaacggtaacttctagatccctgtttaatggttaagttgtggcttccgttatggkgtgtgtgtgtgtgtgtgtgtgtgtgtgtgtgtgtgtgtgtgtgtgtggtcttatcccataacccataaacactttctacataacccacttttgcacactt

SEQ ID NO: 52837 - DNA, 201 bp, Homo sapiens
tgaggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatct

SEQ ID NO: 52838 - DNA, 201 bp, Homo sapiens; identical to SEQ ID NO: 11533

SEQ ID NO: 52839 - DNA, 201 bp, Homo sapiens
ttcctccccgggggcgcgcactcgggcacgcgctcggaagtcgggggtcggcgcggagtgcaggctgctcccggggtaggtgagggaagcgcggaggcggsgcgcgggggcagtggtcggcgagcagcgcggtcctcgctaggggcgcccacccgtcagtctctccggcgcgagccgccgccaccgcccgcgccggagtca

SEQ ID NO: 52840 - DNA, 201 bp, Homo sapiens
gtttgacattctagtgttcagttaagaattctctctgtatgcatataatggctgttttatgatcacattttaattcctatgataagtcaattttggccctycagtttactgaagtgtatatggcattttggggcattgcaattaggcaatgcaagcagaaagcttttattttttagaacttctgcattaggttagtgctgt

SEQ ID NO: 52841 - DNA, 201 bp, Homo sapiens; identical to SEQ ID NO: 11536

SEQ ID NO: 52842 - DNA, 201 bp, Homo sapiens; identical to SEQ ID NO: 11537

SEQ ID NO: 52843 - DNA, 201 bp, Homo sapiens
gaggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatctg

SEQ ID NO: 52844 - DNA, 201 bp, Homo sapiens
cagtggccggcctcacgggcgcagacggccgcgtgtttgctctctgttccccggcatgggccacacagaaactcctttctccaacttcttaaatagatacygcttttaacatcccgtgagggccaggatgttccgcacgagtctctctgctttcctgttctttctgacttaacgggattctggctctctgattattctgca

SEQ ID NO: 52845 - DNA, 201 bp, Homo sapiens
acttaactatgaaaattttcaaagaataggacatttctaataagtccctaagagtgtcctgaaggacatgttttggttctgaaacatagtttctataatcrtccttaaaaaataacttgtttctgcttaataggctttactatgaatatacctccatatattattgagttagaatgtgagaaaaggagattaatttttgaa

SEQ ID NO: 52846 - DNA, 201 bp, Homo sapiens
ggaaacaagaaggtccgccttaaacactttcgcctttaaaatgtttagatgtccttccagggctgagggtgattgctctgttgagttaagggggaatttgrggggagcaaatgccttcgctgcctatattgcctatgtgtaattaaaacataaattcacttttgaagttattgttctttatagctgctcagccttaattaa

SEQ ID NO: 52847 - DNA, 201 bp, Homo sapiens
acacttggggtcaggtgatctgcctgccttggcctcccaaaatgctaggattgcaggcataagccagcattcccggctgtatacttttcaaggggcggggrgaatgcatttgtccttataggctccgttactgtaggcatttagtactgcttgaaaattaaattagaaagtaagtgccacttaaaaagtttataaatatgc

SEQ ID NO: 52848 - DNA, 201 bp, Homo sapiens
acagaggaatctatgtgtgagaaacacgtttgacttaacacttcactccccattgccttggaaggcttgattattaccagtagctggtactaatgaacttccagagagaacagactgcctcaagccattcttctgtcaagggagggtaattttgtaaggctaatatcacttaggggtgttggaaaggaacatgttgtaggc

SEQ ID NO: 52849 - DNA, 201 bp, Homo sapiens
actacatcaaatgtcaggctccatttgcattcagacagcagaaagcacatatgggagctcacagagaaggaggagggtgaggacagagtatttatcccatrgccccttctctatggggttctctggatcgatgacctcaaatccgtcattgatgagccaaatcagctcctggtaggccttctccaaacagctctttttgcc

SEQ ID NO: 52850 - DNA, 201 bp, Homo sapiens
aggagggcaactgcggaaagtgccagtgaatgcctgcgtgagtgccccatgacgtcagtctgtcagttgtcttaaggacttccaagggtggaagaaggaaygggtgactttcttttattcctccttgaaaggaaagctctgaaaggccagctttttgtgtaatttgagtagtattcaagtcagaggaaagtcatagatgag

SEQ ID NO: 52851 - DNA, 201 bp, Homo sapiens
atactggttctcaggcattgcttttaattaccagttatctttctttaacacattgattttacttacgtatctggccgaatttttgtttgacaataggcatyttacattttaggctctctaagcacacagtgtgatagttacggcagatgcagctgtaagccaggagtgatgggggacaaatgtgaccgttgccagcctgga

SEQ ID NO: 52852 - DNA, 201 bp, Homo sapiens
ttctttaacacattgattttacttacgtatctggccgaatttttgtttgacaataggcattttacattttaggctctctaagcacacagtgtgatagttayggcagatgcagctgtaagccaggagtgatgggggacaaatgtgaccgttgccagcctggattccattctctcactgaagcaggatgcaggtaaaatattt

SEQ ID NO: 52853 - DNA, 201 bp, Homo sapiens
acctgccaccacacccagctaatttttatatttttactagagacggggtttcaccatgttgatcaggctggtctccaactcccaaactaaggtgatctccygccttggcctcccaaagtgctgggactacaggtgtgagccaccgcgcccggtggattagagtattttaaatagcacatcacagtggacttttaagttcac

SEQ ID NO: 52854 - DNA, 201 bp, Homo sapiens
gagggtgaggacagagtatttatcccatggccccttctctatggggttctctggatcgatgacctcaaatccgtcattgatgagccaaatcagctcctggkaggccttctccaaacagctctttttgcctttaggttctgctagctgccccacccaccacctgaggcccagggtatggagcctatctcaagtgctgcactc

SEQ ID NO: 52855 - DNA, 201 bp, Homo sapiens
catcttcttgtttctctgtcatcccttctgtagtctttggtcagtacagcaaccagtcatccttttgaaatgctagttagagcctgttactcctttgtatraaactctccagtgggttctcatcttattcagagtacaaaccaagtcttacagtgatctacagagccctccatgttggcattccctcctcctctcagcttc

SEQ ID NO: 52856 - DNA, 201 bp, Homo sapiens
gtatatctgaaactgaactcccagtttcttactctccatccccccatggctgcttcatcattccagttgtataagccaaagcttgcatcccacatccagtycatcagtaaaagtggtttgttccaccctcaaaatatgtccaaaataccattatctgttagctggattgttgcaaaactcatctaactcatcttcttgttt

SEQ ID NO: 52857 - DNA, 201 bp, Homo sapiens
ttctactcttttggtattctttctacttcagtggcttttctctccagtctccttttctgggtcctccccatttcccccattgctaaaagttggtatgtccygagacccagtctgtgtacctcttatctatctatgtccattccctagttgttttcctctaatcccatggctttgaatactaactgtatgctgacgacttcc

SEQ ID NO: 52858 - DNA, 201 bp, Homo sapiens
cattcctgagattttagagtactgcaccagactagggtggcactaattaagtatgtctgcttttctatgtgtgtgctcttctaggggccagcccgaaatamgtgggcccagtcagcctggtacagctacatattcatgaaataaaataaagcagacttctctctttcttagacaatggcaccctcagatctcttgtgggag

SEQ ID NO: 52859 - DNA, 201 bp, Homo sapiens
tgcccagcattctctatggctttcattcctgtcagttctaacaaagcacttcaaggtcacacctccaggttgccaaatccagtagccaatgctcagtcttyatctttcttagcatttcaggagtatatgacaaagttcagttggtcactctcttctttttaaaagaagctttttaaaatttggcttctggaattctactct

SEQ ID NO: 52860 - DNA, 201 bp, Homo sapiens
caaattagttaagaaagttagcagcagccactgaatgaggacctactatgtgtaagcatattttatgctcattttcctcacaagaactctatgaagtagayatcaaattattgcaggtctctaattgcatatccagcactcaaggcaagaggtgtttcacaattcatgacttttttaggtttttagaaaagtgacacatgg

SEQ ID NO: 52861 - DNA, 201 bp, Homo sapiens
ctgtttgggtacagataactctttttagtctggattcttacagtgatcctgaaaatgtatattatgccttttctctttaggaaatctttgggaaggctttkttagagaacgtctttgtggatgaaaggggctctctttctccacatctcttagacccactccaatccactccaaaccaccagagaaagtcctcattgttca

SEQ ID NO: 52862 - DNA, 201 bp, Homo sapiens
ggaagacatagacctgggctggctctaatggaaaggggccttctagagcgcctgggggttttgaactgtttgggtacagataactctttttagtctggatwcttacagtgatcctgaaaatgtatattatgccttttctctttaggaaatctttgggaaggcttttttagagaacgtctttgtggatgaaaggggctctct

SEQ ID NO: 52863 - DNA, 201 bp, Homo sapiens
aggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatctgt

SEQ ID NO: 52864 - DNA, 201 bp, Homo sapiens
gacactgctggaaaaatggtgtcactttttccaagagtgttgttttccttgtctttctgcttcactggttcatttttgtgagctgtataagagctaaaggwtattattacagatttcattttttgaaatgcatcaaaatctccatcccctcccctacctgctaatctttttgcttgttaagaaagaaagtgcttctttctg

SEQ ID NO: 52865 - DNA, 201 bp, Homo sapiens
cttgaaccgggaggcggaggttgcaataagccaagatcacgccactgcacaccagcctgggtgacagagcgagactccatttcaaataataataataatamtaataataataaagtaagcattacctgaattttacttatgtccctatcagatggttgtttcatggcttattttttgttttatctgtatagtcataaacag

SEQ ID NO: 52866 - DNA, 201 bp, Homo sapiens
tgaattctgaaacaggcctggtttgtttaagtaacaaaccagaagattcacaacaaccagtcaaaaggggcccagtttacctgggcatgataagaagtctyctctgttttaaccctaaaaggaaagtaacttttgaaacagtcaatctgctttttgttctgtttctgcttttctcagaacttttttgtctataaaaccaat

SEQ ID NO: 52867 - DNA, 201 bp, Homo sapiens
cgggaggcggaggttgcaataagccaagatcacgccactgcacaccagcctgggtgacagagcgagactccatttcaaataataataataataataataakaataaagtaagcattacctgaattttacttatgtccctatcagatggttgtttcatggcttattttttgttttatctgtatagtcataaacaggaagctg

SEQ ID NO: 52868 - DNA, 201 bp, Homo sapiens
tctacagttcactgctttttctccaaattccttctccattctaagggcattcaaaaaagaatttacacattaggggagaagttggagctataaggcattcctccccccccccacctcttccatttgtcattggtcacatttgtgggaggaatcaagttttgactatttcagttctaaataattttagaaaattgggtgtgc

SEQ ID NO: 52869 - DNA, 201 bp, Homo sapiens
agaaaattttttcttttttttgttgtttttgtgagatgaagtctcactcttgtcccccaggctaaagtgcaatggcgcgatctcggctcactgcatcctcygcctcccgggttcaagcgattctcctgcctcggcctcctgagtagctgggattacaggtgcctgccaccacacccagctaatttttgtattttcagtaga

SEQ ID NO: 52870 - DNA, 201 bp, Homo sapiens
ttgataagctggtgtgtaattgcaaacataacacatatggagtagactgtgaaaagtgtcttcctttcttcaatgaccggccgtggaggagggcaactgcrgaaagtgccagtgaatgcctgcgtgagtgccccatgacgtcagtctgtcagttgtcttaaggacttccaagggtggaagaaggaatgggtgactttcttt

SEQ ID NO: 52871 - DNA, 201 bp, Homo sapiens
tgtgtgtggccgcttcctcttatattgagggcaacattagattcttttatttttagatttttgttattttatctttttgttttgaaagttggaggagataktaattcaaaatcagtcttcttcacattgcttgcttttttttttatttttaaagagacaaagtctcactctgttgcctaagctggaagtgcagcggtgcag

SEQ ID NO: 52872 - DNA, 201 bp, Homo sapiens
ctgcctcccgggttcaagcgattctcctgcctcggcctcctgagtagctgggattacaggtgcctgccaccacacccagctaatttttgtattttcagtasagacggggtttcactatgttggccaggctggttttgaactcctgacctgaagtgatctgctcacctcagcctcccaaagtgctgggattacaggcgtgag

SEQ ID NO: 52873 - DNA, 201 bp, Homo sapiens
tcaagcgattctcctgtctcagcctcccgagtagctgggattacaggcacacacaccaccatgccctgctaggttttttgtattttttttagtagagatckggtttcaccatgttggccaggctggtctcgaactcctgacctcaggtgatgcaccctccttggcctcccaaagtgctgggattacagtcgtgagccactg

SEQ ID NO: 52874 - DNA, 201 bp, Homo sapiens
aggtgggaggatcccttgggcccaggaggtcaaggctgcactaagcagtgattgtgccactgcattccagccagggtgacagagtgaaaccttgtctctcaaaaaaaaaaaaaaaaaaagtagtagttcaaaatatggactctggtgtcagtgggccttggttcaaaaccctgcaccctgcaccacaggtcatgtaacttc

SEQ ID NO: 52875 - DNA, 201 bp, Homo sapiens
tgtgtgcatttctgggactttgcagctgttccattttttggagtatctcttctctccccagatgtaaatgtaatggacacgcaagcgagtgtatgaagaaygaatttgataagctggtgtgtaattgcaaacataacacatatggagtagactgtgaaaagtgtcttcctttcttcaatgaccggccgtggaggagggcaa

SEQ ID NO: 52876 - DNA, 201 bp, Homo sapiens
agcctcctgagtagctggaattacaggcacccaccaccacgcccggctaatttttgtatttttagtagagatggggttttgccatgttggtcaggctggcstcgaactcctgacctcaggtgatccatctgccttggcctcccaaagtgctgggattacaggcgtgagccaccgcacctggccccaaaggattgttttcag

SEQ ID NO: 52877 - DNA, 201 bp, Homo sapiens
gcttcattcttttggaagaggaggctggagaccacaggttaaatgcaggtgcatcgctcttggccggccctggcagggtcctttctccctccttttacackcgcagacaagcttgtggatgctcaataaggacagctgccgtttggacagagattaatcatttatttgtgaaggttttttctgccttgctttcttgttctt

SEQ ID NO: 52878 - DNA, 201 bp, Homo sapiens
acatagtttttctgtgtgcatttctgggactttgcagctgttccattttttggagtatctcttctctccccagatgtaaatgtaatggacacgcaagcgartgtatgaagaacgaatttgataagctggtgtgtaattgcaaacataacacatatggagtagactgtgaaaagtgtcttcctttcttcaatgaccggccgt

SEQ ID NO: 52879 - DNA, 201 bp, Homo sapiens
ttgtatttttaataaagatggggttctaccatgttggccaggctggtctcgaactcctgacctcaggtgagtcacccacctaaagtcctggggttacaggygtgagccactgctcctggcccacagatgatttttaaatgcccttgctcagtttcctttcttacagggagagtgggtggcaccctgtgctacaccggaggg

SEQ ID NO: 52880 - DNA, 201 bp, Homo sapiens
ggggttctaccatgttggccaggctggtctcgaactcctgacctcaggtgagtcacccacctaaagtcctggggttacaggcgtgagccactgctcctggyccacagatgatttttaaatgcccttgctcagtttcctttcttacagggagagtgggtggcaccctgtgctacaccggagggctgagtgttgggcttaaaa

SEQ ID NO: 52881 - DNA, 201 bp, Homo sapiens
gggaggcaaataataaaaaacaaataaataaacaaaacaaacactgagataagtgccaggaagaatacaaatggagaataactgggggaaactactttatrtaaggcctctctacagaattcatctaaggtgagatctgatggatacaaaggaatgagccgagtgaaaagtaatggtaggtttgttccaggcagaaggaac

SEQ ID NO: 52882 - DNA, 201 bp, Homo sapiens
tatttttccctgaatttttttcctttgaattccaactgtggaccttttatatgtgccttcactttagctgtttgccttaatctctacagccttgctctccrgggtggttaataaaatgcaacacttggcatttttatgttttaagaaaaacagtattttatttataataaaatctgaatatttgtaaccctttatatttgg

SEQ ID NO: 52883 - DNA, 201 bp, Homo sapiens
ttactgtgcactaatctctatagaaaaagtggtgaacaagatagatgtggtccctgttcttaaagacttatgtttcagttgggaggcaaataataaaaaayaaataaataaacaaaacaaacactgagataagtgccaggaagaatacaaatggagaataactgggggaaactactttatgtaaggcctctctacagaatt

SEQ ID NO: 52884 - DNA, 201 bp, Homo sapiens
gttggaggtgtgatgagtgcacagtgaaggacctactgggtgtggtaaaggctgtccagctatggcaggggctttgtggaaacctggcagaaagttgcgaygtttagaagagtagagatacatagggcctcagatttcatgtgagatgatatgatcctcttcagataatttacagactttcttctgcaaaccattttagat

SEQ ID NO: 52885 - DNA, 201 bp, Homo sapiens
tcatccagcagacgttgagtggcaacttactgtgcactaatctctatagaaaaagtggtgaacaagatagatgtggtccctgttcttaaagacttatgttycagttgggaggcaaataataaaaaacaaataaataaacaaaacaaacactgagataagtgccaggaagaatacaaatggagaataactgggggaaactac

SEQ ID NO: 52886 - DNA, 201 bp, Homo sapiens
ataaaacctcatgatacatgagagttttaataataacagacttatatttatcttttgatttgttaggacctgagtatgagatttaagttgaatgagcataytaataaagaataatttgaagaactattcaaaaacagagatcagtttgaaagaaattacactgataatgctggcacatgggggtggcaaaagagtctattt

SEQ ID NO: 52887 - DNA, 201 bp, Homo sapiens
tcttggctcactgcaacctccacctcctgggttcaagtgattctcctgcctcagcctcccaagtacctgggactacaggcacatgcccaccatgcccaggyaatttttttgtattttgagtagagatggcagttcaccgtgttagccaggatggtctcgatctcctgacctcgtgatttgcccacctcagcctcccaaagt

SEQ ID NO: 52888 - DNA, 201 bp, Homo sapiens
tgcatgacttctgtgagatggaccaatctttagatgtggctcctaaagcaaggttattagtatagttttataaaattctttctcagtttttaaactactcrtagattataaatcatttcattttttaaacactaattcaaaaagcaacctgacaaatttactgctttaagctacagtaagcatagggtgattttccaacaa

SEQ ID NO: 52889 - DNA, 201 bp, Homo sapiens
tcctttgattactgagctttcccactgtggttcatgaaacttctttattgattgcattcttagtgcagataatgaaatagtggaggattctgttcacaacrtgtttgttgacttgctgtagttgcttcccacccttggggcccttttggtatgattacgtgtaaacatctgcttctccttggcataaacacttgcctggaa

SEQ ID NO: 52890 - DNA, 201 bp, Homo sapiens
actcatagtcagggctgtacctaagtcatcgtagatgctttatttgaagaatattatccatttctaaaactctgcagatcaaagccttctctggtttcttygtatgttttcttttacaacgtttctgatgcttcctttttccaatcttttattttttccaaggaagtcttcctttgattactgagctttcccactgtggtt

SEQ ID NO: 52891 - DNA, 201 bp, Homo sapiens
ttggacctgaaggctgcaaacgtaaggggtgttggtggcatacaactctaagcttccactaattccagttagtgtcttaaggccagaaaggactttgacarcctcagtctagccacttgactcatagtcagggctgtacctaagtcatcgtagatgctttatttgaagaatattatccatttctaaaactctgcagatcaa

SEQ ID NO: 52892 - DNA, 201 bp, Homo sapiens
ccttaccattcagttttctgatacaagttacaaattacatcagtgctatactaaaaaaaaaaaaaagttgtgcttaaagtctgtttttcttgcctgagaartgtcctgtgttcattttcaggtgtgactgccatgccttgggctccaccaatgggcagtgtgacatccgcaccggccagtgtgagtgccagcccggcatca

SEQ ID NO: 52893 - DNA, 201 bp, Homo sapiens
agtgtggtgggaaggggaaggtgtgtgtggaaaaagacaatgtaaataaaatgagagtgggaaatagggagttgggtaggggtagcaatgttagataaggkggccagggaaggcctcagagagaaggtgatattgtggggagggtcaagacaaacacagacaacatcctattggttcaagcctaagtaatgatttattagc

SEQ ID NO: 52894 - DNA, 201 bp, Homo sapiens
tttaatctaagtcatattaaataaagtttatgggggcccattgttttagactagcctcttggactaggccccagcagaccagactaaactagaatggagtygctcatgctaggtaccacataattaaactgaattctgaaacaggcctggtttgtttaagtaacaaaccagaagattcacaacaaccagtcaaaaggggcc

SEQ ID NO: 52895 - DNA, 201 bp, Homo sapiens
taatctataacactaaatacaccaataatttagatcgacttctgattgaaagttatgattctttgtcgtggcagattatcaaatgttctaaattgaggctrttctaggacatagtttttaatctaagtcatattaaataaagtttatgggggcccattgttttagactagcctcttggactaggccccagcagaccagact

SEQ ID NO: 52896 - DNA, 201 bp, Homo sapiens
tcacccttattttatctatgtatcttcagtactcagcctattgcctggcactgagtaaatttcagggtatgtttgtaaattgaatgaatcattgactgaawtaaccaaacagcaagtcagactcacctgggttcactctcgttcttctattgggttgctgcttattttacaagtcagacagttctctccctataaaaggca

SEQ ID NO: 52897 - DNA, 201 bp, Homo sapiens
agttcatcttgtataaactctttattttacacttaagaaaattgaggtatggctgctccttactccctagtacaatacttctctcactgtgtatcttaatyatttgtatcttatctcatctgtcatatggaattcctttagggcagggactcacccttattttatctatgtatcttcagtactcagcctattgcctggcac

SEQ ID NO: 52898 - DNA, 201 bp, Homo sapiens
ggaaagtaaggagacaaatctagtgaaggctgccttgacttaacagtgcagaatcactgtgcagcaatgtgcttatatggccgcgttgcgattataatcckcctacatgcataagtcaatggggtctttgctccaaacttgtggaagaatgaatgagccaagtagtggtgggagttcagtttagttccactgttttgtaaa

SEQ ID NO: 52899 - DNA, 201 bp, Homo sapiens
ccaaaatgctaggattgcaggcataagccagcattcccggctgtatacttttcaaggggcggggagaatgcatttgtccttataggctccgttactgtagscatttagtactgcttgaaaattaaattagaaagtaagtgccacttaaaaagtttataaatatgctttataaattctaaaggtgtggaaaattggtgataa

SEQ ID NO: 52900 - DNA, 201 bp, Homo sapiens
agtgctgggatgacaggcgtgagccaccatgccaagccaaaagtgtctgttttcttatctccttaaataccatactctcccattctcaccaaactaaaacaaaaaaaaaaaatcattctggattttcttcctttgtgtcaattgtgttctttattttttaaactgggcataataggaatagtttgggcagcatcaatagta

SEQ ID NO: 52901 - DNA, 201 bp, Homo sapiens
acatgttttggttctgaaacatagtttctataatcatccttaaaaaataacttgtttctgcttaataggctttactatgaatatacctccatatattattragttagaatgtgagaaaaggagattaatttttgaagtacaaatatagtgagttagtgagtgtaggcatcctgactgcctagtcataactttgatgaagta

SEQ ID NO: 52902 - DNA, 201 bp, Homo sapiens
tttaaggcctttagatgttacagtcctaaattctgagttagcaggttatgagaatatctgttcctctgagaattacctttcctcttctcctttcaaattatttttttatctgaggtgtttacttttcaatattcaatagttaataagtcacagctgtctaggatgcaactctgattttgattgttatgatggattaaagat

SEQ ID NO: 52903 - DNA, 201 bp, Homo sapiens
agttgtattaggtgaggtgcatggatcacctaaggtcaggagttcgagaccacctggccaacatggcaaaaccccttctctactaaaaatataaaaattakctgggcgtggtggggcgtgcctgtagtctcagctactcgggaggctgtggcatgaggatcacttgaacccaggaggtggagtgagccagaattgcaccac

SEQ ID NO: 52904 - DNA, 201 bp, Homo sapiens
ccctctctacctgtcacttctttggttgcaggcaaattacttatcctctctgttctctgagctataatatttaatacaagcagtcagcaactgatgatttytaagttctcttctaacatgccctgattctgtaccaattgatactgattaacaaggattagcacatgcctcttacattttaagagaatggttctgctcacc

SEQ ID NO: 52905 - DNA, 201 bp, Homo sapiens
tggttcctcatggtatcaggattccttgttcttggtgctctattgtgttgccttttcttctgccatcttattcctttgattagtgagaactttgtgcatctttttttttttttttttgagatggagtttcgctcttgttgcctaggctggagtgcagtgacgcaatctcggctcactgcaacctccacctcccgggttcaa

SEQ ID NO: 52906 - DNA, 201 bp, Homo sapiens
aaattgcagcttttaataatggttgaggtagtggtaatgggatgctcagcgctctgcattttaaagcacattgttgaagtaagaattctatttccagaaayggaacatttctataacactaactgggagacctattctgtagagatgtgtaatttctaaaatttcagcccatgctctcttccattttttaccctgacttcc

SEQ ID NO: 52907 - DNA, 201 bp, Homo sapiens
ataaccacttactagggattgactcagctatgaacttgatacctgcttagggtgactaatttagcctcttgaagcctcagttttctcatttgtaaaaaaarttagggtaaaaatataccctattgtgtaaaaaaaaaaacctactttataggattgatgtgaggattaaatgaaataaaggcattaggccgggtgcagtgg

SEQ ID NO: 52908 - DNA, 201 bp, Homo sapiens
gccgggtcctttctgaggcacttagaatcagacccttcagggttgcagcctgggaacttctgttttcaaagctgctacttagtgtccatacagtcccaggytggagagcactggtagcagttaagttaggaaaagaggttctgaatagcactcatgaaaattacttgaaccttaggggcttaataacccttaacattccat

SEQ ID NO: 52909 - DNA, 201 bp, Homo sapiens
gataaggtaagctgtcaatagtgcattcattcattcatccagcagacgttgagtggcaacttactgtgcactaatctctatagaaaaagtggtgaacaagrtagatgtggtccctgttcttaaagacttatgtttcagttgggaggcaaataataaaaaacaaataaataaacaaaacaaacactgagataagtgccagga

SEQ ID NO: 52910 - DNA, 201 bp, Homo sapiens
atttctttttatttactgttgtgtaattataatttataatttgagccattggttaaattattaaaagtcataaattattgaatgattttgttataattttwggtgaacaagagtttaagacttaaaaatttttttttttgagacggagtcttgctctgtcacccaggctgtggtgcaatagcatgatcttggctcactgca

SEQ ID NO: 52911 - DNA, 201 bp, Homo sapiens
tatgaacttgatacctgcttagggtgactaatttagcctcttgaagcctcagttttctcatttgtaaaaaaagttagggtaaaaatataccctattgtgtaaaaaaaaaaacctactttataggattgatgtgaggattaaatgaaataaaggcattaggccgggtgcagtggctcatgcctgtaatcccagcatcttgag

SEQ ID NO: 52912 - DNA, 201 bp, Homo sapiens
tttggtgaaagtaatctttgctttttctgttataaaaaatgaatttttataagtacatttaataattgactgttcagaaattactggagcgcctaatgtargcaaggcatccttcaggggcagtgctggagaattgtaataaagctaatgaaagaaaggagtggagcacagtggccccagctgtgccagaatcacctgagc

SEQ ID NO: 52913 - DNA, 201 bp, Homo sapiens
ctaaagaatctctttaggttgtttatattttagtatttctctcaggtgatttgtgtcttttgccatctctgtcttcctgccttagcctgcaattgcaatcygtatgggaccatgaagcagcagagcagctgtaaccccgtgacggggcagtgtgaatgtttgcctcacgtgactggccaggactgtggtgcttgtgaccct

SEQ ID NO: 52914 - DNA, 201 bp, Homo sapiens
acttgctcagtgtaagtccacaactaatttgtggccactcaggacattgaactgggtctcggagcaaattataagataggtaaaacagaggggacacaaaygtggaatagtgagagggtgaggagagtgcagttcaggctgggatcgtgtgtggcatattcgtaggaaaccacagaatctgaagttagttaggtttggatt

SEQ ID NO: 52915 - DNA, 201 bp, Homo sapiens
caggtgaaatgaatactaatgtattttatttaatatatccaacatatgatttcaataagtaatcaataaaaattgttaatgaaatatatgttttttctcaygctaagccttcaaaatccagtgtgtatctcacgtttatagcacatctcaattcagactcaccagccacatttaaagtgctcagtagccacatgtgacagc

SEQ ID NO: 52916 - DNA, 201 bp, Homo sapiens
aaaagaaacaggtgaaatgaatactaatgtattttatttaatatatccaacatatgatttcaataagtaatcaataaaaattgttaatgaaatatatgttytttctcacgctaagccttcaaaatccagtgtgtatctcacgtttatagcacatctcaattcagactcaccagccacatttaaagtgctcagtagccacat

SEQ ID NO: 52917 - DNA, 201 bp, Homo sapiens
agaaatacattgtgaaccgcttttgtcttttaaaattttctagtcaccacattaaaaaagtataaagaaggacagtcatggtggctgacacctgtggtccygtaaaaagaaacaggtgaaatgaatactaatgtattttatttaatatatccaacatatgatttcaataagtaatcaataaaaattgttaatgaaatatat

SEQ ID NO: 52918 - DNA, 201 bp, Homo sapiens
tatagttgtttagtccaatagaaatacattgtgaaccgcttttgtcttttaaaattttctagtcaccacattaaaaaagtataaagaaggacagtcatggyggctgacacctgtggtcccgtaaaaagaaacaggtgaaatgaatactaatgtattttatttaatatatccaacatatgatttcaataagtaatcaataaa

SEQ ID NO: 52919 - DNA, 201 bp, Homo sapiens; identical to SEQ ID NO: 11517

SEQ ID NO: 52920 - DNA, 201 bp, Homo sapiens
ttttttaaatttgcgtaagattgctgtcactggaagtcactggaagttttatctcaagccatgcatactgatctacataacattaggatagtttttcttaytggtttatatgtgggatctttacaatataactactcactctcctgcctcaaagtattctttaaaaagcatattattggctgggcgctgtggctcatgcct

SEQ ID NO: 52921 - DNA, 201 bp, Homo sapiens
ccatctgggtgaattgtagctaatgtccagaaacagtaagaatcacaccggaacgagttgccagccagctgcccatatactacctgatgtatgctggtatrtcctgagactgaaactttggtataggtactgctcagttaaatgtaggtcattctcacacagaatcccatttgggctaccatcttgtttcttttgaatcat

SEQ ID NO: 52922 - DNA, 201 bp, Homo sapiens
ttctgaaaacatagatgtctgcacctctgcacttgcttgttacgtctccaaaggtgattttgttgtgcagtccctaggaaagacttaaaatggaaatgctstctttgagtggttatatgtaatacaccaccccaaaacctaatggttttagataactgtgatttatgatttctcatgattctgtgttagcctgggtcactc

SEQ ID NO: 52923 - DNA, 201 bp, Homo sapiens
ctcagtgtaagggcttagatctcataaaacctagggaaaaactctacagcccccatgcttgtcctctgccattatggtacacctaccaacttgataagttrtggtttcttcaaattcattcattcacttagcaaataatagttcgcatacctactgcatgctagggaaatggcagtggacaaaatagaaatttcctgccct

SEQ ID NO: 52924 - DNA, 201 bp, Homo sapiens
tgtgctgtctttcatgtgttctgctgtgtctgtctctatctgtgctttcctctgtttttacttttagaacccctggggaaaggtaggtatctgctttttgrattgggaaatagaataggtattaaatttttggtaaaaacctttgagtgggtattgacatttctgtgagaggagaggctgctttgttccctcgagggagac

SEQ ID NO: 52925 - DNA, 201 bp, Homo sapiens
aagtaagagtaaaatggcaagcagatggaagcatctcaagcaaggcatccttccatctgggtgaattgtagctaatgtccagaaacagtaagaatcacacyggaacgagttgccagccagctgcccatatactacctgatgtatgctggtatgtcctgagactgaaactttggtataggtactgctcagttaaatgtaggt

SEQ ID NO: 52926 - DNA, 201 bp, Homo sapiens
tgggtattgacatttctgtgagaggagaggctgctttgttccctcgagggagactgttggtgagggtggtgttggaggtgagactctgaatgtaactagaytcggacttcttcacatctctagtggttttcaattatgaaatgggcaactgatgctctgagtcagcagccttttaaccatgcctgactgaagagaacttgt

SEQ ID NO: 52927 - DNA, 201 bp, Homo sapiens
ttgctctttaaggtcagggtagtgtcctgtgaggttctgccagcctcagccttgatgtggataataccatcatttgtaatgttgtgatatggtggagcagragttctctggcctcagaaaacatagcttgtgtgaagttagtgaaatgctcatgcttctgctgtctgtgatactgaatctttcaatatttttggccttaac

SEQ ID NO: 52928 - DNA, 201 bp, Homo sapiens
gactctgaatgtaactagattcggacttcttcacatctctagtggttttcaattatgaaatgggcaactgatgctctgagtcagcagccttttaaccatgmctgactgaagagaacttgtgtttgaaattcacagcattgcctggatccctgctgtctttttgtgcctcccgctaacacacagctgtttttgttcatacat

SEQ ID NO: 52929 - DNA, 201 bp, Homo sapiens
cagcaattgtatgctaagagtatgtttagaagaaactgccaaactgtcttccaaagtagctgtaccattttgcattcccacaagcaatgaatgagagtagyaatgctttcgaatactaaagagattgcaatgttaaatgtatttttgatgatttccttgtggagatatcattatggcaaaggaccatgaagcacggtaaag

SEQ ID NO: 52930 - DNA, 201 bp, Homo sapiens
atacatttatcataccattcagcaattgtatgctaagagtatgtttagaagaaactgccaaactgtcttccaaagtagctgtaccattttgcattcccacmagcaatgaatgagagtagtaatgctttcgaatactaaagagattgcaatgttaaatgtatttttgatgatttccttgtggagatatcattatggcaaagg

SEQ ID NO: 52931 - DNA, 201 bp, Homo sapiens
aatcctctgctttgtctttcatccttctctcctcccccacctccaggcaatcacagacccttttactgtctcctttcccagaatgtcatatagttggagtmatatattatgtagccttttcagattggcttctttcatctacttatatgcatttaagtttcctctgtatctttttgtagcgtgatagctcattctttttat

SEQ ID NO: 52932 - DNA, 201 bp, Homo sapiens
tacatattcatgcagcacaccaacatggcacatgtatacatatgtaacaaacctgcatgttgtgcacatgtatcctaaaacttaaagtataataataattwaaaaaaaaaaagaactacatattcatggagtgcccatgattcctgcaggaagtgtgattgagttcttcaggaatacttgtgtgtcctacctttccctttt

SEQ ID NO: 52933 - DNA, 201 bp, Homo sapiens
tgagtctaaatgaacacttttctgcagtccttagtgtagtaagatgggagcttgttcagcaagataggcaagttcatgcatatgagttttatttcagagcdaattgacataatttatcaaccaaagtgatttatttttaaaacacctcattagaaatactcagatctgcacattgccacaaagcaaatgaaaataagttag

SEQ ID NO: 52934 - DNA, 201 bp, Homo sapiens
tagtagtttcctattggctgttctgtacttatatatatagatatacatatatatttttgttgttgttgttgttgttgttgtttttgagagacggagtctcrctctgtcacccaggctggagtgcagtggcaggatcttggctcactgcaacctctgcctcccaggttcaagtaattctcctgcctcagcctcctgagtagc

SEQ ID NO: 52935 - DNA, 201 bp, Homo sapiens
gaaaatggatttcttttttttaaaaaaggcctttgttacaatcttattgcctgagatgatgtaacatgttaatgggttatccattttgtattgtttttttktgtgtgtgtatgtgtgtgtgtaaagaatacacacaatctcaatgctgaaatgaatttgaaatgtaaactaattattttcaagtgcataggatattacagt

SEQ ID NO: 52936 - DNA, 201 bp, Homo sapiens
gaattgcttgaacctgggaagcggaggttgcagtgagccgagattatgccattgcactttagcctgggtaacacagactctgtcttaaaagaaaaaaaaawtttttttgctttttaaaaattgtactagctattttttccacagtgctgtttaagttatcacagtttctaggctgtgtccttcatcattgattatctacat

SEQ ID NO: 52937 - DNA, 201 bp, Homo sapiens
ctttgacaatgaaacagggtactaacagcgacaagttgaggagcctttcaaaagcagctccctatcgcctttgtagtacatcagttactaagttactattsaaaacggcttcctacacctcactgaggtccattcatttctctccattcctctgttcccattcttagttcaacctctgtcatctctcctggattactgcca

SEQ ID NO: 52938 - DNA, 201 bp, Homo sapiens
gcttaggatgattgataataaccccagctccacttattggtcactgagttgagtcagacctgctggggatcagaggttttgtttcttcctgtttttttttyccatactcagtagctagttaaatctcaaccattatagtttgatgccagtgttttaaatcctgtgttaaacaagaaacttacgttgttagactgtgtggta

SEQ ID NO: 52939 - DNA, 201 bp, Homo sapiens
ggcaacatttgaacagtccaaatgggtctgtgatgatgccgtactttcagagacagcagaccccagtgctgagagagcagcctaacagattttatgctggsaagtctcagggtggcacctctggagagccttgtctgtccaggagacagaagggatttgctttgagggttcatcctctcatctgccatgtgtttgcagacc

SEQ ID NO: 52940 - DNA, 201 bp, Homo sapiens
agctgtcacggaacacacttgctccatatgcttcaactgtactcaagtctccagtgtccatctgcatactagtgagtcccaagtctctgtctctaactcakacatctctcttggcccgtcaaactgctcacatccagctccctacagacatttcctcatctactgacctgcaggcatcccagaactagtgtatcggaaact

SEQ ID NO: 52941 - DNA, 201 bp, Homo sapiens
ctcaagcaaggcatccttccatctgggtgaattgtagctaatgtccagaaacagtaagaatcacaccggaacgagttgccagccagctgcccatatactacctgatgtatgctggtatgtcctgagactgaaactttggtataggtactgctcagttaaatgtaggtcattctcacacagaatcccatttgggctaccatc

SEQ ID NO: 52942 - DNA, 201 bp, Homo sapiens
agcaaggcatccttccatctgggtgaattgtagctaatgtccagaaacagtaagaatcacaccggaacgagttgccagccagctgcccatatactacctgwtgtatgctggtatgtcctgagactgaaactttggtataggtactgctcagttaaatgtaggtcattctcacacagaatcccatttgggctaccatcttgt

SEQ ID NO: 52943 - DNA, 201 bp, Homo sapiens
atggggaaggagaccctttttggtttcaccatattataagtattactaagcatgtgttgatttatggtaataatttacatttattaaagcacttactatarcatactataatgtgacaagcactgttctaagccctttgattttctacctcagttaaccctcacagtaaccctgtaaggtagatacttttattgtctccat

SEQ ID NO: 52944 - DNA, 201 bp, Homo sapiens
ggcaggagaatggcgtgaacccgggaggcggagcttgcagtgagccaagatcgcgccgccgcactccagcctgggcgtcagagcaagactccgtctcaagaaaaaaaaaaaaaaagcatattatttacaacatcagcacttttaattttaaagccatacctactaagaatgactacataaacctgggttaatttatttttc

SEQ ID NO: 52945 - DNA, 201 bp, Homo sapiens
ccaagaggtcaagctcgcagtgagctgtgatcatgccgttgcacaccagcctgagtttacagagtggatctatctcaaaaaaaaaaaaaaaaaaaaaaagrtggcggggtggtgttgaaactgaaagatcacagtgctttaagaagtaatttgaagttgagtaagtaaaataaagaatgttcagttaagaagtttggctat

SEQ ID NO: 52946 - DNA, 201 bp, Homo sapiens
caagagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgaga

SEQ ID NO: 52947 - DNA, 201 bp, Homo sapiens
aaataagagccaagggagaaaaagaattttaagaaagagaaacaattaacaagtttaggaagctagcatcgttgggttttggattggtgattccttaatcrctgctgagtttttgtttttaagaagtgttaaaactgtccaggcgtggtaactcatgcctgtaattccagtactttgggaggctgaggcaggaggattgct

SEQ ID NO: 52948 - DNA, 201 bp, Homo sapiens
ggcttaggaagagattaggactagcgatccagatttagaaggttgtcaacatatgggcaataatttttaaacttggaaatatgacagaaaatatagatggraaagaaggatggaatcctggaaacagttaagtccatgctctaagacccaagggcaacatggcgaaaccacatctctactaaaaagtacaaaaattagcac

SEQ ID NO: 52949 - DNA, 201 bp, Homo sapiens
ccatattggccaggctgatctcaaactcctgacctcaggtgatccccctgcctcggcctcccaaagtgctgggattacaggcatgagcccctgcacccggycaaaattttttttcttaaaaaaaagttttaaacaaggacctttttctctagcaaggtacagctgtttggggaggtggagttagtgatgatgtggtattgg

SEQ ID NO: 52950 - DNA, 201 bp, Homo sapiens
atctgggttagatgatcttctccatgctttccaaacatgatgtacttcccctgtcatggagtcatctcatgatgagttgtaaattgcagttgtctgtatgygccgttgggttgactgcaactctgagggtggtgcacgtgactctcttgtcatggaggtgtgtgagcctccatacagactgccacagagctccctcatttc

SEQ ID NO: 52951 - DNA, 201 bp, Homo sapiens
tggctttatgttgaagctaatgtgtgtgcaagtatgtttcatgtatgtgggggacagttaatccaacctcctctaagatctgggccagttgagaaatagtyggatattgctcatcctgtcagttttattatagagaacgctcagttgaagaatgtggcctggacacatagctcgcatgggctttctgctcttttcctccct

SEQ ID NO: 52952 - DNA, 201 bp, Homo sapiens; identical to SEQ ID NO: 11521

SEQ ID NO: 52953 - DNA, 201 bp, Homo sapiens; identical to SEQ ID NO: 11523

SEQ ID NO: 52954 - DNA, 201 bp, Homo sapiens
atcacttgaggtcaggaatttgagaccagcttggccaacgtggtgaaaccccatctctactgaaaatgcaaaaattagctgggcatggtggcacacacctrtggtcccagctacagtgaggtgagattgtgccactacactccagcctgggcaacagagcgagactccgcctcaaaaataaataaataaataaataaataa

SEQ ID NO: 52955 - DNA, 201 bp, Homo sapiens
cagctccacttattggtcactgagttgagtcagacctgctggggatcagaggttttgtttcttcctgtttttttttcccatactcagtagctagttaaatytcaaccattatagtttgatgccagtgttttaaatcctgtgttaaacaagaaacttacgttgttagactgtgtggtaaggttttagtttttagttagtttt

SEQ ID NO: 52956 - DNA, 201 bp, Homo sapiens
aaaaatacaaaaaaattagctgggcgtggtggtgcatgcctgtaatccaggcaggagaatcgcttgaacccaggaggcagagtttgtggtgagccaagatygcacctttgcactccagcctgggcaacaagagcaaaactctgtcttaaaaaacaaaagaatattggaaataaggaggagtgaagagtgaaaattttaatc

SEQ ID NO: 52957 - DNA, 201 bp, Homo sapiens
tgttgttttctgcatctggagataagatgttaactggaaagatatttatcacattggaatgttagttgcttttttaaatgtgcttaaggcccaaagctcarttaataagataggatcctcatatcccaaaatcttgagccaagggagggaactaaacctttaacagatgagctggtcaggcgcggtggctcatgcctgtaa

SEQ ID NO: 52958 - DNA, 201 bp, Homo sapiens
gcatggatgcttggtgaaagtcttagggaagtgattcctttgaagtacctaggagaataattatatagcattttcattttacattgtgatcctgttagtcrttttggagagggaagactaatgatagcagacaatgctggctatttgcaggaatgcctttccctgtatcctcttccctgttgcttgttctcagtgctgttc

SEQ ID NO: 52959 - DNA, 201 bp, Homo sapiens
cgtttcatgagttcattttggtaactgatgtaattaagagatactttggagaacagtgtgggttgcttttgtctaatttagagaaaacagaagaaaggacytaaaaggaaaacaatctcaaacccaacttgcccctgcatttctcctttttttttgaaaagcatggatgcttggtgaaagtcttagggaagtgattccttt

SEQ ID NO: 52960 - DNA, 201 bp, Homo sapiens
aagagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgagaa

SEQ ID NO: 52961 - DNA, 201 bp, Homo sapiens
agagcagagaattcatcctttcttgctactaaagaatttattctaaaacattacatgtcacttgtccctcgtggctagatgtggatagagatgctggattgtttgtttggagcatgcagattgcactgtttcatcttttgtagacacagaaatcaagagttatcttttttcttccaaagatggaaacaactatttgagaac

SEQ ID NO: 52962 - DNA, 201 bp, Homo sapiens
gggaagatgagaattgggtgaacaatcttgctcttcctatttcgggatacctgcttcattgatgggtggtctctaggacttcagagggaaaggctgaggayagacttagaccttggggagggtctgagccaatcagtgacttacattcactcagttgccatctaataggtggtcctcccttagaaaattggcggctttctg

SEQ ID NO: 52963 - DNA, 201 bp, Homo sapiens
cgttggccaggctggtcttgaactcctgacctcaggtgatctaaccacctcggcctccagaagtgctgggattacaggcgtgagccactgcgcctggcctrccccctgtcgcccaggctggagtgcaagtggcacagtctcggctcactgcaacctctgcctcccaggttcaagcgattctcctgcctcagcctcctgagt

SEQ ID NO: 52964 - DNA, 201 bp, Homo sapiens
actgctcttctgttgttttttagccacatgccttgaaacagtcctctttcccatgtttcttcatcagcaccattaacccaaggtatactgtcctctcttayctttcacaaggtcttggagttcccatgcctttgtaagcatccctccccgagattcagcaccaaccaaaatcacatttggaaaaattgcttgtttcccaag

SEQ ID NO: 52965 - DNA, 201 bp, Homo sapiens
cctcccaagtagctgggaccacaggcacgcgccaccacactcagctaattttttttttttggtagagatggggtctcctaggctggtcttgaactcctggrctcaagcaatcttcctgcctcagccttccaaagtactgggattactggcgtgggccaccatgcctggcttgaaatttttctatggctttattctttctcc

SEQ ID NO: 52966 - DNA, 201 bp, Homo sapiens
acccaaccttctgagatctttggttttcttttcctaggtaactatagtacatacttatttatgttaaacaacagcaatcacacatttctttttctatacartcatgctttataggcaaataaagcctccgtcttaggctttctggattttttcaaaagatgcaattcctggagtatgtttttacttagagcaaagcagcct

SEQ ID NO: 52967 - DNA, 201 bp, Homo sapiens
caatgttggcaggaagcagaaaagaagggaagattgtgacaataactgttgcaaaggccattaacttgactttgtgggacagacatgtaggtctctctttrctgcttctggacacaaattatgggaaagcctgcacaataggtctcattaacttccagagtgacatgacagggactccagcttttgggacagcttgagtcc

SEQ ID NO: 52968 - DNA, 201 bp, Homo sapiens
tggctggtcggtgtcagggagatcaccgtgggaggtagcaggagtcagtctttaaaaaaattattgggccgggcatggtggctcacacctgtaatctcagyactttgggaggccaaggcgggtggatcatgaggtcaggagatcaagaccagcctggccaacatggtgaaaccccgtctctattaaaaatacaaaaatcag

SEQ ID NO: 52969 - DNA, 201 bp, Homo sapiens
gagacagggtttcgctatgttgcccaggttggtcttgaattcctggactcaagcaatctgcccaccttggcctcgcaaagtgctgggattacaggtgtgartcaccgctcctggcctgaagcattttggatttttgggttagagttgcacagcctttactgttattatcctgatgttattatccacattttacaggcaagg

SEQ ID NO: 52970 - DNA, 201 bp, Homo sapiens
ggtagagtgctggtcctggggttctgggggaacctttgaggcctccacaggaaccccaggggtggagcagtaggggactttgggggaacggtggtgggggkgcccctgttgcttttctgggtgttgaaaaggaagctctttggggtggttgaggcctggtgtggcagtggttttccactccctttggagaagttcatttgc

SEQ ID NO: 52971 - DNA, 201 bp, Homo sapiens
aatggggtctcttacttttcatagcagcactgcaaacagagttacgtttctattcattttatggattagaaagctgagatccagagcgggcagatgtaaayctggggtctttaaaatgcatcctttttgcaaacaaataaacttagtgtattaaaagggctggagagagcagagtaaggtaacatttgggtggtcagcatg

SEQ ID NO: 52972 - DNA, 201 bp, Homo sapiens
aaatttctggctgtgaaatcccctgtgtagtgggaagaagaaatagcaaatcttagctgccttggacctgatataattatttgtcttcatttacatggttyatccttcaaggttgaataaatgatgtgggagctagtcaaggggctttaggtatgtgatttcatgcctacttttttttaggtagagaaactgaggtcacag

SEQ ID NO: 52973 - DNA, 201 bp, Homo sapiens
caaccttctcccccaggaagagtgaccagggacctgaggggcatggtcgagcagatgacagcctttgtaaaacatctccctggtctcatcagcgatattcrtcctgccttccttctgagtaatttccatcttaggactggagtcaggtggagcaagattccatgttggtttctgttgggcctagagtgtcacactgagacc

SEQ ID NO: 52974 - DNA, 201 bp, Homo sapiens
gttacattcctagttcctcaactgcttatttctttttggtttttgaagcaggaatttgatttggtgtctgggttttgataggggtgtttatgtttcatcartgtcttttggttctttcagcgtttctctccttgtctgtcatgtgtcagagagggtgcctgtcaacgattctctctctccagggagaaagtctttcttaaa

SEQ ID NO: 52975 - DNA, 201 bp, Homo sapiens
gaagtggaatttgatttggtgtctggattttgatagggccatttatatttcttcagcactttttggttcttgcagaaagttacattcctagttcctcaacygcttatttctttttggtttttgaagcaggaatttgatttggtgtctgggttttgataggggtgtttatgtttcatcaatgtcttttggttctttcagcgt

SEQ ID NO: 52976 - DNA, 201 bp, Homo sapiens
tgatttaaagtcagatgaggattttggttccttttaaatagatattgtttacttcatttaatggttcggctttttagtagactttttctttagtttcttgwcagcccagaactgacgacataaagtgtttttatcatctgaatcctgctgggccgagatactgcatgtttgtatttgagaagcagaaacatcctattaaat

SEQ ID NO: 52977 - DNA, 201 bp, Homo sapiens
agagctccagttgccagacactgtggccgctctggtaccagctactcctagtacccagtgcaggcaaggtgtttagtgtggcctatgaggatgttgtttaycaggcagcaacctcatgaataggcaaaaggcctgttttgaatgcctcctgtttagaagtctgaaatgtcacatccagacagtttggaaacattttaggtg

SEQ ID NO: 52978 - DNA, 201 bp, Homo sapiens
gctcgttgtgaggatttcctagaataaagcatgtgatgcactcagcacagaggcacacagacacagagcccaaggcaccattaaacggcggccaccctgasctgtgctggtgtggatggtagtgcttcaggggtagcagctggtcagtccccatcctaccttcatttcgtctagaaaaggtgttctaagctgatggtggtg

SEQ ID NO: 52979 - DNA, 201 bp, Homo sapiens
ggaccaagaagggtgcacacacacccccagcaatgggcatcgtgtgatgtaggaagaaagggttctggggtctgaggccggagagacataggcatttgtamgaagaaaatccctccatcatagaggattccaggtagaggcaggttggctggagtggcaattagtccctggttttggcaggtatgaccacagagttctcct

SEQ ID NO: 52980 - DNA, 201 bp, Homo sapiens
agtagggtcggagtttcactgtgttggccaggttggtcttgaactcctgaactgaagtgatctgcccaccttggcctcccagagtgatgggattataggcrtgagccaccgtgcccagccttggctaattttttatattttttgtagagacagggtttcgctatgttgcccaggttggtcttgaattcctggactcaagca

SEQ ID NO: 52981 - DNA, 201 bp, Homo sapiens
cctcccgcctcagccttccaaagggagggattactggcgtgagtcaccgcgcctggcctttattttttatttcttttgagatggagttttgctctgtcacscaggctggagtacggtggtgggatctcgcctcactgcaacttgcgcctcccgggttcaagcgattctccagcctcagcctcctgagtagctgggattaca

SEQ ID NO: 52982 - DNA, 201 bp, Homo sapiens
ttcagttcagtcagctggtccttgagcctgttgtgtgccagatatcctgaccaaagaagctagatgggagctgctgtgttgttccttggggctgctggatkcaagttgtttaggtcggcggttttcaaatgctggtgattttgctcaccagaggacatttggcaatgtctagagacatttagcatggccagtcattgggag

SEQ ID NO: 52983 - DNA, 201 bp, Homo sapiens
atcttcaactctgacttataattgagcacatttgtgaaggaaatggttaattttacaaccaaaggcaaactcgcacctcgacaggtctgctgaaagaaatgtgccccagtctttttgctggcaagcgcaccaccaggtcataaatccacaggctttatttacagcccataacacttatgaatgttaagatatttgacgcca

SEQ ID NO: 52984 - DNA, 201 bp, Homo sapiens
ttgtacaactggtagggagtgggtcatagtatggccggtctttttaaaggtgaggaattcttaggcccagaaaggcaaagtgacagatcctggatttaacyagcagcccagatttgaggcctagcacatagcaaagcaccatagctattcaatagctgccaagtgggagtttggatgatggctttcctggacagcgaaagc

SEQ ID NO: 52985 - DNA, 201 bp, Homo sapiens
tggctgggaaggaggagggagcagagggctctcttgggtgtggcctattgcagttgagccagggaaaggctggtccactggagacaccctctctggtcacygcagacttcctgccctccatccagtgtccttctacttgcaggatgtgtgcccagcagagagaatctctgaagccatgtcattattgggataacattcctg

SEQ ID NO: 52986 - DNA, 201 bp, Homo sapiens
cctggtctcatcagcgatattcgtcctgccttccttctgagtaatttccatcttaggactggagtcaggtggagcaagattccatgttggtttctgttggscctagagtgtcacactgagacctaatttcatactttatgaattctagtactgctctcgaaggtaagagccgtcctctttggctgaaggtttttgcctgca

SEQ ID NO: 52987 - DNA, 201 bp, Homo sapiens
ctcaatttttccagttatgaaatggggctggcattattccgtgatgtgcatgttaagagaggggaaagctcacatttttgaggtcctcttgtggttctatyttgtgtaggaactcacgctttgtttattcagcaatcattcctccagaaataaccttaatagcaacaagaaaaaagaataggtgttttttgagctctatct

SEQ ID NO: 52988 - DNA, 201 bp, Homo sapiens
ttgtttattcagcaatcattcctccagaaataaccttaatagcaacaagaaaaaagaataggtgttttttgagctctatctgccagtttctctatatatgracattatatattgcaacataacactcacaatgcctttaaacatcatccccgttatacagataagaaaacagaatttcaaagaaggtaggggacttgccca

SEQ ID NO: 52989 - DNA, 201 bp, Homo sapiens
gagtcttgttctgtcaccagggtggagtgcagtagcacgatctcagctcactgcaacctctgcctcccaggttcaagtgatcctcctgtctcagcctcccsagtagctgggactacagatatgtgccaccacgcccagctaattttttgtatttttagtagagatggggtttcaccatgttggccaggatggtctcgatct

SEQ ID NO: 52990 - DNA, 201 bp, Homo sapiens
cattttttcctactatgcttagaagacgcgcagcggtggtttaatatgtgttaggaccatttgctttaaaggaacacatccacaagtttcggtaggttttkttttttttttaagttagtcatgaaaaatgttatacagtaaattgttctgaattcttttacatatgggtgtttttaatgatctatattggtttttgtatcc

SEQ ID NO: 52991 - DNA, 201 bp, Homo sapiens
gaagatatgctttgcttctcctagatgctacaacctgaaatatgttgctaccttccttgaagggattttctctctctctctctctctctctctctctctcyctctctctctctctctctctctctctctctctctctctctcttctccccccaacaaatatagctaacgtaatagaaattacagaacaggatacaatgaga

SEQ ID NO: 52992 - DNA, 201 bp, Homo sapiens
gttagttattctcatggtgtggatgaaaaatggaatacgctgaaatttcagttactcgtcacaaaaataaggcgtatgtagaaaacatcctgggctaaggrtttgcatgcttctagaacttcctgttacttaatggctgttgagtataaacctcgggaacagtggggatccttggagaccccaaataacttgtatttgtgg

SEQ ID NO: 52993 - DNA, 201 bp, Homo sapiens
aggatcacctgagtccaggaggtggaggctgtaatgagctgtgatcacgccactgcactccagcctgggcaactgagtgacaccttttctttaaataaaawaaaataaataaataaataaaattattaaccagctaatctcaaatcaattcttctaaatcctctgagcttgtttgtttttctgtctgtaaaatggggctgt

SEQ ID NO: 52994 - DNA, 201 bp, Homo sapiens
cctgtgagatagtgaaacaatggtagtgccatccaatgataggcacttttctgtcattcagaagcagaaagggggccagaggcccattggccttactgggmagtaagctgtagagctgctgccttttcgtgaaagggttgacaccaaccttctcccccaggaagagtgaccagggacctgaggggcatggtcgagcagatg

SEQ ID NO: 52995 - DNA, 201 bp, Homo sapiens
cccccagcaatgggcatcgtgtgatgtaggaagaaagggttctggggtctgaggccggagagacataggcatttgtaagaagaaaatccctccatcatagmggattccaggtagaggcaggttggctggagtggcaattagtccctggttttggcaggtatgaccacagagttctcctctcttgcaagggaacccatgagc

SEQ ID NO: 52996 - DNA, 201 bp, Homo sapiens
tgtccccagtgaaagaataagcaaagaagtgaatgttgtgcattgagaaaaatgactctcggaggaggatgagcctctcggatatggcgaccgaagtgatwtggggcccttgtcaagggtctctattatggcatcaagaaaagatgctgctttcggtgatgcccgaggagagcctcaatattttacatgggaaacctaaaa

SEQ ID NO: 52997 - DNA, 201 bp, Homo sapiens
cattagcagtcactcctcatttcctctccccccagcccctggcaatcactgtggatttgcctgttcttgacatttcatataaatggtatcataaaatctaygggcttttgtgtctgtctgctttcacttagcatacggttctcaaggttcatccagtattgtagcatctatcagtatgtcattcctttttatggccaaata

SEQ ID NO: 52998 - DNA, 201 bp, Homo sapiens
gagaaacctcccttacccattagcagtcactcctcatttcctctccccccagcccctggcaatcactgtggatttgcctgttcttgacatttcatataaayggtatcataaaatctatgggcttttgtgtctgtctgctttcacttagcatacggttctcaaggttcatccagtattgtagcatctatcagtatgtcattc

SEQ ID NO: 52999 - DNA, 201 bp, Homo sapiens
ccacgccataggcagattttcataccagttgcctttacctcagtagttttcagctggggcaattttgttccccaggagacatctggatacagtgttggttgtaacagctgggcagggggtacttctgtcatcatctcatgggcacaggccagggatgctgctagggcaacccctcaccctcccaaagaattatcaaaaaca

SEQ ID NO: 53000 - DNA, 201 bp, Homo sapiens
gctactcaggaggctgaggcaggagaatcacttgaacctgagaggcagaggttgcagttagctgagaccatgccattgcactccagcctgggcggcagagygagactctgtctcaaaaaaaaaaaaaaagaaagtagcagctctactgagatatttagaaaccataaaatccacctatttgaggtgtacaattgagtgatt

SEQ ID NO: 53001 - DNA, 201 bp, Homo sapiens
ggctggtggaggaaggtgggctctgggagccggggagaagggaaaagccatgaatttggacaaaaggacaaatgtggtttacatttgtgaaatacttgaaygcttgtcatgaatggtgactttggttctatgagtcagccctgtgatggggtatttctgcagtcttcacctgacaccaggggtgagaaggaggatttctgg

SEQ ID NO: 53002 - DNA, 201 bp, Homo sapiens
tctgtttttcctttttctgtaggccaggctgaaagcttaataaattgtacgaaacccaagtaagcatggatgttaaagaacattaaataaattatataagkatgcctacctgtaacacttttataaggcaaatgcacatgggttattttgccataaacgtgcacatggaccaagatttattctaaagccctcttgtttcag

SEQ ID NO: 53003 - DNA, 201 bp, Homo sapiens
gagttgatcacctgaggtcaggagttcgagacacacctggccaacatggtgaaaccctgtctctactaaaaatacaaaaattagccaggcgtggtggcacrtgcctgtaatcccagctactggggaggctgaggcaggagaatcacttaaacccaggaggcgaaggttgtagtgagccgaaatcacgccactgcactccag

SEQ ID NO: 53004 - DNA, 201 bp, Homo sapiens
caaagcctaaccttctgcttggtcttagaactcctccaccatgaatcagtaaggccaccaggaccctcctccagggcctgggtgctttttggagccaaggrgagaagaatactaactggagagtgtccttaccccatgttggccacttattcctggatgtgaactggatgttcagtcttgtccgtgtcttaacattgttaa

SEQ ID NO: 53005 - DNA, 201 bp, Homo sapiens
aaatgctctctcctgcacaggaagtagatgacattatattgggggaagggaggagatttcaggcaaggagtgatttaccttttttttttttttttttttttaaatgctggagttgccaaataaataagcactttccagggaagtaagtgtaagctttttagtcttggtgagtggcattagataatatctttgactgcattt

SEQ ID NO: 53006 - DNA, 201 bp, Homo sapiens
tacaacaaaagatttcacctttcattttagagctgattaggacttaggaaattgtcttcttagatgccactaataatgcctcaaaaaacaagtggacgtgygatttctggcaggtagtccaagcccacttttccgcccaagtacgtcagttgaatttgtcttttgctaaagatgttaaaaatcataatgtcttatgtcagt

SEQ ID NO: 53007 - DNA, 201 bp, Homo sapiens
aggagaatctccagaacctatgaggtggaggttgcagtgagctgagatcacaccattgcactccagcctgggcaacagaacaagattccgtttcaagaaakcagaaactctgaaatttttgcctgtccaggccacatcaatcccattcctctgctgtctctgcaggattctgtgaggaataattagttaatgtttgcagag

SEQ ID NO: 53008 - DNA, 201 bp, Homo sapiens
tggaggttaacagtggtaaagtaattgtaggatagggattggggttaagctgatcgattgaattatcattaggaggttagtcgatgaattataggtgggcrtgggggtggaggaaaggcagggaacgtcaggaagaaaggttagggcctcaaggtgcggggagaggcggccgactccccaggtaggccaaatgaaagatag

SEQ ID NO: 53009 - DNA, 201 bp, Homo sapiens
catgtgcgcgcttgtgcgtccacacaaagacaactaggagaggatccagaagaaatggaccattttatttgtttacacagctgaggagtggatactgtgcrgtgggggttactttccctcttgttcttatgcttgcaagttcccatctgagctttaccaaagcctaaccttctgcttggtcttagaactcctccaccatga

SEQ ID NO: 53010 - DNA, 201 bp, Homo sapiens
tgccagtttcttgtaagtggtggttttcctagatggtcccctgtgcagcctgcgtgcctcctggaggtggggccttggggtaggaggtccccacaacatgyggaaacgcagtaggcatgggagattgaagtctccacttctgactcacctgctaatgggaaaagtgcagactcttgggctccataatggggtaggggttga

SEQ ID NO: 53011 - DNA, 201 bp, Homo sapiens
gtggctaaggaggctggctgggtgggatttgggccctgccagtttcttgtaagtggtggttttcctagatggtcccctgtgcagcctgcgtgcctcctggmggtggggccttggggtaggaggtccccacaacatgtggaaacgcagtaggcatgggagattgaagtctccacttctgactcacctgctaatgggaaaagt

SEQ ID NO: 53012 - DNA, 201 bp, Homo sapiens
gaaggattgtagcatgcccgctgtttctaagggcagggaggggataggagctgtcggggggtggctaaggaggctggctgggtgggatttgggccctgccrgtttcttgtaagtggtggttttcctagatggtcccctgtgcagcctgcgtgcctcctggaggtggggccttggggtaggaggtccccacaacatgtggaa

SEQ ID NO: 53013 - DNA, 201 bp, Homo sapiens
ctcctctccctgcttgctctgttcagtcatttcccagcaagaagaattttaatgcctgtgtgaatccatgagaaactatgagtcggcaaaatttcacagayggcagggagaatcatctctcttcctcttcttgctgtctaaatggatttgattccagagagggagagggagagaaataaaagccagctattgataatttac

SEQ ID NO: 53014 - DNA, 201 bp, Homo sapiens
ctgcactccagcgtaggcaacagagcaagactccatctcaaaaaaaaaaaaaaaaaaaaaagacaggatcttgctctgtcacccaggctgggatatactgrcttgatcatagctcactgcaacctttagctcctggactcaagcaatcctccagcatcagcctcctgagcagctgggactataggtgtgaattaccatgcc

SEQ ID NO: 53015 - DNA, 201 bp, Homo sapiens
gcttctgttagtttaatttctgataaaacttccatttcaactttgcggcaccctaaatgagaccatcttggctccgaaggagtctagcgggcactctttcygaatggcgatttgggatctgctgcatgtatcagaggctttcgttgagttgtgttgtttcctgtgtgtttatgacagaaagatgtcatcgttaaaggaaac

SEQ ID NO: 53016 - DNA, 201 bp, Homo sapiens
aggggtaaggttaattctacaagttcaaagccagtagcccctgatgcgctgttggacgtgaactataaatttggctctgaggttcccaggcatggaagaayatctagatctgtacagagaggttgtgtgtgtgtttaacatttccataatgtacaatttcctctaagagtaaaggccatgaggaaatgcccgtggaagata

SEQ ID NO: 53017 - DNA, 201 bp, Homo sapiens
tttgagatagagtcttgctgtgtcgcccaggctggagtgcagtggcatatctcggctcactgcaacctctgcctcccaggttcaggcgattcacctgcctyggcctcctgtgtagcaggcccatgccaccacgcctggcttgcttatttatttatttatttatttatttatttatttatttatttattgtatttttagtag

SEQ ID NO: 53018 - DNA, 201 bp, Homo sapiens
ctgggcccggtatccctccttggccatcacaattgctgcaaccgttatagggaagagaagtgtagaaaccagaaacccctattgaaagaagcatcaattcrtataattaattttgccattataaaaatcatttgtaaaatttgcattattaacattatcaagtcactagttggtaagacatcagacatgacgagagtgaag

SEQ ID NO: 53019 - DNA, 201 bp, Homo sapiens
tataacttgcaagcaaaaaataataaagttcttggccacatgtctccacccccaaaagaaacattttagccatggtgtcccttaaggtgtttttttttttwaaaaaacttatcgaaggtttcaatataatagactaattttccagttatgtggcaaagtttattggatttgtgtgtataattatggattggattagttgag

SEQ ID NO: 53020 - DNA, 201 bp, Homo sapiens
agagaagcttggacaagtttccattaagatctgaatcaggcgattggaaaagaagagaataaaaccaactgaaaagagagggacaagttgttagtgttgcstactctgctttgaaggagaaccctcctcagacaagagctactttctggccaagaattccaggctcgcagagaaacctgtcccaggcacagaagttgtttt

SEQ ID NO: 53021 - DNA, 201 bp, Homo sapiens
ctaatttttgtattcttggtagagacggggtttcaccatgttggccagggtggtctcaaacctctgacctcaggtgatctgcccgcctcagccccccaaartgctgggattacaggcgtgagccactgcgccctgccagcggttcacttcagatactgcttctgagtatgtgtggggggctgtgtgtgggggacagatctt

SEQ ID NO: 53022 - DNA, 201 bp, Homo sapiens
ctttctccaaaccacctggcacggtgcaggccatgtgaagctctttctcaggaggaagatggagtaaattacagagctcattgttttggaggactgaaacyattactattcctccatgaacaggtagtattgttctctgcttctatttgctaaggcttgatgcccatgtgggcaaacagagagacattttattagagaccc

SEQ ID NO: 53023 - DNA, 201 bp, Homo sapiens
catgaaaatctgaatccatatgcatttgtcagggttctccagagacataaaaccaataggatgtatgtgtttatatagagagatttgtaataaggaactgrctcacccagtcatggaattccataatctgcatcatcaagtgtcatggtctgtagctgggaagctggagacccaggagagtccatggtgcagctctagtct

SEQ ID NO: 53024 - DNA, 201 bp, Homo sapiens
acacctagaacatgcttttatcttcagaaaagcaaaagtcaatgcagatgaaaaattttcaaggaactcttaggtttaaacagcaaatgatttagtactartgttagcttttaaaaaaagaaaagtgaatatttatgaaccaaataataaagcctctgtctttaaaaacatttattgtatacctattgggtgctgtgctat

SEQ ID NO: 53025 - DNA, 201 bp, Homo sapiens
ggggtagagagtgggtttcctccaggcattggacttgagaactggctagcgcgcagagcccggggccctggagaggctccttggctttctcttttgggcgrctatgtatttagctttctagtggagattgctggctctcggccctccttcccccttcccctggaaggtcacacttcccagattggtcccaccgcaaacttg

SEQ ID NO: 53026 - DNA, 201 bp, Homo sapiens
gccttcgttactagtaatttagaacttaaagattttcttttaaaattcagggtgctggaaaatgcccactttgcctcgacaatacctacctgaggcagccrtgaatggctttactcgcagatgttgctctccaaggacaggaagcattgttaatttcctttaaataattcaatacagtgtcaataccccacactgctcagt

SEQ ID NO: 53027 - DNA, 201 bp, Homo sapiens
tcagccttttaagaatcaaatgcaaagccagtcacttagccttgaatttcccactgtgattccacttttcaaaacccaggatgaccatcatgatgggtttmgttgtactatcagttgttacaggtcaaatcatagtctcatgattgttaaaatcttaataaggccccctctaatcctgtgagttttcagaaggaaatccct

SEQ ID NO: 53028 - DNA, 201 bp, Homo sapiens
ttttatagatcttttaaaaagtgacttgtttgaagattataacatcatttcatacagaaaatagctttgctatgcttacattttgaaaacacctgttgaarcctctaaagaaacatgtttataaaatgttaaacacgtcagttatatttttggtttaaaacaagcatgataattcttgacttcttcctctgaatttgggaa

SEQ ID NO: 53029 - DNA, 201 bp, Homo sapiens
caacactatgtgagaaaacttgaaaagtatataggttgtggatcaccagttctcgaactcaggaccaccctgactgagttgaccatgatcagaatggatgsaagagttcactggttttataatttttgcgaagagctgtcttctgcccttagcactcccatgtcctgtaaccaggaaacaagccggtgccctgggttgagt

SEQ ID NO: 53030 - DNA, 201 bp, Homo sapiens
gggcactaaaagatgaaagcactaaatacttgctttagaaaaacacagtggaagattctctcatcctccccgctgaaaatttatgggcttagaattccatraaccaaaatgactgtcttcagttaaacttattgcgaccctctgggcatgattaacaaatcaggtggaaagggaaggtggaggagtatacgggattctttt

SEQ ID NO: 53031 - DNA, 201 bp, Homo sapiens
tctgtgtgtgcttgtcctccccctgggaaatgatgagaggtgacccccgagctcccagctcagtgtcacactcgagtgaacagtagatgatgcttctgccrtgcgttttgctggggaaggtaacagccatcgcacacatgtaaattcttgtgtaatccaattcctgtctttgtaattacttggagacttgccatcgcagcc

SEQ ID NO: 53032 - DNA, 201 bp, Homo sapiens
ttcttagggaaaagtacaatgtagggctatgtgtgtggtggggatcttctgtgtgtgcttgtcctccccctgggaaatgatgagaggtgacccccgagctsccagctcagtgtcacactcgagtgaacagtagatgatgcttctgccatgcgttttgctggggaaggtaacagccatcgcacacatgtaaattcttgtgta

SEQ ID NO: 53033 - DNA, 201 bp, Homo sapiens
tcatctgccccactacttagatgaaaccaggaatggcaagaggagagcatccaagccgcctgcaccagccctcagtgcatccccacccaggctctggaacragctgctacatgcacgggaagaccagagctgccgtcttcctggctgttgttcagagcttatgctttcttagggaaaagtacaatgtagggctatgtgtgt

SEQ ID NO: 53034 - DNA, 201 bp, Homo sapiens
gatttttaagatttgggcataatgtttaaaatgaagatggtatgtctgtagattttattgacccaacttggtccccccaggctgtcctcatctgccccackacttagatgaaaccaggaatggcaagaggagagcatccaagccgcctgcaccagccctcagtgcatccccacccaggctctggaacgagctgctacatgc

SEQ ID NO: 53035 - DNA, 201 bp, Homo sapiens
tacagaacatttctagacatctggcaagagctagttatcatcccttcctgatttggggtgctaagacctgtggtccccttcttccaccgtaatttacattyttccctgagtcctgcaggaactcagccaggcagtggaaagaaaacagaagctctgtggacctctgcttactgtaaaatgggaataataattcttatcctg

SEQ ID NO: 53036 - DNA, 201 bp, Homo sapiens
gggattctcatacctcaacctccccagtagctgggattataggcgtgcaccaccatgcttggctaatttttgtattttcagtagagatgaggtttcaccaygttggccaggctgttctcaaactcctgacctcaagtgatccgcccgtctcggcctcccaaagtgctgggattacaggcgtgagccgccatggtcggcctg

SEQ ID NO: 53037 - DNA, 201 bp, Homo sapiens
ctcagtgaggtcatattcccagtgtagagggaacatgacgtagtcccactctacttatcagatgcagagcttgctaccaggaaaacagacgcggagaagcygggatcatttctggccccatttccctcattgttcaccattccttggactgcaaagagatgtcattgtaaacgctatccttttcattttgtatactaagca

SEQ ID NO: 53038 - DNA, 201 bp, Homo sapiens
cagcctccacacctccctgggaagattttgaggaagtgtcatgtttgagaaccccacttaagtgggagctgcactcacctccgtctcctttttctctgggsatactggatccctgttttggaagtttctagttcagtataattttaatacctggacctgaacaagtccagcctgttttatgtcactgtttttgctcctggg

SEQ ID NO: 53039 - DNA, 201 bp, Homo sapiens
tgtcaggacagatttttaagatttgggcataatgtttaaaatgaagatggtatgtctgtagattttattgacccaacttggtccccccaggctgtcctcayctgccccactacttagatgaaaccaggaatggcaagaggagagcatccaagccgcctgcaccagccctcagtgcatccccacccaggctctggaacgagc

SEQ ID NO: 53040 - DNA, 201 bp, Homo sapiens
ctcttccttccctcttctgtggcgtcttgggctttccccggttaaccccttggctgccgctgcgggccacgagtgactgactgtgctgcgcccgatgcgcrgggtagagagtgggtttcctccaggcattggacttgagaactggctagcgcgcagagcccggggccctggagaggctccttggctttctcttttgggcga

SEQ ID NO: 53041 - DNA, 201 bp, Homo sapiens
aggcaagagaatttcttgagtctaggagttcgaggctgcagtgagctctaattgagccactgcactccagcttgggtggcagaacgaaaccttgcctcttraaaaaagaagagaggggctgggcgcggtggctcacgcctgtaatcccagcactttgggaggttgaggtgggcggatcacaaggtcaggagatcgagatca

SEQ ID NO: 53042 - DNA, 201 bp, Homo sapiens
agggcctgggtgctttttggagccaaggagagaagaatactaactggagagtgtccttaccccatgttggccacttattcctggatgtgaactggatgttyagtcttgtccgtgtcttaacattgttaagattcctggggtgcgttgacacagagtctatgtctgtgtctgagcagacccttcatactgtgatgagcatgg

SEQ ID NO: 53043 - DNA, 201 bp, Homo sapiens
ttctaaaaagcatgtcatcacggtcaaagttttatttttgcttgttagtcatttgaaacaaatatagatattgcttcatttcctgggtactgtatttttcrgtacgtggtatgtatggaaaatttgggtttacacaatgaagtgcactagaagggaagtatttgctaatttagaactctctacattataactttggattag

SEQ ID NO: 53044 - DNA, 201 bp, Homo sapiens
attagagagagatcatttcactagagtagtttgatagaacctgtggatggcaggtaacttgctcaagaggttcattgacttgctatggtgatgagttttarcctaattagctaatttaagtccatacctcagaagaatgttcattcatgaaaaatatttgcatctaatgtgtgccaggccactggagaattcatcagtgag

SEQ ID NO: 53045 - DNA, 201 bp, Homo sapiens
ataattttaatacctggacctgaacaagtccagcctgttttatgtcactgtttttgctcctgggctttttcttgcagatattggtgggtgaagacatgcaytgaattctttccagaatgtctgctgtgaagaattactcatgtcatttgcaaggcttaagctgaagcattcgctgctatggtcgatctaggcttttgtggg

SEQ ID NO: 53046 - DNA, 201 bp, Homo sapiens
aataatagggtgtgacccatggcatataaccgcattcagataagaagaaagagttttcttttttcttcttcctgtaattgctcagtcaataccattttcayggaaatacttgcaaacaaacttttaaaaagttcattgtccaaagccttccctgattccttgtttccttcctcttcaggggttctataaacttttcctgat

SEQ ID NO: 53047 - DNA, 201 bp, Homo sapiens
ggtaggtctcggagcagaatcacggtatgagatgagctagctctaaaatgaagccgcccacccaaagtttacctctctctagggcagggcccatccactgygatccctgaattcttgttgggtcactgtcattttgggtgccatgatgtctgggtgtgctgaccgctgatagggatatcatagccataaaaacgcctgttt

SEQ ID NO: 53048 - DNA, 201 bp, Homo sapiens
aaaggagccactccttacaaaaagttggggagccctggtgtattgaggtaggtctcggagcagaatcacggtatgagatgagctagctctaaaatgaagcygcccacccaaagtttacctctctctagggcagggcccatccactgcgatccctgaattcttgttgggtcactgtcattttgggtgccatgatgtctgggt

SEQ ID NO: 53049 - DNA, 201 bp, Homo sapiens
ttaatcctgaacaaattacatgaaaaaatcgttcatggagtttttcttcatataaaactttttacaatgaacataaagggcatagctatttcttttttttwaaaaagaaacgtagaatattatttcttggttgtgaaatcgcccttcttggaccccaagttgttttttacagccctaaattctcttgtttatagagcctgt

SEQ ID NO: 53050 - DNA, 201 bp, Homo sapiens
aatacagcatcatttgaaatgacaagggagccattgagtaggacattaggaggaggaaggactattctttggagtggttggtaatcagagtcttgggtacygagaaaatcataccttctagaggagtgttcagaggcagaatgtcttctgttttcaaggggacgtaggagggtgttatgaaatactgagttgcaccgagca

SEQ ID NO: 53051 - DNA, 201 bp, Homo sapiens
attttgagctaataaatgtttggggacaccactttcctgtagaatctcatgtaatcccaaacagatcctagctgcttgctatggcccatctgcgggacccrcgtcaaggctttcccataaaggagagccctgcgggaatcatcatgtgccaggcactgtgctaggctctttaggtgcatcttgaaacttaatcctcgtgac

SEQ ID NO: 53052 - DNA, 201 bp, Homo sapiens
caaccatggatacatttctttcccaacgcattctctgaggcactttggtaactctgcctctttgctctcagcattgtgttagaaaataaagccagcagacwaggattaaaccctcatgttgctgggttccttctagaaacaattggagggctaaccaagtcacctttggtggaaggcagtaaggtgagtcattgctgtggc

SEQ ID NO: 53053 - DNA, 201 bp, Homo sapiens
gtgcccctgactgttcctgatttagcgaggtgtttctgaattctgatggaattcaaagaagcctgggcaggcaggcagcttgacttggggcttggggaagygtgcagcccagacatagcagcgatgagagggcctcagggctgagggctgagatgagaatttcatcacatgcaaaagtgaaagcgacccatcgtcttctcc

SEQ ID NO: 53054 - DNA, 201 bp, Homo sapiens
aaaaaccctgacacataaaattaatcaccaccagagttttctgaggcaaagaggagtaaagctgttgcctttttcttcttgcctgtgaggttggttgagaktcttctaacagccaacaggtgttggccaatgttactctgattgacacctttctttttttttattcaggtttccctctgtcacccaggctggagtgcgggg

SEQ ID NO: 53055 - DNA, 201 bp, Homo sapiens
ttgggaggccgaggtgggcggatcacttgagaccaggagttggataccagcctggccaacatggtgaaacccggtctctaccaaaaaaaatacaaacattwgccgggagtggtgttgtgcacctgtattcccagctactcgggaggctgtcacaagaatcgcttgaacccgggaggcggaggttgcagtgagctgagattg

SEQ ID NO: 53056 - DNA, 201 bp, Homo sapiens
acagaatgacatagataacaaatcaagttttgtctaaacattcctgttagtgccaggacccagccgacggtcagtatgtacagattataccatttctggayggactcacccaaaaaggcagcattatttatcccctgaccttggcgtaatgtgtgatgttctttcatgcttttctctttgttcatgtctttctcatctgta

SEQ ID NO: 53057 - DNA, 201 bp, Homo sapiens
tgacagtggttgccttcaagcaggcagcatcttggttgcttccagcggcagaaagctggccagtgcttacacacgtgtttccagttggagtgttatcagcyatggttctgacaatattctagggtccttagatgagcacacttcctgtatctgcattatttttatagcattagtggggttgatccccaggctcacctttcc

SEQ ID NO: 53058 - DNA, 201 bp, Homo sapiens
atgagagcaaaggtcgtagctgagtgcacgttgaaagaaagcgcggccatcaaccagatccttgggcggagggtaggtgacgcccttctcagggagaagckgggggcgggtggtgagggaccagagtgcagcaggtcaggtggcagaatgtctctgtccccatttctttggagaattcttgcccttcagccacattctgaa

SEQ ID NO: 53059 - DNA, 201 bp, Homo sapiens
caggtgagaatataaacagataatggttaagagatagtttagtctttctaggccagattatttagtttttgccatctaggtaaaattcggtccaattaagygtccattaagtgttttaatataagctggagaaggagttgaacctggaggtcagggctctgtggtctattacagtccccctggggtctctagcccaaggga

SEQ ID NO: 53060 - DNA, 201 bp, Homo sapiens
taagtgagtgggtagagaggacatttgtcaaggagcgggagggcgggccattggcttgggggaaatgggctgagactctaggggtggccagcaccgcatayggaggccagcagggttgggcttggctaagtgctgtggtgtctggatgcctatgtgagtttcctccagaagttttcagttggcaaagtagaacctgctgga

SEQ ID NO: 53061 - DNA, 201 bp, Homo sapiens
gccaggctggtctcgaactcctgacctcaggtgatctgcccttctcggcctcccgaagtggtgggattataggcgtgagtcaccgagcctggccccaggcrataatataccagtgggcaagaaaatattcttgctctcatgggacttctgttgggggtcagggtatagggaggaaggcatagagatgaaaaccagtaaata

SEQ ID NO: 53062 - DNA, 201 bp, Homo sapiens
gtggaataagtgagtgggtagagaggacatttgtcaaggagcgggagggcgggccattggcttgggggaaatgggctgagactctaggggtggccagcacygcatacggaggccagcagggttgggcttggctaagtgctgtggtgtctggatgcctatgtgagtttcctccagaagttttcagttggcaaagtagaacct

SEQ ID NO: 53063 - DNA, 201 bp, Homo sapiens
ccctccagattacgtagttctgcacacatttgaggatttttgaaaaaattcaactttgcctgggtcactccctcgttaccttaaacttgcaacacatcagytggagatcagagggagcagcaattgtgtttgccctccttgtcccatggtgactctgtgtcattttcacgcgtgttatttattctggctgtagatgcccat

SEQ ID NO: 53064 - DNA, 201 bp, Homo sapiens
gtttgtacttggacctgcaggctgggtggcgtctgtgggagcagtgtgttgagagagattctgaggctgtatgtgtcagggcctccaggggaaggatgcaytgatggattaatttctgccaaggctgaaagaggagagagtaagaggctgtagaggtgtcacagctgtcattgctgttttaggcagtcaagcttttgggaa

SEQ ID NO: 53065 - DNA, 201 bp, Homo sapiens
ctccttgtcccatggtgactctgtgtcattttcacgcgtgttatttattctggctgtagatgcccattaaaggatgcccatgtttgggatactaacaaggsaggatagaacggaacaatgcagttctgcctttgtgttcgtcttcctttctgtcggtctttgctgaatcacagggtttgagcatttgtgtttgttgagcca

SEQ ID NO: 53066 - DNA, 201 bp, Homo sapiens
aaatctcactgaaagctaattgatcgcttttgacagaagtagctcccttgggccgtatatttatttcctagcttggaggaaggtggggacagacagaattratgtacacctttatttttatctctatggtaaacctgtgcatactaaagcattcctctggtcttttgagatgagtgtatacattgtgtctggccctgtgca

SEQ ID NO: 53067 - DNA, 201 bp, Homo sapiens
gatggagactggaaatatttactttagtggttctcaacttgagatgatactgctcccagagaaggtatttggaagtgatgagatggtaaggataaccaagrgggttcctgttggtatttactgtctgggggcttggagtcctacaagtccttcagtgtttggggcagactccccacctaataccctgtcgcagataggaca

SEQ ID NO: 53068 - DNA, 201 bp, Homo sapiens
ttgggtggcagaacgaaaccttgcctcttgaaaaaagaagagaggggctgggcgcggtggctcacgcctgtaatcccagcactttgggaggttgaggtggscggatcacaaggtcaggagatcgagatcatcctggctaacacagtgaaactctgtctctactaaaaaatacaaaaaattagctgggcatggtggcggccg

SEQ ID NO: 53069 - DNA, 201 bp, Homo sapiens
agggcagaatattaaattaatcacaacttcttgtattttaaccattctgggtaaattgggattccgtgacgcccaggcaaaattatttgtttatagaagawgggctgaattttccatcgtccatttctgagaaatgaggtaggtttagaaagagacaatcaggcctcttctttaacagaaatgtttgtgtctactaggtgt

SEQ ID NO: 53070 - DNA, 201 bp, Homo sapiens
tgaatgaacaaaatgatggaacttggatttgaacccaggtctgagctggctttgagtcttcagaatagtaggtccaattagtggagtgggggctcagtagyccaaagggaaaggagcaaggagacattgtgggggccgagaagagggcttctggggtgtttcctgggcacattggcattaaaggcatagtgtgaagtgcca

SEQ ID NO: 53071 - DNA, 201 bp, Homo sapiens
ttcaaactttgcaacacatcagaatcacttgggaaacctttaaaattctaacgcccaggtcacatcccattccaactagatcagaacatctggggaatgcragccatgcaccagtagttataaaacctgcccaggtgattccaaagtgtgggaacctttgagaagcactgctttaggggttggaatagtcctggctgaatt

SEQ ID NO: 53072 - DNA, 201 bp, Homo sapiens
acccctccggccacgctggcactttcagcttctccagcctcctgcccttcccacttccagtcctgcacctgctgtcctcactgatgcacctgcccttttcyttccgtcctttatgtggcacacccttaagggagacatcttcctgtctgtgttttgcaccctcttaaaactacattcctttcccttcagcattggcatctc

SEQ ID NO: 53073 - DNA, 201 bp, Homo sapiens
gacttgttcttaaaaaaaatgcggatatgaaagaaaataaaaaccacattatccctccactttttcttggaggaggatgtgttgaagaagtcaaagttcascatccctttagatagaatcattttgaacaatttcatatgtcaatacattttgctcatctctaaatttcattttagagcctgtggtgttctgtgcatggat

SEQ ID NO: 53074 - DNA, 201 bp, Homo sapiens
gttgcagttagctgagaccatgccattgcactccagcctgggcggcagagcgagactctgtctcaaaaaaaaaaaaaaagaaagtagcagctctactgagatatttagaaaccataaaatccacctatttgaggtgtacaattgagtgattttctgtatagtcacagatctgtgcagtcatccacaccctctaactccagg

SEQ ID NO: 53075 - DNA, 201 bp, Homo sapiens
ccccatctctactaaaaatacaaaaattagccaggcctggtggtgggcgcctgtaatcccagctactcaggaggcttgaggcaggagaatcgcttgaaccygggagactgaggttgcagtgagcggagatcatgccattgcactccagcctgggcaacaagagcgaaactgtgtctcaaaacaaatgaaaagaaaaggctg

SEQ ID NO: 53076 - DNA, 201 bp, Homo sapiens
agaccccaggacaaaaggtagaaaagaacaaagtgttaaaaaatttcttgatacatagccacagattattttcctgaaagttctcaacatttataactacsagcagtatgtaagagagttatggttggaatgattttaatgtctctggggaatttaacaacaaaaaaactttaggcttctttggagagagacatgccctta

SEQ ID NO: 53077 - DNA, 201 bp, Homo sapiens
cactccagcctaggcaacagagtaagactgtatctcaaaaataccataattcgttttgtcttttctttacttttttctttccttttccttcccctctcccytcccctccttccctttcctcccctttccttccctttccatctctttccttcctttcttttctctctttctctctttctttcaacagggtctcgctctgaa

SEQ ID NO: 53078 - DNA, 201 bp, Homo sapiens
ctcaggaggatgccggctggtttggaggaagatcagccttgtattctgttcaggccttcagctgatgggctgaggcctgctcacatcaaggaggaccatcygccttactcagtgaatgttaaacttatctaaaaatatcctcagagaaacatccagaatagtgtataaccaaatatccgggcaccttgtgacttagtcaaa

SEQ ID NO: 53079 - DNA, 201 bp, Homo sapiens
atacccaccaccatgcctggctaattttttttttttaagtatttttagtagagacagagtttcaacaagttggtcaggctcctcttgaacttctgacctcrtgatctgcctgcctcggcctcccaaagtgctgggattacaggcatgagccaccatgcctggcctaagtttggtttttaaccatgctgctttttctagacc

SEQ ID NO: 53080 - DNA, 201 bp, Homo sapiens
atgtcctcgaaattagatgtgccttcaaaaagacttgatttaatgttagccaggtctgtttgaacttcattattactattattattttgagatggagtgtygctctgttgcccaggctgcgcccaggctggagtgcagtggcatgatctcggctcactgcaacctctgcctcccaggttcaagcaattctcctgcctcagc

SEQ ID NO: 53081 - DNA, 201 bp, Homo sapiens
tcactgcaaccttcacctcccaggttcaagtgattctcctgcctcagcctccccagtagctgggactgcaggtgtgcaccaccacacccagctaatttttstattgttttattttattttatttattttttaattttttttttgagacggagtctcgctctgttgcccaggctggagtgcaatggcgtgatctcggctcac

SEQ ID NO: 53082 - DNA, 201 bp, Homo sapiens
aaagaacttgttttcattaaagccatttcaatttcgtacatttttatgcaataatttagtgtttatggtgtctcttaaccaacatggcttgttttcataarcacccgagaaggtttaaataacattttctcataaattagccctcgtttgcacacttattcagttattgcatcatgaagaccctctggagtttgatgttgt

SEQ ID NO: 53083 - DNA, 201 bp, Homo sapiens
tttctttttattttttgagatggagtctccctctgtcacccaagctggagtgcagtggcacgatctcagctcactgcaaccttcacctcccaggttcaagygattctcctgcctcagcctccccagtagctgggactgcaggtgtgcaccaccacacccagctaatttttgtattgttttattttattttatttatttttt

SEQ ID NO: 53084 - DNA, 201 bp, Homo sapiens
aatagagacgggggtttcaccatgttggccaggctggtctcaaactcctgaccttaagtgatccacccatcctggcctcccaaagtgctgggattacaggygtgagccagtgcgctgggccagccacagcagattctgacaggtgatgcccttgccagcctggggagccttttggttttgggtttggtttttaaatttgtt

SEQ ID NO: 53085 - DNA, 201 bp, Homo sapiens
ttaacaggctatgttttaaatcttattgacatctctgaagaaagaggaggaaaaaaaaatcaagacatggccttagagaagtgacaggttttctttgagaktttgttttctgttttcctttttattttgtgcacattgcaaaacctctttgggatgatgatttcgtgtggtttcttggtagcccttgggcagctgctgcca

SEQ ID NO: 53086 - DNA, 201 bp, Homo sapiens
gctaatgtacttggttgggaaatgccaattcaggtcctaaaatgtgccttagagaactgtccaaaaaatgagcagcatgagaggagaaaacacaaactgtwtctttcatttataattttgataatcatttagaagacttcttaatgatgcctagacaacatatgaagtaaaagtgatataggaatcctaaattttagagga

SEQ ID NO: 53087 - DNA, 201 bp, Homo sapiens
ggattctgccctttctgtccctcactattttttctatagtaggatatgttgcttgaagaggggtgagtcttccaacccagtacaaatcatggtgacaccaygcaaaatagaaaatgagaaaggtgtttgatccagttgtcagtctgcagatgggccaagagtaggttgagattagctctttctgtcctggctaatgtactt

SEQ ID NO: 53088 - DNA, 201 bp, Homo sapiens
tgtgacatgttgctttcatgaaaggttcccctctagccaaagactgagtggtccttgcaggctttctcctgagtcctttttttttttttttttttttttttaaagacagagactctgttgccagattggagtgcagtgacgcggtctcggctcactgcaaccgctgcctcccaggttcaagcaatctacaaaatgcatcta

SEQ ID NO: 53089 - DNA, 201 bp, Homo sapiens
gctgacactcacttgtgccaccctgtgaccccctttagattgagatgttggagctccgggccctcagcctgctaaattggtgcaaggctcttctcctgacragagccggctctgaaatctgccggcttcaaagggagcgagatcatgtataaaccataatgtgggtgcaccgtggctcacaaaaaataaggcaggaagaga

SEQ ID NO: 53090 - DNA, 201 bp, Homo sapiens
atttttttggtttgtaattggttaaggaagataagctttgattaaagatttggggtcagcagaaagaaatgttaggtctggctcgtgggcatgtctttttmtaggcccctccttggaaagaactttagagcaaagaaaggcagttggagcttagtccccactttctcctgatctgaggtctacggaccactggatccattt

SEQ ID NO: 53091 - DNA, 201 bp, Homo sapiens
tgatgatggcacataatgaaattagcatgcgttacatggcaggggtgctgtccccagcttctttccccagtccctgtggccaacatgggaagccaagaccrgagaagggcctggaaagacaggtcaagatgctgcttttcctacttacaaaacagtaactttagcagtgatagagagttacattcattaagaaaaacaaac

SEQ ID NO: 53092 - DNA, 201 bp, Homo sapiens
atttgtaggtcaccaagcagggcaaatccagcagctcacgcttaagacctgacctctcccatggtttataagcaagtggttttttttttttttttttttttcagactgagtcttgctctgtcacccaggctggagtgcagtggcgtgatctcagctcactgcaacctccgcctcccaggttcaagcgattctcctgcctca

SEQ ID NO: 53093 - DNA, 201 bp, Homo sapiens
ctggtgcatatcatagtggtctgtgcagctctaagtctttgaaagttaaaaaaaaacatgtgtgtgtgtgctgtacattcatatatatttatatttcagcrtagaaacatatttacaagatacattcctatccccatgttcttcttttcctccctctgattaattctggctaatttttcagtgactgctagtttatttaca

SEQ ID NO: 53094 - DNA, 201 bp, Homo sapiens
cagaggaaagcttggctttgccaaagagcgttttctccaggtagaaagcataaagccctgaatgatttaaagtcagatgaggattttggttccttttaaayagatattgtttacttcatttaatggttcggctttttagtagactttttctttagtttcttgtcagcccagaactgacgacataaagtgtttttatcatct

SEQ ID NO: 53095 - DNA, 201 bp, Homo sapiens
ctactggaacttccacccaatgaagctggtcatgacccttctgctgttggctgcccaaactgcagtcatgtcattgggttgaggctgtcgagtcctccatkttaggtgttacatattttggggcacagaagcaggaacaagaacggccttgttttgaaatccagggttgggattagggcatgttcttgtatgattccagga

SEQ ID NO: 53096 - DNA, 201 bp, Homo sapiens
ggtgccctgagctggctggggaacatggaccttcccccttccttcacggattctgtagtggcaaagattagaaagtagaaggagtttttaaaatttttttwaaaaaattaaatctgcaaccagctgaactctagattattagtggacttttttgttttttatttttaagatttttttagggatgtgtgtacagggggaagg

SEQ ID NO: 53097 - DNA, 201 bp, Homo sapiens
caggtgggcttaatccccacagacgactctgtcctctagcggatgaagttccagaatggagtacacaagcctccaacacctccttgtctgttcagctctgwctctgccttagataagatgccagatggcatttgatcagtttctccagctcatccaaatagaggcagagacattttagaggagtcaccatttttgaaaaaa

SEQ ID NO: 53098 - DNA, 201 bp, Homo sapiens
taacagcaacaaagactgtagcgcttcctatgcgaggcttgttccagttgcttcagaggctgtgttacccctgttctagagaggaggaactaggcccaggkaggtggggatttgcccagtcgtgggagtcaggatgtgaaacaaggcaccctggctccagagcacaccgtcctctcaaccactgcagagaagctgggaaag

SEQ ID NO: 53099 - DNA, 201 bp, Homo sapiens
gttatataatccagtgattcctaatctgtgttcagaggagagaggaaatcgattgcaacagggacgatgccttcattggctggcccaaaactgggagtttwtacaaggcgtcagtctttgccttcctcctccctgccttccctcttccttcttccttccccatactccccaacaaattcatggacttcttaacaactcaga

SEQ ID NO: 53100 - DNA, 201 bp, Homo sapiens
caaagatcctccacctcaaatcccacaagaacagttgccacaacctgggccctaagcatctcattttcctatgtagaaattaatgatctggaggagatggsaaaacattccttccagagcctgtgtggattttggccaggggtgcagcaagggggcttaggcacctttttcctctgctgtgtcttagcaggcgtgttgacc

SEQ ID NO: 53101 - DNA, 201 bp, Homo sapiens
caacctgttcgtgcagtgagcgtgtcttcctcgccctgcccttggctggggaatgtgctggcttggagggcaggagagtgacaggcggtttgagaactccrggctctcccgtcttcggatggctcctgtgaaagcagggcctgaaacttttatcgtcactgctgcaggtgaaagactttcatttggctgtagtggtccaac

SEQ ID NO: 53102 - DNA, 201 bp, Homo sapiens
tctccaaaagtgaatgccctgttaaaaaaaaattcttaacaaatatacagagattttttttttaaaaaagtgtgacagttctagacacctagagagtaaartgaagaagcctgttttcaggtttcccgcctccctgaatttcccagcatggtccaggctttgaaatttatttatctgcttttggcaatggttgatgggaat

SEQ ID NO: 53103 - DNA, 201 bp, Homo sapiens
tcctttttaaatggtgacaaattcatgggctttctctgcctcaaaacctagcacagctgttatttactgaacaattagagagctaagcactttttagataytatataatttaattgccgtatgaggcacccttagttttcagacgagaaaccacagttacagggaaggcaagtaacttagtcaatgtcagataactaggaa

SEQ ID NO: 53104 - DNA, 201 bp, Homo sapiens
ggtggggacagacagaattgatgtacacctttatttttatctctatggtaaacctgtgcatactaaagcattcctctggtcttttgagatgagtgtatacrttgtgtctggccctgtgcattttttaccaagaagtaagttttgttgagtaaacttgggttgtatgaagaactgcatgctcaccgtactcaagtagctttt

SEQ ID NO: 53105 - DNA, 201 bp, Homo sapiens
atattttatggagagatgcaacatgtcaggccttggagggaaaccccaggatccagatggttgcactctcaaaccagggcccccctcaccttggccttcascatttagtgttggaaccaatagcataagctttggtcaggacctttgatggaagccacagtgctcattagtgaccacggttgactaccttctctctcctaa

SEQ ID NO: 53106 - DNA, 201 bp, Homo sapiens
tgctaaaaggaataaatcctggtaaaactcaggtttgagtcttagggaagatggcctttcaaagccttaaggaagataaaattttggagtggcttaccccmcaattctacccgtatttctctagttagatagattctatgctgtttttttttttttaataaaaaacagattgcattatgtagtagctgtaccaaataccaa

SEQ ID NO: 53107 - DNA, 201 bp, Homo sapiens
ctaagagtttcttatacatgggctgagtacctctgtgactgggcaagccacctcacctcattttaccttgtctgcaaaatgaggaactgggtcaactcatygttcaaatctcactgaaagctaattgatcgcttttgacagaagtagctcccttgggccgtatatttatttcctagcttggaggaaggtggggacagacag

SEQ ID NO: 53108 - DNA, 201 bp, Homo sapiens
gtctctgcacctaagatactaaaggaaatattttatggagagatgcaacatgtcaggccttggagggaaaccccaggatccagatggttgcactctcaaaycagggcccccctcaccttggccttcagcatttagtgttggaaccaatagcataagctttggtcaggacctttgatggaagccacagtgctcattagtgac

SEQ ID NO: 53109 - DNA, 201 bp, Homo sapiens
tggtgttctcaaagctcagactctgattgcaagtcaacaagaaagcatccgcctcctcccctcgaaggtagcactgtccaatagaaatatagtgtgagccmcagagggaattttaaatttcgtagtagccgtgtttttaaaaaagtttttgtttttttttttttaaaaaaaagataaagttatttttaatgacatgttttt

SEQ ID NO: 53110 - DNA, 201 bp, Homo sapiens
tgtcaaatttgtataggaattatttactgtgctgtctttcctgagccgctacagtaaaagtgaagacatggaaaattatcccagatgggacgaatcgctcrttctctgttctttttttaaaaagaaaagatttcagaaaaaaaaaaaagtcgtctttttctttagaacagtatgaataaaatctggacagctgtcgaaaaa

SEQ ID NO: 53111 - DNA, 201 bp, Homo sapiens
caccagaataaatagctttggttgcaaaccagaaatcttccaaggcttgaaaatggatgtgtgtgatagtagcccattctaggggtactggaagattcttytcactagggctttggtgaggctgccctgtagggaagaagtcttgtgtcaacagtttttaagttgattcagtaagcattgttgatgattgaaattgaagaa

SEQ ID NO: 53112 - DNA, 201 bp, Homo sapiens
agcaagctgtgaaaaagttaccggaaggtttccaggggcttgcagatcaagaatgctgttctgtttgccgtgctggatcgctgcagttctgcacgccattraaaaaaatatttgctttagaaaactagcattttaatagttgcaccagaggctgtgcttttaaagattacagtagaagtctttccaggtttcgaatgcctc

SEQ ID NO: 53113 - DNA, 201 bp, Homo sapiens
gacatttagcatggccagtcattgggaggtactcctggcatctcgtgggcagaggctaaggatgctattgaacatcctgcaatgcccaggacagccccctrtgacaggagtcatccagcccaacatgtcactagtgctgcagtggagaagccctggctgtgtgtgggggtgtgtgtgtgtcctcttctacatttgataagg

SEQ ID NO: 53114 - DNA, 201 bp, Homo sapiens
cagaaaggaaacagtatataagtgagattggggtaggtgtatattagaggtaacaaagtgtgcttttagaatttttaaataacagccccttttataatatraaagaccaaaaataatttgtttttgtgctcagccaggtagtttgagatgagtgttcgaccactttgtcaacttggtgttcttttccacgtatcttagatt

SEQ ID NO: 53115 - DNA, 201 bp, Homo sapiens
taaatgctttttgtgaattattattactattttgagacagggtctcactctgtcacccaggctggagcacagtggtgtgatcatagctcactgcagcctcsacctccctggactaaggtgattctcccacctcagcctcttgagtagctgggactacaggtatgcatcaccacacctggctaatttttgcatttttagtgg

SEQ ID NO: 53116 - DNA, 201 bp, Homo sapiens
agctgggatgtcaggcacccgccaccatgcccggctaattttcgtgtgttttagtagagatggggttccaccgtgttggccaggctggtcacaaactcccracctcaggcaatccgcccgcctcggcctcccaaaggctgtgattacaggtgtgagccactgtgcccagcctagggttccatttcttaacccctccttctg

SEQ ID NO: 53117 - DNA, 201 bp, Homo sapiens
ccagtgttaaatgctttttgtgaattattattactattttgagacagggtctcactctgtcacccaggctggagcacagtggtgtgatcatagctcactgmagcctcgacctccctggactaaggtgattctcccacctcagcctcttgagtagctgggactacaggtatgcatcaccacacctggctaatttttgcattt

SEQ ID NO: 53118 - DNA, 201 bp, Homo sapiens
tagcgaggtgtttctgaattctgatggaattcaaagaagcctgggcaggcaggcagcttgacttggggcttggggaagtgtgcagcccagacatagcagcratgagagggcctcagggctgagggctgagatgagaatttcatcacatgcaaaagtgaaagcgacccatcgtcttctccacttgatctcttgctgagcttt

SEQ ID NO: 53119 - DNA, 201 bp, Homo sapiens
acctgaggtcaggagttcaagaccaacatggcgaaaccccgtctctactaaaaatacataaattagccaggtgtggtggtgggcgcctgtaatgccacctmctcgggaggctgaggcagggagaattgcttgatcccaggaggcggaggctgcagtgagccaagattgtgccactgccctccagcctgggcgacagagcga

SEQ ID NO: 53120 - DNA, 201 bp, Homo sapiens
ggcccgagggtaagctttttagaagtgagtgtgtgtgttgtgttgttttaattaatgaatcttctgggcctgaagataatgaggtcagtgagggcagccatgctgcctcacagctcaccttagggtccttgttgtccagaacgtgcctgacctactggaggggcctgggaatgcttctttgattgacgtgggtaggaagac

SEQ ID NO: 53121 - DNA, 201 bp, Homo sapiens
tatttgtaggtcaccaagcagggcaaatccagcagctcacgcttaagacctgacctctcccatggtttataagcaagtggttttttttttttttttttttttcagactgagtcttgctctgtcacccaggctggagtgcagtggcgtgatctcagctcactgcaacctccgcctcccaggttcaagcgattctcctgcctc

SEQ ID NO: 53122 - DNA, 201 bp, Homo sapiens
tcaaaaaaagagaaaagattaaagctgcacagacatgatgatgtaaaagctagtagcttctcaagctgtgaaaggtctgtggtgcagagaatagctccctrtgagctgaattttgtttgctgtggtgcagcatgggtttagatcctacctggttagtgaaagagataatgtgaagtcattgcatttgcatttgtcaaaatc

SEQ ID NO: 53123 - DNA, 201 bp, Homo sapiens
tgttcattgagcaactaaagaatagactcagatataggaaagtatttatttatttatttatttagagacagggtctggctctgttgtccagatcataactmactgtaaccttgatctcctgggctgaagcaatcttctcaccttagtctcccaaagcatgctgggattacaggtataagccacagtgcccagcctgaaaag

SEQ ID NO: 53124 - DNA, 201 bp, Homo sapiens
ctgggaggagcccatatggagaaacaggaaaattccacttcaccagaaagctggggaaatgagtgggagtaggggccaggctggttaactaggaagacttktggtcactctgctttacttagcctaaagtgttcatttcccccttaagcggtggttaatacgcgtatctgcagatttactttttggatgatttaaaatctt

SEQ ID NO: 53125 - DNA, 201 bp, Homo sapiens
tgggtctccaaagcttcaggaacatatcctggggtgttgaggaaacacccaccttaaaatgttcctcaagggggaatgttactgcttgccctaaccctctkgagctgatgctcacatgacgtccctgagatgggcttcttttttgcccgtacttaaagctgtaaagggccattgtcaaatttgtttagcttctcaattcat

SEQ ID NO: 53126 - DNA, 201 bp, Homo sapiens
tttccatgtcctcttcattagtgttagcttgtggatggatttgaggctctctgtgctttccccccagcaaagtgaataccagactttcctattaaaaaaaktattttatttttcagagacagggtctcattctgtctcccaggctggagtgcagtggcacaatcatagcccactgcagcctccaactcttgggttcaaatg

SEQ ID NO: 53127 - DNA, 201 bp, Homo sapiens
atggtcccctgtgcagcctgcgtgcctcctggaggtggggccttggggtaggaggtccccacaacatgtggaaacgcagtaggcatgggagattgaagtcyccacttctgactcacctgctaatgggaaaagtgcagactcttgggctccataatggggtaggggttgagaaggtattttaaaagccaggcttagtgggga

SEQ ID NO: 53128 - DNA, 201 bp, Homo sapiens
ggttgagtatttggatttgaatgggatggttttaatgttgctactgactactacagtgatccaaataaactttaaagctggggcctccacgccataggcarattttcataccagttgcctttacctcagtagttttcagctggggcaattttgttccccaggagacatctggatacagtgttggttgtaacagctgggcag

SEQ ID NO: 53129 - DNA, 201 bp, Homo sapiens
aattatcttctcctaagcccactactgcctggtgtgttggttaaattagcctaaaggtcattccctcggagaggccctctgggaaacctccctttcctgakagtcactgcttgctggcgcctgcccctggggttccttcagagtcgtgatcatgccctggcctcttcctttatttggcagtcccttcccttccccatccct

SEQ ID NO: 53130 - DNA, 201 bp, Homo sapiens
tttctccaagagtccagttatacataggaattggtaaaccaggctgttggaaacgttgacttctttttctgtagtttttttctggggcatctagagagaakgccttatttttctttccacacataaccacaaaaaagttaaaagcactttttaaaagacactttcccctcaattacctgtggtaagaaatgctgttcttat

SEQ ID NO: 53131 - DNA, 201 bp, Homo sapiens
gatctcggttgagtatttggatttgaatgggatggttttaatgttgctactgactactacagtgatccaaataaactttaaagctggggcctccacgccayaggcagattttcataccagttgcctttacctcagtagttttcagctggggcaattttgttccccaggagacatctggatacagtgttggttgtaacagct

SEQ ID NO: 53132 - DNA, 201 bp, Homo sapiens
cacttgaacctgagaggcagaggttgcagttagctgagaccatgccattgcactccagcctgggcggcagagcgagactctgtctcaaaaaaaaaaaaaaagaaagtagcagctctactgagatatttagaaaccataaaatccacctatttgaggtgtacaattgagtgattttctgtatagtcacagatctgtgcagtc

SEQ ID NO: 53133 - DNA, 201 bp, Homo sapiens
acctgctagcccctttctccaagagtccagttatacataggaattggtaaaccaggctgttggaaacgttgacttctttttctgtagtttttttctggggyatctagagagaatgccttatttttctttccacacataaccacaaaaaagttaaaagcactttttaaaagacactttcccctcaattacctgtggtaagaa

SEQ ID NO: 53134 - DNA, 201 bp, Homo sapiens
ctgggctattatgattagcagattactaaagctgtgtgattttaacaagacgtaaacacatatgggaacccctccttccatatcttgctaatgtcaattarcaacatattaatcttgctaatgtcaatcctgtcacttcatacatttataaatattagggacatttaaaagagttgtcggactgtgcgggaccttggcaca

SEQ ID NO: 53135 - DNA, 201 bp, Homo sapiens
gtctctttccctcccttcctctccttttcccttttccttctccacctcagcacacagtgggagcttccttgttccttatttctcaagttgtcctgagcaawtcttcctcttaaggaatccttagtgcctgtccttgaggtgcccagcactggctgtgggcagcagcccttcaccctggccatggcctgccccgcccttcat

SEQ ID NO: 53136 - DNA, 201 bp, Homo sapiens
acatccggtgctgctgttgactctggtgtcggccgctggtgagctggctgtagctggtcacctctgggtggtttctggggcggtcgcaggctgactaacayaccaaaggtcagccagggtgttgaagctggcacctttcttcctggagcacagacgtcatcttggatcttttagatacttggacttactttatgcagaaca

SEQ ID NO: 53137 - DNA, 201 bp, Homo sapiens
cctggctaattttttgtatttttagtagagatggggttttaccatcttggccaggctggtcttgaactcctgacctcataatccacccgcctcggcctccraaagtgctgggatcacaggcgtgagccaccgcacccggccactgtcttgtatttctaacgtccccctgacttttctgatcatgtaattcttaactttctc

SEQ ID NO: 53138 - DNA, 201 bp, Homo sapiens
tttatttttattttttatttttgagatggagtctcactcttaccgcctaggctggagtgcagcgataaggtcttggctcactgcaacttctgcctcctggrtccaagcaattttcctgcctcagcctcctgagtagctgggactataggcgcccgccaccacgcctggctaatttttgtattcttggtagagacggggttt

SEQ ID NO: 53139 - DNA, 201 bp, Homo sapiens
aatcatcttcccttctctgggctatgggtggttctccccactggccctggtgtttttccacactcactttaaactgtctggagctggtctgctttctttcmtgtcagcgggtatgtatctttccaaccaaagagaaaacttctggaaggcagcaacagtcatttgccctgcctcctaacagtctccactttgtccgtgtct

SEQ ID NO: 53140 - DNA, 201 bp, Homo sapiens
tagctagttggccaggcgcatgactcatgccagtaatcccagcactttgggaggctgaggtgggtggatcgcttgagcccagaaattcgagaccagcctaracaacatggcaaaaccctgtctctacaaacaaaacaaaatctagctgggcatggtggtgcatgcctgtagtcccagctactggggaggctgaggtgggcg

SEQ ID NO: 53141 - DNA, 201 bp, Homo sapiens
cctaggattggggaatctgaatgagtgaaaagcatcccgggagatgcttgactaggggctgactgctgctggttctgatgcccaccactagccctttctcytcccatgtgatccttctcctggctgatggtggtcctgctcccgtggcacttgatcagtccttccaccccttagtaatcatcttcccttctctgggctatg

SEQ ID NO: 53142 - DNA, 201 bp, Homo sapiens
gtccacctcacttctcaagcaggtgtctttccagtctacaactcgttgaccacaggtggaattcataagctctgttccctgtcctgcttgggtcctccagrgaaagaaatgttgaattatcatcttggtgatggtcaactctgaaagcctaaattttcatgatcaccaaagtgtttggatttaaaagggtggctcactccg

SEQ ID NO: 53143 - DNA, 201 bp, Homo sapiens
aatattttttctcccccaaccttttccccagcatacatccccgtcccgtaagtttctgggcagagacaatctcaggaacctaaaggttgctaaaaaattakctagttggccaggcgcatgactcatgccagtaatcccagcactttgggaggctgaggtgggtggatcgcttgagcccagaaattcgagaccagcctagac

SEQ ID NO: 53144 - DNA, 201 bp, Homo sapiens
gctaggttctgtgctaagccttttcctgggttccttaagaactaggatttgattcatgatcagaacccatggctctttgcctctgtgcttgcctgtgtgcrtgtggtcctcatggcggaacacaagaaccacccacaacacccagcaagcaggcccaggatgcttgggtcctgagcccagacccactgtgaatgaattagg

SEQ ID NO: 53145 - DNA, 201 bp, Homo sapiens
aaaacactttataaagttacatgctgggtttcttctatgtcctagaaactgtcttaattcatcttcccctttactcttatatgagcaggaagaaaaaaaaattgctagtcaatgctaataattatggcatgtaatgtaattggaagtgtttcactgacatgctcatgagagtttgcggcttcatcttcaggctgggatgta

SEQ ID NO: 53146 - DNA, 201 bp, Homo sapiens
cttgaagttaatctgtgattggctttgtctttccctttgaatgcttgcagttgcaatttggtggttcttctgcagtttaggagaatgtgctctccattccrcagactgggcacttgggaggacataaagttctagaagacatagtccttgtccctaagggacttaggtatagtgggaccaagaagggtgcacacacacccc

SEQ ID NO: 53147 - DNA, 201 bp, Homo sapiens
cttcatttgggataggttcgatttatttctggctcgattttgaagatctgctctcctagaaacagctgtactctcttacccaattcccaaacattctctgygaactcgggcacttaacaagattgattatgttaacgctaatcatttaatacccaagtagtagagaaatatttggcaggagggtggaggttgcaaattcct

SEQ ID NO: 53148 - DNA, 201 bp, Homo sapiens
accactattcttgatgtcttaggagaagggagttcctttgaaaacgtaaattcccgactccagtgatacaggtattatgatctctgtattgtcacaacagsctgctgcatcggcattttctggaagcagcagagcctgaaaccttgtattcttagggaaacctcccctttgtggtttggggttgttggggacctggctgag

SEQ ID NO: 53149 - DNA, 201 bp, Homo sapiens
ggctcgtctccatgtgcttctaagcattgtgtctaagttctgtttggtttcctgagtgaaactgtcttaatgttaccaacagaagttaaatgcctaagagwttcttatacatgggctgagtacctctgtgactgggcaagccacctcacctcattttaccttgtctgcaaaatgaggaactgggtcaactcatcgttcaaa

SEQ ID NO: 53150 - DNA, 201 bp, Homo sapiens
gaaatgaataattaagaacattaaagaggaaagcagggggtggtgggaaagtgtggtcttgagggggtaataaacctcctacaggccacacacacacaagraaaaaaaaagggcaataagtgtagcccagtaacataaggtggggaataaggttaggggtaaggttaattctacaagttcaaagccagtagcccctgatgc

SEQ ID NO: 53151 - DNA, 201 bp, Homo sapiens
acagaggatttcaattgttttaattgtctttgaggaggagattcctgtggttgaaaaaagctgtttcccattccatgtctgggtatctctgatgttttgcrtatcagaaacatcaaatttagagcccagtagtgattagaaataagatgaagaatctagatatgatgataataagggaaggggttaatcttaaaatgttgg

SEQ ID NO: 53152 - DNA, 201 bp, Homo sapiens
tggaagtttccttatggaggggcgtgggagtaccctgggctgggctattaaaaagggatattgctttgctcagcaaagatgggctgcgatcccttcattasccagggtgttctacctagccacagatgtgtttcctatcagttactgtgtaagcatctgagggtgaggcattatctgtggtggagactggagtgtgagaga

SEQ ID NO: 53153 - DNA, 201 bp, Homo sapiens
acattacatagtacactagttaaactagttaacgtgagagtttttaaaaaagtgagatgaggtgaagagagttgactaaaagaatataataggtgaggggraaaaaaatccaggtttacactggggatgggagggctgcttatttgtgaaaaatgtactggtatctgcgggaggaggcacagaaaagtagccagaggagac

SEQ ID NO: 53154 - DNA, 201 bp, Homo sapiens
ttaaaatgtccatgacttatgatatgaaccaaataggaactatttgaattttccctgtcttcctgcctcactctctcccattcctgtcaaatgatgggacmcagcacaaaagaaaaataaaaattgtattgcacttcatcaacaggatgaggcctaatgaggcttgcacagcattgtcaaaaatgtatgtatatttcaacc

SEQ ID NO: 53155 - DNA, 201 bp, Homo sapiens
ccccaggaaaagtaagtcgggtttgtggaattcagctctagcctttgcatccctctgccgtttcccttccttctctctctctctctttctttctctctctstgttcctggggaaagctcacaaaactcaacagtcaaaaaagcgagttagcattctgactattggaatactagcgagcccaggaagcttcgtttcttctgc

SEQ ID NO: 53156 - DNA, 201 bp, Homo sapiens
cattttatggattagaaagctgagatccagagcgggcagatgtaaacctggggtctttaaaatgcatcctttttgcaaacaaataaacttagtgtattaaragggctggagagagcagagtaaggtaacatttgggtggtcagcatgtagttctgggtccccacagtggagatggcacagtgctgggtgctgggggaacta

SEQ ID NO: 53157 - DNA, 201 bp, Homo sapiens
ttttaattttactgatagggatttcatttagagtcattgctggaagttggtcagctttctgtttcttagcaagctgtgaaaaagttaccggaaggtttccrggggcttgcagatcaagaatgctgttctgtttgccgtgctggatcgctgcagttctgcacgccattgaaaaaaatatttgctttagaaaactagcatttt

SEQ ID NO: 53158 - DNA, 201 bp, Homo sapiens
atgtccatgacttatgatatgaaccaaataggaactatttgaattttccctgtcttcctgcctcactctctcccattcctgtcaaatgatgggacacagcmcaaaagaaaaataaaaattgtattgcacttcatcaacaggatgaggcctaatgaggcttgcacagcattgtcaaaaatgtatgtatatttcaaccacgtt

SEQ ID NO: 53159 - DNA, 201 bp, Homo sapiens
gttcccctctagccaaagactgagtggtccttgcaggctttctcctgagtcctttttttttttttttttttttttttaaagacagagactctgttgccagrttggagtgcagtgacgcggtctcggctcactgcaaccgctgcctcccaggttcaagcaatctacaaaatgcatctataaaatgatgcatcagcctcctga

SEQ ID NO: 53160 - DNA, 201 bp, Homo sapiens
cagcacaaaagaaaaataaaaattgtattgcacttcatcaacaggatgaggcctaatgaggcttgcacagcattgtcaaaaatgtatgtatatttcaaccmcgttaatattttatttagctgtcaatatacaacaaaagatttcacctttcattttagagctgattaggacttaggaaattgtcttcttagatgccactaa

SEQ ID NO: 53161 - DNA, 201 bp, Homo sapiens
caggaatgtcgtgtgtcttggcttgagatgtcaaagaaacatgttggacacaccatggtgacagagcaggagtctcttaaccccggcgtggttgaggctgycgttctggtgggatctggggtcagtcaggggttaacagtcgctcctgcttgcctgattgacacagtaataaaggcagtgacaccaaactaggtctcagga

SEQ ID NO: 53162 - DNA, 201 bp, Homo sapiens
tgacctactggaggggcctgggaatgcttctttgattgacgtgggtaggaagacagatgtggcggcctccatgctgatgggaggcagctgggaagaaggtmatgggcaccatctcaggagtggcagagccacctccccctctcctcaccccgtgtgtctggattcttccagctgtgtggtccttcttcctgcctggaaatg

SEQ ID NO: 53163 - DNA, 201 bp, Homo sapiens
aaatcaccaaatgaggcaattaccaactttggaataagaatagcaacggtggtaagagctgacatttcttgagcgcttgccatatgctgggtgtactactmtaagctgctgcctgcaattatgatttgggaacaactctgaaagtagttacctcccattttatagaagagtaaactgaggttcagagaggttaagtaaccc

SEQ ID NO: 53164 - DNA, 201 bp, Homo sapiens
gtgctctccattccgcagactgggcacttgggaggacataaagttctagaagacatagtccttgtccctaagggacttaggtatagtgggaccaagaaggrtgcacacacacccccagcaatgggcatcgtgtgatgtaggaagaaagggttctggggtctgaggccggagagacataggcatttgtaagaagaaaatccc

SEQ ID NO: 53165 - DNA, 201 bp, Homo sapiens
aaatccacactggtctttggactgaaccagaggctggcgatggtcccgaaacagggtgccaagtggctgacccttgtttttatgccttgcgctggtaagcytggggcaccaggagttctttgaatttctctttcttgactgtccacgccttctttaggcaatcttttaacaggctatgttttaaatcttattgacatctct

SEQ ID NO: 53166 - DNA, 201 bp, Homo sapiens
atttcctggcacctagcacgtgttgggtcaaacaggaatgatgaatgcatgcatgaatgaggttcttagcgctgaagacggtgtcataggtggtctaccasgccgcctgatcattccaatggcccattatgaatgtgtgtgctgcagggccctcccacgatcccgtcagcactgtgcatgttgtggggaggtgctgggaga

SEQ ID NO: 53167 - DNA, 201 bp, Homo sapiens
tcagaagatgggttagaggtgggtccttctctgctgctggctagcagggtagctgtggaggggtgccccatcttgctggtcttaaattttctcactgtagrcagggagcatgacctggctgaattctaagtccttttctactctgaggttcattgtgggtgtgacctgctgggctcagctctggctttgggagacaccctc

SEQ ID NO: 53168 - DNA, 201 bp, Homo sapiens
gggaaagctcacatttttgaggtcctcttgtggttctattttgtgtaggaactcacgctttgtttattcagcaatcattcctccagaaataaccttaatarcaacaagaaaaaagaataggtgttttttgagctctatctgccagtttctctatatatggacattatatattgcaacataacactcacaatgcctttaaac

SEQ ID NO: 53169 - DNA, 201 bp, Homo sapiens
tagagctacactcatggttttgactatgtttatctttccagtaaataaaacaaaattgttcatttggcacccagcctgtcctgcttgtcatttcttgtctygctgattaactctatggatggggcatgtttctccaaccagattgtaagtttcttgaagccaaggagccctgtggttgatttcttcacatgtggctctctc

SEQ ID NO: 53170 - DNA, 201 bp, Homo sapiens
gcctgggattctttttctaggggtgtaatacacccatgaaaaaataaataaataaataaataaaaataaaataaaaatgcctcaatgggggaaaaaaaacrcaccagagacaaatacttatttaggatctgtaatgtacccattgccatacctaggcatcctagatacagcaacatatccctgccctttaggaatgtacag

SEQ ID NO: 53171 - DNA, 201 bp, Homo sapiens
gggtctggcttggaaagtgtattgctatgtccagtttacacataaggatgtgcaaatccagcaggttagctgagctgcccaggaatatccaggcaagaatkaccatattctgataattactcaggcctctgcctcatctccgctgcccccccgccccctgactctcttctgagtgccagattcagcctccatttgaatgcc

SEQ ID NO: 53172 - DNA, 201 bp, Homo sapiens
ttttttttttttttttcccccaaatgcattcaaaataaacaaatctccttttactaccataacggtgtatgtgaatgtcctggcggatgctctcaagagcrtcaacaatgtgggaaagagaagcaaacaccaggttcttctcaggtggagctccagagtcgtccagtttctaagtgtgatgatgaagcatgggtgcattga

SEQ ID NO: 53173 - DNA, 201 bp, Homo sapiens; identical to SEQ ID NO: 11567

SEQ ID NO: 53174 - DNA, 201 bp, Homo sapiens
aggtgggggtgttatcaagacctgtttttgagccatacctctgactcttcctggaaagttagacccaactcaagaacacactaagagaagtgtttcccccyagccctttcagattgaaaggagacgccaaccttgatgggtggaggtagaaaataaagtcccaaaacagtgtcttgtaagcgaaggggaacatggctgggc

SEQ ID NO: 53175 - DNA, 201 bp, Homo sapiens
ttgttgtgataatgaaatgaaatgatactgtatcttttgctttttaaataagccacttctggggagcttccaggaagcagaagttttttttttttttttttcccccaaatgcattcaaaataaacaaatctccttttactaccataacggtgtatgtgaatgtcctggcggatgctctcaagagcgtcaacaatgtgggaa

SEQ ID NO: 53176 - DNA, 201 bp, Homo sapiens
catgcttatggtattgaccattaaacctatgctttttccccccccttaatttagatcatgggaaggaaaaaacaaaacaagaataaatggtcaactcaagmtatgccctttctttgagtccttttcacagcagttttttggggagggggagaaagggttaaaaaaagatggggaggagagaagtctcactttcatcacagt

SEQ ID NO: 53177 - DNA, 201 bp, Homo sapiens
ggatgcccctccatccatcccatcctcaccatctctccttccaaccttctcactacggggtgggggaggggaaagccccaaatcttaaaaaaaaaaaaaaaatcaagtttgaatcttaatttaatccacaacctgcaggccatacaaccagttattcttgttcctttgaatcattttctgtttttcttattcttccccctc

SEQ ID NO: 53178 - DNA, 201 bp, Homo sapiens
taataaaaaatgacatgctttttcttttggatttttaatgcttttgaattaaaaatgctagaacatgaactgattcttctatcgctatttagatagagccytgcaagagcagagcacgcatgctttctttaagaacaggttggtttgtggtcgtctgaggactgttttaaggagacttattatacacaatcatcccccaca

SEQ ID NO: 53179 - DNA, 201 bp, Homo sapiens
atgaggcatttttctctggggagaaccttgtctttgtgtatggcagtggggaagaattaattaagggagaggatgaagcttagtaattgaagttaggggcycaggagctctgaacactcctaggtctgctattaaattatctggctgcagatagctggttctctgggtcttggtttgctcatctgtgaaatgcccccacag

SEQ ID NO: 53180 - DNA, 201 bp, Homo sapiens
ccatgcttatggtattgaccattaaacctatgctttttccccccccttaatttagatcatgggaaggaaaaaacaaaacaagaataaatggtcaactcaakctatgccctttctttgagtccttttcacagcagttttttggggagggggagaaagggttaaaaaaagatggggaggagagaagtctcactttcatcacag

SEQ ID NO: 53181 - DNA, 201 bp, Homo sapiens
caccttctcccctcctcttctctctctctttttatttatttattttttcattgttgttttttggtttctggttgttgttttgtgtgtgtgtgttttattgktttattttattattttttttcttttggctcatagaagtcctttcctttcatgtccttggtgagggaagattatcaaatagaaccaaggtgatagagaaga

SEQ ID NO: 53182 - DNA, 201 bp, Homo sapiens; identical to SEQ ID NO: 11568

SEQ ID NO: 53183 - DNA, 201 bp, Homo sapiens
ctatttccccaggcagtgcattgtgagatgaggcatttttctctggggagaaccttgtctttgtgtatggcagtggggaagaattaattaagggagaggakgaagcttagtaattgaagttaggggcccaggagctctgaacactcctaggtctgctattaaattatctggctgcagatagctggttctctgggtcttggt

SEQ ID NO: 53184 - DNA, 201 bp, Homo sapiens
ccttagcgcgccccctcccagggaatgttacctgccaacccccatcccttccttgtgacagcccaggatcggaatcctggcctaggtagaagcaaatgacrtcaccttctcccctcctcttctctctctctttttatttatttattttttcattgttgttttttggtttctggttgttgttttgtgtgtgtgtgttttatt

SEQ ID NO: 53185 - DNA, 201 bp, Homo sapiens
ctacccatatcgtaggccctttctttcttctgttacatttaaaggggtagtagcgtggccacttccctggagatgcatcttcctcttcactaagtgtaggktttatccactttctcatgtcttctttttattaaaacacaatccctgtcctccagaagtctctagtctaaatgacaacttcttcagtagtcaacatctccg

SEQ ID NO: 53186 - DNA, 201 bp, Homo sapiens
cctcccacactcccctccttcatgtaaaagaggacgatttctggcctgtgatgtctgagtgtctcaactcaagttaagttaaaaccacacaaatgtacccrgccctggatcccataagagccccaggaaaagtaagtcgggtttgtggaattcagctctagcctttgcatccctctgccgtttcccttccttctctctctc

SEQ ID NO: 53187 - DNA, 201 bp, Homo sapiens
agtaaacctgggaggtggagcttgcagtgagccgagatcgcgccactgcactccagcctgggcgacagagcgagactctgtctcaaataaataaataaatwaattaattaattaaaaagtcatccttttcagttctcaaatggcagaggtctgcatcctgccttgcgaacctattaacactcctttctttctttatgtggg

SEQ ID NO: 53188 - DNA, 201 bp, Homo sapiens
ctttcaaagccttaaggaagataaaattttggagtggcttaccccacaattctacccgtatttctctagttagatagattctatgctgtttttttttttttaataaaaaacagattgcattatgtagtagctgtaccaaataccaaccctgggtatagtttctgtttctctgtctcttcttatttttattgggacggtaga

SEQ ID NO: 53189 - DNA, 201 bp, Homo sapiens
tcattacacatgggtgtgaacacacacactcacactcacgccttccttttatgtgctagggaacactgggactaagaaccgcagcactgaagcttttatgsatttgaatgtggtagcaacttaactagtatttttttttttttttttaactaacttgacgtgggagtttccatatattactttggtcattgtaaactccaa

SEQ ID NO: 53190 - DNA, 201 bp, Homo sapiens
gcctcctgggttcatgcgattctcctgcctcagccctcccgagtagctgggactacaggcacctgccaccacgcctggctaatttttttttttttttttttgtatttttagtagagatgaggtttcactgtgttagccaggatggtctcgatctcctgaccttgtgatccacctgtcttggcctcccaaagtgctgggatt

SEQ ID NO: 53191 - DNA, 201 bp, Homo sapiens
aagagggggtctgtctagcatgagttagcttatgttgctgcgtcctttttttttttttttttttttccatttttcggtcttttgagaaagctagaaaatarattcttagtcaaagttgcccatcctgtttgccgcactttataagttattgttgctgaatgattgggagctgtccatcagcggcagagaacttgcagttta

SEQ ID NO: 53192 - DNA, 201 bp, Homo sapiens
gtagttaatttgtttcttgagtttgatttggttgcatggtatcaaatcctgatcaaacagataagtggttgcttctttttttttctttttcttttttttttactggtttgccttgaaatcttagcatccacttcagttaaacagaaatggcattacctgttcccgggggttccaccaaaaccactggttggatggtagtgt

SEQ ID NO: 53193 - DNA, 201 bp, Homo sapiens
ccaagactgacatgtctttaacttgaggctgcaattgttctttttggcatgctgcccatttgtccctccttcttccttttgatggacagcatagtaagtcwtgctcccagaaagtgctttaggtgcgggacttggttagagaacaagcccaaaccctaactcctggtgcctgagtggatgtacaactcttggtgaacgggt

SEQ ID NO: 53194 - DNA, 201 bp, Homo sapiens
cgtttggtttgactgcagccaatacccagcctgtgtgggctcttcactcccttacaaagagagagagagtgcacagtggcagaatctcactgtaccaccgygggttagaacagaactgttttttgtgtgtgtacttggatacactgggatttgcaaccacttccctgccccctaaccgcatcattgaacatttagagcttt

SEQ ID NO: 53195 - DNA, 201 bp, Homo sapiens
gcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttcttttaa

SEQ ID NO: 53196 - DNA, 201 bp, Homo sapiens
ccatccattcctccaagacccatttccccttcctcccttcttgaacctctttatttaaaacaaaacaaaagtttgctgatgctgcagatgcggaccgtggratgtaaatgagcagttcctcccacctccttacttcattcctcctgcacatgattgtaatttcatgctgaaaggaaaggaagctttcgtttttgttttgtt

SEQ ID NO: 53197 - DNA, 201 bp, Homo sapiens
agcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttctttta

SEQ ID NO: 53198 - DNA, 201 bp, Homo sapiens
gtaaagaatcagcattttgctacttttcgtccatccattcctccaagacccatttccccttcctcccttcttgaacctctttatttaaaacaaaacaaaastttgctgatgctgcagatgcggaccgtggaatgtaaatgagcagttcctcccacctccttacttcattcctcctgcacatgattgtaatttcatgctgaa

SEQ ID NO: 53199 - DNA, 201 bp, Homo sapiens
aagcactttttaaaagacactttcccctcaattacctgtggtaagaaatgctgttcttatattacattccttcctcacccatttaaaaaaaaaaaaaaaaaaaggacaagaagagaaatagtaaagagaactaactgcttagtgatccctcagctcaacaggcactagtgggcagcactaggaccttccttcttttctttt

SEQ ID NO: 53200 - DNA, 201 bp, Homo sapiens
tttttttttaagttagtcatgaaaaatgttatacagtaaattgttctgaattcttttacatatgggtgtttttaatgatctatattggtttttgtatcccyccacctccaaaaaaaagaattcagcaagataattaagctctggatgttgccaagaattttgagagtactttcagttggcagaaaactttggagtgaagtg

SEQ ID NO: 53201 - DNA, 201 bp, Homo sapiens
catctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggcatctagagagaatgccttattttt

SEQ ID NO: 53202 - DNA, 201 bp, Homo sapiens
ttggcaagcagagggttaaatgctgcaggaggacatgggagagtttttgctttgagggtccactggagcaagagaagcttgagagtctgtctctgagatcycagaacagacatgaagatatggtaccgattcccttggtgctaaaaggaactccaggggaatttcaggaaacccctccttttctcgtctttattctcaccc

SEQ ID NO: 53203 - DNA, 201 bp, Homo sapiens
acagtgtcattgtttaaatgtggaatgtaggtgttctgtgttctgggaaataaaaaccaaaactggtccaggggatccacagaggtaagaaaagaacattmcaataggaatgtttcagaaccaggaggggaggagagaaaaacggctctgttggtctcctagaggaagaacttgttagatttggggagagtcaggataaat

SEQ ID NO: 53204 - DNA, 201 bp, Homo sapiens
cttttttgggccctggcaaaatggcaagggcatgctagaccggtcattttttttatggctagggaagagaaataattattccccccctgcccggcgcccaracatgcttgggaagctgggagagcggttcggctcaacccccttctccagggccagttccaccaggctgcaggggccgcgctctgggcttgcagctgtagg

SEQ ID NO: 53205 - DNA, 201 bp, Homo sapiens
gataacgcggccactttcctatacatttccttaatttaagggaacagcgtaaactcagcccaggtggattaatctctccagtgacttttgaaacttcaatytccaatttccctcttatgtctaggtgtgagtgaggatacgtgtagtaattgtcgcaggtattagtgagaaagggtgcagatcacacaaatatttcacacg

SEQ ID NO: 53206 - DNA, 201 bp, Homo sapiens
gtttgagaaagtgcttagccttcctttccctcctttagtgacttgtggtttggggcatctgttgactcctagggctcccttgttcatctttctgttcctargctcagggattagttgctcaacccaggtgtggcctcaaaattctgctcatggaatagcctcaggcttctataaatctcatcttttttgttttgttttgtt

SEQ ID NO: 53207 - DNA, 201 bp, Homo sapiens
gacaagtttccattaagatctgaatcaggcgattggaaaagaagagaataaaaccaactgaaaagagagggacaagttgttagtgttgcctactctgctttgaaggagaaccctcctcagacaagagctactttctggccaagaattccaggctcgcagagaaacctgtcccaggcacagaagttgttttaacatgatgca

SEQ ID NO: 53208 - DNA, 201 bp, Homo sapiens
ccctttctgtccctcactattttttctatagtaggatatgttgcttgaagaggggtgagtcttccaacccagtacaaatcatggtgacaccacgcaaaatwgaaaatgagaaaggtgtttgatccagttgtcagtctgcagatgggccaagagtaggttgagattagctctttctgtcctggctaatgtacttggttggga

SEQ ID NO: 53209 - DNA, 201 bp, Homo sapiens
cggatgaggaaatgatgtggagtggtcttggagcactcctggtgactggtgcaggacagtcccaagagatgaggcagatgggaacctgtttttttttttttgagatggagtttcgctcttgttttccaggccggagtgcagtggtgcgatcttggctcactgtagcctctgccttcccggctcaagcaattctcctgcctc

SEQ ID NO: 53210 - DNA, 201 bp, Homo sapiens
ggcttccaagaacacatgttcttaacttctgtttcctctgaggccttcgagcagtgggaaggaacagggtgtcacttggagcccaagtgtctcccaagggsttttgctttttttgtttttcacattattttgagaggaaggggatgaagatgaaggttgttagcatgtttgtttccttacattttccttctctctctcttt

SEQ ID NO: 53211 - DNA, 201 bp, Homo sapiens
gaaattagatttcaagtggctcatggtagcagctacagggtagagaggaaagtggaccaaaaaaactaacacctcctaggaaatgatctgtttttttttttaatatagataagagaaagccaggtgattcataaaactgaaaataaagtaaatgttccacctcttcccaatttagcaggacgaataggcatcaaaaattaa

SEQ ID NO: 53212 - DNA, 201 bp, Homo sapiens
gtgaacggtgggaatggggcatttggaaccgtcactgcagcatgtggggccttcgtaagcatcaatcctagctcctggcagtgcccagattatttgactawcttttgcaacttaaaaaaactgtgttttaaattcagagtagaaaggcctttgatgcattagcatactgtggcaggttgtgtgtatgtatatttttgcatg

SEQ ID NO: 53213 - DNA, 201 bp, Homo sapiens
attatgttttgacgttgaaagaaaatcatctagtttttctcaaaaatcaacccagaaatgcccatcaccataaagaagttcaagctcaactttttttttttgcgagactttgcagcacaaagtggagaaacgatgaacatagcatttccccgcagacctacagataaaactttcttgaagcgactttttcccctttttttc

SEQ ID NO: 53214 - DNA, 201 bp, Homo sapiens
aaaatcctctatggggaatagggttttttgcaattggattactctcagtaaatggcccagtagttcgcttgtttcagcttaattttttctttgtgatcttsctgggctaagttatagcacagagtagtggagtggggaggggtggactgagcgggaggtgggggaaagaggaggagaataatttgggaaagcctgggcatg

SEQ ID NO: 53215 - DNA, 201 bp, Homo sapiens
ccatctgctttggtggcttttagcttacttgctttgatgcaaaattggtagcacataacacaaagctcctgtaagcaacctgctagcccctttctccaagagtccagttatacataggaattggtaaaccaggctgttggaaacgttgacttctttttctgtagtttttttctggggcatctagagagaatgccttatttt

SEQ ID NO: 53216 - DNA, 201 bp, Homo sapiens
aggatcccatgtggcagcaggggtgttttcttacctgcatgcaaatcggagttgtgtgtttgcttttgaagagggtgaaatggcttaacacttggggtggsaaaagaccggaaaagcgttctggatgagttttgtcccctgcaactttttctgtctgtaatccctccatgagcagccaccctcccacactcccctccttca

SEQ ID NO: 53217 - DNA, 201 bp, Homo sapiens
ctttcccagaggactggtatttgggaatctttttataaagtgttgctttctgggctttcattaaaagctcaaacatagaaatgtatgaaaatgatcctttkaaaacaagtttggcaccaacactatgtgagaaaacttgaaaagtatataggttgtggatcaccagttctcgaactcaggaccaccctgactgagttgacc

SEQ ID NO: 53218 - DNA, 201 bp, Homo sapiens
agatttgatacagctgcgggaggaatggaggaatgcataggcaagatagcgggcttcccatactcttctgaaatccttagtgttttatagggtgtgtttttaatggcaaggtgtaaagacaaatttcgctgtatgctttattattttccctttgctccttggtggcggtgatttttgctacattttctgttacttatggtg

SEQ ID NO: 53219 - DNA, 201 bp, Homo sapiens
acatttgcaatggggaaaacacgttgccatattgattgaagaaaatacgtccattagtttcttcctgtaatacacggattcggaacaacagtaacacaatyattacataacacactgtaaatcaaaggaatatatgaagcttctattagtcgagcacattttactctgaacttagtgacattcttctgtccaaaatcagca

SEQ ID NO: 53220 - DNA, 201 bp, Homo sapiens
aagaaattcaagaaatttccctttactttttaaggaagagggggtctgtctagcatgagttagcttatgttgctgcgtcctttttttttttttttttttttccatttttcggtcttttgagaaagctagaaaataaattcttagtcaaagttgcccatcctgtttgccgcactttataagttattgttgctgaatgattgg

SEQ ID NO: 53221 - DNA, 201 bp, Homo sapiens
cttgcctgagatctcaacactttgggaggccgagataggaggattgcctgagcccaggagttcaagaccagcctgagcaacatagcaagattctgcctccmcaaaaaaataaaataaaaataaaaagattagctgagtgtggtggcgtgcacctgtagtcctaactgtttgggaggctgagacaggaggattgcttgagcc

SEQ ID NO: 53222 - DNA, 201 bp, Homo sapiens
tcgcctggcaccgtaggacaaatcccccatccgctaggatggttagtaccacagtaaggagttccattttttaatttcctttttgtttcttacatgggcaygtttattatttattctgtgtgtgtgtctgtgtgtgtgtgtgtgtgtgtgtgtgtgtgtgtatgtgtgtgtgttagaagccagggttggggagggggctgc

SEQ ID NO: 53223 - DNA, 201 bp, Homo sapiens
gagtgggccgccgatcgccggccacccaactttgggggccccagggcagcgcggggtgccgggctcggggggcgcttcctgcagggtcggtcccgcgcccwaccctgacatttgttaatacggctcatcccctcccccaccggcctgtgccccctgccctcaccctgaaccccctcctcctcatccctccctgccctgccc

SEQ ID NO: 53224 - DNA, 201 bp, Homo sapiens
tttacaacaaactaacagcaccagtgtcacaggaggataccgatagcggagtagattgtggtggattagattatggcctacaaaccctgagtttcagaacwgtttctcaaccagacaaagcctcaggaagtatgaggccaagagcagttacacatgcattaaattggctaaatgcttggctcagaaaaataatgtctgatg

SEQ ID NO: 53225 - DNA, 201 bp, Homo sapiens
tagtcattttttcctactatgcttagaagacgcgcagcggtggtttaatatgtgttaggaccatttgctttaaaggaacacatccacaagtttcggtaggtttttttttttttttaagttagtcatgaaaaatgttatacagtaaattgttctgaattcttttacatatgggtgtttttaatgatctatattggtttttgt

SEQ ID NO: 53226 - DNA, 201 bp, Homo sapiens
ctgtagcagctattgtgatagggtttgaaattcaaattaacgcatatttcttgagcacccaaggtgtgtgctgctggatctttcaaggggtccagaattgrtagtatagttgcttttctcaaaagactgtcgcctggcagaggaaaaggtgttaaggtatgagtgaagacagatcagccagacatggtgccgcttgcctga

SEQ ID NO: 53227 - DNA, 201 bp, Homo sapiens
acttcccagattggtcccaccgcaaacttgggggctctgaggcgtccttttctttggcaacccgcagggccgcgagcgccctgggcgccgtggcgggctcsgctgcccggcgcactggctgcgggctctcccgggccgcgcagggcagcagggctgagtggggcggggaggcccctgcggcccggattcttggtttgtgtg

SEQ ID NO: 53228 - DNA, 201 bp, Homo sapiens
gttccctgccaccccctccaccccacccccacccccatggtatagttttgactgaacaggaaaaaactagttggctaggctcaggtgtgcaaaataatacygggagaggtgttagtagccagaacacagggctccaccttttgttggaatcgccttcatatgtatatctaagaagatggagacttaatttttaaatctcac

SEQ ID NO: 53229 - DNA, 201 bp, Homo sapiens
tttggaaaggctctttttttgggcaaaaggggagggtgtaaagatacagagttcaaagatgcaaatcacgagaaagtagaaaccttaaaaaaaatttttttatgagaactttgccatctgtatatacagcacaggcttcccagcatcgaaggtcagattcacacccttttcgaacaaaactctaatttagaatgttcatct

SEQ ID NO: 53230 - DNA, 201 bp, Homo sapiens
ggggggaatccgaagaactttcctttgcgttctggttccccctccccctttggtggtggtgtttgtttcttcaccctgggaagatgactctgtggctcttyctttgctctctctccctctctctccttctcttccttccctcttctgtggcgtcttgggctttccccggttaaccccttggctgccgctgcgggccacgag

SEQ ID NO: 53231 - DNA, 201 bp, Homo sapiens
caattgtaatgaacgcattcagaactggagaatagatttacccttggcttcaaatagtcgacgttatcaggcgctgtcattcgttccttcctattttcggsctgctaattgatgtttttgatgtcagcaagaaaattgaagaaaatgtcatgtgtgaaccagtgcggaagttaataagattgacttcgttgacagaattta

SEQ ID NO: 53232 - DNA, 201 bp, Homo sapiens
gaggggatttggaaaggctctttttttgggcaaaaggggagggtgtaaagatacagagttcaaagatgcaaatcacgagaaagtagaaaccttaaaaaaawtttttttatgagaactttgccatctgtatatacagcacaggcttcccagcatcgaaggtcagattcacacccttttcgaacaaaactctaatttagaatg

SEQ ID NO: 53233 - DNA, 201 bp, Homo sapiens
ttataacttgcaagcaaaaaataataaagttcttggccacatgtctccacccccaaaagaaacattttagccatggtgtcccttaaggtgtttttttttttaaaaaaacttatcgaaggtttcaatataatagactaattttccagttatgtggcaaagtttattggatttgtgtgtataattatggattggattagttga

SEQ ID NO: 53234 - DNA, 201 bp, Homo sapiens
tcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgtggca

SEQ ID NO: 53235 - DNA, 201 bp, Homo sapiens
ttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgtggc

SEQ ID NO: 53236 - DNA, 201 bp, Homo sapiens
gttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgtgg

SEQ ID NO: 53237 - DNA, 201 bp, Homo sapiens
aagtaggaaataggtaccgtccagtaaatcttaattaagttattgaaaattgaagagcactgaataataaagcagttctaattgcagttaaaactgtattsgcagcagatatgcttgaacagggatgataaaacagctgaggaagagcgttggatggcagaatcgaaaaagggtaatacacagattaaatgcaaaactcaa

SEQ ID NO: 53238 - DNA, 201 bp, Homo sapiens
cttggcctggaagtgtcatgggtcacttactcccatcacccattggccagagctagtcatgtgacccaacctaactgcaggagatgctgggaaatgtgcakttactgtgcacaagttattacagggattcagagttaagtcggatatctttactccctcagaacttagcatccgccaggaaatcgcaaacatctgccggcc

SEQ ID NO: 53239 - DNA, 201 bp, Homo sapiens
agatgctgggaaatgtgcagttactgtgcacaagttattacagggattcagagttaagtcggatatctttactccctcagaacttagcatccgccaggaawtcgcaaacatctgccggcctatgtgatcctgaggaagagctgcttctgcctgctctgatgagtaatttcaggcctccttcctctttcttctcatactttt

SEQ ID NO: 53240 - DNA, 201 bp, Homo sapiens
tgttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgtg

SEQ ID NO: 53241 - DNA, 201 bp, Homo sapiens
ttgttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaagttgt

SEQ ID NO: 53242 - DNA, 201 bp, Homo sapiens
ttttcctccagcgtggagttttgtcatttctaatgatgacaatctatcagtccacatggttcaaaatgaagataaattgaattaatatatgtgagttaacygactcattgatataattatactgtgaggatttctttagtgtaacctaacacatttagtagtgttaattgtaatggctttgcacgggagcacttaatttcc

SEQ ID NO: 53243 - DNA, 201 bp, Homo sapiens
gtgtttgttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaag

SEQ ID NO: 53244 - DNA, 201 bp, Homo sapiens
tagttcctttttaatcagaaatgcttatcagtaggttgcatggttggggaaaatggcatttattttgtagcattttcccaaggaatattggatgaatattyctttagtactaaatatataatggtctttgtcttaagaacttattagcactgagatttctgtgttggaattttctttattgataccggtttgtaggttctg

SEQ ID NO: 53245 - DNA, 201 bp, Homo sapiens; identical to SEQ ID NO: 11566

SEQ ID NO: 53246 - DNA, 201 bp, Homo sapiens
tgtgtttgttcacctacacatttgcctggagtatagtgagaacccaggaaaatggataggccctaccaggagaggctgcaatctgttggggaagtttttttgttttttttgttttttttattttattttattcccaagccttggttgctatttgatagtaagtgtggtccaggctgcatattttataaactttctattaaa

SEQ ID NO: 53247 - DNA, 201 bp, Homo sapiens
cttttaagaatcaaatgcaaagccagtcacttagccttgaatttcccactgtgattccacttttcaaaacccaggatgaccatcatgatgggtttcgttgkactatcagttgttacaggtcaaatcatagtctcatgattgttaaaatcttaataaggccccctctaatcctgtgagttttcagaaggaaatccctgtgaa

SEQ ID NO: 53248 - DNA, 201 bp, Homo sapiens
gagctgtgatcacgccactgcactccagcctgggcaactgagtgacaccttttctttaaataaaataaaataaataaataaataaaattattaaccagctratctcaaatcaattcttctaaatcctctgagcttgtttgtttttctgtctgtaaaatggggctgttttcatgtgagacttagattatgagaaatagtcac

SEQ ID NO: 53249 - DNA, 201 bp, Homo sapiens
aatgacagactttgttgccttttctttttcattttttaaagttttcaaccaactggtcatctggggggtgtgtgtgtgtgtgtgtgtgtgtgtgtgtgtgtttgttcacctacacatttgcctggagtatagtgagaacccaggaaaatggataggccctaccaggagaggctgcaatctgttggggaagtttttttgttt

SEQ ID NO: 53250 - DNA, 201 bp, Homo sapiens
gactgctgtaagatcaagcaatcgtgtgtagccagacagtgggagaatcaagactagaatccagatctcttggttttcctctttcccctcggccacctccrattcaagggagagtttaattttgtgaaccattcctgttaagtgccattaatttcaaggtctttctggattagtgtgtgaaattcagtgtgttcagtatga

SEQ ID NO: 53251 - DNA, 201 bp, Homo sapiens
gaatgacagactttgttgccttttctttttcattttttaaagttttcaaccaactggtcatctggggggtgtgtgtgtgtgtgtgtgtgtgtgtgtgtgtktttgttcacctacacatttgcctggagtatagtgagaacccaggaaaatggataggccctaccaggagaggctgcaatctgttggggaagtttttttgtt

SEQ ID NO: 53252 - DNA, 201 bp, Homo sapiens
tcccaccacacttccaattcttgctcattcaacatcaagtctttgctctgcctttcttcgaatcacgaagatcctgtctgccagaagcatcctgtccaggytccaggcagacgacagtctctgagcattccagggtcttacagtttagaaagaggagagagcaagagaatcttaaaagcaccataagctggagctgtttag

SEQ ID NO: 53253 - DNA, 201 bp, Homo sapiens
tcacctgagtccaggaggtggaggctgtaatgagctgtgatcacgccactgcactccagcctgggcaactgagtgacaccttttctttaaataaaataaaataaataaataaataaaattattaaccagctaatctcaaatcaattcttctaaatcctctgagcttgtttgtttttctgtctgtaaaatggggctgttttc

SEQ ID NO: 53254 - DNA, 201 bp, Homo sapiens
ttgctctgaggcctgctcctctctgggaagaaatcaccttgagagcttctgggatttggaactccctgcatggttggatcccttccatcttcatgtgaatygtcttggtaatgaggctgcccaggaaagccataacacagggacatttggtgggcaggtccactttcgaagttctgggagttaccgtggctattgttctga

SEQ ID NO: 53255 - DNA, 201 bp, Homo sapiens
gaggatcacctgagtccaggaggtggaggctgtaatgagctgtgatcacgccactgcactccagcctgggcaactgagtgacaccttttctttaaataaaataaaataaataaataaataaaattattaaccagctaatctcaaatcaattcttctaaatcctctgagcttgtttgtttttctgtctgtaaaatggggctg

SEQ ID NO: 53256 - DNA, 201 bp, Homo sapiens
aggaggcggaggttgcagtgagccaagattgcaccactgcactccagcctgggtgacagagcgtgactccatcaaaaaaaaaaaaaaaaaaaaaaaaaaaagtgagaaagaatgtggttttggtactcagtgtctaggacgtctgtttaatgggatggttaggagcgtgtgctctgtactctgagctcaaaccttggcttt

SEQ ID NO: 53257 - DNA, 201 bp, Homo sapiens
atagtgtcatataccatactctacaattctaggacaaaggacacagtgtcctaatggtcttgcagatggcctaaaatacatatggtaagccacttatttamtttgatctcaaatatctcagcattactgagctctacacctggatgtttacaaagcctgaagatctgtacccactgctgtaacatcaggtgacactcaagg

SEQ ID NO: 53258 - DNA, 201 bp, Homo sapiens
ccacagaagagaaaaaccaatattatttaaagtttatgtataaataagctagtcgctaacatgtactcagcacttactgtataccaggctctgccttaagyggttttcatatattaactcatttaatctgctcaatttgtgggaaccattttttctcattttatagagaggaaactggtgcagactttttttttcttttta

SEQ ID NO: 53259 - DNA, 201 bp, Homo sapiens; identical to SEQ ID NO: 11565

SEQ ID NO: 53260 - DNA, 201 bp, Homo sapiens
ttaatttattcataagattgtgactatatgaatttttttcaacaacatatccttagttatcaggtgtccactcaattttaattgacaatataagattcctrtggtaaccctgtgtacagattgcctaggggctctgcagggattgtgggaagagaagcttggacaagtttccattaagatctgaatcaggcgattggaaaa

SEQ ID NO: 53261 - DNA, 201 bp, Homo sapiens
gtaaggcatcgggtggcccctgaattctgtctgacacatttgttttcccagaaatagaattgcattggagagttggggcccagttattagaaatatggggrtggggtgcttgtacttgttgcagtcttgtggcttctcataatcttttctctcctaatccttcctcttgcctacatgttgcaattctgatgactttttgca

SEQ ID NO: 53262 - DNA, 201 bp, Homo sapiens
aagttgcagagcgctatgcttaagggttcttgaaaggtcaaaggtcagccacaggggcgcctccccctccccattcccccccactgtagtcgatgaatacsatgaatactttgggtggaagggctttgtgtgccttgagggctgttaaaggaccttttctttatgatttaactattcaatgctcaaaacccatggagccta

SEQ ID NO: 53263 - DNA, 201 bp, Homo sapiens
ggctgaggatagacttagaccttggggagggtctgagccaatcagtgacttacattcactcagttgccatctaataggtggtcctcccttagaaaattggyggctttctggcagtgtttggccctctctttggggaagtgtggattactagagtgcaggcgacagagatggcctgggatggacagcttagtcatcatgaaa

SEQ ID NO: 53264 - DNA, 201 bp, Homo sapiens
gaactgtggtaacatttgtatattaaagataagaatactgtaacctattaaagttgattggaaaaagtagttttacatttctttttccctcctggcaaagkggaaataggaatatggtggttgaaattccagttaggtttgaaatttctttttaaggacttgattattcgagcccttgcatcttctcttatccaaagttat

SEQ ID NO: 53265 - DNA, 201 bp, Homo sapiens
ctgggaggtggaggttgcagtgagccaagataatgccactacactccagcctgggtgacagagtgagactctgtctcaaaaaaaaaaaaaaaaaaaaaaaagaagaagaagaagaaacacatgtcgtacctgaagggaaggtaggtcctttccctgcccttcttccccatttccttggtaggggcagcagtgtctggcaca

SEQ ID NO: 53266 - DNA, 201 bp, Homo sapiens
cagataaataagctgcatcttgaattcatttttgaacttggaatccagcatttaaaggaaaccgagaggggcctattcattgggattttatttagccgggyaacttctctttctggcttgtgaaaaatggacgttttttcctcactgaaacaacataatcctttctaatacaaaagatttagaccttggagtgtgaagggt

SEQ ID NO: 53267 - DNA, 201 bp, Homo sapiens
taacctggaaaaaaaatatctttacctaccgcgtggaactgataacaaatgccgactacttcataggctcgttgtgaggatttcctagaataaagcatgtsatgcactcagcacagaggcacacagacacagagcccaaggcaccattaaacggcggccaccctgagctgtgctggtgtggatggtagtgcttcaggggta

SEQ ID NO: 53268 - DNA, 201 bp, Homo sapiens
cacgccattgaaaaaaatatttgctttagaaaactagcattttaatagttgcaccagaggctgtgcttttaaagattacagtagaagtctttccaggtttygaatgcctccttacatcccacgaggtgcccctggctgtgtgcaaaaagtgcctagatttctcggtggagaaatcctggtgcaacttctcttacacacgtg

SEQ ID NO: 53269 - DNA, 201 bp, Homo sapiens
gggaataccatatactatggtaaccatgtacactgctctaaagatgtggctgctgttgtataactttttcctttatttttgtcaatttcctattttccagrgtcttgcatacccactatgtctactgtgatagtgaacgtaaaaacatacaagatgttggtgttatcctcaatctcttattcttaatcctgaacaaattac

SEQ ID NO: 53270 - DNA, 201 bp, Homo sapiens
aaatgcagagtgggaggctctgcttgccagacggagaccttagacctccaggggtggagaacggagtacttcctctggtgctcggcttcccttcctgggggcagatctctcagcttctggttggtggctctcaaaatccagacacaaggtcagctgcagccagcgtgggccctggagtagctccagttatggggcagcaat

SEQ ID NO: 53271 - DNA, 201 bp, Homo sapiens
gcagaaaactcagcagatgtttatttcctggtctttaggatttgttgaagagttttttatttgtttgttttttaagaaagactcaaaaggaaaaaaaaaaagaaactatagttattttctcatgatataaaaagattctgtagttgtatatacatttgaactttttgtaagacatctcctacccccctaaaattggaagtc

SEQ ID NO: 53272 - DNA, 201 bp, Homo sapiens
ctgcagccttgatcttccaggcttaaccaaacctttcaccttggccttctgagtagctacaggcctgcaccaccacatctggctattttttttttttttttaatttttagtagagacgaggtcttgctatgttgcccagtctagtcttgaactcttgagctcaagcagtcctccagccttggcctctgacagtgctgggat

SEQ ID NO: 53273 - DNA, 201 bp, Homo sapiens
ctgctggaaccggcttgacggtgtctttctctgttctcctccccacagtctaacaaagtgccagtggtgcagcaccctcaccatgtccaccccctcacgcmtcttatcacgtacagcaatgaacacttcacgccgggaaacccacctccacacttaccagccgacgtagaccccaaaacaggtaggctgtgggctacggag

SEQ ID NO: 53274 - DNA, 201 bp, Homo sapiens
gtttgcacacttattcagttattgcatcatgaagaccctctggagtttgatgttgtcaggaaacatattagcagaaaatagtgtgttattatctaatgctrataattggttagtggaaatgagaaaagaggatatgtaattggggttcctgtggctaacaagatgtgaattatgaaagcatttccaggagaaattccaggg

SEQ ID NO: 53275 - DNA, 201 bp, Homo sapiens
gattcacctgcctcggcctcctgtgtagcaggcccatgccaccacgcctggcttgcttatttatttatttatttatttatttatttatttatttatttatwgtatttttagtagagatggggtttcaccatgttggctaggctggtgtagaactcctgacctcaagtgatctgccctccttggcctcccaaagtgctggga

SEQ ID NO: 53276 - DNA, 201 bp, Homo sapiens
aggacaaatttctttcctcttgccagttgtagaagaacccatgaggaggccgggcacggtggctcacgcctataatcccagcactttgggaagccaaggcrggtgaatcacctgaggtcaggagttcgagaccagcctggccaacatggtaaaaccccatctctactgaaaatacaaaaattagccagacatggtggcagg

SEQ ID NO: 53277 - DNA, 201 bp, Homo sapiens
atctcaaaaaaaaaaaaaaaaaaaaaagacaggatcttgctctgtcacccaggctgggatatactggcttgatcatagctcactgcaacctttagctcctrgactcaagcaatcctccagcatcagcctcctgagcagctgggactataggtgtgaattaccatgcctggctaacttttttattttttgtagagacagggt

SEQ ID NO: 53278 - DNA, 201 bp, Homo sapiens
aggaagtgagcttggaaatctctccagcgcaatggttgctggctgggaagaaagatctgacttagacacagaataagctgcttgtgctgggtgtgtttgtragctgggtgaggttttctgtgtcgctgggcacgtgagggaagttacgtggctggggggtggggtggggggcattagaagggagtatgggtgtctgtgggc

SEQ ID NO: 53279 - DNA, 201 bp, Homo sapiens
acccaggaggcgaaggttgtagtgagccgaaatcacgccactgcactccagcgtaggcaacagagcaagactccatctcaaaaaaaaaaaaaaaaaaaaaagacaggatcttgctctgtcacccaggctgggatatactggcttgatcatagctcactgcaacctttagctcctggactcaagcaatcctccagcatcagc

SEQ ID NO: 53280 - DNA, 201 bp, Homo sapiens
cattttcatttatctcctacccctgattatataaagaagcagatgagacaaccaaagaaatacccctccaagacaaagtgaatattttgaaatacttcctytcagtcttttaaaaaatgtgatttaaaaatcgtaggtgggatcatactatacatgcacttgttttctgtttattttacatctctctatactagaaacact

SEQ ID NO: 53281 - DNA, 201 bp, Homo sapiens
ggaactttatctcttgtaagaggtacttagattcctattacaatggctcattacacatgggtgtgaacacacacactcacactcacgccttccttttatgygctagggaacactgggactaagaaccgcagcactgaagcttttatgcatttgaatgtggtagcaacttaactagtatttttttttttttttttaactaac

SEQ ID NO: 53282 - DNA, 201 bp, Homo sapiens
tcagcagtgatcagtggtgtggccttctagggaagaccagtgggtaggtgtggaggaacagaatttaattcctcccaggcctttcagcaggccctttaccrttaagaaggaaaaacaaaactattcctttgtgccatggtgcagtagaagttagaagcctatttcatcctgagaggagcatgatgggaatatccctgaaag

SEQ ID NO: 53283 - DNA, 201 bp, Homo sapiens
tcccagtgttccagctcaggaccaatgaggttgatttggtgcttgtctcctttctagaggaggcaaggctcttaggatacacccaaaggaccttatgttcyggattaggttccgcaggctcctcagcagtgatcagtggtgtggccttctagggaagaccagtgggtaggtgtggaggaacagaatttaattcctcccagg

SEQ ID NO: 53284 - DNA, 201 bp, Homo sapiens
atggatagttgctgctaatttagttgccatgaatacatttctggaaggttgtctatgttgcaaccaagttacttttcatatctaaattttcttagggtggwgcagttttgaacacaattcttaaagacctcgttagagaagtgggaggtgttcaaagagaaggagaaccatccaaggggcatctttctgtttggattcttt

SEQ ID NO: 53285 - DNA, 201 bp, Homo sapiens
tcatatgcaactgtaccccggctggtccgcgcgggataactatgtaggtggatcattttcgttaggattggagtctgtagagctgtgttgtgcgtctatayggacaaagagaacaggacctgccacttgactagggtgggcctcaggaccatccaatctgcccgctttggggactggtagcatcttcctggatcgctaaac

SEQ ID NO: 53286 - DNA, 201 bp, Homo sapiens
agggaagttacgtggctggggggtggggtggggggcattagaagggagtatgggtgtctgtgggcgctcgcgtgtgcgtgtatgtgtgtgtgtgtgtgtgwgagagagagagagaaggtaaaattaactttgtcctatatgttggtttctctgctagagtcttaaggaacttgcagctgcatttttattgtttcaattaca

SEQ ID NO: 53287 - DNA, 201 bp, Homo sapiens
ggttgctggctgggaagaaagatctgacttagacacagaataagctgcttgtgctgggtgtgtttgtgagctgggtgaggttttctgtgtcgctgggcacstgagggaagttacgtggctggggggtggggtggggggcattagaagggagtatgggtgtctgtgggcgctcgcgtgtgcgtgtatgtgtgtgtgtgtgtg

SEQ ID NO: 53288 - DNA, 201 bp, Homo sapiens
taccgcgtggaactgataacaaatgccgactacttcataggctcgttgtgaggatttcctagaataaagcatgtgatgcactcagcacagaggcacacagmcacagagcccaaggcaccattaaacggcggccaccctgagctgtgctggtgtggatggtagtgcttcaggggtagcagctggtcagtccccatcctacct

SEQ ID NO: 53289 - DNA, 201 bp, Homo sapiens
tttcatgtcagcgggtatgtatctttccaaccaaagagaaaacttctggaaggcagcaacagtcatttgccctgcctcctaacagtctccactttgtccgkgtctgtctctttccctcccttcctctccttttcccttttccttctccacctcagcacacagtgggagcttccttgttccttatttctcaagttgtcctga

SEQ ID NO: 53290 - DNA, 201 bp, Homo sapiens
tttatgttttacagggaaggaaaaagcagtgaaagtatgcattttcgaaagaaaagtgtgttgggaaaagagagagagggtggaaacccaaaggagaaatraaaattttaagtccttgttgcagtagctggaggaagtgagcttggaaatctctccagcgcaatggttgctggctgggaagaaagatctgacttagacaca

SEQ ID NO: 53291 - DNA, 201 bp, Homo sapiens
tctcacctcatattccaaagcacacaaatggcctaccatcttttattcttccttctagcttctggagagagaaatgattgttccagtttagaatgccaggrgtttactgggtgtttgtattttttatctgtgccttaaaaaaattagattataatgaacaagacatctttatgttttacagggaaggaaaaagcagtgaaa

SEQ ID NO: 53292 - DNA, 201 bp, Homo sapiens
ctatatgctagaaatatgttttgtacaagagcaggaaacttgattcactttattttttcccccagacagtttaagagctttaattatgttttgacgttgaragaaaatcatctagtttttctcaaaaatcaacccagaaatgcccatcaccataaagaagttcaagctcaactttttttttttgcgagactttgcagcaca

SEQ ID NO: 53293 - DNA, 201 bp, Homo sapiens
ttgtcagatgtttcacaacaggcccccctgaatcacattaaaaatgcactgtagagaaaggacagctgcaaatttttgtgtggacgcgtgtttctggaccrtgactaaaactccgaggacctttcccccagctgtctggaagttatgtggaagttggtttattggcagttaagtatgagacaacctggatttagcaaatgc

SEQ ID NO: 53294 - DNA, 201 bp, Homo sapiens
tttgtttgtttcattttgtttttaaagacaggatcttacagccggggcctgtaatcctagcactctgggaggctgaggcgagttgatcacctgaggtcagragttcgagacacacctggccaacatggtgaaaccctgtctctactaaaaatacaaaaattagccaggcgtggtggcacgtgcctgtaatcccagctactg

SEQ ID NO: 53295 - DNA, 201 bp, Homo sapiens
atgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacacc

SEQ ID NO: 53296 - DNA, 201 bp, Homo sapiens
aatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcacac

SEQ ID NO: 53297 - DNA, 201 bp, Homo sapiens
gaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcaca

SEQ ID NO: 53298 - DNA, 201 bp, Homo sapiens
agaatgattgttttaataaattactgttttaataagggaggtggaagagctttttaatcacttgctttttaaaaatttttaattttattttaattaattaattagtttatttattttttgagacggagtcttgctctgtcgcccaggctggagtgcagtggcacgatctcggctcactgcacctctgcctcctggattcac

SEQ ID NO: 53299 - DNA, 201 bp, Homo sapiens
aggttgcagtgagccgagatggtgccactgcactccagcctggcgacagagtgagactccgtcttaaaaaaaaaaaaatttatatatatatatatatatawgaattaattaatttaatgttgcattaacgagtggtataaggttcttagccctttgtctggtatctgctgggtgttcagtattcatttcctcgctttccct

SEQ ID NO: 53300 - DNA, 201 bp, Homo sapiens
agtcggaggttgcagtgagccgagatggtgccactgcactccagcctggcgacagagtgagactccgtcttaaaaaaaaaaaaatttatatatatatatakatatatgaattaattaatttaatgttgcattaacgagtggtataaggttcttagccctttgtctggtatctgctgggtgttcagtattcatttcctcgct

SEQ ID NO: 53301 - DNA, 201 bp, Homo sapiens
aatcccttgaaccagcgagtcggaggttgcagtgagccgagatggtgccactgcactccagcctggcgacagagtgagactccgtcttaaaaaaaaaaaaatttatatatatatatatatatatgaattaattaatttaatgttgcattaacgagtggtataaggttcttagccctttgtctggtatctgctgggtgttca

SEQ ID NO: 53302 - DNA, 201 bp, Homo sapiens
ttagccctgtgctttgtatcctatgcaatcctgtctgattaaatgtacacatttgttttacttcttttcaggctccttctcactctacttctgatattctgattaatatcaaagttgggagttacagtgattctcctctgcctcccccccaacccatttttattttgcctgcatcttattctttagtgtgcaaatgtggtt

SEQ ID NO: 53303 - DNA, 201 bp, Homo sapiens
ggtcaggagatcaagaccagcctggccaacatggtgaaaccccgtctctattaaaaatacaaaaatcagctgagtgtggtggcaagtgcctgtaatcccakctactcgggaggctgaggcaggagaatcccttgaaccagcgagtcggaggttgcagtgagccgagatggtgccactgcactccagcctggcgacagagtg

SEQ ID NO: 53304 - DNA, 201 bp, Homo sapiens
actctgaactttggccattcgcatgctgccagaccccttccaactcttggactcctccttacatccctttaccgttggctcccaattctttttttttttttaatttcccaattaaaacaacaaccaccaccaagaacaagagttaggccctgcctacccttctttggatggggtgtttgtgccaagtagcatcaccaactg

SEQ ID NO: 53305 - DNA, 201 bp, Homo sapiens
aggcagggcagcccttgaagctggtgcggccatgaccaccttcatgtgctcctcaaagatgggctctcagactgcttgcaacgccatcatcccactcctcyctgaatcttcctcgtgccgtcccccattcccttttatggatcaaatgctgtgggtcaggtttgacaatggacataggtacatgagaaatgagagcttccc

SEQ ID NO: 53306 - DNA, 201 bp, Homo sapiens; identical to SEQ ID NO: 11569

SEQ ID NO: 53307 - DNA, 201 bp, Homo sapiens
ctcaggtttgagtcttagggaagatggcctttcaaagccttaaggaagataaaattttggagtggcttaccccacaattctacccgtatttctctagttaratagattctatgctgtttttttttttttaataaaaaacagattgcattatgtagtagctgtaccaaataccaaccctgggtatagtttctgtttctctgt

SEQ ID NO: 53308 - DNA, 201 bp, Homo sapiens
tgcaagtcaacaagaaagcatccgcctcctcccctcgaaggtagcactgtccaatagaaatatagtgtgagccacagagggaattttaaatttcgtagtarccgtgtttttaaaaaagtttttgtttttttttttttaaaaaaaagataaagttatttttaatgacatgtttttattcaatgcaatatagccaaaatatta

SEQ ID NO: 53309 - DNA, 201 bp, Homo sapiens
cctcctcccctcgaaggtagcactgtccaatagaaatatagtgtgagccacagagggaattttaaatttcgtagtagccgtgtttttaaaaaagtttttgkttttttttttttaaaaaaaagataaagttatttttaatgacatgtttttattcaatgcaatatagccaaaatattatcattttaacatgctattcctgga

SEQ ID NO: 53310 - DNA, 201 bp, Homo sapiens
cgttggccttgtcaatctcggtatcattatttttagtagtctttctgagactttagcctataaaacagttttgctgaaaccccaaactctctaaatattayatggcaaatttgctttcttttggaaacctcggtgctgatgggccagctgaagtgcaggtgagctttttcagggaagggtgggacaacagtacatcctgga

SEQ ID NO: 53311 - DNA, 201 bp, Homo sapiens
aatcccaaacagatcctagctgcttgctatggcccatctgcgggacccgcgtcaaggctttcccataaaggagagccctgcgggaatcatcatgtgccagrcactgtgctaggctctttaggtgcatcttgaaacttaatcctcgtgacattttggagtagatactatcatccccacagaaggtactgaagtctcaagcac

SEQ ID NO: 53312 - DNA, 201 bp, Homo sapiens
aaataaaaggaaagaggcaaacaccgtcattctacatctgtttattttgttattaacaaaaggcaaggcgattttcattaaagttttgctggggttggggktgagggtgtagagagcaaaagtgtgagttgtacaccatgactggaatcgcttggacatactcttcagcagacatcgtgtgactgtggaagaaatgagttt

SEQ ID NO: 53313 - DNA, 201 bp, Homo sapiens
gtgcaagggggaaaatgagagaataatgacaaacctaatgcaactcaaagcaggattgttgcacaggaaaatgcatcctactgcttgtgcataaaatcaakgccggcagatgacatccggttaacagaaacgtgtcaacagtgaagtaaagtgagagtgagtaagagagaagcccctgagacagccagaaacaaaaattag

SEQ ID NO: 53314 - DNA, 201 bp, Homo sapiens
aagagagaagcccctgagacagccagaaacaaaaattagttgttcttaacaagttaaggttcatcattatattctggcttggagccatgaaagcagacggkggtatataatgagctgcttagaatttttagggtgtttattgcatttcatgaaatagtagtctgcagaaaggaatttcttaagcgaaggtatgtgtataca

SEQ ID NO: 53315 - DNA, 201 bp, Homo sapiens
gccagaaacaaaaattagttgttcttaacaagttaaggttcatcattatattctggcttggagccatgaaagcagacgggggtatataatgagctgcttasaatttttagggtgtttattgcatttcatgaaatagtagtctgcagaaaggaatttcttaagcgaaggtatgtgtatacagcccacatccatgttcacaca

SEQ ID NO: 53316 - DNA, 201 bp, Homo sapiens
ggaacactgagctccacctaatttggggtttaggggcaatatttgctgaaaatggtctaggatgcagtgattggtaggtgggagtttgaggacagatcccmccgagagtcctgaagcagctgtatccaataggaaggttggcccaggctgatctcattgggtgcatctccctagatgaacacagcaattaaccccatccca

SEQ ID NO: 53317 - DNA, 201 bp, Homo sapiens
ttcctttttgtttcttacatgggcatgtttattatttattctgtgtgtgtgtctgtgtgtgtgtgtgtgtgtgtgtgtgtgtgtgtatgtgtgtgtgttaraagccagggttggggagggggctgcgggagggcacagaaaaggtgttgctgaggtgtcctgtgggaatacaggcaaatccacagccattcaggtggctta

SEQ ID NO: 53318 - DNA, 201 bp, Homo sapiens
tgccatggaggaagttggaccacgaccttgtttattgggttgcgtctgttttgtctatctccagaaagcatcaggactccaaaaaggaagaagaaaagaakaagccccacataaagaaacctcttaatgcattcatgttgtatatgaaggaaatgagagcaaaggtcgtagctgagtgcacgttgaaagaaagcgcggcca

SEQ ID NO: 53319 - DNA, 201 bp, Homo sapiens
cagcagctgtagggaatgttatcagtgttgggactgggcacgggaccaagccttcctggtgcctggactgcaaccaagctgagagctgacatggcagggcragttgtgtgtgagttggctgcccctaggctcataggcctagcacaatagagaccctgtcaatggagggacactatcaggcaggtcactatcaatgtgaca

SEQ ID NO: 53320 - DNA, 201 bp, Homo sapiens
gaaagcagaaagcagccagaggagtccatgattcaaggagcatgagaattactgtttgcaacaccatgttttctgaattccagtataccatcagttgtaakatatgcttaaggttggacgcggtggctcatgcctgtaatcccagcactttgggaggccgaggagggcggatcacttgagatcaggagtacgagaccagcc

SEQ ID NO: 53321 - DNA, 201 bp, Homo sapiens
tatttatttttgagatggagtctcactctgttacccaggctggagtacagtggtgccatctcggctcactgcaacctctgcctcctgggttcaagctgttygcctgcctcagcctcccaagtatctgagattacaggttcttgccaccacgccctggctaatttttgtatttttggtagatacggcgtttcaccatgttgg

SEQ ID NO: 53322 - DNA, 201 bp, Homo sapiens
ctggctaatttttgcatttttagtggagatggggcttcgccatgttgcccaggctggtctctaactcctgagctcaagctctccgcctgccttagcctccyaaagtgctgggattacaggcgtgatccaccgcgcccagcatatgtgaattctttattgattcttcataacaacacagagggaaatttgaaaggtgtagtt

SEQ ID NO: 53323 - DNA, 201 bp, Homo sapiens
ctgcacacatttgaggatttttgaaaaaattcaactttgcctgggtcactccctcgttaccttaaacttgcaacacatcagctggagatcagagggagcarcaattgtgtttgccctccttgtcccatggtgactctgtgtcattttcacgcgtgttatttattctggctgtagatgcccattaaaggatgcccatgtttg

SEQ ID NO: 53324 - DNA, 201 bp, Homo sapiens
gaggattttggttccttttaaatagatattgtttacttcatttaatggttcggctttttagtagactttttctttagtttcttgtcagcccagaactgackacataaagtgtttttatcatctgaatcctgctgggccgagatactgcatgtttgtatttgagaagcagaaacatcctattaaatgtctttaccccttcca

SEQ ID NO: 53325 - DNA, 201 bp, Homo sapiens
ccaagctggagtgcagttgcacaatcttggctcactataacctctgcctcccaggttcaagcaattctcctgctttagcctcccgagtagctggcataacrggcgcctgccaccacacccagctaatttttatattttttggagagatggggtctcaccatgttggccaggctggtctcgaactactgacctcaaagtgat

SEQ ID NO: 53326 - DNA, 201 bp, Homo sapiens
gcgcctgccaccacacccagctaatttttatattttttggagagatggggtctcaccatgttggccaggctggtctcgaactactgacctcaaagtgatcygcccacctctgcctcttaaagtgctgggattacaggcatgagccactgtgtctggccctacttaccttctttgtgttaattcctgcaccattgattagct

SEQ ID NO: 53327 - DNA, 201 bp, Homo sapiens
acctggcatgcactgtagctggtcttggaaaatgcgataatgatgccataagtacccttgtgcaaaagttgttttttgttccaaaacattgccagttcacrgcatataaaactaccacggatgcttcagccgggtttctttttctccaaataaggcaagcattaatgaagcagctgagggcttgggaaaatattttgtcat

SEQ ID NO: 53328 - DNA, 201 bp, Homo sapiens
gcatgatggttttgtcctaaacattaacagccacaaaaggtagagagtgtgtctgtttatagatacacatgtatcatgaataattagttggggactgtgcrtcaggtctctcattttacattcgaggaagcaatgcacggaatgaattctggacctgcgaactctgaatttcaattctctgtctcctacttttactggagt

SEQ ID NO: 53329 - DNA, 201 bp, Homo sapiens
gattggtaggtgggagtttgaggacagatcccaccgagagtcctgaagcagctgtatccaataggaaggttggcccaggctgatctcattgggtgcatctycctagatgaacacagcaattaaccccatcccagtaatgccagtttctgcagactgggagagtgtagaagtggggtggtggaggcaggcaggtgaggctgc

SEQ ID NO: 53330 - DNA, 201 bp, Homo sapiens
ttgggcatgatggttttgtcctaaacattaacagccacaaaaggtagagagtgtgtctgtttatagatacacatgtatcatgaataattagttggggactstgcgtcaggtctctcattttacattcgaggaagcaatgcacggaatgaattctggacctgcgaactctgaatttcaattctctgtctcctacttttactg

SEQ ID NO: 53331 - DNA, 201 bp, Homo sapiens
atctccctagatgaacacagcaattaaccccatcccagtaatgccagtttctgcagactgggagagtgtagaagtggggtggtggaggcaggcaggtgagkctgcaaagcttagaaacaccactctctcaaggcatgtaacctggaaaaaaaatatctttacctaccgcgtggaactgataacaaatgccgactacttcat

SEQ ID NO: 53332 - DNA, 201 bp, Homo sapiens
tctgtctctgagatcccagaacagacatgaagatatggtaccgattcccttggtgctaaaaggaactccaggggaatttcaggaaacccctccttttctcrtctttattctcaccccgtccccccgccacctctctccccaagttcacactcaggagggaggaatcttttaccttttccgttctgggcagcagctgtaggg

SEQ ID NO: 53333 - DNA, 201 bp, Homo sapiens
gttaacacaggaggacaggggtagacgcaccaagggcatgtgcctcgagtgcgtggtccttattaagaagggtggttagacagggaatgggttagttcccrggtcggcattcagctgaaacagtgatggttaaaattctgaaaaatgtccacgctctgcattctcttcctaacacccaggacccagtaactataaagcccc

SEQ ID NO: 53334 - DNA, 201 bp, Homo sapiens
agttaacacaggaggacaggggtagacgcaccaagggcatgtgcctcgagtgcgtggtccttattaagaagggtggttagacagggaatgggttagttccyaggtcggcattcagctgaaacagtgatggttaaaattctgaaaaatgtccacgctctgcattctcttcctaacacccaggacccagtaactataaagccc

SEQ ID NO: 53335 - DNA, 201 bp, Homo sapiens
cagggagacttaatttacagattaaaagcttcctgaatgaattttttaaaaaatgaagtcgttttcgtccacgaacatgcagcccgttccctccattactstgttttaattctgtggtattgtgccttttgcctcccacttcaatggcatacatcaattcctctctgtcagagtggactacaggatgtgctcctgtggaac

SEQ ID NO: 53336 - DNA, 201 bp, Homo sapiens
gctgggatgtcaggcacccgccaccatgcccggctaattttcgtgtgttttagtagagatggggttccaccgtgttggccaggctggtcacaaactcccgmcctcaggcaatccgcccgcctcggcctcccaaaggctgtgattacaggtgtgagccactgtgcccagcctagggttccatttcttaacccctccttctga

SEQ ID NO: 53337 - DNA, 201 bp, Homo sapiens
ttttttttttttttttttttgagattacattgcctatattgtgcattttccccaggaatacttaaagaaacctggtatgggagacggctctttaatttatwtgatgttcccctgagtggaagggaaaatgtacacattacatagtacactagttaaactagttaacgtgagagtttttaaaaaagtgagatgaggtgaaga

SEQ ID NO: 53338 - DNA, 201 bp, Homo sapiens
ccaaaacaggtaggctgtgggctacggagccaaggtagagtgctggtcctggggttctgggggaacctttgaggcctccacaggaaccccaggggtggagyagtaggggactttgggggaacggtggtgggggggcccctgttgcttttctgggtgttgaaaaggaagctctttggggtggttgaggcctggtgtggcagt

SEQ ID NO: 53339 - DNA, 201 bp, Homo sapiens
aatcttttaccttttccgttctgggcagcagctgtagggaatgttatcagtgttgggactgggcacgggaccaagccttcctggtgcctggactgcaaccwagctgagagctgacatggcagggcgagttgtgtgtgagttggctgcccctaggctcataggcctagcacaatagagaccctgtcaatggagggacactat

SEQ ID NO: 53340 - DNA, 201 bp, Homo sapiens
attttgaggcctttactaccaaagactgaataatacattgggcatgatggttttgtcctaaacattaacagccacaaaaggtagagagtgtgtctgtttayagatacacatgtatcatgaataattagttggggactgtgcgtcaggtctctcattttacattcgaggaagcaatgcacggaatgaattctggacctgcga

SEQ ID NO: 53341 - DNA, 201 bp, Homo sapiens
ccgcgtggaactgataacaaatgccgactacttcataggctcgttgtgaggatttcctagaataaagcatgtgatgcactcagcacagaggcacacagacwcagagcccaaggcaccattaaacggcggccaccctgagctgtgctggtgtggatggtagtgcttcaggggtagcagctggtcagtccccatcctaccttc

SEQ ID NO: 53342 - DNA, 201 bp, Homo sapiens
tggaatcgcttggacatactcttcagcagacatcgtgtgactgtggaagaaatgagtttcatgaagatgactgatagaaggaagccactgaaccagtcctytatcacctcttccaaggctaaagtttggagccacttgcagaaggctctcctcaaacccctgtgttctttgcctacccctgctgttgccacatcatcttgg

SEQ ID NO: 53343 - DNA, 201 bp, Homo sapiens
gctctgcaaacaggaaacggtgctcactgctgtgtatgcttttcatggagataaagtgtcaggagcaagaccccaaacctgcgaaatcactaatgcaaccrccccccatgccccaaaaggtgggagtgggggataaaaagagtaggaaagtggtgtggggaggggaagctttagggccataactcagacaatttgtcaggc

SEQ ID NO: 53344 - DNA, 201 bp, Homo sapiens
gtgatttagttaatgcccgctctgcaaacaggaaacggtgctcactgctgtgtatgcttttcatggagataaagtgtcaggagcaagaccccaaacctgcraaatcactaatgcaaccgccccccatgccccaaaaggtgggagtgggggataaaaagagtaggaaagtggtgtggggaggggaagctttagggccataac

SEQ ID NO: 53345 - DNA, 201 bp, Homo sapiens
atacattacgttaatccttatgatctttgggggctaagtattagtattccattttacggatgaagagactgaggctcagagggaagggaggtggcttttckcaggtggaaagccagaccttttcagtggtcattcagttcatagctaaggtcttattttctgtgctctctgtcggctgaaaatgggcaaggtaatttcaca

SEQ ID NO: 53346 - DNA, 201 bp, Homo sapiens
ttggtttctctcccttcctcttgtctctcctaccctgtaaacacatacttggtgattacccatggggagacaagacaggctgggaatatatacttctgcamcttcagcctcctgggttccagcgattctcctgcctcagtctccagaagagctcggattacaggtgtgcaccaccaggcccagctaactttttgtattttt

SEQ ID NO: 53347 - DNA, 201 bp, Homo sapiens
ccccagcaatgggcatcgtgtgatgtaggaagaaagggttctggggtctgaggccggagagacataggcatttgtaagaagaaaatccctccatcatagakgattccaggtagaggcaggttggctggagtggcaattagtccctggttttggcaggtatgaccacagagttctcctctcttgcaagggaacccatgagct

SEQ ID NO: 53348 - DNA, 201 bp, Homo sapiens
gtcagcgggtatgtatctttccaaccaaagagaaaacttctggaaggcagcaacagtcatttgccctgcctcctaacagtctccactttgtccgtgtctgwctctttccctcccttcctctccttttcccttttccttctccacctcagcacacagtgggagcttccttgttccttatttctcaagttgtcctgagcaaat

SEQ ID NO: 53349 - DNA, 201 bp, Homo sapiens
aagatggggttaaccggagccaagccagagatctggtggtagtggggggtttccaagctagaatggttgtgtggtattctgtcctcaggggctttgaactstgtgtgctaatgaggcctcaaattctctggggctctggttaaaatgtagattctgatatcagttggcttgggtggggccttgcatttctgtaagccctta

SEQ ID NO: 53350 - DNA, 201 bp, Homo sapiens
ggcgtgatctcggctcactgcaagctccacctcccgggttcatgccattctcctgaatcagcctcccaagtagctgggactacaggcacctgccaccacasccggctcattttttgtatttttagtagagatggggtttcaccatgttggccaggtctcttgaccttgtgatccgcccgcctcggcctcccaaagtgctgg

SEQ ID NO: 53351 - DNA, 201 bp, Homo sapiens
ggggccaggcatggtggctcacacctatgattccaacactttgggagactgaggtaggcagatctcttgagcccaggagttcgagaccaacctgggcaacrtggcaaaagccatctctgcaaaaaatacaaaactcacctgggcatggtggtgcatttctgtggtcccagccaaaattagcaggccatggtggtgtgtgcc

SEQ ID NO: 53352 - DNA, 201 bp, Homo sapiens
aattagcaggccatggtggtgtgtgcctgtagtcctgtgtgggaggattgcctgagcctaggagctcaaagttgcagtgagcccagatcgtgccattgcastccagcctgggtgacagagtgagaccccatgtcaaaaaaaaaacaaaaaacaggggcctgcctcagccagcaggtgaggtctgccactgagagcacttct

SEQ ID NO: 53353 - DNA, 201 bp, Homo sapiens
tgtttggtttataaaggtaggtataggactgttggccagggataggactgttggccaggggaacatactagtggggaaaaaaaaaaaatctccaagctgcyaatccaggcctttttcctccagcagcagcaccagcaaaaacttccatagtgatgatttccagctttgactagctcatactctgtgccctgtcctgcactg

SEQ ID NO: 53354 - DNA, 201 bp, Homo sapiens
tgttggttacctggccgcttaagtaatttgtgtaagaacaggtttaccccacccaaaagaactgggccatggagagccttcataggaagaaaaggacttawctcctcttggtcaaagtgaccaaatgactgcatagccctcgcagcttccccagtctccccacccccacagaatttgagagaagcagctgagcatctagag

SEQ ID NO: 53355 - DNA, 201 bp, Homo sapiens
ccctccgcacctgagccaggtctagccagacctggaggaggtagtgggatggtcaggtgccaggcttggtcggcggcctctgtgacagccgagtccagggkccctttgctgctgccagtttctccaattgctccatccaggatgaccacgtccctatgcatgccctgtaagggagacagctagacttcaacacatttctgc

SEQ ID NO: 53356 - DNA, 201 bp, Homo sapiens
ggtatgggcagccctggagccaaaaggtcacagcctagagtccaagagcacgggcctgcaagctcatccctttctagctgagcaagttatttctacaagcytccattttctcatgagaaaatggggctaagagtgcatgcctcacagtgggggtgaaagcagacagtaacttacagccaaaatgcagcccttgaggcccat

SEQ ID NO: 53357 - DNA, 201 bp, Homo sapiens
gtgatgatggtggccttgggtcggagcccatctgatgaatacaaagacaacctgcaccaggtaagtctctggccctcacggggtggagctaaggcaaagcygccctctctcccactactcccatgtgacagcctcccccagccattggcaggccggaggctcagggagagcagggcctggcttaaagctctgggttctccc

SEQ ID NO: 53358 - DNA, 201 bp, Homo sapiens
tgtctttgtctgtgtggtacctagttaagaggggctgagtgcgggcaggttaaagaagagaggcctgggtccctttgtgaaggcgcccggggctttgcagwtggagttctgttaagtgtttctggaacgatttgattctgtggaggggcctgggtcaggtctggcaaatgccaaactctgtgggtagagggcaaattgggc

SEQ ID NO: 53359 - DNA, 201 bp, Homo sapiens
tggtcttcgtagaccgcggccgcaggaatcagcagcgtagcccaaagccagaaacgagaagcccactcagccgccatgatgcgagcgcatgcaccacccaycgccgtcccggcatgcaccgcgccgcgggctccgcctccgcgggaccacagagctgggatagcgcgcgaggccctcggtcggacgggacgctcgggattc

SEQ ID NO: 53360 - DNA, 201 bp, Homo sapiens
catggtggtgcatttctgtggtcccagccaaaattagcaggccatggtggtgtgtgcctgtagtcctgtgtgggaggattgcctgagcctaggagctcaargttgcagtgagcccagatcgtgccattgcagtccagcctgggtgacagagtgagaccccatgtcaaaaaaaaaacaaaaaacaggggcctgcctcagcca

SEQ ID NO: 53361 - DNA, 201 bp, Homo sapiens
cctcttctgcaggtgtggtgactctgctgtctgactacgaggtgtgcaaggagggcgatgtgctgaccccagagcaggctcgcgtcctggtgagtctggcrccttgcgggctgttgcgggcggggttgctggctttcctctgcctgctgaaaatgcccccctgcactttgaataccttcattcctcctgattctttgttcc

SEQ ID NO: 53362 - DNA, 201 bp, Homo sapiens
gcgcttgtttaaaaaaaaaaaaagtcaaaaaattagacagccatggtggtgtgtgcctgtggtcctagctacatgggaggctgaggcaagaggatcactakagcccaggaggtcgaggctgcggcaaatcaaagggacctcagggagacagccactgcccagtgtgtgttggagccgtggggagggcaggtggctgactgg

SEQ ID NO: 53363 - DNA, 201 bp, Homo sapiens
tcctgatttgtaggtcagcaaaaggttgaggggtgaggtgggtctcctgttcaccaaccgcacaaaggaggaggtgaatgagtaagtactgctgaggaacrgagggaaagaggcgggtgagaggggatttcagggagggaatgatgcaggaacttcgttccatatgtggcatcaagttggaactgctcctggaagcctgtc

SEQ ID NO: 53364 - DNA, 201 bp, Homo sapiens
caccaggtaagtctctggccctcacggggtggagctaaggcaaagccgccctctctcccactactcccatgtgacagcctcccccagccattggcaggccrgaggctcagggagagcagggcctggcttaaagctctgggttctcccttcacctccggacccaaggaatagcagcttcctgcctcccactccttcctgcta

SEQ ID NO: 53365 - DNA, 201 bp, Homo sapiens
gacaacctgcaccaggtaagtctctggccctcacggggtggagctaaggcaaagccgccctctctcccactactcccatgtgacagcctcccccagccatyggcaggccggaggctcagggagagcagggcctggcttaaagctctgggttctcccttcacctccggacccaaggaatagcagcttcctgcctcccactcc

SEQ ID NO: 53366 - DNA, 201 bp, Homo sapiens
tgatggtggccttgggtcggagcccatctgatgaatacaaagacaacctgcaccaggtaagtctctggccctcacggggtggagctaaggcaaagccgccytctctcccactactcccatgtgacagcctcccccagccattggcaggccggaggctcagggagagcagggcctggcttaaagctctgggttctcccttca

SEQ ID NO: 53367 - DNA, 201 bp, Homo sapiens
tgctctttctcttgcttggtaggatgttctttggcaaaaacaaggtgatgatggtggccttgggtcggagcccatctgatgaatacaaagacaacctgcaycaggtaagtctctggccctcacggggtggagctaaggcaaagccgccctctctcccactactcccatgtgacagcctcccccagccattggcaggccgga

SEQ ID NO: 53368 - DNA, 201 bp, Homo sapiens
caggtggctctggtggtggtctcttgccgcaccagctctggttcaggctgttaacatgcctcccgcatacatccagatagagaactggtacatgatgctcstgatgggctgggagacaaaatgttgccatgtcaggagtctgtgggtgggaacataatgaaagggaccccgacgtggggacagtgtggccaggcagcatgg

SEQ ID NO: 53369 - DNA, 201 bp, Homo sapiens
cgtagcccaaagccagaaacgagaagcccactcagccgccatgatgcgagcgcatgcaccacccaccgccgtcccggcatgcaccgcgccgcgggctccgyctccgcgggaccacagagctgggatagcgcgcgaggccctcggtcggacgggacgctcgggattcagggactgcctcggcacacgggaagttgccctaca

SEQ ID NO: 53370 - DNA, 201 bp, Homo sapiens
tacaagtaccttttcatcttctctgtggccaacatgaggaacagcaagctgaaggacatccggaacgcctggaagcacagccggtgagcgggcagggggargaaggcccttctgagtggggacccggccaggctgctctcagtcaaagcacaggagcaatttctgaccctttaggtgcctgggtcatgccgctgacacctt

SEQ ID NO: 53371 - DNA, 201 bp, Homo sapiens
tgccagaaatgatggccacaaaggccttgctgccttttttcagaatggctgcatccagctgagtgctctctgccaaaggggagaagaaaataagtctccartgcatttagattggtctctcatcatctctctcctttttgtttttattagtctccttaaccaaaactgccaagaaaggcttggaattgaaacaaaacctga

SEQ ID NO: 53372 - DNA, 201 bp, Homo sapiens; identical to SEQ ID NO: 11626

SEQ ID NO: 53373 - DNA, 201 bp, Homo sapiens
gccatgatgcgagcgcatgcaccacccaccgccgtcccggcatgcaccgcgccgcgggctccgcctccgcgggaccacagagctgggatagcgcgcgaggscctcggtcggacgggacgctcgggattcagggactgcctcggcacacgggaagttgccctacaggcgcgggagaaagcgcaggcggcggcttggcaggga

SEQ ID NO: 53374 - DNA, 201 bp, Homo sapiens
gaaaatgcccccctgcactttgaataccttcattcctcctgattctttgttccctttgtctcttgcagaagctttttgggtatgagatggctgaattcaargtgaccatcaaatacatgtgggattcacagtcgggaaggttccagcagatgggagacgacttgccagagagcgcatctgagtccacagaagagtcagact

SEQ ID NO: 53375 - DNA, 201 bp, Homo sapiens
gcaacatgacaaaacctcatctctacaaaaagaaaagaaaaaaaaactagctggacgtggtggtacgcagcctgggcaacagagtgagaccctgtctttaaaaaaaaaaaaaagagctgggagatttaccaggtgtaggtgactgcaccaacccactgtctgtacagcttctgacctgccaacctgggctgcaggctgggt

SEQ ID NO: 53376 - DNA, 201 bp, Homo sapiens
gtgggtactaggtgatgatgttgctgttttgcatttggggtcactgaagcttacagagatttgttagcctgcccaatgtcaaaaaacaggaggccaggaayggtgggccacgcctgtaatcccagcactttgggaggccaagtgggtcagacagcttgagtctgggagctcaagagcagcctgggcaacatgacaaaacct

SEQ ID NO: 53377 - DNA, 201 bp, Homo sapiens
actccatcctcataacatccctgtgatgtgggtactaggtgatgatgttgctgttttgcatttggggtcactgaagcttacagagatttgttagcctgccyaatgtcaaaaaacaggaggccaggaacggtgggccacgcctgtaatcccagcactttgggaggccaagtgggtcagacagcttgagtctgggagctcaag

SEQ ID NO: 53378 - DNA, 201 bp, Homo sapiens
cactgacctcctgtaaagaataaaactgtgggccgggcgcggtggctcacgcctggaatcccagcactttgggaagccgaggtgggcagatcataaggtcrggagattaagaccatcctggctaacacggtgaaaccccgtctctactaaaaatagaaaaaaaaactagttgggcatagtggcatgtgcctgtagtcccag

SEQ ID NO: 53379 - DNA, 201 bp, Homo sapiens
aaaaaaaaaaaatctccaagctgccaatccaggcctttttcctccagcagcagcaccagcaaaaacttccatagtgatgatttccagctttgactagctcrtactctgtgccctgtcctgcactgtgtttcttatgcgttgttccactccatcctcataacatccctgtgatgtgggtactaggtgatgatgttgctgttt

SEQ ID NO: 53380 - DNA, 201 bp, Homo sapiens
ttttgtttgtttttgatttttctgttttaaaattttaaggagagatggggtttcaccatgttgcccaggctggtctcaaactcctgagctcaagcgatctrcccaccttggcctcccaaagtgctgggattataggtgtgagccaccgcatccagcccacattgttctatttgtatttcatgaaagcagttctgaatgaga

SEQ ID NO: 53381 - DNA, 201 bp, Homo sapiens
gcggattgcttgagcccaaagactcaagatcagcccaggctcaggccgggcacggtggctcatgcctgtaatcccagccctttgggaggccgaggcaggcrgatcacgaggtcaggagatggagaccatcctggctaacacggtgaaaccccgtctctactaaaaatacaaaaaattagctgggcatggtgacgggcgcct

SEQ ID NO: 53382 - DNA, 201 bp, Homo sapiens
atccagatagagaactggtacatgatgctcgtgatgggctgggagacaaaatgttgccatgtcaggagtctgtgggtgggaacataatgaaagggaccccracgtggggacagtgtggccaggcagcatggagaagtgggtgccactggctcagcctgggcctgagctcactggggaccggagctactttgcatgttgctg

SEQ ID NO: 53383 - DNA, 201 bp, Homo sapiens
ctgcccaccgccctcaagagaggtatgggcagccctggagccaaaaggtcacagcctagagtccaagagcacgggcctgcaagctcatccctttctagctragcaagttatttctacaagcttccattttctcatgagaaaatggggctaagagtgcatgcctcacagtgggggtgaaagcagacagtaacttacagccaa

SEQ ID NO: 53384 - DNA, 201 bp, Homo sapiens
cactgctctaatgtgaccaagctgtcctcactcctgatttgtaggtcagcaaaaggttgaggggtgaggtgggtctcctgttcaccaaccgcacaaaggargaggtgaatgagtaagtactgctgaggaacggagggaaagaggcgggtgagaggggatttcagggagggaatgatgcaggaacttcgttccatatgtggc

SEQ ID NO: 53385 - DNA, 201 bp, Homo sapiens
tgtagatccatggctcagcctcccctgtggttagggatcctaatttcagtaatggaggtaggagacaaccaaattagaggcctccagttcttccagtttcmatagttgtcaggggcccagagcagattcattctcatctgaggccagagtagtgcccgttgtatgctgctgcttgaactcagagcctcgtgaattgtccca

SEQ ID NO: 53386 - DNA, 201 bp, Homo sapiens
ctgaggaaaattaggtatccttcctagccctccacacacttccaaaccagggctgcggatctgatggatgccaggaagacagccttgggctgagagtgacrtcactgcaagagttgagagccagcgtctaaagtgtccacggcatcctgggaggttttatccttggtgactctaatggtagatttttgtccaccttgttct

SEQ ID NO: 53387 - DNA, 201 bp, Homo sapiens
gatgccaggaagacagccttgggctgagagtgacatcactgcaagagttgagagccagcgtctaaagtgtccacggcatcctgggaggttttatccttggygactctaatggtagatttttgtccaccttgttctatttgcttttgtttgtttttgatttttctgttttaaaattttaaggagagatggggtttcaccatg

SEQ ID NO: 53388 - DNA, 201 bp, Homo sapiens
tggtctcaaactcctgagctcaagcgatctacccaccttggcctcccaaagtgctgggattataggtgtgagccaccgcatccagcccacattgttctatytgtatttcatgaaagcagttctgaatgagagtaaatcagcttcagggtgtacagtggccctcttttttctgccatgcatggaagagggccacctccagcc

SEQ ID NO: 53389 - DNA, 201 bp, Homo sapiens
gatgtgctgaccccagagcaggctcgcgtcctggtgagtctggcgccttgcgggctgttgcgggcggggttgctggctttcctctgcctgctgaaaatgcscccctgcactttgaataccttcattcctcctgattctttgttccctttgtctcttgcagaagctttttgggtatgagatggctgaattcaaggtgaccat

SEQ ID NO: 53390 - DNA, 201 bp, Homo sapiens
tccccccaaaaagaaaaacattagtttcagtcaaacccacgttcgttccctaccatgtgtagctgtgggaccctacacaagtgaaattgcctctgagccarttgcctcatgtaaaactgagatgaccatacttaacatggccatcgcaataactagtgttggttacctggccgcttaagtaatttgtgtaagaacaggttt

SEQ ID NO: 53391 - DNA, 201 bp, Homo sapiens
accccagagcaggctcgcgtcctggtgagtctggcgccttgcgggctgttgcgggcggggttgctggctttcctctgcctgctgaaaatgcccccctgcaytttgaataccttcattcctcctgattctttgttccctttgtctcttgcagaagctttttgggtatgagatggctgaattcaaggtgaccatcaaatacat

SEQ ID NO: 53392 - DNA, 201 bp, Homo sapiens
ttgttcttttctagagcttgcaattgtttggtttataaaggtaggtataggactgttggccagggataggactgttggccaggggaacatactagtggggaaaaaaaaaaaatctccaagctgccaatccaggcctttttcctccagcagcagcaccagcaaaaacttccatagtgatgatttccagctttgactagctca

SEQ ID NO: 53393 - DNA, 201 bp, Homo sapiens
aatcagcagcgtagcccaaagccagaaacgagaagcccactcagccgccatgatgcgagcgcatgcaccacccaccgccgtcccggcatgcaccgcgccgsgggctccgcctccgcgggaccacagagctgggatagcgcgcgaggccctcggtcggacgggacgctcgggattcagggactgcctcggcacacgggaagt

SEQ ID NO: 53394 - DNA, 201 bp, Homo sapiens; identical to SEQ ID NO: 11631

SEQ ID NO: 53395 - DNA, 201 bp, Homo sapiens
cattgtgcctctgacaccctctcagtgcctctgttctttggagacttcctactcccgcccacttctcaccacgcccttgggaaggacagcaggaagcaggsttcgggcagaagaggaattcaccatgttcacccaggcctaggccaggtcaagcaccagcctcagcaggaagtgctgaaggagagctcaggcccggccctc

SEQ ID NO: 53396 - DNA, 201 bp, Homo sapiens
ctaagatcaggaactttccagcagcccacacacgacatctaaatttgatatattaaggaatagcgataaagtgtgtagctttttttttaataagagatggyggtcttgctttaatatccaggccaaactcctaagctcaagcaatcctcctatcttggcctcctaaggctggaactacaggcctatgacaccatgcctggc

SEQ ID NO: 53397 - DNA, 201 bp, Homo sapiens
ttccatctgccttccaggttgtggcctatggtttggacatttaccaaactcgagtctacccatccaagcagtttgacgttctgaaggatgactatgactaygtgttaatcagcagcgtcctctttggcctggtttttgccaccatgatcactaagagactggcacaggtgaagctcctgaatcgggcctggcgataaagaa

SEQ ID NO: 53398 - DNA, 201 bp, Homo sapiens
tctggctgcctcggcctcccaaagtgctgggattacaggtgtgagccactgcacctggcctacagttttcagattgaaaaataaatgaagacatacaggtrtgcatcacttaatgatgggaatacatcctgagaaatgccctcttgtgcaaacgttgtagcatgtacttatgtaaatctagatggtttagcctactacaca

SEQ ID NO: 53399 - DNA, 201 bp, Homo sapiens
atgtacagatacacgcagagcgattcatcaactataaccagacagtttctcgaatgcgaggtatctacacagctccctcgggtctggagtccacttgtttrgtgagtagagcccacagctgccctatttcacccttggtggatcattggttgtttctttcctaattcttattccatctgccttccaggttgtggcctatgg

SEQ ID NO: 53400 - DNA, 201 bp, Homo sapiens
ccttcctggtctccactaggaaccctgaaaatcagaagtctgggcacattgacctggtcagtttgaacccagcgggcaggaggctgttgagaagtgaggtmttgcctcaactatagagctttctgcacaccccatttctccccaggaacgagaccctaatgtgatgaccttactttcatatggggctattaagggttgaat

SEQ ID NO: 53401 - DNA, 201 bp, Homo sapiens
gaggtagaggctgcagtgagccgtgatcgcaccactgcactgcagcctgggtgacagagtgagacgctgtctaaaaaaaaacacaacaaagaaaatgctaygaggcgggttatgaaatatccatgagcaacactggctggatgggagctgcagtgctcctggcctgcctggagggggcagccttacccacctgattggtgc

SEQ ID NO: 53402 - DNA, 201 bp, Homo sapiens
actgaagagccagccattgacattgagtacccattgtggatatgcttgctcagccaacatgtattgagcgcctgttagatgcagagtttctaggtgcaatrtttgcgcttgtgcttgaatgctgttcctaatttcactgtgattcgtgagttttgcaatgttccagatataagaacataatataaaacttccactgtttag

SEQ ID NO: 53403 - DNA, 201 bp, Homo sapiens
gtggtgtgcctagagatggtggacctccccctgactggggcacaggccgagctggaaggagaatttggcaaaaaggcaggtatgaacctaagaggttggarctgcagagttgctggaggggccagtctggaaatgaccacaagagacactgtatcatgcatctctggcttcctaggctgggcagattgctagtcttttctg

SEQ ID NO: 53404 - DNA, 201 bp, Homo sapiens
taaattttccttgcatatttcctactcagataaacaacgggatactattgagcgttcgcctcctttcctactggctttattatctttttttttttttttttgagccggagtttcgctcttgttgcccaggctggagtgcaatggtgcagtctcggctcactgcaacctccacctcctgggttcaagtgattctcttgcctc

SEQ ID NO: 53405 - DNA, 201 bp, Homo sapiens
cttcagttttttattacagaaaaatattgacaaaagtgcaaaatcatgaggtatggctcagtgaaccctcaccaagggaatacacttgtgtacctggtgaycacttcaggaaacagaatagcaccagctcctagaaggcccttgtgccctttgccagtaactacctcctgtctccacccccaagggctccgcataattcca

SEQ ID NO: 53406 - DNA, 201 bp, Homo sapiens
acagttttcagattgaaaaataaatgaagacatacaggtatgcatcacttaatgatgggaatacatcctgagaaatgccctcttgtgcaaacgttgtagcrtgtacttatgtaaatctagatggtttagcctactacacacctaggctatatggtacagcctattcttcctaggctacaaacctgtacggcatgttacttt

SEQ ID NO: 53407 - DNA, 201 bp, Homo sapiens
tccggcctgccaatggctgggggaggctgtcacatgggagtagtgggagagagggcggctttgccttagctccaccccgtgagggccagagacttacctgrtgcaggttgtctttgtattcatcagatgggctccgacccaaggccaccatcatcaccttgtttttgccaaagaacatcctaccaagcaagagaaagagca

SEQ ID NO: 53408 - DNA, 201 bp, Homo sapiens
aaggtgtcagcggcatgacccaggcacctaaagggtcagaaattgctcctgtgctttgactgagagcagcctggccgggtccccactcagaagggccttcytccccctgcccgctcaccggctgtgcttccaggcgttccggatgtccttcagcttgctgttcctcatgttggccacagagaagatgaaaaggtacttgta

SEQ ID NO: 53409 - DNA, 201 bp, Homo sapiens
cttgcagtccttgcttctcccagtcatggatcaagactacgccaaggtgttgctgttgatagatgatgaatacaaggtactgtcttcagaggggatggagmacatgctagcggagtccggtttggggccaggtggtcaaacacagcggcccggagatggagtgctctctgcacccagcacgtgtttgggctctaaggccat

SEQ ID NO: 53410 - DNA, 201 bp, Homo sapiens
atcccagcattttgagaggtcgaggtgggtggattacttgagtccaggagtttgaggccagcttgggcaacatggctgaaaccttgtctttaccacccccmaaaaaaaaaaacaaaaaaaacaattagctgggcatggtggtgcatgcctgtggtctcagctactcgggaggctgaggtaggaggatcacctgagcctggg

SEQ ID NO: 53411 - DNA, 201 bp, Homo sapiens
atgcttggctaattttttgatatttatttatttttattttattttattttatttcaagacggagtctcgctgtgtcgcccaggctggagtgcaatggcacratctcggctcactgcaacctccacctcccgggttcacgccattctcctgcctcagcctcccgagtagctggaactacaggcgcccaccatcatgcctggc

SEQ ID NO: 53412 - DNA, 201 bp, Homo sapiens
gcgtgtgccaccacgaccagctaatttttgtattttcagtagagacagggtttccccatgttggccaggctggtctcgaattcctgacctcaagtgatccrcctgcctcggcctcccaaagtgctgggattacaggtgtgagccaccgtgcctggcctgtcacctgcttttttttttttttttgagacggagttttgctct

SEQ ID NO: 53413 - DNA, 201 bp, Homo sapiens
ttgggaggctgcaggtttctggaagagattcaagtggagtgtgccctgagtgtttcgttcatagccaaatgtcacctgctttttttttttttttttttttttgagatagagtcttgctctcttgcccaggctggagtgcagtggcatgatctcggcccactgcaatctccacctttcggattcaagcgattctcctgcctc

SEQ ID NO: 53414 - DNA, 201 bp, Homo sapiens
gttgggtaagtagacctcattcaacccatttttttatttccccaggccttccaatgtgttccaatcagactgttttttgggaggctgcaggtttctggaaragattcaagtggagtgtgccctgagtgtttcgttcatagccaaatgtcacctgctttttttttttttttttttttttgagatagagtcttgctctcttgc

SEQ ID NO: 53415 - DNA, 201 bp, Homo sapiens
gaagaacctttgagcttaggacccccagtgggatgctggcagcaatattgctgttgggctgagagggaaatgtaaaaatctttcacgagcttcctgttaaygatgacttttctgtaggttagggtttcaactccgtggctgcagcacctgtctggagcctgtggtgtggtggatgaggctgtcctggtgtgtcctgacccg

SEQ ID NO: 53416 - DNA, 201 bp, Homo sapiens
tccagaagagtgatatattacattttaaaatttttattatttatttattttttattgttttgagacagagtcttgctctgtcacccacgccggagtacagyggcatgatcttggctcactgcaacctccgcttccagggttcaaacgattttcctgccttagcctcccaagtagctgggattataggtgcccatcacgccc

SEQ ID NO: 53417 - DNA, 201 bp, Homo sapiens
ggtttctccatgttggtcaggctggtctcaaactcccgatctcaggtaatccacccgcctaggcctcccaaagtgttggaattacaggtgggagccactgygcccagccaagactttttaaaattttttgagacagggactcattctgtagcccaggctggagtacagtactatcatggctcactgcagctttgaccttgc

SEQ ID NO: 53418 - DNA, 201 bp, Homo sapiens
atctttgaatatttgtatgttcctataactgacctttgcggtttgttctctcagcttgaatcctgagtgtccttaaataagatattgctgcaagcccaggygggaggatcacttgagctcaggagttcgagaccagcctggggatcacagtgaggccccatgtctaaaattaaaaaaatcaggcatggtggcgtgtgccta

SEQ ID NO: 53419 - DNA, 201 bp, Homo sapiens
cagctacttgggagactgaggtgggaggattgcttgagcccagcaggttgaggctgcagtgagctgtgatcatgccagttcactccagcctgggcaatagrgcaacaccttgtctcaaaaaaaaagatgctgctgcaaaaaacacattattctactttgcagtaaactctcagataccctcacttaattacctacactggc

SEQ ID NO: 53420 - DNA, 201 bp, Homo sapiens
gtttttggaagctcctgcatgagcctcacctgagtgtgagactttgggcatcagatacaggactgccctttgggcttgtggcctagagtgtggactttatygctccagaggagaggcagagatccctcattaggaaaatcatgtacctccttatggacccctagtctgatgtagagtatgttacttttcctttacaccaga

SEQ ID NO: 53421 - DNA, 201 bp, Homo sapiens
cctgttttcttacccactaagcaacagtgggtactgttctggactgtctctcccagcctgaggctctgcaggtgtgggctgctctcaacctgtacttgtgytcagtttccaggcacttgggctggttggcctgcaggagtctgtaaggtacatcgcagtcctgaagaagactacacttgccctccatcacctctccagtgg

SEQ ID NO: 53422 - DNA, 201 bp, Homo sapiens
acaggcaatagctgcctcgttctactctctaggagctcctctttctcctcgagggacccgaagcatttgctttaacccaggcctgtctcttgttggtgttscatggagtgtgttgcactcagaatatcttgaaggctgtgagtatgggtgaaactccggagtatgcctggagtttcctttgcactgaggagaacactctca

SEQ ID NO: 53423 - DNA, 201 bp, Homo sapiens
cccctggatccaagaagttggttgtagccacagagaagaatgtgattgcagcattaaattcccgaactggggagatctgtgagtgaactgagaactgtgtstactggctgcctcagggatgaaagacttaccattgccaactctgcctggctgattcctgaataaggaacatgttggccaaaagatgcctctcctagtgga

SEQ ID NO: 53424 - DNA, 201 bp, Homo sapiens
caggcatggtggtgcgtgcttgtgatcccagctacttgggaggctgaggtgggaggatcacctgagcctcgggaggtagaggctgcagtgagccgtgatcrcaccactgcactgcagcctgggtgacagagtgagacgctgtctaaaaaaaaacacaacaaagaaaatgctatgaggcgggttatgaaatatccatgagca

SEQ ID NO: 53425 - DNA, 201 bp, Homo sapiens
aatctttcacgagcttcctgttaacgatgacttttctgtaggttagggtttcaactccgtggctgcagcacctgtctggagcctgtggtgtggtggatgargctgtcctggtgtgtcctgacccgagctcacgttccctccaaactttggctctggagacggaatgggagttgagacagatcccactgcaggtgagaggct

SEQ ID NO: 53426 - DNA, 201 bp, Homo sapiens
gttttctctctctctccagagcctgaaccccaacctgctggccgtggtgacagagagcacagacgcgcaccatgagcgcacctttattggcatcttcctcrttgatggcgtcactgggcgtatcattcactcctctgtgcagaagaaagccaaaggccctgtccatatcgtgcattcagagaactgggtggtggtaagcgg

SEQ ID NO: 53427 - DNA, 201 bp, Homo sapiens
gggtattatttatgccagctcatcattgtgcaccagggactgttctaagcttttaacttacacattaattgatttaaccctccaaacactctcatgaagcrgttgttcctgacctggttttaaaatgattctgtggcctggtgggatcgagtaccatagccagagtcacggagccagtaagaggtgtcactgcggttcaga

SEQ ID NO: 53428 - DNA, 201 bp, Homo sapiens
cagtctctcgacttagaatttggaagtggattccaaccccgggtcctgcctacccagcccaacccagtggacgcttcccgggcccagttcttcctgcactygtccccaagccactatgctctgctgcagtaccattatggaacgctgagtttgcttaaaaacttcccacaggtaactgcaggcaacatggtttgctaggat

SEQ ID NO: 53429 - DNA, 201 bp, Homo sapiens
tagattccagagaccatgctctttaccttgcttccttgcatctgtttacaaatctgtggtctccaatggaggagatttggagggcagtggcttcattgacrgaatcagggaaagagtgaatgatggtcctgggaactcgttgcaagtacgtctgttgggtgcaggttaaacagctgacaaagtaggaatgaagcaatggga

SEQ ID NO: 53430 - DNA, 201 bp, Homo sapiens
tctttgtactggggaacagggaacttggctgggcagatgcaaaagctacttatgctccctcattctggtcacttgccagctgccttcccattaggcctctwtttaaagtactcatatttgcatgtgttatcttctggggtggctaaaaaattacatagatctagtctctgcctgtaagtatcttacagtgctgtgaaatca

SEQ ID NO: 53431 - DNA, 201 bp, Homo sapiens
tttctttgtactggggaacagggaacttggctgggcagatgcaaaagctacttatgctccctcattctggtcacttgccagctgccttcccattaggcctytatttaaagtactcatatttgcatgtgttatcttctggggtggctaaaaaattacatagatctagtctctgcctgtaagtatcttacagtgctgtgaaat

SEQ ID NO: 53432 - DNA, 201 bp, Homo sapiens
tcctaactctttccttgggctctctgggtttttcaaggtcacagcttttccagccactcggaatgtcttgcgacagctacatgagcttgccccttccatcytcttctatttggtggatgcagagcagggacggctgtgtggatatcggcttcgaaaggtaggaaggcatgtcctggcacaaccctttgtggatgagatgca

SEQ ID NO: 53433 - DNA, 201 bp, Homo sapiens
gactcaaaacttcaaattctggcctggcatggtgtctcacgcctgtaatccctgcactttgggagcctgaggtgggtagatcacttgagctcaggagttcragaccagcctgggcaaccccatctctacaaaaagtacaaaaaattagccaggcatggtggtgcgtgcttgtgatcccagctacttgggaggctgaggtgg

SEQ ID NO: 53434 - DNA, 201 bp, Homo sapiens
tggtaaaaataggatatgaaagataaaaaatggtacactggtatagggcacttaacatgaatgtatcttgcagaactaggagttgttctggggttagtcagtaagtggttggtgagtaaatgtaaaggcttaggacattactgtacactactgtggactttataaatactgtgcatttagactatactaaatttataaaat

SEQ ID NO: 53435 - DNA, 201 bp, Homo sapiens
ctcccgggttcacgccattctcctgcctcagcctcccgagtagctggaactacaggcgcccaccatcatgcctggctaattttttgtatttttagtagagrggggtttcaccatgttagccaggatggtctcgatctcctgacctcgtgatctgcccgccttggcctcccaaagtgctgggattacaggcgtgagccactg

SEQ ID NO: 53436 - DNA, 201 bp, Homo sapiens
atggtaaaaataggatatgaaagataaaaaatggtacactggtatagggcacttaacatgaatgtatcttgcagaactaggagttgttctggggttagtcagtaagtggttggtgagtaaatgtaaaggcttaggacattactgtacactactgtggactttataaatactgtgcatttagactatactaaatttataaaa

SEQ ID NO: 53437 - DNA, 201 bp, Homo sapiens; identical to SEQ ID NO: 11645

SEQ ID NO: 53438 - DNA, 201 bp, Homo sapiens
tatggtaaaaataggatatgaaagataaaaaatggtacactggtatagggcacttaacatgaatgtatcttgcagaactaggagttgttctggggttagtcagtaagtggttggtgagtaaatgtaaaggcttaggacattactgtacactactgtggactttataaatactgtgcatttagactatactaaatttataaa

SEQ ID NO: 53439 - DNA, 201 bp, Homo sapiens
gctccagaggtctccctgcctcctgagtcctttccagaaacccagttgctgctttggttttcttaggatctcaaattccctggatggcagcaaagcgtgcyggttagggcactgggctcaggaatcagattgcctaggtttaatcttacctcttccgtttcctgactgtataaccttgaactagttatgtacacgctctgt

SEQ ID NO: 53440 - DNA, 201 bp, Homo sapiens
gttaggatccagctgtgtttgaccccaaagcctgttttcttacccactaagcaacagtgggtactgttctggactgtctctcccagcctgaggctctgcasgtgtgggctgctctcaacctgtacttgtgttcagtttccaggcacttgggctggttggcctgcaggagtctgtaaggtacatcgcagtcctgaagaagac

SEQ ID NO: 53441 - DNA, 201 bp, Homo sapiens
aagggaggttttctctctctctccagagcctgaaccccaacctgctggccgtggtgacagagagcacagacgcgcaccatgagcgcacctttattggcatyttcctcattgatggcgtcactgggcgtatcattcactcctctgtgcagaagaaagccaaaggccctgtccatatcgtgcattcagagaactgggtggtgg

SEQ ID NO: 53442 - DNA, 201 bp, Homo sapiens
tggtctcacagcacaggaatggagtgtgtgatgagtcgtcgtggttctaagggaggttttctctctctctccagagcctgaaccccaacctgctggccgtrgtgacagagagcacagacgcgcaccatgagcgcacctttattggcatcttcctcattgatggcgtcactgggcgtatcattcactcctctgtgcagaaga

SEQ ID NO: 53443 - DNA, 201 bp, Homo sapiens
ccaaacaggaagctcttttcaccagaaaccctgattcctctgccaggctggagagctccaggttggtctcacagcacaggaatggagtgtgtgatgagtcrtcgtggttctaagggaggttttctctctctctccagagcctgaaccccaacctgctggccgtggtgacagagagcacagacgcgcaccatgagcgcacct

SEQ ID NO: 53444 - DNA, 201 bp, Homo sapiens
aaaattttttttaaattttttatttttgtagaagatagagatcaacctaggaaacatagtaaaaccctgtcttcaaaaaaaaatttttttttaattttttrtttttatattgacagggtctcactatgttgcctaggttggtctctatctcctggcctcaagcagttctcttaccttagcctcccaaagtgttgaggttag

SEQ ID NO: 53445 - DNA, 201 bp, Homo sapiens
acggacagggtaagcagagtcctcccgtgtctccattgtgcggccagctccctgtcccattccttggctccttgatctgtacagggtctggtagggaaagragactggggactcctgacagtgaaggacaggtacctgtttaacatgtatttgcatccagaaatcagaggtgaggccactgctcacagtgggaccctagga

SEQ ID NO: 53446 - DNA, 201 bp, Homo sapiens
tcctgttgcttctcacttctcttccttgagcagaggtgggtggaaaataagataagcagaggttctgctccttttttagtgagttattaccatgtaccagscaccacgctaaatcctttatgtacatcgtatgatgtaattttggaacagtccagtgggttacatgccactttacagatgaggaaccagaagcaaaaaggt

SEQ ID NO: 53447 - DNA, 201 bp, Homo sapiens
actttcatgtctctcagtgtggcgccatgttgacaagggcacggcagaaggggctgtggatgccatgctgctgcacggacagggtaagcagagtcctcccstgtctccattgtgcggccagctccctgtcccattccttggctccttgatctgtacagggtctggtagggaaaggagactggggactcctgacagtgaagg

SEQ ID NO: 53448 - DNA, 201 bp, Homo sapiens
aacttattttccacaaagagggcaaagactagagaacccccacagttgttgagctggagtcccagctcttcaggtctatccctaggatttgcagtcttttyttgttggtggagcctgacagtttgctcattttaggagtcgggaatgagttctctgtatgtcttcaatcccatttttgggaagtggagtcaggtagctccc

SEQ ID NO: 53449 - DNA, 201 bp, Homo sapiens
gaatcccgagcgtcccgtccgaccgagggcctcgcgcgctatcccagctctgtggtcccgcggaggcggagcccgcggcgcggtgcatgccgggacggcgrtgggtggtgcatgcgctcgcatcatggcggctgagtgggcttctcgtttctggctttgggctacgctgctgattcctgcggccgcggtctacgaagacca

SEQ ID NO: 53450 - DNA, 201 bp, Homo sapiens
ttgatctgggtattgtggaaacagcccagtgccctctaaagctggccatggtcccaactgccaggatgaacttgattcactctgctctgattcagtcctgycccccaccctctctcttctctccattcatccagccctccaacggatagctgttgagggcctgctctggaccaggcactctgctaggcaatgcacattttc

SEQ ID NO: 53451 - DNA, 201 bp, Homo sapiens
tactgaaccttttcaaattctgagggtgaggaacaaaaagccttcagtgagggataacactggttctagttttcaaggacagactcagttctttggtttcyctttctagtagtgagccaagtatttgtttatcttgcagctttttggcattgagagcagctctggcaccatcctgtggaaacagtatctacccaatgtcaa

SEQ ID NO: 53452 - DNA, 201 bp, Homo sapiens
ggactgtttggagaagtactctgtggtgtgtactcacaaacagctctcccatcctgtcctgtaaggccttttgagaggcatagagtttaaccaatttgctrgattggaagtctaggtttgtcacttactaactttgtgaccttgggctctggtcttctgttttcttatctgtaaaataaggtgataagtacctgtctcata

SEQ ID NO: 53453 - DNA, 201 bp, Homo sapiens
cagaatatcttgaaggctgtgagtatgggtgaaactccggagtatgcctggagtttcctttgcactgaggagaacactctcaaactggggtgctagggcgwgccatgctacgggagccactcactcgctcatggttatggtactttgtgccttctgacttctagttcaagttctagttctagttctagttctgactgagcc

SEQ ID NO: 53454 - DNA, 201 bp, Homo sapiens
gtcctgcctacccagcccaacccagtggacgcttcccgggcccagttcttcctgcacttgtccccaagccactatgctctgctgcagtaccattatggaaygctgagtttgcttaaaaacttcccacaggtaactgcaggcaacatggtttgctaggattcaggagatctctccaagacatggatgctagaaggcagtgct

SEQ ID NO: 53455 - DNA, 201 bp, Homo sapiens
tcccagtcatggatcaagactacgccaaggtgttgctgttgatagatgatgaatacaaggtactgtcttcagaggggatggagaacatgctagcggagtcsggtttggggccaggtggtcaaacacagcggcccggagatggagtgctctctgcacccagcacgtgtttgggctctaaggccatcccgaagagaaatgatg

SEQ ID NO: 53456 - DNA, 201 bp, Homo sapiens
gtgtgattagagcatggatgaatggcgtggtacccgtggagtactcaggttcttccatggaaaggtctgggagaccccagcatcattatgttggctcctamgaatatgtatcacttactggcatccagataatagctacattgtttagacatcaaataatgccatggcctgtacctctgttaagtccaggctttgactcct

SEQ ID NO: 53457 - DNA, 201 bp, Homo sapiens
tagtagagatggggtttggccatgttggccaggttggtcttgaactcctgacctcaagtgatccgcccgccttggcctcccaaagtgctgggattacaagmatgagccactgctcctggctcatttttctagttctgatctctattccttcctgcacaaaggcctcaaataatgaactgtaggatgtgtctaactccagct

SEQ ID NO: 53458 - DNA, 201 bp, Homo sapiens
gttcttcctgcacttgtccccaagccactatgctctgctgcagtaccattatggaacgctgagtttgcttaaaaacttcccacaggtaactgcaggcaacrtggtttgctaggattcaggagatctctccaagacatggatgctagaaggcagtgcttttgaatctggaaacgtttgctcttaggcccaagattgatgaca

SEQ ID NO: 53459 - DNA, 201 bp, Homo sapiens
tacaggcatgagccaccgcacccggccagcagcaagcagtttttgagtgctagctggatgcaggcactcatttagacactgggatataaaatgggcaaaayagacaaaacttcctgacctcgtgaggctttcatcatagttgggtgaggctaataataaagaaaataaataggtaaattagatagtatattagaaagtgac

SEQ ID NO: 53460 - DNA, 201 bp, Homo sapiens
cagagcaagtgggaaatgacttcaccacgatcttttcttttccagatgtgatcactgtgtccaatggaggccgaatcatgcgttcctgggagactaacatygggggcctgaactgggagataaccctggacagtggcaggtaggggagaaactggattttatcttgactgagttaaaggcttcaccggaacacagatctgc

SEQ ID NO: 53461 - DNA, 201 bp, Homo sapiens
aatgtcgcaaggaggtagtgatcacctgcgtcacgtggtactagtgggtcaagtaagttgagggccaagacttagccactggatttagcgatggggagggsggtggtgaccctcagaagaaaaatatcactgcagcatttgtccctaggtcaatgagtgggcagacctggattttgtcttgggttaccatttgctatctgt

SEQ ID NO: 53462 - DNA, 201 bp, Homo sapiens
ccttgggcaaccacacttaaggacagagcaagggacacattgctggcagagccttgttgaaccacctgtaagggaaaggtggtgaggagggctatatatcrgtggaaaaagtttcttagttcatctttgccacctatgaaggtgaccacttctctctcagttctcatcttttttttgtttttcgagacagggtctcactct

SEQ ID NO: 53463 - DNA, 201 bp, Homo sapiens
tggcgcgatctcatggctcaccacaacctccgcctctggggttcaagcgattctcctgcctcagcctcccgagtagctgggattacaggcatgcgccaccrcacccagctaatttttgtatttttggtagagacagggtttctccatgttggtcaggctggtctcaaactcccgatctcaggtaatccacccgcctaggcc

SEQ ID NO: 53464 - DNA, 201 bp, Homo sapiens
cctgccatggcccagttacttcccccggcaaagtagggcagaggttgtgagcctgggatgggtcagggagtcgtcagctgttagccataatcctcctcctycttgccttccagtctctcgacttagaatttggaagtggattccaaccccgggtcctgcctacccagcccaacccagtggacgcttcccgggcccagttct

SEQ ID NO: 53465 - DNA, 201 bp, Homo sapiens
gaaagttaagaaaccagtgtcttcaaaagtgagaaccttcattcagacccatgcgtatcattggattattatttttggctatgtaagggagcctcattgasccatttttttgttttaaattcttatttaaatgtctgcaataatgacatttttgtaactggcccttgctggacactggatcggtgtgaacattcacttcct

SEQ ID NO: 53466 - DNA, 201 bp, Homo sapiens
gtgttgggattacaggtgtgagccactgcgcccagctaacaaacacgtcttatgtgtcctaaaatgaatgtgatggtgatagccctgtgattttttttccrgagcattttgtggaatggtgattttagctccttatggtcccctgtactctttttttctcaggagacagcaatatgttgggaaggtcaagtttgcctcctt

SEQ ID NO: 53467 - DNA, 201 bp, Homo sapiens
ccccacagcctggactcctcatcactacccagtattgcctctgtgtgcatctggttgtgttcctcagctgcttgggctgtggcttcttcgtttctaaagcrgaaagtctaatcccggcctcctgctcactttgtggggtgtgattagagcatggatgaatggcgtggtacccgtggagtactcaggttcttccatggaaag

SEQ ID NO: 53468 - DNA, 201 bp, Homo sapiens
attcaggtctaaccccacagcctggactcctcatcactacccagtattgcctctgtgtgcatctggttgtgttcctcagctgcttgggctgtggcttcttygtttctaaagcggaaagtctaatcccggcctcctgctcactttgtggggtgtgattagagcatggatgaatggcgtggtacccgtggagtactcaggttc

SEQ ID NO: 53469 - DNA, 201 bp, Homo sapiens
ccctccaaacactctcatgaagcggttgttcctgacctggttttaaaatgattctgtggcctggtgggatcgagtaccatagccagagtcacggagccagyaagaggtgtcactgcggttcagattcaggtctaaccccacagcctggactcctcatcactacccagtattgcctctgtgtgcatctggttgtgttcctca

SEQ ID NO: 53470 - DNA, 201 bp, Homo sapiens
agcttttaacttacacattaattgatttaaccctccaaacactctcatgaagcggttgttcctgacctggttttaaaatgattctgtggcctggtgggatygagtaccatagccagagtcacggagccagtaagaggtgtcactgcggttcagattcaggtctaaccccacagcctggactcctcatcactacccagtatt

SEQ ID NO: 53471 - DNA, 201 bp, Homo sapiens
ctgggcagtatgccagacctagagacgcaggaggccaccaaagagagttgggggaagagctttggttaggagcaggtcctagagttcccagcttcaaatgrggtttcctaagtactgtaaattaaatgatgtttctcttaatctcattttaccgggagattaggaggtagaatccctagagtctgtttctagccactttct

SEQ ID NO: 53472 - DNA, 201 bp, Homo sapiens
ctaagaagacaaaaacaaaagcttcatttcagtgactgggaagtgaccctttggctgaattttctcctgtccttctctttctcatagcagaaaagtagcarttctgaagatgggtcaatggggagcttttcggagaagtctagttcaaaggtatggtgtggcactgggcagtatgccagacctagagacgcaggaggccac

SEQ ID NO: 53473 - DNA, 201 bp, Homo sapiens
caagtgctaagaagacaaaaacaaaagcttcatttcagtgactgggaagtgaccctttggctgaattttctcctgtccttctctttctcatagcagaaaastagcagttctgaagatgggtcaatggggagcttttcggagaagtctagttcaaaggtatggtgtggcactgggcagtatgccagacctagagacgcagga

SEQ ID NO: 53474 - DNA, 201 bp, Homo sapiens
atgattcccctggagggtctttctcctagactcttcctgagcagtggaagccattcaggcctctggctgaactggtgtaagaggaaatcagtcactttccyctttggggaacttgaactggagcatttggagccacctgccatggcccagttacttcccccggcaaagtagggcagaggttgtgagcctgggatgggtcag

SEQ ID NO: 53475 - DNA, 201 bp, Homo sapiens
ggagtccctggcagaagtggtgtgcctagagatggtggacctccccctgactggggcacaggccgagctggaaggagaatttggcaaaaaggcaggtatgracctaagaggttggagctgcagagttgctggaggggccagtctggaaatgaccacaagagacactgtatcatgcatctctggcttcctaggctgggcaga

SEQ ID NO: 53476 - DNA, 201 bp, Homo sapiens
ctagtgttgccacatcttctaaccgtaggaaaatttagaaatctgattgtgaagtataatatcttctaaatgttgacaactaattcaaattaagaacaacwacaacaaaagcccccaaactgtgtgagccaaacaaaacctatttgggaattactagtttgtgacatctggctgaggcctggcagcccctgaggataatcc

SEQ ID NO: 53477 - DNA, 201 bp, Homo sapiens
attgttttgaagattaatgataacatgtaaagtgattagaatagtgcctgccacatacttaacattattattagtgctattgactctttttttttttttttgagacagggtcttgccatgttgcccaggctggagtgcagtggtgtgatcacagctcactgcagctttgacctcccgggcttaagcagtcctcccatctca

SEQ ID NO: 53478 - DNA, 201 bp, Homo sapiens
tccaaacaggaagctcttttcaccagaaaccctgattcctctgccaggctggagagctccaggttggtctcacagcacaggaatggagtgtgtgatgagtygtcgtggttctaagggaggttttctctctctctccagagcctgaaccccaacctgctggccgtggtgacagagagcacagacgcgcaccatgagcgcacc

SEQ ID NO: 53479 - DNA, 201 bp, Homo sapiens
ttgatggttctccttcatggatctgtagctaattagaggggtgccttccagtgcaatttccctttccagttgaagcagctgctaagccctgagctgccacstcctatccctgcagtaccagtactggaacaccaaggctcggcgcaacgagtttaccgtactggagctctatgagggcactgagcaatacaacgccaccgc

SEQ ID NO: 53480 - DNA, 201 bp, Homo sapiens
acttcccgtgtgccgaggcagtccctgaatcccgagcgtcccgtccgaccgagggcctcgcgcgctatcccagctctgtggtcccgcggaggcggagcccscggcgcggtgcatgccgggacggcggtgggtggtgcatgcgctcgcatcatggcggctgagtgggcttctcgtttctggctttgggctacgctgctgatt

SEQ ID NO: 53481 - DNA, 201 bp, Homo sapiens
cgtatcattcactcctctgtgcagaagaaagccaaaggccctgtccatatcgtgcattcagagaactgggtggtggtaagcggtcactaccagggacccarggtagctccagaggtctccctgcctcctgagtcctttccagaaacccagttgctgctttggttttcttaggatctcaaattccctggatggcagcaaagc

SEQ ID NO: 53482 - DNA, 201 bp, Homo sapiens
ttccccttctggcctggctccttctctagggtatttgcccccaatccttggacttcctttggtgggctttgctttcgggggatacctgtagttgacacgtsctgtctgtactcctaggactctctggcttgcttcaatcagacctacaccattaacctatacctcgtggagacaggtcggcggctgctggacaccacgata

SEQ ID NO: 53483 - DNA, 201 bp, Homo sapiens
gtgagccaaggggacacaggggagaacaggtcccatgcaggaaacaaatgaaaatttttgtatttgtccccactccctttttgtcaccactcccccccccmcacacacacacctgtctctttatgtttttctatagtttcccatggtctccgtctttgtctttgcctctttccctttgctacaggctggaaattccttgtt

SEQ ID NO: 53484 - DNA, 201 bp, Homo sapiens
gaaggggggaggggagaggtcagagccaaaccacccccgcagctcctgacagaaccagaaattccagcgcaaccgaggaggcgggagagaaagagagagaracagacagagacagagctacgcacagccagggaggggagggggctcacacacatgggaatggaaccccccatacacatgcagtgggcaggaggcagtaat

SEQ ID NO: 53485 - DNA, 201 bp, Homo sapiens; identical to SEQ ID NO: 11661

SEQ ID NO: 53486 - DNA, 201 bp, Homo sapiens; identical to SEQ ID NO: 11663

SEQ ID NO: 53487 - DNA, 201 bp, Homo sapiens; identical to SEQ ID NO: 11662

SEQ ID NO: 53488 - DNA, 201 bp, Homo sapiens
gggaatgaagctggccagcagcgtccactgtgggggagactgggctcctacattcactttagtatgggtgacttcacttcagtgttgagactgctgagtgwttagaggggaaggtgaggattgtgttttgggggagagggaggtccagccatcccaggtcggtgctggtcagcctcagcgctcaagttcttcttgccccag

SEQ ID NO: 53489 - DNA, 201 bp, Homo sapiens; identical to SEQ ID NO: 11665

SEQ ID NO: 53490 - DNA, 201 bp, Homo sapiens; identical to SEQ ID NO: 11664

SEQ ID NO: 53491 - DNA, 201 bp, Homo sapiens
ggaatgaagctggccagcagcgtccactgtgggggagactgggctcctacattcactttagtatgggtgacttcacttcagtgttgagactgctgagtgtktagaggggaaggtgaggattgtgttttgggggagagggaggtccagccatcccaggtcggtgctggtcagcctcagcgctcaagttcttcttgccccaga

SEQ ID NO: 53492 - DNA, 201 bp, Homo sapiens; identical to SEQ ID NO: 11666

SEQ ID NO: 53493 - DNA, 201 bp, Homo sapiens
aggatggctgggctccagccagccaggccttggggtgcagagaggcagaccctgccgagctgctcccaccatggaaagtctggtcctagtgtagatctgtraaaggggaactggggaatggggggacagagaaaagaggatgaaggagcaggaaggaggagcatcaataagggaagctcagatggcacttccaccaaccca

SEQ ID NO: 53494 - DNA, 201 bp, Homo sapiens
cggccgcagtgcttccatcctcagctgagggggaagcagagatacaggcagcaccgagctgttcagctccttgtcactcaggaccccacaggagaggaggmggccccgggcattcctaggaagctgtgggtgctgacctctgtcttcccacctcagaaagctcccatgtagtgtcaaaaccaaagcaagcgtctgatggat

SEQ ID NO: 53495 - DNA, 201 bp, Homo sapiens; identical to SEQ ID NO: 11667

SEQ ID NO: 53496 - DNA, 201 bp, Homo sapiens
gaaaagaggatgaaggagcaggaaggaggagcatcaataagggaagctcagatggcacttccaccaacccaggagtggggagcaggctaggagttgtgggkatggggatggggatgcccagcttggaagcagaggagcccaaagcagtgatgctttgtgtgtggaagggggaagagggagtgggcaggcggagggccgggc

SEQ ID NO: 53497 - DNA, 201 bp, Homo sapiens
gcagctcagcctgcacgaggtgagaacccccaggcctcctaggattgcccttgacttccaggtctccagccgcttacctctgcgagtttctacagtctccractatctttcattatctcttgaccaggaccccaggccctgatcccctccccaacaggcccctaccccagcggccgcagtgcttccatcctcagctgaggg

SEQ ID NO: 53498 - DNA, 201 bp, Homo sapiens
gctaggagttgtgggtatggggatggggatgcccagcttggaagcagaggagcccaaagcagtgatgctttgtgtgtggaagggggaagagggagtgggcmggcggagggccgggcagccgctgggctgagagtgacgcagcagacaaagccaccaaccctggcttggtatttttaaactgtgcgtgggtgggaagtgggg

SEQ ID NO: 53499 - DNA, 201 bp, Homo sapiens; identical to SEQ ID NO: 11668

SEQ ID NO: 53500 - DNA, 201 bp, Homo sapiens; identical to SEQ ID NO: 11669

SEQ ID NO: 53501 - DNA, 201 bp, Homo sapiens
ttgggaaggggggaggggagaggtcagagccaaaccacccccgcagctcctgacagaaccagaaattccagcgcaaccgaggaggcgggagagaaagagasagagacagacagagacagagctacgcacagccagggaggggagggggctcacacacatgggaatggaaccccccatacacatgcagtgggcaggaggcag

SEQ ID NO: 53502 - DNA, 201 bp, Homo sapiens; identical to SEQ ID NO: 11670

SEQ ID NO: 53503 - DNA, 201 bp, Homo sapiens; identical to SEQ ID NO: 11671

SEQ ID NO: 53504 - DNA, 201 bp, Homo sapiens
gagtgagccaaggggacacaggggagaacaggtcccatgcaggaaacaaatgaaaatttttgtatttgtccccactccctttttgtcaccactcccccccmcccacacacacacctgtctctttatgtttttctatagtttcccatggtctccgtctttgtctttgcctctttccctttgctacaggctggaaattccttg

SEQ ID NO: 53505 - DNA, 201 bp, Homo sapiens
agttagtgggcaaagggaggcagcggggagtggagatgggtggagctggacttgggaatggggtccagagggcggaggtcgaggggaggacgtggggaagsaggacgggggtggggggtggagactgatggaaaagggggtgcgtcttcgaattagggggccctgggagcaggcaagcatctgatgaagctggatatgaaa

SEQ ID NO: 53506 - DNA, 201 bp, Homo sapiens
ttttaaatttaggaattgtggataaaggatttgcaggccacgaatatttgatgaaggctattccagagttttgagaaggaacactccattccacatactcmgtcacccaagctaggagcctgagagtcaccctaaaccctcattctctcctctcaacccctcagccaatcaatcaagtcctgtcgatcttattttctatat

SEQ ID NO: 53507 - DNA, 201 bp, Homo sapiens
tacgcacagccagggaggggagggggctcacacacatgggaatggaaccccccatacacatgcagtgggcaggaggcagtaattcaataaacctaaactgwgcccatcttcacagctttctttgcccctgcttctgttcccaaccacctctgtctgcagccagtcaccctgcagtctcctaactgcccccttttccctgca

SEQ ID NO: 53508 - DNA, 201 bp, Homo sapiens; identical to SEQ ID NO: 11688

SEQ ID NO: 53509 - DNA, 201 bp, Homo sapiens; identical to SEQ ID NO: 11673

SEQ ID NO: 53510 - DNA, 201 bp, Homo sapiens; identical to SEQ ID NO: 11691

SEQ ID NO: 53511 - DNA, 201 bp, Homo sapiens
gaggcagcggggaagttcgaattctgactctcctggctgccctccctccacagctcaccatcaacgaggctgctgcccagttctgcatgagggacaacacrctcttattacggagagtggagctcttctctttgtcccgccaagtagcccgagagagcacctacttgtcctccttgaagggctccaggtgagaccccttcc

SEQ ID NO: 53512 - DNA, 201 bp, Homo sapiens
gaagaggagatccgcaaatacagcatcatctatggccgtttcgactctaagcggcgggagggcaagcagctcagcctgcacgaggtgagaacccccaggcytcctaggattgcccttgacttccaggtctccagccgcttacctctgcgagtttctacagtctccgactatctttcattatctcttgaccaggaccccagg

SEQ ID NO: 53513 - DNA, 201 bp, Homo sapiens
ccctacaacaatagtgcttgaactagagactctttctcggccagcttcttggcaaaggttttaaataacacatgcctctggctgggttctgtgctctgccrgtcgagtggccctcgtcagcctcatccactttattcttacccatcttttcaggcttcaccctgaagaactgggaggccctccactgaagaagctgaaaca

SEQ ID NO: 53514 - DNA, 201 bp, Homo sapiens
cagatggcacttccaccaacccaggagtggggagcaggctaggagttgtgggtatggggatggggatgcccagcttggaagcagaggagcccaaagcagtsatgctttgtgtgtggaagggggaagagggagtgggcaggcggagggccgggcagccgctgggctgagagtgacgcagcagacaaagccaccaaccctggc

SEQ ID NO: 53515 - DNA, 201 bp, Homo sapiens; identical to SEQ ID NO: 11674

SEQ ID NO: 53516 - DNA, 201 bp, Homo sapiens; identical to SEQ ID NO: 11675

SEQ ID NO: 53517 - DNA, 201 bp, Homo sapiens; identical to SEQ ID NO: 11676

SEQ ID NO: 53518 - DNA, 201 bp, Homo sapiens; identical to SEQ ID NO: 11770

SEQ ID NO: 53519 - DNA, 201 bp, Homo sapiens
actttctcatgggcctgctttcgtgcttctgacctcttttcaccccagtcttaacaactatcaggccacagcactgtaacctagaaaaaacagcatgtttrtgagcgatatcaggggctgtggaggggtaggccacaggcaggtgggagggatgaaggccggcccgaggaataacaagacggtagcctgcagtgctctctt

SEQ ID NO: 53520 - DNA, 201 bp, Homo sapiens; identical to SEQ ID NO: 11771

SEQ ID NO: 53521 - DNA, 201 bp, Homo sapiens; identical to SEQ ID NO: 11772

SEQ ID NO: 53522 - DNA, 201 bp, Homo sapiens; identical to SEQ ID NO: 11773

SEQ ID NO: 53523 - DNA, 201 bp, Homo sapiens
agcaaaaactgcagaaccctccactagttatgttgatgactcagaagttgagcaagactgtgtgtgtgtgtgtgtgtgtgtgtgtgtgtgtgtgtgtgtgtgtgtgtgtggtgttgtgattgcaatgggctctgtttgtgagcctgcctgcacgtgtgtgtgtgtgtgtgtgtgtgtgtgtgtgtagtcttgtggtcaggg

SEQ ID NO: 53524 - DNA, 201 bp, Homo sapiens
gccaccacgccctgctaattttgtttttgtatttttagtagagatggggtttcactgtgttagccaggatggtcttgatctcctgacctcgtgatctgccygcctcggcctcccaaagcgctgggattacaggcatgagccactgcgcctggccgagccttgtggttttcaaattatctcatggagtcctagaattttgag

SEQ ID NO: 53525 - DNA, 201 bp, Homo sapiens
gcccggccctccgcctgcccactccctcttcccccttccacacacaaagcatcactgctttgggctcctctgcttccaagctgggcatccccatccccatmcccacaactcctagcctgctccccactcctgggttggtggaagtgccatctgagcttcccttattgatgctcctccttcctgctccttcatcctcttttc

SEQ ID NO: 53526 - DNA, 201 bp, Homo sapiens
tttccggagccactacaagcgtgagctggaactggcagctctgattccttcctgtcacccacttcctccctgctccccgctgccctcctctccctgcccgygtgtcatcctgatgtcactccctatttcatagctgtgcttctcttacttccccatgatccatgcccaccttttccacctcccttcctccctaaccccaga

SEQ ID NO: 53527 - DNA, 201 bp, Homo sapiens
ccccacttcccacccacgcacagtttaaaaataccaagccagggttggtggctttgtctgctgcgtcactctcagcccagcggctgcccggccctccgcckgcccactccctcttcccccttccacacacaaagcatcactgctttgggctcctctgcttccaagctgggcatccccatccccatacccacaactcctagc

SEQ ID NO: 53528 - DNA, 201 bp, Homo sapiens
ctgcctcctgcccactgcatgtgtatggggggttccattcccatgtgtgtgagccccctcccctccctggctgtgcgtagctctgtctctgtctgtctctstctctttctctcccgcctcctcggttgcgctggaatttctggttctgtcaggagctgcgggggtggtttggctctgacctctcccctccccccttcccaa

SEQ ID NO: 53529 - DNA, 201 bp, Homo sapiens
ctccctcccttccccttcaaggggctgaagacaaaaggtgcccctgtcctggtcaagccaatcgacccagccttgttatgggttggggtggggagaaatgwgtcctcctgatggctggggaagaagaggggttggatatttctagccagggccatgccaggaggctggtcactctgcaaggggatgcagaggaaagcggtg

SEQ ID NO: 53530 - DNA, 201 bp, Homo sapiens
tcccagcggcggcgccgagttaaccctcctcgtgctgaactggctccacctccccgcctgcccccaccgccacattcacgcattgggcaactcagagaagmtgttttaactttcgatcctgtggtcccacaatcagaggactcgggcagataggggttgagataagcgagtttaggccaccaagcgggcggacgaggatcc

SEQ ID NO: 53531 - DNA, 201 bp, Homo sapiens
gaggtaggggcggctggtggggagcttgagcccaagacccgggcatcgctgactggccggctggatgaagtcctgagaaccctcgtcaccaggtattcccygggagctcccagtctggcctagaacagacctcgggaagaaaagaagggggctagagctgtggggagggcaccagcagggacctagcccccaactcccctt

SEQ ID NO: 53532 - DNA, 201 bp, Homo sapiens
tgggattcatgcacactggggcccgggtgagtgggggtgagcaagagcatggagtgcacagggcagggaatggtagtggatagcagcaaacacttcggaascacttcctatagaccagggcactctattaaatgatacatacgcacatgcgtgccagcacacacacgtctggttttcacaataacattatgaggtaggcag

SEQ ID NO: 53533 - DNA, 201 bp, Homo sapiens
ctggttttcacaataacattatgaggtaggcagtattatcagcctcattttatagataaggacattgagacagagagtttaagtagtttgtcccagtcacmcagctaagtgttggagctggtatttgaaacctggaggtctggttccatagcgatgactaataaccacttctctacggtgaggccctgattgagcttcaga

SEQ ID NO: 53534 - DNA, 201 bp, Homo sapiens
ccaggtattccccgggagctcccagtctggcctagaacagacctcgggaagaaaagaagggggctagagctgtggggagggcaccagcagggacctagccsccaactccccttgtgtcctcctcactcccagttgcttcctggtggagaagcagcccccccaggtactgaagactcagaccaagttccaggctggagttcg

SEQ ID NO: 53535 - DNA, 201 bp, Homo sapiens
cttcctgctttaatgctttccttgttctttgcctgaataattcttatgtcccttcaagattcatttcaggctgggcacggtggctcacgcctgtaatcccraaactttgggaggtcgaggcaggaagatcacttgagttcaggagtttgagagcctggacaacatattgagaccctgttctatgagagagagagagagagg

SEQ ID NO: 53536 - DNA, 201 bp, Homo sapiens
tttcatatccagcttcatcagatgcttgcctgctcccagggccccctaattcgaagacgcacccccttttccatcagtctccaccccccacccccgtcctscttccccacgtcctcccctcgacctccgccctctggaccccattcccaagtccagctccacccatctccactccccgctgcctccctttgcccactaact

SEQ ID NO: 53537 - DNA, 201 bp, Homo sapiens
ggaaggggtctcacctggagcccttcaaggaggacaagtaggtgctctctcgggctacttggcgggacaaagagaagagctccactctccgtaataagagygtgttgtccctcatgcagaactgggcagcagcctcgttgatggtgagctgtggagggagggcagccaggagagtcagaattcgaacttccccgctgcctc

SEQ ID NO: 53538 - DNA, 201 bp, Homo sapiens
agcttcacacttggccccggcaaactccccatccagctccaggtgaaccgtggcccagccctgccccaatctgggaccccgagtcctcctccaatgccacrcacaagggccctggaccctcacctcttgtgactgccccataccccatgtgtctgggattcatgcacactggggcccgggtgagtgggggtgagcaagagc

SEQ ID NO: 53539 - DNA, 201 bp, Homo sapiens
ctacagagggcctagatggagaataaggagcgagaaaggaactgctgagcttttggctgtggggtaaagggtcaggagagctgaggaagccctggcctgargtagcctcatcctgatcttcctgcagggagttcctggtcggctccgacgccttctgctgcaacttggctagtgccctactttcagacactgtccagcacc

SEQ ID NO: 53540 - DNA, 201 bp, Homo sapiens
gccagggttggtggctttgtctgctgcgtcactctcagcccagcggctgcccggccctccgcctgcccactccctcttcccccttccacacacaaagcatsactgctttgggctcctctgcttccaagctgggcatccccatccccatacccacaactcctagcctgctccccactcctgggttggtggaagtgccatctg

SEQ ID NO: 53541 - DNA, 201 bp, Homo sapiens
tggctcctccctcccttccccttcaaggggctgaagacaaaaggtgcccctgtcctggtcaagccaatcgacccagccttgttatgggttggggtggggaraaatgtgtcctcctgatggctggggaagaagaggggttggatatttctagccagggccatgccaggaggctggtcactctgcaaggggatgcagaggaaa

SEQ ID NO: 53542 - DNA, 201 bp, Homo sapiens
tcaagggtgtggctggggcgtgagcaagccccagatgtagacctcatggtggcccagacgagggggaatttccccctcaaaactgctccacgcttggctgstgtagacgctgagatttcccagcggcggcgccgagttaaccctcctcgtgctgaactggctccacctccccgcctgcccccaccgccacattcacgcatt

SEQ ID NO: 53543 - DNA, 201 bp, Homo sapiens
ccccagccaagcctccgctggtcagggccgacatggtgacagagaagcaggcgcgggagctgagtgtgcctcagggtcctggggctggagcgtaagctggrattggacctggggttggagaagggctgttagggtgatggaggcagcctggagggctggcactgaaaagagcaagggatggggagggagggccatgggatg

SEQ ID NO: 53544 - DNA, 201 bp, Homo sapiens
aaagctgtgtaagtccagtcgtggatcacttaatgaaggagcattttctgtctttggcagtttcataattatgcgaataccattgagtataattacacaamcctagatggtatagactactatacactgaggctatattgtgtagcctattgatcctagctttaaacccgagcagcatgatactgttctgaatagtataag

SEQ ID NO: 53545 - DNA, 201 bp, Homo sapiens
gtgtcctggacctcaccaaacgctgtctccggagctactggtctgaccggtgagtccccaccctgggtagtctgagcagccatacaccagtcacctccatmctcactgcccatgccccatcctctccttcatcccggccaggctgatcattggcttcatcagcaaacagtacgttactagccttcttctcaatgagcccga

SEQ ID NO: 53546 - DNA, 201 bp, Homo sapiens
catagtgcatggctcatagcaaaagctgtgtaagtccagtcgtggatcacttaatgaaggagcattttctgtctttggcagtttcataattatgcgaataycattgagtataattacacaaacctagatggtatagactactatacactgaggctatattgtgtagcctattgatcctagctttaaacccgagcagcatga

SEQ ID NO: 53547 - DNA, 201 bp, Homo sapiens
attactgcctcctgcccactgcatgtgtatggggggttccattcccatgtgtgtgagccccctcccctccctggctgtgcgtagctctgtctctgtctgtytctctctctttctctcccgcctcctcggttgcgctggaatttctggttctgtcaggagctgcgggggtggtttggctctgacctctcccctccccccttc

SEQ ID NO: 53548 - DNA, 201 bp, Homo sapiens
caggtggggaggcaggagaagggcagaggaaggatccagggttgtgactagattccggggatggagagcgtgggggtctgtgtgagccagaagtctgaggkcctgggtctgaagacaccagtccaaccctcactgccggctggcctcagcctccactttcacgctgctcctgcgaccctccaccagcgcgggatggggtcc

SEQ ID NO: 53549 - DNA, 201 bp, Homo sapiens
agtcttatgcccatggagcaggtggggaggcaggagaagggcagaggaaggatccagggttgtgactagattccggggatggagagcgtgggggtctgtgkgagccagaagtctgaggtcctgggtctgaagacaccagtccaaccctcactgccggctggcctcagcctccactttcacgctgctcctgcgaccctccac

SEQ ID NO: 53550 - DNA, 201 bp, Homo sapiens
acagtcttatgcccatggagcaggtggggaggcaggagaagggcagaggaaggatccagggttgtgactagattccggggatggagagcgtgggggtctgkgtgagccagaagtctgaggtcctgggtctgaagacaccagtccaaccctcactgccggctggcctcagcctccactttcacgctgctcctgcgaccctcc

SEQ ID NO: 53551 - DNA, 201 bp, Homo sapiens
ctctctccaggcctctgcttgttattgcttgaagccccacagtcttatgcccatggagcaggtggggaggcaggagaagggcagaggaaggatccagggtkgtgactagattccggggatggagagcgtgggggtctgtgtgagccagaagtctgaggtcctgggtctgaagacaccagtccaaccctcactgccggctgg

SEQ ID NO: 53552 - DNA, 201 bp, Homo sapiens
catcagggggtctgttttctttccccaggccccaggtgtacccaccacactctcactccatccccccgtatcaaggcctctccccagaagaatcagtcaaygtgttgtcagccttccaggagtaagtgaaaaacctcatggggataccatcccactctaagggggtgggcatttgaattgttagaagaggctcttctgtga

SEQ ID NO: 53553 - DNA, 201 bp, Homo sapiens
cctctctccaggcctctgcttgttattgcttgaagccccacagtcttatgcccatggagcaggtggggaggcaggagaagggcagaggaaggatccagggktgtgactagattccggggatggagagcgtgggggtctgtgtgagccagaagtctgaggtcctgggtctgaagacaccagtccaaccctcactgccggctg

SEQ ID NO: 53554 - DNA, 201 bp, Homo sapiens
ccttcatcccggccaggctgatcattggcttcatcagcaaacagtacgttactagccttcttctcaatgagcccgacggaacctttctcctccgcttcagygactcagagattgggggcatcaccattgcccatgtcatccggggccaggatggtgaggccaccccagccagtcctctgtctctgtgcctgtgccctctgg

SEQ ID NO: 53555 - DNA, 201 bp, Homo sapiens; identical to SEQ ID NO: 11731

SEQ ID NO: 53556 - DNA, 201 bp, Homo sapiens
ggtaggcagtattatcagcctcattttatagataaggacattgagacagagagtttaagtagtttgtcccagtcacacagctaagtgttggagctggtatytgaaacctggaggtctggttccatagcgatgactaataaccacttctctacggtgaggccctgattgagcttcagaacgcatttaataacatggcatgag

SEQ ID NO: 53557 - DNA, 201 bp, Homo sapiens; identical to SEQ ID NO: 11733

SEQ ID NO: 53558 - DNA, 201 bp, Homo sapiens
ccacccctgtgtctatcactgaaggagttacccccatctcaggcattgactcaggatgcccctggtttaaggtggtctggccatgagtggtggtggggacrgtccctaggagggctatctatgggaggtccctggctgccccaggagataggccaagtttcttgggcacccctcagagtggccttatttttctcctccagg

SEQ ID NO: 53559 - DNA, 201 bp, Homo sapiens; identical to SEQ ID NO: 11734

SEQ ID NO: 53560 - DNA, 201 bp, Homo sapiens
cctgcacccccagggccatggaaagtcagggaaaggaggtgaaggagtgcccctctgccctgagtcgggggaagtggccgcccctccctggaaggttgatsccagagggcagtggatccttgttaaacccctatcctgccctccactaaaggttcctgttcaagggtgtggctggggcgtgagcaagccccagatgtagac

SEQ ID NO: 53561 - DNA, 201 bp, Homo sapiens
aggtcaggaagaactgccaaaggggagaggggaacaagaaaacgctatctgcagagcagagagtggaggccaggtatagagggatgagcagagtgtttcasttcttggcatctgtccttcctgtgtagttccgccacttgccaatgcctttccactggaagcaggaagaactcaagtttaagacaggcttgcggaggctgc

SEQ ID NO: 53562 - DNA, 201 bp, Homo sapiens
aaaggtcaggaagaactgccaaaggggagaggggaacaagaaaacgctatctgcagagcagagagtggaggccaggtatagagggatgagcagagtgtttsacttcttggcatctgtccttcctgtgtagttccgccacttgccaatgcctttccactggaagcaggaagaactcaagtttaagacaggcttgcggaggct

SEQ ID NO: 53563 - DNA, 201 bp, Homo sapiens
gtcctccactggagggagcgcagagtccagagggatttacttttcctgaggccctggggagcccagtcccttgtgggtccaaaccccagcccttggcagastttgagtttgggagccaggcagttaggggtggcaaatctctgtttgatattgggtgactttctggagaaaagctgatgcttttgagggggacagagtaag

SEQ ID NO: 53564 - DNA, 201 bp, Homo sapiens
tgcagggaaaagggggcagttaggagactgcagggtgactggctgcagacagaggtggttgggaacagaagcaggggcaaagaaagctgtgaagatgggcwcagtttaggtttattgaattactgcctcctgcccactgcatgtgtatggggggttccattcccatgtgtgtgagccccctcccctccctggctgtgcgta

SEQ ID NO: 53565 - DNA, 201 bp, Homo sapiens
ctggctccagtcggtctggaccacccccagtcccacctgctgccagccccccagccccagtcccctcagggactcctccccctgcagggggggagaagggsggcgagccagcctcctcttctcctcctgccccaacgtccgactctggagtgctccggcctggccagatccgggggtcccctgccccaggtcccccaggca

SEQ ID NO: 53566 - DNA, 201 bp, Homo sapiens
cctaggagttggctggcatcgagctccctggcggctttttagggtcctccactggagggagcgcagagtccagagggatttacttttcctgaggccctggrgagcccagtcccttgtgggtccaaaccccagcccttggcagagtttgagtttgggagccaggcagttaggggtggcaaatctctgtttgatattgggtga

SEQ ID NO: 53567 - DNA, 201 bp, Homo sapiens
atgcgtaccatctctggctccagtcggtctggaccacccccagtcccacctgctgccagccccccagccccagtcccctcagggactcctccccctgcagrgggggagaaggggggcgagccagcctcctcttctcctcctgccccaacgtccgactctggagtgctccggcctggccagatccgggggtcccctgcccca

SEQ ID NO: 53568 - DNA, 201 bp, Homo sapiens
tctcaatgagcccgacggaacctttctcctccgcttcagcgactcagagattgggggcatcaccattgcccatgtcatccggggccaggatggtgaggccmccccagccagtcctctgtctctgtgcctgtgccctctggggtttcttctgggaatgaaatgtcctgaccttcctgatgccgatcctgatcttcaggaagt

SEQ ID NO: 53569 - DNA, 201 bp, Homo sapiens
tggggaagagggggcaagctgggggtgggcagctgaccctgctgaaggccctacaggtgagagaaagaagccaggcgggagggccttggagtggaccaagwtgcataaaagccagttccagcggggctgtgcacactgtcgttcaggtcgcatcctgtacaagtgggcctagtggaggggcacaagcggggactcatccaa

SEQ ID NO: 53570 - DNA, 201 bp, Homo sapiens
ctgtaagtggtggcagttgtcctgggtgcaagagccgtcgggggagaggcagctgggtttccacagggggtgtaggcactgagaatgaacctcccacccasaccctaggccaacagatcacagaacccccttcagcccaggtgccttgcagccacacccactacccaccccacttctccacacatgatagcctttctccct

SEQ ID NO: 53571 - DNA, 201 bp, Homo sapiens
gagtctcaggttcggtctgatcctcagccctgtgattctgtcgtgagggcactcacagctcactgcctgccctaaacaggctccagctctggccctccctsggctcacacctttccccctctccccctaggagatcctgctgggccgtggcttcaccttttggcagtggtttgatggtgtcctggacctcaccaaacgctg

SEQ ID NO: 53572 - DNA, 201 bp, Homo sapiens
gcacaagcggggactcatccaacccaggcttctctcctcaagccccatgcctagaggaataggagggcttttccatttggtttattgggtgggaacacttyccaatttgccacaaagcactgtaagtggtggcagttgtcctgggtgcaagagccgtcgggggagaggcagctgggtttccacagggggtgtaggcactga

SEQ ID NO: 53573 - DNA, 201 bp, Homo sapiens
cagcaaatgctaacagcctgtcttcttctcttctgtccactctaatgagggggtagtagttaagatctggactgcctaggtttgaattctagctccaccayttactggtttggggcaaattacttagcctttggtgccttatctgcacaatgggggataataatgctaataataataacctacctcactgcattattgtgg

SEQ ID NO: 53574 - DNA, 201 bp, Homo sapiens
ttcaagggtgtggctggggcgtgagcaagccccagatgtagacctcatggtggcccagacgagggggaatttccccctcaaaactgctccacgcttggctsctgtagacgctgagatttcccagcggcggcgccgagttaaccctcctcgtgctgaactggctccacctccccgcctgcccccaccgccacattcacgcat

SEQ ID NO: 53575 - DNA, 201 bp, Homo sapiens
ctgcacccccagggccatggaaagtcagggaaaggaggtgaaggagtgcccctctgccctgagtcgggggaagtggccgcccctccctggaaggttgatgscagagggcagtggatccttgttaaacccctatcctgccctccactaaaggttcctgttcaagggtgtggctggggcgtgagcaagccccagatgtagacc

SEQ ID NO: 53576 - DNA, 201 bp, Homo sapiens
agaggaataggagggcttttccatttggtttattgggtgggaacactttccaatttgccacaaagcactgtaagtggtggcagttgtcctgggtgcaagarccgtcgggggagaggcagctgggtttccacagggggtgtaggcactgagaatgaacctcccacccagaccctaggccaacagatcacagaacccccttca

SEQ ID NO: 53577 - DNA, 201 bp, Homo sapiens
tgtagacctcatggtggcccagacgagggggaatttccccctcaaaactgctccacgcttggctgctgtagacgctgagatttcccagcggcggcgccgarttaaccctcctcgtgctgaactggctccacctccccgcctgcccccaccgccacattcacgcattgggcaactcagagaagctgttttaactttcgatcc

SEQ ID NO: 53578 - DNA, 201 bp, Homo sapiens
ccatgtgtagtgacctagatttagcagggagtctgtgccccatcaagaccaggctatgaatgttgacagatggagaccccatctcttaggaggctgagccraagaggaggggggtttgggctgggacaaaggcacttctcataacagctagaagactgggaaacaaggcgcatgggtgaaagctacagagggcctagatgg

SEQ ID NO: 53579 - DNA, 201 bp, Homo sapiens
ggtggggacggtccctaggagggctatctatgggaggtccctggctgccccaggagataggccaagtttcttgggcacccctcagagtggccttatttttytcctccaggcaacctccaagtcccagatcatgtctctgtggggtctggtctccaagatgcccccagaaaaagtgcagcggctctatgtcgactttcccca

SEQ ID NO: 53580 - DNA, 201 bp, Homo sapiens
tgggttggtggaagtgccatctgagcttcccttattgatgctcctccttcctgctccttcatcctcttttctctgtccccccattccccagttcccctttyacagatctacactaggaccagactttccatggtgggagcagctcggcagggtctgcctctctgcaccccaaggcctggctggctggagcccagccatcct

SEQ ID NO: 53581 - DNA, 201 bp, Homo sapiens; identical to SEQ ID NO: 11732

SEQ ID NO: 53582 - DNA, 201 bp, Homo sapiens
gcagcaccgagtaggggagatccaccttctccgagaagccctgcagaagggggctgaggctggccaaggtgggggccagggtggttctggggagtgtgtargagtggttgcctcttggatctcaaccttatctgaacctctaatctgtctgcacccttgatttctgcccccaaccctcagtgtctctgcacagcttgatag

SEQ ID NO: 53583 - DNA, 201 bp, Homo sapiens
aacctgagcaggaggggtaaggattctgccttgaggagaaaagagctggggtaagtgggcactggaggaaagaggggcatgaaggtcttggagcagaaacrtccagagaagggacctctccattttccatccctctgagaggcctgggagaggtgagaggctgaacgtgcaacaggaggacttggggttactgggtttggg

SEQ ID NO: 53584 - DNA, 201 bp, Homo sapiens; identical to SEQ ID NO: 11737

SEQ ID NO: 53585 - DNA, 201 bp, Homo sapiens
cccaccacagtctcaggaggggtgccctgtgaggagagagcaaagaccagcttcagtccaagggactcctagagtcttccagaattctgagctgagggttyccctcccccactccctcccgtcagtggtcacgagaccgacctctaaggcgttccctgccggaagggagggggacctaggagttggctggcatcgagctcc

SEQ ID NO: 53586 - DNA, 201 bp, Homo sapiens
tctttgcctgaataattcttatgtcccttcaagattcatttcaggctgggcacggtggctcacgcctgtaatcccgaaactttgggaggtcgaggcaggargatcacttgagttcaggagtttgagagcctggacaacatattgagaccctgttctatgagagagagagagagaggagagagagagagaggagagagagaa

SEQ ID NO: 53587 - DNA, 201 bp, Homo sapiens; identical to SEQ ID NO: 11738

SEQ ID NO: 53588 - DNA, 201 bp, Homo sapiens
tgcagctaggctgatccctctactaaatcttatcatatgactcacctgtctaaatcttctaatgctccgcattgcccattactacccattcccagaaggtrccatgctcccacaggtatccatgcctttgcatatgctagaccttcttcctgctttaatgctttccttgttctttgcctgaataattcttatgtcccttca

SEQ ID NO: 53589 - DNA, 201 bp, Homo sapiens
ctctgcctcttaccagctatgtagacctgggcaagtcattcgacgtttttggacttccatttcttcatctgtaagatggaattattataatccctacttcyatagcctggtaaagagcaaataaatatatggaaaggcttgaaatagtggctggcacgtgtaagcattaggattggtcgttgtcattgatggagtctcagg

SEQ ID NO: 53590 - DNA, 201 bp, Homo sapiens; identical to SEQ ID NO: 11739

SEQ ID NO: 53591 - DNA, 201 bp, Homo sapiens
ggatggcaggggttatgtcccagctaccatcaagatgaccgtggaaaggtgagtgtggtggtatggacagtgggtaggtcaggggcttagtgcttatctgyaggaaggaggggtggcatcaacccttggtcagtcacatgtacctccttccctcctccagggaccaaccacttcctaccccagagctccagatgcctacca

SEQ ID NO: 53592 - DNA, 201 bp, Homo sapiens
tggacctcccacccccaagctcttcatccctggggcactcagggcctgctcagcctccatgcagggaccttccactggattctccacagtgccccctcagrtcctttaggaaggcctgtcatggaccagggaggaaaaaccccaggcctgggggttggctctggagatgcgttctctgacatccctgaggttttggtctgg

SEQ ID NO: 53593 - DNA, 201 bp, Homo sapiens
ccaagaagcccaaggatgaggctttccggagccactacaagcgtgagctggaactggcagctctgattccttcctgtcacccacttcctccctgctccccrctgccctcctctccctgcccgcgtgtcatcctgatgtcactccctatttcatagctgtgcttctcttacttccccatgatccatgcccaccttttccacc

SEQ ID NO: 53594 - DNA, 201 bp, Homo sapiens
atcatcaacaacactgtgcccttggagaacagcattcctgggaactgctgctctgccctgttcaagaacctggtgaggggctttggggtgcagtgaggggrgcaccactaggagactgtgggactctccttggagaggatgtcaggaagcccaggaggagcggtctctgtcctcatgacctcgcccttgctctccctcacc

SEQ ID NO: 53595 - DNA, 201 bp, Homo sapiens
tatcagcctcattttatagataaggacattgagacagagagtttaagtagtttgtcccagtcacacagctaagtgttggagctggtatttgaaacctggargtctggttccatagcgatgactaataaccacttctctacggtgaggccctgattgagcttcagaacgcatttaataacatggcatgagctttttgattat

SEQ ID NO: 53596 - DNA, 201 bp, Homo sapiens
gcatggtggcgggcgcctgagtcccagctactcgggaggctgaagcaggagaatggcgtgaacctgggagggagagcttgcagtgagccaagatcgcgccrctgcactccagcctgagtgacagagcgagactctgtctcaaaaataaataaataaataattagctggattaggtggtacatttctgtagttccagctatt

SEQ ID NO: 53597 - DNA, 201 bp, Homo sapiens
agtttaagtagtttgtcccagtcacacagctaagtgttggagctggtatttgaaacctggaggtctggttccatagcgatgactaataaccacttctctayggtgaggccctgattgagcttcagaacgcatttaataacatggcatgagctttttgattatgatgtgtgagtccaataacttctctgagtgctcagagcc

SEQ ID NO: 53598 - DNA, 201 bp, Homo sapiens
ataaggagctgattctgctaggagcaaggtcttatctccacgatattccaaaaggtcaggaagaactgccaaaggggagaggggaacaagaaaacgctatmtgcagagcagagagtggaggccaggtatagagggatgagcagagtgtttcacttcttggcatctgtccttcctgtgtagttccgccacttgccaatgcct

SEQ ID NO: 53599 - DNA, 201 bp, Homo sapiens
aaaagctgttatggaacaggtattgtgatattccacctcccaccccaactcaatcccctgagactttggcctgagccatgacaaactagaaagaatttgawcctcagtaaaggctcagtgttctaggcccaggaatgaccaaaggaggttcctagggtcagagtgaaccccaagtcaagctcagggaatctttctatgagg

SEQ ID NO: 53600 - DNA, 201 bp, Homo sapiens
tcgcccaggctggagtgcagtggctcgatctctgctcactgcaagctccgccccccaggttcacgccattctgtcacctcagcctccccagtagctgggastacaggcgctcgccaccacgccctgctaattttgtttttgtatttttagtagagatggggtttcactgtgttagccaggatggtcttgatctcctgacct

SEQ ID NO: 53601 - DNA, 201 bp, Homo sapiens
gtgtcctcctgatggctggggaagaagaggggttggatatttctagccagggccatgccaggaggctggtcactctgcaaggggatgcagaggaaagcggwgcccactcactccagaggacctttctctcttgggctagagaaaggcctattggaggaacctgagcaggaggggtaaggattctgccttgaggagaaaaga

SEQ ID NO: 53602 - DNA, 201 bp, Homo sapiens; identical to SEQ ID NO: 11723

SEQ ID NO: 53603 - DNA, 201 bp, Homo sapiens
ccacttgccaatgcctttccactggaagcaggaagaactcaagtttaagacaggcttgcggaggctgcagcaccgagtaggggagatccaccttctccgasaagccctgcagaagggggctgaggctggccaaggtgggggccagggtggttctggggagtgtgtaggagtggttgcctcttggatctcaaccttatctga

SEQ ID NO: 53604 - DNA, 201 bp, Homo sapiens; identical to SEQ ID NO: 11726

SEQ ID NO: 53605 - DNA, 201 bp, Homo sapiens
gttatggaacaggtattgtgatattccacctcccaccccaactcaatcccctgagactttggcctgagccatgacaaactagaaagaatttgaacctcagwaaaggctcagtgttctaggcccaggaatgaccaaaggaggttcctagggtcagagtgaaccccaagtcaagctcagggaatctttctatgagggactgaa

SEQ ID NO: 53606 - DNA, 201 bp, Homo sapiens
tcttggcgtgtctcagtgtttaccccagaaacatataggaacttggcagataggaacacagcagattcgtattcaaacttgccccttgtgaatctgcaggsagcagctccggcttgtgctggttcccaccacagtctcaggaggggtgccctgtgaggagagagcaaagaccagcttcagtccaagggactcctagagtct

SEQ ID NO: 53607 - DNA, 201 bp, Homo sapiens; identical to SEQ ID NO: 11735

SEQ ID NO: 53608 - DNA, 201 bp, Homo sapiens
gaggtttcccctagtccggaatctcagccccgccccgcctctctgtccgcacttctgaggggctggggtggggcatggcggggcgtggaggccgtggaccrgggctggttttacaatgtggcctagcgaggagacctttccgccttgtggggtccggggagaaggagcgcgttgttggtgggaggatttcagttgctcagg

SEQ ID NO: 53609 - DNA, 201 bp, Homo sapiens
atgccagaggagtgagaaaaagagccgtatcccaggagctgggtgtggaggcagcgtgaggccctggctcaggcccctctctgcccataggccctggccakgctactgcaggagaccactggagagctagaggcagccaaagccctagtgctgaagaggatccagatttggaaacggcagcagcagctggcagggaatggc

SEQ ID NO: 53610 - DNA, 201 bp, Homo sapiens
atggagaccccatctcttaggaggctgagccgaagaggaggggggtttgggctgggacaaaggcacttctcataacagctagaagactgggaaacaaggcrcatgggtgaaagctacagagggcctagatggagaataaggagcgagaaaggaactgctgagcttttggctgtggggtaaagggtcaggagagctgaggaa

SEQ ID NO: 53611 - DNA, 201 bp, Homo sapiens
aagggaaggctctttgcccacagaaccagagccaggtctagagctgcaactaaatcctctgccactctaagagagctctcgctctactgccctgtctcccyttgcctccccatccctctggctacagctcagctcttcccacccctgtgtctatcactgaaggagttacccccatctcaggcattgactcaggatgcccct

SEQ ID NO: 53612 - DNA, 201 bp, Homo sapiens
aggatgcccctggtttaaggtggtctggccatgagtggtggtggggacggtccctaggagggctatctatgggaggtccctggctgccccaggagataggycaagtttcttgggcacccctcagagtggccttatttttctcctccaggcaacctccaagtcccagatcatgtctctgtggggtctggtctccaagatgcc

SEQ ID NO: 53613 - DNA, 201 bp, Homo sapiens
taacaaatagtagctgttattactctcccatcctcttcatcatctagccttgtggttttcatttttattttatttcatttatttatttatttattttgagrcagagtctctctctgtcgcccaggctggagtgcagtggctcgatctctgctcactgcaagctccgccccccaggttcacgccattctgtcacctcagcct

SEQ ID NO: 53614 - DNA, 201 bp, Homo sapiens
gcgccccgccggcgacattccttctctcccccacccctccgagctgagagaggagtttcacaaccacgcacaagtacacaaagacacagaagcgcacggasgtgcacacgcgcctaaacaactacggggacgcccgttgcccatactcaggccttgtggtgctggacgtgtgaatgttagcagtgagccgggaaaagttag

SEQ ID NO: 53615 - DNA, 201 bp, Homo sapiens
gaaggggggaggtgctagcagggccagccttgaactcgctggacagagctacagacctatggggcctggaagtgcccgctgagaaagggagaagacagcasaggggttgccgaggtgaggggttgcctccgaggtgggtgcgggggcctctatgagtgcatgggggtggattcgtggggggagctctcgggatcctcccct

SEQ ID NO: 53616 - DNA, 201 bp, Homo sapiens; identical to SEQ ID NO: 11741

SEQ ID NO: 53617 - DNA, 201 bp, Homo sapiens; identical to SEQ ID NO: 11795

SEQ ID NO: 53618 - DNA, 201 bp, Homo sapiens
tattattttctgtcctgcccctgagagccactgtcacttctctgctgtattggtttttgtttactcatctgttttggccttgaaatggcctagacattttkcttcccgaagtatgacactcgggtgcttattaacttagtcaagacacaacatctcccttcccagaaggtgaggcgggagtgaggacttggggacttaaga

SEQ ID NO: 53619 - DNA, 201 bp, Homo sapiens
taattttttttttttgagacagggtctcactcactggagtgcagtggtgcgatcttagctccctgcaacctccgcctcttgggctcgagcaatcctcctgytgtagtgcaccacgacactcggctaattcttttttaagatttttctgcagacaaggtctcacttactgcccaagctggtctcaaactcctgggcttaagt

SEQ ID NO: 53620 - DNA, 201 bp, Homo sapiens
ctagaaaaaacagcatgtttgtgagcgatatcaggggctgtggaggggtaggccacaggcaggtgggagggatgaaggccggcccgaggaataacaagacrgtagcctgcagtgctctcttcttcccccttctccccaggaccgcgtgccctttgtggtggctgagcgggtgccctgggagaagatgtgtgaaactctgaa

SEQ ID NO: 53621 - DNA, 201 bp, Homo sapiens
gacaaatttattaaggctatatcagatttcctcagtcacttagggaaaataagagagaaatgactggaattgtagccacaccaaaattatatttgcatctrtcatattatgttgggttttgcccaatataattttaagggtaaaatcaagaatatcacacacaatcatctataaatcttagaagtacaataggttttacaa

SEQ ID NO: 53622 - DNA, 201 bp, Homo sapiens
ctggattatttctaatttttaaaaattagaaacagtttgaactaaatctttgacaatggacagacattcacttttcaaaggcaaattagagctgagcccargaacccaggctttcacagcagagtcagtgggtggccctactgcttactgatgaggtgatccccagcaagtaatgtgccagacacatagtgtcaataaatg

SEQ ID NO: 53623 - DNA, 201 bp, Homo sapiens
agcactcattcagtgataaagcagtgaggtgctagccatcatgcagggtgtagcttattcttgtggtaaatatcagaggttgcagtgggggcaaaggaggyagtgaagtcaaacatatgataccatttcattcaatgatcattgttttcttaaaaaaaagcaaaaaaaaaaaacacctctgtttatcaaactgtgagcatt

SEQ ID NO: 53624 - DNA, 201 bp, Homo sapiens
cagactgtatctgttgagctctttggactataacagaaatccttaaatatctgtccacaaacaaagggctagatcatcacaaagttctcaccagttcacasctaaataaggacagcacaatattataaatcagggagctgcagtctgtgtcagcataaaaacagattattggcgagaaccatcttttattctcagtttatg

SEQ ID NO: 53625 - DNA, 201 bp, Homo sapiens
atttagtgtagtcgtggccccaaacctgaccctggaacctgacagtgactttgccaaaaaagaaaaatgttgaggaaatgtaccttaagtttcaccctgtyctggagcgtacttaaactgagttttaaactcttaagtctcaggaaggacactaggaaaatgcacggaataagggcttggaagggagacctaagctgctag

SEQ ID NO: 53626 - DNA, 201 bp, Homo sapiens
ctcatgttgaggaatgagaggagctccttcaaagatcacctctgcctctgcacagctttcctctgttcccagttttctcttttttgcctgtttatctaaamatccgaagagaaaagcaaaagcagattctaagcaggtgacaatgctagacaccttaggctcatgaaagggtcttgaagaaaacaggagagcacccaactt

SEQ ID NO: 53627 - DNA, 201 bp, Homo sapiens
ctttagcaagaaagtgcccagagttctgagctctcagtacttcaggatatctgataattcttcaaggaaacatactttcatattttgcctaaagaaaaagmgctcaaacattaactgagcatctactctgagcctagaactgagtcaaacacagggtttgcatctgtgaaggcaaaacggtgcctgactggaaggaggttg

SEQ ID NO: 53628 - DNA, 201 bp, Homo sapiens
gccttgcctaggaaagttgtctcatggaaacaaaatccagcccacatactaaacacatctgaactcattaaaatcctcagctgaaaaaaaggtggaccctytgcctttgtaaagtgtgagaggctggaatacaatgcctttaagagttaaaagcatactgatcttgcattatgtacaatggaaagatgataccaataactg

SEQ ID NO: 53629 - DNA, 201 bp, Homo sapiens
taaagaacttcagtgacaaataagtgatccatggaaataatgttcacatcagcttccttccctgaatttttttcttttaaaaaaattagaagcaaaaaggygtatttgttatattcattgcattgtagaaaaactataaaatgcaggtggacaaaaggaaataattaaataatctataatccccactacccaaaaccaatc

SEQ ID NO: 53630 - DNA, 201 bp, Homo sapiens
gcactcattcagtgataaagcagtgaggtgctagccatcatgcagggtgtagcttattcttgtggtaaatatcagaggttgcagtgggggcaaaggaggcrgtgaagtcaaacatatgataccatttcattcaatgatcattgttttcttaaaaaaaagcaaaaaaaaaaaacacctctgtttatcaaactgtgagcattt

SEQ ID NO: 53631 - DNA, 201 bp, Homo sapiens
tatgcttccaagcgtgttttgtttttaaaagaagggtggcatccttaacctaaagaaatggatgtctacggatggaatttccaacattagtgaaagatatrtagaggaaatgcttttgcacacaggcctccctttcaagagtctgccaacattacagcacatctgtgatcaccagctccgcctcagggctgctttcctgac

SEQ ID NO: 53632 - DNA, 201 bp, Homo sapiens
tatttatatttattattaaaatatatttttgtagtaataaatatactatttattaataatatattattaaaacattattttataataataaataaaatackttatttattattatatgttatattatttaataggtataattatttaataaattacattaaattatattaaatacattatattaaataattacattaatat

SEQ ID NO: 53633 - DNA, 201 bp, Homo sapiens
aaggaataaagaataaattaagtcatctgtaatttcattacccagacataatcaacattaatattcaggcagacttccttttattattgtatgtgtgtgcrtgtgtgtatatgcgtgtatatgtatgatttattcagaaaattattattataaccttataaagatttctcctcttcttttctcagtatattgccattacat

SEQ ID NO: 53634 - DNA, 201 bp, Homo sapiens
acacttactttttataatagatgacaaatttattaaggctatatcagatttcctcagtcacttagggaaaataagagagaaatgactggaattgtagccayaccaaaattatatttgcatctatcatattatgttgggttttgcccaatataattttaagggtaaaatcaagaatatcacacacaatcatctataaatctt

SEQ ID NO: 53635 - DNA, 201 bp, Homo sapiens
agtgataaagcagtgaggtgctagccatcatgcagggtgtagcttattcttgtggtaaatatcagaggttgcagtgggggcaaaggaggcagtgaagtcaracatatgataccatttcattcaatgatcattgttttcttaaaaaaaagcaaaaaaaaaaaacacctctgtttatcaaactgtgagcatttagcaattact

SEQ ID NO: 53636 - DNA, 201 bp, Homo sapiens
atagcatgtagcactcattcagtgataaagcagtgaggtgctagccatcatgcagggtgtagcttattcttgtggtaaatatcagaggttgcagtgggggyaaaggaggcagtgaagtcaaacatatgataccatttcattcaatgatcattgttttcttaaaaaaaagcaaaaaaaaaaaacacctctgtttatcaaact

SEQ ID NO: 53637 - DNA, 201 bp, Homo sapiens
gaggcttgcaaagttgaataatgtgcctcaaatcacacagctcagcaaccaggagagccgggactcaaacccatacctgccctcaacagccatgatcatgrtcacatgtccagcgtgaaagtgtacaacctcccctggggctctagagcagaagtgtgtgaactccaaattcccgttaccattttgaccaactcattttga

SEQ ID NO: 53638 - DNA, 201 bp, Homo sapiens
aatggaggaactttcaaacacctataaaaccatcatatcttgtgagaactcactcattgtcatgagaacagcatgacggaaccacccccatgatccaatcmcctccctccctcaacacatggggattacaattcgagatgagatttggttagggacacagagccaaaccatattaatgtgtgacaaactcttgttcagtgc

SEQ ID NO: 53639 - DNA, 201 bp, Homo sapiens
agtactattattatccctcccttttaacaagtgaggaagctgaggcttgcaaagttgaataatgtgcctcaaatcacacagctcagcaaccaggagagccrggactcaaacccatacctgccctcaacagccatgatcatgatcacatgtccagcgtgaaagtgtacaacctcccctggggctctagagcagaagtgtgtg

SEQ ID NO: 53640 - DNA, 201 bp, Homo sapiens
cttacctattctcataatccaggattttattctgggtttgtttgtttgttaaacaaaattagtgtcaatatgacatttaaaacatactttttaaattatgyttaaaaataaaaattttaactaccacattattatgaactcataactaaggaaaatgaaaatacacactgttaattcaggtgtttttactaccattttatt

SEQ ID NO: 53641 - DNA, 201 bp, Homo sapiens
ccctgaaattggcaggcattcagtctccgaattaaagaaagtgcattttatctgcattggtaaagatcaatctagaaaccatagccccagctatgccttcytgtgaagagctgatttgctagttataaatatgtgtgtgatgtgtgattaaattttgcatctttcctttacagcatattagtcctggatagccttagaaaa

SEQ ID NO: 53642 - DNA, 201 bp, Homo sapiens
actaccattttattttctatgataaagactttttaaaattgttactgtcttcaaaatgtggtttttacttttctaactattatgtcataagaaaattttgrttttatactattttcataacatcactttaaacagtcagaaatattccagaatatgagttataatttatttgaccatttcctttaacaaatagattacttc

SEQ ID NO: 53643 - DNA, 201 bp, Homo sapiens
ttgatgactcaccctgaaattggcaggcattcagtctccgaattaaagaaagtgcattttatctgcattggtaaagatcaatctagaaaccatagccccarctatgccttcttgtgaagagctgatttgctagttataaatatgtgtgtgatgtgtgattaaattttgcatctttcctttacagcatattagtcctggata

SEQ ID NO: 53644 - DNA, 201 bp, Homo sapiens
gacactcttgggtggagtcactcttgctattctagctggtcaggagtcagctaggcacgtttagaaacagtagcatggcctgggaatattggggacctttwgtgattccttacttcttcctctccaaaataaatcaacccttctctgtctcccttatgacatactctcagaaagaccttagaccaaggagcagggaaactt

SEQ ID NO: 53645 - DNA, 201 bp, Homo sapiens
ccttctttgatgactcaccctgaaattggcaggcattcagtctccgaattaaagaaagtgcattttatctgcattggtaaagatcaatctagaaaccatarccccagctatgccttcttgtgaagagctgatttgctagttataaatatgtgtgtgatgtgtgattaaattttgcatctttcctttacagcatattagtcc

SEQ ID NO: 53646 - DNA, 201 bp, Homo sapiens
gaaggtgctgggagaagataaacaagtcaaccaatgagtgcacaagatgtttcagaaagtgatcagtgagcctggaaagaagttaatcaggatgacagagwgttgctgactgggacagtggtctggtgagggagtatttttaatggcgtagtccaggaagtcctctcggaggaagtgaactttgagatgaacctgagctgc

SEQ ID NO: 53647 - DNA, 201 bp, Homo sapiens
gaaaggtcattctgctaacaggttcacattccaatcagtggggtaggttttgctatcgaatgccgcccccccgccgccccgccccgccccagtcgttctcyttttgtaatctgtggcacatgcaaagtccacagtatcctatgtgtcagttaacagatgtcatgatagcaacaataacccaaaacaggtgtttttttattg

SEQ ID NO: 53648 - DNA, 201 bp, Homo sapiens
tgagcctggaaagaagttaatcaggatgacagagagttgctgactgggacagtggtctggtgagggagtatttttaatggcgtagtccaggaagtcctctyggaggaagtgaactttgagatgaacctgagctgcatgaaagagccagtcacgtgaagacctggagatggggcagtccagacggaggaaacagcagctgct

SEQ ID NO: 53649 - DNA, 201 bp, Homo sapiens
gtgttttactagaacaagaatcacatcttatggaagcaccaactagggagagattttgtttatatcactgcagtgatgaatttttgtttttaagaaggaayagtttctaattttatttttacttcattaaaaggtactatttcaatcctgcctatatgaccagccagaaaccttttgtgctctaagactaacattttgtgc

SEQ ID NO: 53650 - DNA, 201 bp, Homo sapiens
cttttatccagcctagaatatgaaaatccttcttatccaaaggaaaacatataatttcaattcctgtcctcaggggcttcgtatgagcaagtctgaatcaratgtcatctgtcatccaatcactgcacatagggtcacaccttatcttagctactgagtttctatccttagttgactcatgttgaggaatgagaggagctc

SEQ ID NO: 53651 - DNA, 201 bp, Homo sapiens
ttccttttacaagtcatagaaaggataagcaacttgttcaagagtacatagctagtaaggggtggagctggaattcaaacccaaactagcaaacttcagartccgtgcccctaactaccctgcctcctaaggtgctgtccagagctggaatcccatgactctatagctctgatcccctaccagctgccgctaaatgtccca

SEQ ID NO: 53652 - DNA, 201 bp, Homo sapiens
ttcagaatccgtgcccctaactaccctgcctcctaaggtgctgtccagagctggaatcccatgactctatagctctgatcccctaccagctgccgctaaawgtcccagagtgcttgctaagcctggacaaagaacaaagaattctttcaagccacagttctaatggcaaccagggagccactgattatgaaagcgctccca

SEQ ID NO: 53653 - DNA, 201 bp, Homo sapiens
tccaaaggaaaacatataatttcaattcctgtcctcaggggcttcgtatgagcaagtctgaatcagatgtcatctgtcatccaatcactgcacatagggtyacaccttatcttagctactgagtttctatccttagttgactcatgttgaggaatgagaggagctccttcaaagatcacctctgcctctgcacagctttcc

SEQ ID NO: 53654 - DNA, 201 bp, Homo sapiens
gtccatgactatgtacaacaaagacaagaagcctgggtcaagataatgtgatgcttagggaagtataatattcttgtgataagctgggcagtcttaaaaakccctcaacacacacattgcctatccactcttgctccccaataactctaccatcgcctccccatgaaaaaggacactagaggctatcacagtactctgcct

SEQ ID NO: 53655 - DNA, 201 bp, Homo sapiens
ctctgctgactcttctgggccactgagagccctggaagcattgctcagtgtcatgcggtgtcatgagctgtcacttccagaccagtgtttaagccactagrccagctatttttctctcagaccttcctttttaaaacatgatgacaggaattcacttattaaggccctaatatctgcaagacagagtatgattctctaaag

SEQ ID NO: 53656 - DNA, 201 bp, Homo sapiens
attctatagctctcttcttttggccccaaacctggggttaaagagctccttgttccttccctctcaagtcctgaattgagctatttgctatcctttctgtrggcacagtcctttcatttgggaccctaggattactgctgttggtttctcattgaaattgcaccatctgcattataataacctaagatacctttcaaaaca

SEQ ID NO: 53657 - DNA, 201 bp, Homo sapiens
ttagctataataagttgagaggcatatatatagctagatatacttaatgaacatacacttactttttataatagatgacaaatttattaaggctatatcasatttcctcagtcacttagggaaaataagagagaaatgactggaattgtagccacaccaaaattatatttgcatctatcatattatgttgggttttgccca

SEQ ID NO: 53658 - DNA, 201 bp, Homo sapiens
agtgaggtggatgattcatggttgatttcttggcttctgactcatcatgaactaagcagccctggttaatgagtcccatagaatgaatggcttctcagccmatgacatgacagtttgtacttcaaagtttccagtgaagcaaactaagaaggaaacttggctatattgataaactctaagtttatattctgcatatcatct

SEQ ID NO: 53659 - DNA, 201 bp, Homo sapiens
caaataaagggtgaaggcatctcctgaaaatgaaagtctgatggggtcagcttaggtaggtggagaatgatgactgggtaaaacaaaagaagacctttaasgctcaacaacatgcatcaagtccctggatgcaccaggcagcatgctaagcccaaggataaaaagatgaataatacatgatgctggaggaggaattcaagg

SEQ ID NO: 53660 - DNA, 201 bp, Homo sapiens
tgaagtcctcggtgtgtgcacctgagtagactgcatttcactgaaacctgagaaatgccataccaaaactttgttctgtcggctttttaaaaaaaaaaaamaaactaaaactgggtatccttactaagatttttttaagtggtaaactatatcccttattttgttcttcctcctcctcttctattaaatttgtaatgaatt

SEQ ID NO: 53661 - DNA, 201 bp, Homo sapiens
tgccattgcactccagcctgggcgacaagagcaaaactccatctcaaaaaaaaaaaaaaaagaaagaaaagaaaaagaaaaaagaaaagaatgcattattytgagggaaaaaaaaaccttccccaatagccctggggaaatcctgaggagctttgaataagaattagcaaaacttcaaaactccacatttctattttttat

SEQ ID NO: 53662 - DNA, 201 bp, Homo sapiens
aactgtctctcatctctccctttcatttgtcttgttgtttcatatgcagaaatttaacatataataaagcaaaataagaattattatttcagagaaaaatytaaattgtagatttacatttaacattttttgaatacaacatataattcttgccttcttcggagcagttactgaaaagaaaacatgttccttccgttttca

SEQ ID NO: 53663 - DNA, 201 bp, Homo sapiens
aaattctattgttcttttaaaatcattttatataagtccattgaagtctaactgatgctatcttctgtccacctagattggtgtctggtgcatattaggtrtaccatgttacatgactgaataaatacatgaggatatatctacctagctatcttgcttcataaagaattccaggtggcttgtgaaaaccatgcaatataa

SEQ ID NO: 53664 - DNA, 201 bp, Homo sapiens
ttatataagtccattgaagtctaactgatgctatcttctgtccacctagattggtgtctggtgcatattaggtgtaccatgttacatgactgaataaatasatgaggatatatctacctagctatcttgcttcataaagaattccaggtggcttgtgaaaaccatgcaatataaaaggagcaaacaagtacttcccgggaa

SEQ ID NO: 53665 - DNA, 201 bp, Homo sapiens
aagtccattgaagtctaactgatgctatcttctgtccacctagattggtgtctggtgcatattaggtgtaccatgttacatgactgaataaatacatgagkatatatctacctagctatcttgcttcataaagaattccaggtggcttgtgaaaaccatgcaatataaaaggagcaaacaagtacttcccgggaatgatgt

SEQ ID NO: 53666 - DNA, 201 bp, Homo sapiens
tgccactcatccttattaactggtcagttccccggccataccagtcattaaacacttaaatatcagccccgcagatgaacagcacagctgatgcccagcayaaccatgttgaactgaacttcttttgactttagcccacttttagatgaactaaattcaaaataactcaggatactgggatccttattcaattgtattttg

SEQ ID NO: 53667 - DNA, 201 bp, Homo sapiens
aagcaaagaatattaattattggtcctttgcagaaaaaattagtcacccctgaccagtctattaaggaataaggctagaccagccaagcaccagtttcatrgaagacagtttttcatggacgtgggaagtaggaggctggaggggtgatggttttgggacgaaactgttccacctcagatcatcaggcataagattctcaa

SEQ ID NO: 53668 - DNA, 201 bp, Homo sapiens
taggtttcagagcctgggcaccccatgttccctctcccttttcctcctcttggcttctcatctcacctaaggtttttacaagggacaacaatggggaaagygatcttctctcacaggaagggcagggagtaaaggatcagctgatcctgcagtgaaaaaatagcgtaccctctccaaacatgagtgatacttactcctttt

SEQ ID NO: 53669 - DNA, 201 bp, Homo sapiens
gtaggaggctggaggggtgatggttttgggacgaaactgttccacctcagatcatcaggcataagattctcaaaagagcatgcaacctaggtccctcacayatgcagttcacaatagggttctgctcctatgcgaatctgatgactctgctgatctgacaggaggcagagctcaggaagtaatgctggcccgccactcacc

SEQ ID NO: 53670 - DNA, 201 bp, Homo sapiens
taggaggctggaggggtgatggttttgggacgaaactgttccacctcagatcatcaggcataagattctcaaaagagcatgcaacctaggtccctcacacrtgcagttcacaatagggttctgctcctatgcgaatctgatgactctgctgatctgacaggaggcagagctcaggaagtaatgctggcccgccactcacct

SEQ ID NO: 53671 - DNA, 201 bp, Homo sapiens
agctgaatcaaatttgaaaggtcattctgctaacaggttcacattccaatcagtggggtaggttttgctatcgaatgccgcccccccgccgccccgccccrccccagtcgttctccttttgtaatctgtggcacatgcaaagtccacagtatcctatgtgtcagttaacagatgtcatgatagcaacaataacccaaaaca

SEQ ID NO: 53672 - DNA, 201 bp, Homo sapiens
ccaactctgactccacccacagtccaaaaagcactacatttttctgccttcaggtgtcatcgtcacaccagtaattgctgaaaggctcacccttttttcarttccagtgagcctccgtttttaaagctagcccttcctctttaagaatgtattattttgggctgggggcagtggctcacgcctgtaatccgagcactttgg

SEQ ID NO: 53673 - DNA, 201 bp, Homo sapiens
cagggccggtccctgctcatggggttggctctcacagacacagcttctcactttgcatcatattccagcccagcccaaggtctcgggtagaagttgccctycctgcctttcctttgtgtgctgccagaaatccccagaccctgggcttcagagcagaaagttctaacaatcaccaactctgactccacccacagtccaaaa

SEQ ID NO: 53674 - DNA, 201 bp, Homo sapiens
tcatctcttcacaacctggcattcagtgatggtaagttggtagcttgaattagccatagtgagaatatttacaacacagaaatcagcaagtcatgcaaatyaagtgggttttttttttctccttgtagagccacttgttaacctgttccagcacaccagtgagtccatttgatcaaaggaggggccagaatccagggaaca

SEQ ID NO: 53675 - DNA, 201 bp, Homo sapiens
ttacattaaattatattaaatacattatattaaataattacattaatataataaattatattaaattatattaaaaataaaggtaataacatattgcctcytatttcactacattttattattttctctgttcatgaggctatgtacatctgtataatctgagtggttcattcatgctcatctcttcacaacctggcattc

SEQ ID NO: 53676 - DNA, 201 bp, Homo sapiens
ccttcaaagatcacctctgcctctgcacagctttcctctgttcccagttttctcttttttgcctgtttatctaaacatccgaagagaaaagcaaaagcagmttctaagcaggtgacaatgctagacaccttaggctcatgaaagggtcttgaagaaaacaggagagcacccaactttgttccaagagctttcattttattt

SEQ ID NO: 53677 - DNA, 201 bp, Homo sapiens
aggagctccttcaaagatcacctctgcctctgcacagctttcctctgttcccagttttctcttttttgcctgtttatctaaacatccgaagagaaaagcamaagcagattctaagcaggtgacaatgctagacaccttaggctcatgaaagggtcttgaagaaaacaggagagcacccaactttgttccaagagctttcat

SEQ ID NO: 53678 - DNA, 201 bp, Homo sapiens
gtaataaatatactatttattaataatatattattaaaacattattttataataataaataaaatacgttatttattattatatgttatattatttaatakgtataattatttaataaattacattaaattatattaaatacattatattaaataattacattaatataataaattatattaaattatattaaaaataaag

SEQ ID NO: 53679 - DNA, 201 bp, Homo sapiens
tgagaggagctccttcaaagatcacctctgcctctgcacagctttcctctgttcccagttttctcttttttgcctgtttatctaaacatccgaagagaaamgcaaaagcagattctaagcaggtgacaatgctagacaccttaggctcatgaaagggtcttgaagaaaacaggagagcacccaactttgttccaagagctt

SEQ ID NO: 53680 - DNA, 201 bp, Homo sapiens
tggaggggcagcctgaagggcaactagagcgtgatgtcaaggagtttggactttatccccagggcggtggagagccaggccaggaccaggatcagatttcscttttaggatgagcacatctagatgataactggagatggggaaaggctggactcgtgcaatagtctaagcagtggtatggtagagctgccgcctaatagc

SEQ ID NO: 53681 - DNA, 201 bp, Homo sapiens
aaaacacaacaaagaaaaaataaataacaacataaatgcatgtgtatgtgtatgtgaaacagagagagagaggaacacctaaataagttatgtgtccatakgcctgaccagtatagtgtcatctacaaccagtaaaaacctcttagtaatattatttatgaaataatactttttctagctacgacgaaaggaaaaggaaaa

SEQ ID NO: 53682 - DNA, 201 bp, Homo sapiens
aatcttttattgatgattcaagaaatgcattccatttgagggttataaaggtgaacaggtcaactttcttgaccttagggaactcacagtcctttaaggaragacagacatgcaaacagacagctgtagctctgtgtgaaaagtgcaaaagcatagctctaagcagtgaactgtgggaccacagttcacatggacagagct

SEQ ID NO: 53683 - DNA, 201 bp, Homo sapiens
gatgataccaataactgtttaccaaagaaaccagatagcctttgttttgcaaattgggtaaagaacttcagtgacaaataagtgatccatggaaataatgytcacatcagcttccttccctgaatttttttcttttaaaaaaattagaagcaaaaaggcgtatttgttatattcattgcattgtagaaaaactataaaatg

SEQ ID NO: 53684 - DNA, 201 bp, Homo sapiens
ccatgtatctatgggcaactgatttttgacaacgatataaagtcattcaaaggagaaaaatggtatcttcaacaaatgatgctggaaggagtggatagccrcatgcaaaagaatggacttagaccccaacctctcaacatatacaaaaattaactcaaaattgatcaaattccttaaatataagagctaatctgacaaaac

SEQ ID NO: 53685 - DNA, 201 bp, Homo sapiens
gtaaaaagtctgacagtttagagccagtatggcaggctggtgatcaacagggacccaagttcccttaaacattttgctctgctattcttaacacatacttscattctcgtggttgcctcatgacttgaggtggccaggggagctttagtcattatgtccctactgtagaaggatggaactgagaagaaaggacaaaggaga

SEQ ID NO: 53686 - DNA, 201 bp, Homo sapiens
tatgtccttcctgcctttttggtgttaacgtttctttgtctttgtgaaatgagtgtgaaaacaggtggtagtagttcttttgatggttaaatggtaatgtycttacttagtaaaatgaaaagtaggtaacctcgtgtttgttatgcaggcccctgcataatgtctacacataaggtccacatgaaatattaatggttatag

SEQ ID NO: 53687 - DNA, 201 bp, Homo sapiens
agtatggcaggctggtgatcaacagggacccaagttcccttaaacattttgctctgctattcttaacacatacttccattctcgtggttgcctcatgactygaggtggccaggggagctttagtcattatgtccctactgtagaaggatggaactgagaagaaaggacaaaggagataaatgaagttttgtaggtaagcac

SEQ ID NO: 53688 - DNA, 201 bp, Homo sapiens
aaatagtatacacttcctagaattatggcattgaaagggaaaaatgtgaaatgcctgtcacataataagcattcagctcatgttgggtgttattaatgccstcaacagatcttacagttgagggtaaatatatagataaataactaacagaaatccaagtgccaaaagtgctctgatacaagacttcatgaagatcagtgg

SEQ ID NO: 53689 - DNA, 201 bp, Homo sapiens
ggtaagcacatggccatactcaaaaatatggaaggtcccaagcctcaagttatggaataagaatttcactacattgacatccactgaaagtgtgttaggtyttatttgtcttagacatttctcaagttcttccttgctcctcatgctagttcagtctgtgacgtaagtaatgtgccaagggaagaaaagtctctggaaatt

SEQ ID NO: 53690 - DNA, 201 bp, Homo sapiens
ttaggttttatttgtcttagacatttctcaagttcttccttgctcctcatgctagttcagtctgtgacgtaagtaatgtgccaagggaagaaaagtctctrgaaattctgcaagaactcccagagtttggacccagttttagtgaatgaaatgccatgaggaaatgaccgaggaacttcctccacagaggattgaaggttg

SEQ ID NO: 53691 - DNA, 201 bp, Homo sapiens
ctatccatatggcaccttacagtttataatacactttcatattcattatctcattttatccttataatggtctcatgatattggccaggaaattatttttsccatgtaagctgattaaactgaggcttggagaggctggtcagcagtggagttaaaactctagcccacatcttctcaaacacaatgtgtttttccttctgc

SEQ ID NO: 53692 - DNA, 201 bp, Homo sapiens
ccttcagtgtagagataaggaaaataggcacaggtcttttagcctcagcagaccctcccatgagacccagatcttctgactccagtccagaatctatcctrgcactaatatagaaagctttctgcctatgaaatggaaataccaagaaaagcactgaaatttaacctgaatgaacatatgcccattgactgttatgcattt

SEQ ID NO: 53693 - DNA, 201 bp, Homo sapiens
aagcccaaggataaaaagatgaataatacatgatgctggaggaggaattcaaggaactagcaaagagctgcaagaggccaggtgaaagttatcagagaccraatctcaaatttgatgagttagttactgttctttggtaaaagtgaatgaaaattttaaagaatatgaaacttgttgatcaagtaagttccaatcatctct

SEQ ID NO: 53694 - DNA, 201 bp, Homo sapiens
tcttacaccagcctcacaaccaacctgtggggtgtgaagtgttttcctcatttgatagctgagaaagctgaggtttgaagacagtaagtatcctaagatawcctaagataagttacctcaagtattaatattcttccaaaaggtaataagggattattagaaactctgtatccaattttccttaagggaaaaacaaaccaa

SEQ ID NO: 53695 - DNA, 201 bp, Homo sapiens
gagccctggagacctggttattaggcttctgattatcagagcttctccccatcttctcagtgcctagagacccagatcccccaacagcttcctggggtgcyaggaatctggccccaggggatctggagggtgggaagcccagaaatgggcacaccattcaaaatcagtcagatttcacctgaggcacaaaagacaaatttc

SEQ ID NO: 53696 - DNA, 201 bp, Homo sapiens
taactgtaaaagttctggtattttagttctctctttcctaatggaaagtttttgtttgtttgtttgtttgtttttgtttttttgtgtgtgtgtgttgttttttgtttttgttttttgttttttgttttttgttttttttgagacggagtctcgctctgtggccaggctggactgcagtggcgcgatctctgctcactgcaa

SEQ ID NO: 53697 - DNA, 201 bp, Homo sapiens
agagtaactgtaaaagttctggtattttagttctctctttcctaatggaaagtttttgtttgtttgtttgtttgtttttgtttttttgtgtgtgtgtgttgttttttgtttttgttttttgttttttgttttttgttttttttgagacggagtctcgctctgtggccaggctggactgcagtggcgcgatctctgctcact

SEQ ID NO: 53698 - DNA, 201 bp, Homo sapiens
taaacagattgtccactagaaagagtaactgtaaaagttctggtattttagttctctctttcctaatggaaagtttttgtttgtttgtttgtttgtttttktttttttgtgtgtgtgtgttgttttttgtttttgttttttgttttttgttttttgttttttttgagacggagtctcgctctgtggccaggctggactgca

SEQ ID NO: 53699 - DNA, 201 bp, Homo sapiens
attaagcaagaacgaatgaaataaaaattatccagataggagagaaagtaaaactatttctttttgcatatggtattatcttttatatagaaaaaccctasagaatactctaaaaaaacttttagaactaataaatgagttcagaaaggttgcaaggaatgaattcaatgtgttaatcaattgtgtttttatacacctgaa

SEQ ID NO: 53700 - DNA, 201 bp, Homo sapiens
gaaagctgaggtttgaagacagtaagtatcctaagatatcctaagataagttacctcaagtattaatattcttccaaaaggtaataagggattattagaarctctgtatccaattttccttaagggaaaaacaaaccaattaatccatcagaaggaatcttgaaacatccttagaccttgacaatttttctttaatggata

SEQ ID NO: 53701 - DNA, 201 bp, Homo sapiens
ccatatcaatagaataaaaacaaaaatcatatgatcatctcagtagatacagtaaaagcatttggcaaaattcaacattatttcatgataaaaaaacattyagcaacctaggaataaaacctaggaataaaaataaccgttttcaaatcaataaagagcgtctatgaaaacccacagctgatggcatagtcagtggtgaaa

SEQ ID NO: 53702 - DNA, 201 bp, Homo sapiens
ttttcacagacttttccaaaacatagaagagtggaaaacactacctaactcactgaagtcagcattatccttataccaaaaccacacagaaacatgacaaraaaataaagcttcagaccagtatctattgtgaatatggctacaaagatcctccaaaaacaccaacaacctaaatccagcaacgtatgaaaagaattatac

SEQ ID NO: 53703 - DNA, 201 bp, Homo sapiens
ccaggaggcaaagcacatattttggcacagctattatgacacaggtgaacaaaatgtgaaaacatgggtttatgttacaagggagcattcatatcacccasccgatcgcttgccgctgctgaccctctccaatttccagcttcgatattctcccaaagcctcaccccgcctctgatcttcgccttgatgctaaccctactc

SEQ ID NO: 53704 - DNA, 201 bp, Homo sapiens
gacttcagatgggttttgaagattggccggaggcttaactagggaaagaaaaggggagtggcttcctggaggagagcagcctgagcagaagcacagtacayaactgagcatggcacattggatgaccccaacaagaaggccttaccccggctggaacaaggagaaagctcagaaatgactgagaagttcaggagtcaggtt

SEQ ID NO: 53705 - DNA, 201 bp, Homo sapiens
tatccttactaagatttttttaagtggtaaactatatcccttattttgttcttcctcctcctcttctattaaatttgtaatgaattgttagttaaaatagwtaattaaacaaaaacttaaaaagctttaaaagttaggattttataaacacctttatgactttcatatgttttccacatgaaagtatgtcaaaattacaga

SEQ ID NO: 53706 - DNA, 201 bp, Homo sapiens
attctgcccatcttctgccttctctgttttgccaaccatattccagctctgcaccctggagcctcatgtcagtcctgccctttggatctgcagcttgtgckggaaattgctctctggctttccctttgaccaaggttcacccggcaaatgactcctggcctctgcttttctgtgtcagtacctggaactgtgggtgagagg

SEQ ID NO: 53707 - DNA, 201 bp, Homo sapiens
cagtactctgcctgtgtagctactgactttcagaataacttcttacaacataacccagaggattacaaaaggaaaaaaaatacagcatagtgcttatatgmataagctttggagtcagacagaactgggctcaaacctgactaatcataacatgtagatgatgatgatgatcttcctcttaggggtcgaagtgaggattag

SEQ ID NO: 53708 - DNA, 201 bp, Homo sapiens
acagtactctgcctgtgtagctactgactttcagaataacttcttacaacataacccagaggattacaaaaggaaaaaaaatacagcatagtgcttatatrcataagctttggagtcagacagaactgggctcaaacctgactaatcataacatgtagatgatgatgatgatcttcctcttaggggtcgaagtgaggatta

SEQ ID NO: 53709 - DNA, 201 bp, Homo sapiens
gctgcaaagtagaatacgtcttccacattctcttcttcctgaatgcctcagaaatactagaaatagatgtttttatttgaggattttatagtcaccataartaaataaataataagtaataaaaataagatgaaatagggttcaaaaatcttgttttttcatgttttaaattttaaaaaacttatgactaaactaccacat

SEQ ID NO: 53710 - DNA, 201 bp, Homo sapiens
aaaaaacttatgactaaactaccacattcaacctacatttattagacatattatgtgtcagcctgtgtactagtgacattcaagagaaggtgtagagtttsctggttaagaatgggcagaagtaaaaagtcctagtgttaatcttaactctaccaacaattatctggcaatttggatcacctttctgtctgtttcatcatc

SEQ ID NO: 53711 - DNA, 201 bp, Homo sapiens
ccttgagggacaggaaaaatgccatgaatgtctccatgtcacaaactcagctccagagccttggtggcagtgttccaatgggaagcgattcctgtgggccrccgagaagggctgagctcaaacacttgcctttggaggtccttgtgccctggaaagtcactgccttcggatggccactgtcactcagccaggaggcaaagc

SEQ ID NO: 53712 - DNA, 201 bp, Homo sapiens
acaattgtataccaataaattagataaatgaaatggacaaattcctaagaagacacaatctagtaaaaccgagtcaagaagaaatacacagtctgaatatrcctacaataagaaaagatattaaagcagtaatcaaaaactatccacaaagaaaagcccaggcccagaagggttcactggtaaattctaccaatacattga

SEQ ID NO: 53713 - DNA, 201 bp, Homo sapiens
ctgaaggttggttctttgagaaaataaacaaaggtgacaaactttctactagattgatcaaataaaaaagaaacaattttttttttttgaggcggagtctkgctctgtcccccaggctggagtacagtggcatgatctcggctcactgcaagctccgcctcccgggttcacaccattctcctgcctcagcctcctgagtag

SEQ ID NO: 53714 - DNA, 201 bp, Homo sapiens
gtcaccagatattgcctaacgtcccccagggtgcaaaatcacacttgatttacaatgactacttcaatttagtcctcacgatatcctacatcaatatttcyttagtaaggaatttgagagtctaccacttgtgaaaagtttcaagagtacagttttcctttgcctgagctcgtaactactaccctttactacttctcatgt

SEQ ID NO: 53715 - DNA, 201 bp, Homo sapiens
ttttctcttttttgcctgtttatctaaacatccgaagagaaaagcaaaagcagattctaagcaggtgacaatgctagacaccttaggctcatgaaagggtsttgaagaaaacaggagagcacccaactttgttccaagagctttcattttattttctatcacgtattttaaataatcatttttgtggtataaaagaaattt

SEQ ID NO: 53716 - DNA, 201 bp, Homo sapiens
atttgagagtctaccacttgtgaaaagtttcaagagtacagttttcctttgcctgagctcgtaactactaccctttactacttctcatgttgagtcattcmagatatcactgtcccaaaacttcaactaaaaagtaggacttagctttgcctagagttgcttgttgatttttaagtgagaaatgcaagaaaatgcatctgg

SEQ ID NO: 53717 - DNA, 201 bp, Homo sapiens
cgtaactactaccctttactacttctcatgttgagtcattccagatatcactgtcccaaaacttcaactaaaaagtaggacttagctttgcctagagttgsttgttgatttttaagtgagaaatgcaagaaaatgcatctggctttagagtgatcaaagagaaagcagctggaagtctactacacctcatcagagacatca

SEQ ID NO: 53718 - DNA, 201 bp, Homo sapiens
aaaatgatttctacatatatatatatatatatatgcttccaagcgtgttttgtttttaaaagaagggtggcatccttaacctaaagaaatggatgtctacrgatggaatttccaacattagtgaaagatatgtagaggaaatgcttttgcacacaggcctccctttcaagagtctgccaacattacagcacatctgtgatc

SEQ ID NO: 53719 - DNA, 201 bp, Homo sapiens
tgaatcagatgtcatctgtcatccaatcactgcacatagggtcacaccttatcttagctactgagtttctatccttagttgactcatgttgaggaatgagwggagctccttcaaagatcacctctgcctctgcacagctttcctctgttcccagttttctcttttttgcctgtttatctaaacatccgaagagaaaagcaa

SEQ ID NO: 53720 - DNA, 201 bp, Homo sapiens
ctgtgggccaccgagaagggctgagctcaaacacttgcctttggaggtccttgtgccctggaaagtcactgccttcggatggccactgtcactcagccagraggcaaagcacatattttggcacagctattatgacacaggtgaacaaaatgtgaaaacatgggtttatgttacaagggagcattcatatcacccacccga

SEQ ID NO: 53721 - DNA, 201 bp, Homo sapiens
tactaaaaatacaaaattagccgggagtggtgtcacatgcctgtaatcccagctactcgggaggctgaggcaggagaattgcttgaacccaggaggcggargttgccatgaacttagatcacgccattgcactccagcctgggcaacaagagtgaaactccatctcaaaaaaaagaaaagaaaagaaatttgtcataattt

SEQ ID NO: 53722 - DNA, 201 bp, Homo sapiens
gtccttgtgccctggaaagtcactgccttcggatggccactgtcactcagccaggaggcaaagcacatattttggcacagctattatgacacaggtgaacmaaatgtgaaaacatgggtttatgttacaagggagcattcatatcacccacccgatcgcttgccgctgctgaccctctccaatttccagcttcgatattct

SEQ ID NO: 53723 - DNA, 201 bp, Homo sapiens
attgccacaagacatcatttttttcattagtttactgaaatttttcatgactacagattctttttgaaatttgtgataatttggccaggcatggtgtctaygcctgtaatctcagcactttgggaggtggaggcaggcagatcacctgaggtcgggagttcgagaccagcctgaccaacatggagaaaccccacctctact

SEQ ID NO: 53724 - DNA, 201 bp, Homo sapiens
cccgatcgcttgccgctgctgaccctctccaatttccagcttcgatattctcccaaagcctcaccccgcctctgatcttcgccttgatgctaaccctactycatccctgacctcaaacctcatctgacccttatcagaggcctgaacctttcccttccctgtgcctcattccttccctgactctcacctgtaattatgacg

SEQ ID NO: 53725 - DNA, 201 bp, Homo sapiens
agaagaaagacaccccttcccacaaataggaaagaagatgacagagatcagaatctaagagagtgtgagactaaagacgatgaaaattgggccactcattcagcttgtgctgagttgccttgattgtccagcaaataaagggtgaaggcatctcctgaaaatgaaagtctgatggggtcagcttaggtaggtggagaatga

SEQ ID NO: 53726 - DNA, 201 bp, Homo sapiens
tttgaacccaggaggcagaggttgcagtgagctgagattgcgccgctgcactccagcctaggcaccaaagcaagactccatctcaaaaaaaaaaaaaaaaagatagaagaaagacaccccttcccacaaataggaaagaagatgacagagatcagaatctaagagagtgtgagactaaagacgatgaaaattgggccactc

SEQ ID NO: 53727 - DNA, 201 bp, Homo sapiens
ttaaagagcaaatggggccaggcgcagtggctcacacctgtaatcccagcactttgggagaggcggcgagtggatcactggaggtcaggagttcaagaccwgcctgggaaacatggtgaaaccctgtctctactaaaaatacaaaaaaaattagccagatgtggtggcagtgccttgtaatcccagcttctcaggaggctg

SEQ ID NO: 53728 - DNA, 201 bp, Homo sapiens
actgagtggccaggatagtttggaatatagtcacagcagagcagtgaggaagaaagccagatcatggaaaggggttaaagagcaaatggggccaggcgcartggctcacacctgtaatcccagcactttgggagaggcggcgagtggatcactggaggtcaggagttcaagacctgcctgggaaacatggtgaaaccctgt

SEQ ID NO: 53729 - DNA, 201 bp, Homo sapiens
ttctcctacctcagcctcccaagtagctgggactacaggcgctggccaccaggcccagctaatgtttgtatttttagtggagatggagtttcaccatgttkgccacctaatggaaagtttttaaagtatagcttcaatcgattagtcagctagatcataaagtctaccggggtcaagattaccttttctatctttaaaata

SEQ ID NO: 53730 - DNA, 201 bp, Homo sapiens
aaagtaaaagccctatctttaaaaatacatcatcttaaatccattattaaggtttaaccactgttagtcccttagactatatctttcataatacttttctrtgattcagggccaggattagtgtgagacaaccaaagcaggaatgcatcctgtatttaaaattttgaaattttgtttatcatggatttttttggcatttat

SEQ ID NO: 53731 - DNA, 201 bp, Homo sapiens
ttgttcttttaaaatcattttatataagtccattgaagtctaactgatgctatcttctgtccacctagattggtgtctggtgcatattaggtgtaccatgytacatgactgaataaatacatgaggatatatctacctagctatcttgcttcataaagaattccaggtggcttgtgaaaaccatgcaatataaaaggagca

SEQ ID NO: 53732 - DNA, 201 bp, Homo sapiens
tgtgaggggatgaaggtgctccctgcatctggccttgctgtcttcctcatcatggctttgacgttttccactgcagccccctccctagttgcagcctcccycaggacctggaggaacaactaccgcctcgcacaggtttgtgaatttttgcccaattccttcttgctcctctgccctagaaaacctaaaagggcatagtga

SEQ ID NO: 53733 - DNA, 201 bp, Homo sapiens
ttagtgagtggcctctgagtacatttcagtcaaagtgcaattttatatgtaaatcaatcattgatcttgattttttttttttttttttggaatgtcccatwggattttctggagacggcaggttcacttgcggacaggaattcggcccagcactattaccagctccttcccccagctcatgtccaatgtggatgcagctta

SEQ ID NO: 53734 - DNA, 201 bp, Homo sapiens; identical to SEQ ID NO: 11828

SEQ ID NO: 53735 - DNA, 201 bp, Homo sapiens
ttatcgcctcttccctggtgaacccaaatggaaaaaaaatactttgacatacaggtaatgagatcaagtctttccaaattcagagaaaaacaccacctctmtctttttcccttttcttgaaaaaatattttccttctcatccgtataaaaatcctgacacctcacaaccataagaataagaactttttacatccatccgtc

SEQ ID NO: 53736 - DNA, 201 bp, Homo sapiens
gtactagtgacattcaagagaaggtgtagagtttgctggttaagaatgggcagaagtaaaaagtcctagtgttaatcttaactctaccaacaattatctgrcaatttggatcacctttctgtctgtttcatcatctgcaaaatgggggtagaaatagtatacacttcctagaattatggcattgaaagggaaaaatgtgaa

SEQ ID NO: 53737 - DNA, 201 bp, Homo sapiens
ctctctttttcccttttcttgaaaaaatattttccttctcatccgtataaaaatcctgacacctcacaaccataagaataagaactttttacatccatccrtcaggcaatgacaatgggcaattcaccagaaaatacggttttaggattatcataatgactggctattttaggcattccaaacaattttaccagctagaaa

SEQ ID NO: 53738 - DNA, 201 bp, Homo sapiens
gcatggggaaaacctcaaacagttcagtatgactagaatatagactaaaatcagaacgatggcccaaggaaaccaggttacagatcatgtagtgtcaatgyctttctagggagatcagtgtttattctgcagagaagagggacatgttaaataccttccataagggagaaactcaataagattaatgttataaaaataaca

SEQ ID NO: 53739 - DNA, 201 bp, Homo sapiens
tttaacattttttgaatacaacatataattcttgccttcttcggagcagttactgaaaagaaaacatgttccttccgttttcacagaatatctaaatacayaccttccatgagttctgtcgaggtggacaaagcagtggagatggccttgcaggcctggagtagcgccgtccctctgagctttgtcagaataaactcagga

SEQ ID NO: 53740 - DNA, 201 bp, Homo sapiens
acttagaaataaatgaaaattaaaatacaacataccagaacttatgagatgcagtgaaagcagcactcagagaaaaaaattatagctataaaagcctatayttaaaaaggagaaaaatctcaaatcaataacttcaccttccactttgagataatggaaaatcaagaacatattaaacctaaagcaagaagaaagaaggaa

SEQ ID NO: 53741 - DNA, 201 bp, Homo sapiens
gagaggatatatgcaatgattttagcagatactcaagatatagttgattctcaataaaaattgtatttatttccttaatattgaaattcagttactatttyttgatggctggcttactgtgtgccaggaatcatgctgagcgttttctcatattctctcattgtcccatccacctttcaacaatcttgagaagtaggtatt

SEQ ID NO: 53742 - DNA, 201 bp, Homo sapiens
aaagcaaaatttacccagaatcccaccacctggagtgtatcagtctgcaggagctgctataaccaagtaccatagaccaggtggcttagacaacagaaatktattcctcacagttttggagggtaagaagttcaagatcaaggtactgcaaggtaagtttcaccccaaggcctcttttcctggcttgtaggcagccgccat

SEQ ID NO: 53743 - DNA, 201 bp, Homo sapiens
ccagcctcacaaccaacctgtggggtgtgaagtgttttcctcatttgatagctgagaaagctgaggtttgaagacagtaagtatcctaagatatcctaagrtaagttacctcaagtattaatattcttccaaaaggtaataagggattattagaaactctgtatccaattttccttaagggaaaaacaaaccaattaatcc

SEQ ID NO: 53744 - DNA, 201 bp, Homo sapiens
catatctgctcctctacctccccactttccccacatggcctcatcattataatattcttaaatgcacactttgtgtcttagcacagcaacttataagagamaacatttcagagctatgtattgaattgcattaattggaacacacttgctcttcaggtttcatcccaggttcccaattaatccaagaagtagttgcgggat

SEQ ID NO: 53745 - DNA, 201 bp, Homo sapiens
cattccttttttggattttatcatcagcttaagttgcctcattagggatacctttattaagcccctaaatgcaatgggatatacttcttgtgtgttctcaragtatcctgaacttaactcttcgtagcaccaatcactctgatcgttactaatcagtctctactattagattgtaaacatattgagggcagggccgacatc

SEQ ID NO: 53746 - DNA, 201 bp, Homo sapiens
ataaatatgtgtgtgatgtgtgattaaattttgcatctttcctttacagcatattagtcctggatagccttagaaaatatagtcatttgtctgtttgtttrtgtttttcctttgagtgcaggttagaatttacacattgggagaggatggatatagtttatagttcatatatgtggtgcttacccatttgcagataagtga

SEQ ID NO: 53747 - DNA, 201 bp, Homo sapiens
agaggggatcacagaaatgctaagacaatgaaaagggagtagaaactgtttaccaaggtccaaaaagttgtgtttttccttaaaaacatggcaagggtggratggacatggtcattcatgtctgtaatcccagcactttgggaggccgaggcaggtgggtcacttgaggtcaggagttcgagaccagcctggccaatgtgg

SEQ ID NO: 53748 - DNA, 201 bp, Homo sapiens
tgccgctgctgaccctctccaatttccagcttcgatattctcccaaagcctcaccccgcctctgatcttcgccttgatgctaaccctactccatccctgayctcaaacctcatctgacccttatcagaggcctgaacctttcccttccctgtgcctcattccttccctgactctcacctgtaattatgacgaggcttcatc

SEQ ID NO: 53749 - DNA, 201 bp, Homo sapiens
agttataaatatgtgtgtgatgtgtgattaaattttgcatctttcctttacagcatattagtcctggatagccttagaaaatatagtcatttgtctgtttrtttgtgtttttcctttgagtgcaggttagaatttacacattgggagaggatggatatagtttatagttcatatatgtggtgcttacccatttgcagataa

SEQ ID NO: 53750 - DNA, 201 bp, Homo sapiens
aaccctactccatccctgacctcaaacctcatctgacccttatcagaggcctgaacctttcccttccctgtgcctcattccttccctgactctcacctgtrattatgacgaggcttcatcaaagagcaggaacctgccagaggtgacagtccaagctgtgcaggctcattcttctggagctgggacacagtcctgagagat

SEQ ID NO: 53751 - DNA, 201 bp, Homo sapiens
tagttataaatatgtgtgtgatgtgtgattaaattttgcatctttcctttacagcatattagtcctggatagccttagaaaatatagtcatttgtctgtttgtttgtgtttttcctttgagtgcaggttagaatttacacattgggagaggatggatatagtttatagttcatatatgtggtgcttacccatttgcagata

SEQ ID NO: 53752 - DNA, 201 bp, Homo sapiens
ctagttataaatatgtgtgtgatgtgtgattaaattttgcatctttcctttacagcatattagtcctggatagccttagaaaatatagtcatttgtctgtttgtttgtgtttttcctttgagtgcaggttagaatttacacattgggagaggatggatatagtttatagttcatatatgtggtgcttacccatttgcagat

SEQ ID NO: 53753 - DNA, 201 bp, Homo sapiens
gtgtacaacctcccctggggctctagagcagaagtgtgtgaactccaaattcccgttaccattttgaccaactcattttgaatcctaggacctcggaaagyattcctggggaagcccactctgccccatgccccccatcacaagccatccatccctgacctctgtgactccagctcatcctttgacgctgtgacaatgctg

SEQ ID NO: 53754 - DNA, 201 bp, Homo sapiens
gctagttataaatatgtgtgtgatgtgtgattaaattttgcatctttcctttacagcatattagtcctggatagccttagaaaatatagtcatttgtctgtttgtttgtgtttttcctttgagtgcaggttagaatttacacattgggagaggatggatatagtttatagttcatatatgtggtgcttacccatttgcaga

SEQ ID NO: 53755 - DNA, 201 bp, Homo sapiens
tatttttcaaaactgatcttagtagaggcctagtactgtctcatataaatataggataatatatataataaatcccctgacatcagacattaaggttactyccaattacttattatctttatatatatgttaaaaatatgtgtgtataatatgtaagtaaacaatttgcatagtttatatgtggtaatatatggttaatat

SEQ ID NO: 53756 - DNA, 201 bp, Homo sapiens
ttgctagttataaatatgtgtgtgatgtgtgattaaattttgcatctttcctttacagcatattagtcctggatagccttagaaaatatagtcatttgtctgtttgtttgtgtttttcctttgagtgcaggttagaatttacacattgggagaggatggatatagtttatagttcatatatgtggtgcttacccatttgca

SEQ ID NO: 53757 - DNA, 201 bp, Homo sapiens
gtatattgccattacataaagagcattctttcataccattaaatatttatttttcaaaactgatcttagtagaggcctagtactgtctcatataaatatargataatatatataataaatcccctgacatcagacattaaggttacttccaattacttattatctttatatatatgttaaaaatatgtgtgtataatatgt

SEQ ID NO: 53758 - DNA, 201 bp, Homo sapiens
tcactatcactgtctcagctgaatcaaatttgaaaggtcattctgctaacaggttcacattccaatcagtggggtaggttttgctatcgaatgccgccccmccgccgccccgccccgccccagtcgttctccttttgtaatctgtggcacatgcaaagtccacagtatcctatgtgtcagttaacagatgtcatgatagca

SEQ ID NO: 53759 - DNA, 201 bp, Homo sapiens
gaagtcctcggtgtgtgcacctgagtagactgcatttcactgaaacctgagaaatgccataccaaaactttgttctgtcggctttttaaaaaaaaaaaacmaactaaaactgggtatccttactaagatttttttaagtggtaaactatatcccttattttgttcttcctcctcctcttctattaaatttgtaatgaattg

SEQ ID NO: 53760 - DNA, 201 bp, Homo sapiens
cttttttcctttttactatctatctttatttaatgagaatgattttaaaaagataaaaacccttccacgaaagaatgcaaagcaagtttgcgataggcccrttgactcttctcggccactggggtgcgatttacagatggttgactgtcttcaagatatggaaccatcaaaatgatgagtgaaaccttcattcaataatcc

SEQ ID NO: 53761 - DNA, 201 bp, Homo sapiens
tttcaatgcactcattaaccggacacctagtggcctaaaagcgtagatgcagcatcaccaaatccctaactacccactgagaatgcctgactttgctgttwtgtgagcatcaaatgcatcccacaatactccatgatttggggcaaaatggagatggtcctgaccatgggtctctttgaaggatagttctgctggaaggaa

SEQ ID NO: 53762 - DNA, 201 bp, Homo sapiens
tagtggtggattccatgacatatattgtaattcttttcataggaaatgtcattacagtatgaattataattatttacaagcaatggcttttgtggccatcwtttggccatcatttgttataataaatataaatttcccaatttttacttaaaagacatcacaacaaaatactgcataagagtggtttcttgtgtgtttaac

SEQ ID NO: 53763 - DNA, 201 bp, Homo sapiens
ccttacaattcccctgtgaggcctgaagtattattccttttacaagtcatagaaaggataagcaacttgttcaagagtacatagctagtaaggggtggagstggaattcaaacccaaactagcaaacttcagaatccgtgcccctaactaccctgcctcctaaggtgctgtccagagctggaatcccatgactctatagct

SEQ ID NO: 53764 - DNA, 201 bp, Homo sapiens
cttgccactaactcaccgtggcacctggagcttctcttccttttctataaagtgagggagttgtctgtaataatagtgacttaaaagtgttcagtacttaytatgcaaagcactatattatcacatccttacaattcccctgtgaggcctgaagtattattccttttacaagtcatagaaaggataagcaacttgttcaag

SEQ ID NO: 53765 - DNA, 201 bp, Homo sapiens
tacaatgtacgtatctgcttagtcaccaccttctcatcttcttccatttcagattcaatgagctactggggtagggcagatgattccaaagaactagaackagctataagcaggatggggagtcaggagtggtcccagcactggacttgccactaactcaccgtggcacctggagcttctcttccttttctataaagtgag

SEQ ID NO: 53766 - DNA, 201 bp, Homo sapiens
atactgagggtgataacagactagtaagtgagacattggtgcaagagacgtctagaaatgaaaaatcagcagagggaccgcaggagagatggcctgctacmatgtacgtatctgcttagtcaccaccttctcatcttcttccatttcagattcaatgagctactggggtagggcagatgattccaaagaactagaactagc

SEQ ID NO: 53767 - DNA, 201 bp, Homo sapiens
tttgacatagtcttgattataaatactgagggtgataacagactagtaagtgagacattggtgcaagagacgtctagaaatgaaaaatcagcagagggacygcaggagagatggcctgctacaatgtacgtatctgcttagtcaccaccttctcatcttcttccatttcagattcaatgagctactggggtagggcagatg

SEQ ID NO: 53768 - DNA, 201 bp, Homo sapiens
ttttttatttttcaatgggctgttactcattgacaaatgaacttcccattataacaaataaatactgaaaagtgaatttaagtgtcaatgctactcaaaaygtcccttttctgtaatatgatgcgcccctcagaatttctagaaggactcaatcttgttggcctttctccccacttgtttagatcacggggattcctatcc

SEQ ID NO: 53769 - DNA, 201 bp, Homo sapiens
aatactgaaaagtgaatttaagtgtcaatgctactcaaaatgtcccttttctgtaatatgatgcgcccctcagaatttctagaaggactcaatcttgttgrcctttctccccacttgtttagatcacggggattcctatccattcgatgggcctcgggggactctagcccatgcatttgctcctggagaaggcctgggagg

SEQ ID NO: 53770 - DNA, 201 bp, Homo sapiens
ctctctcatattgtctaggttttaatttgtttaccgttgctgctcatgaatttggccatgccctgggcctggcccattccacagacccatcagcactgatrtacccaacttataagtacaagaatccctatggattccacctccccaaagatgatgtgaaagggatccaggcattatacggtaagattattaccttctttg

SEQ ID NO: 53771 - DNA, 201 bp, Homo sapiens
ccacagacccatcagcactgatgtacccaacttataagtacaagaatccctatggattccacctccccaaagatgatgtgaaagggatccaggcattatayggtaagattattaccttctttgatgactcaccctgaaattggcaggcattcagtctccgaattaaagaaagtgcattttatctgcattggtaaagatcaa

SEQ ID NO: 53772 - DNA, 201 bp, Homo sapiens
ggagacattgctactcaccttacagaaataaaaaaggtcataaaggaatactatgaacaattgtataccaataaattagataaatgaaatggacaaattcmtaagaagacacaatctagtaaaaccgagtcaagaagaaatacacagtctgaatatacctacaataagaaaagatattaaagcagtaatcaaaaactatcc

SEQ ID NO: 53773 - DNA, 201 bp, Homo sapiens
tcatctaacttttctgtaatcagaatggaaaaaggcccccaaatgaagactaatcaaatgtttcagttgagttgggttcaaatcaatcaagtttacttcartttttgtaactagctgaccaacttcattaaaagtgactgtttttctccttttgccacttggtaaataacaaaaaaaatatgaagctttccctgattcctg

SEQ ID NO: 53774 - DNA, 201 bp, Homo sapiens
accctcatctgggattgtacatggcagcttcctcctctcctgccttctcttcattcccgatcactgtcctacctgcccttctctagtatagatcacaaagsccacttcattcatgaaagtcatgtgatttctggctgaaatcattaacttcaaaatggaatttcagatttctatttcattgtccctcctgacccacactgg

SEQ ID NO: 53775 - DNA, 201 bp, Homo sapiens
ttttaggtattttaagagcccgatttaaacaacaagggccaggcccagtggcttattcctgtaatcccagcactttgggaggctgaggtgtgggaggattkcttgagaccaggagtttgagaccagcctgggcaacatggcaagaccctgtctttataaaaaataaaaattagccagggtgtggtggtacatgcctgtagt

SEQ ID NO: 53776 - DNA, 201 bp, Homo sapiens
gtattgcttactacccacttaggctatatggtataccctgttgctcctatagctcctacagacctatacaacatgatactgtactgaatactgtaggcaawtgtgatacaatggtaagtatttgtgtatctaaacttagaaatggtacagtaaaaatacagtgttataatcttatgggaccactatcatgtacatggtctg

SEQ ID NO: 53777 - DNA, 201 bp, Homo sapiens
tctagccctttactatttgagtgactttggaaagttatctaatggctctgagctccatttcttcctctgcaaagtgattatagcaatataaaccttgaagrtgcgttgtgacaatggcgagccaatggaagttatccagtaggtgataactatcagttttagcttatatgttcttgatactgagggataaggttagaaagc

SEQ ID NO: 53778 - DNA, 201 bp, Homo sapiens
agaaaatgtaagataaatcttcgtgatcttggatttagcaatgaatactcagatacaacatgaaaagcataagccaaaaagaaaaaaaggacaagttggayttactcaaaattaaaaacttttctgcttcacagtacactatcaacaaagtaaaaagacaacccagggaatgggaagaaatgtttgtaagtcatatatctg

SEQ ID NO: 53779 - DNA, 201 bp, Homo sapiens
acatttcagttgctctttgtcctcaagttgggtatgaaatgccaccctacatttgttatacccgacattgtgtaacaatggaaatgatggcagtggccctsagaaccaagcctgttaggctagtaaggcactgtgttaggtgatagtgcctagggagctagaaacatggtccctgccacacaggacctctgctcagagtga

SEQ ID NO: 53780 - DNA, 201 bp, Homo sapiens
tgagtgactttggaaagttatctaatggctctgagctccatttcttcctctgcaaagtgattatagcaatataaaccttgaaggtgcgttgtgacaatggygagccaatggaagttatccagtaggtgataactatcagttttagcttatatgttcttgatactgagggataaggttagaaagcaagtgccaatttaagta

SEQ ID NO: 53781 - DNA, 201 bp, Homo sapiens
gaaatggcagggctgcagtgccccattcatttggcatatctagccctgccagcatttttccagtcatcatggagcacatttcagttgctctttgtcctcargttgggtatgaaatgccaccctacatttgttatacccgacattgtgtaacaatggaaatgatggcagtggccctgagaaccaagcctgttaggctagtaa

SEQ ID NO: 53782 - DNA, 201 bp, Homo sapiens
aatgttattgctttcttaaggcataactagggacttttgcctccagggaagtttgaagtcttttactgaactgaatagttagaagcttatatctcttgttrggttatagccatggcaagtatcccataaactaaccccatttaagagccttcatagaaatctttatgagagaagtgcatcaccaagtggtgcagagttttc

SEQ ID NO: 53783 - DNA, 201 bp, Homo sapiens
ctgagaggggcactgcttacttcttcaaaggtaccctacagatccctcaaagaaagaaatggcagggctgcagtgccccattcatttggcatatctagccytgccagcatttttccagtcatcatggagcacatttcagttgctctttgtcctcaagttgggtatgaaatgccaccctacatttgttatacccgacattgt

SEQ ID NO: 53784 - DNA, 201 bp, Homo sapiens
ccatgtaagctgattaaactgaggcttggagaggctggtcagcagtggagttaaaactctagcccacatcttctcaaacacaatgtgtttttccttctgcmccatgatgcctcttacgaaacatgaggaaatatttatcttttcccaatacattccttttttggattttatcatcagcttaagttgcctcattagggatac

SEQ ID NO: 53785 - DNA, 201 bp, Homo sapiens
ggtgtttaaagcagggtttcttaacattgacactactggtatcttgagccagataagtcttagttgtgttgagctgtcttttgcattaggatgtttagtgrcatccctggctgtactcattagactccaatagcactgctcatccccacctgtgacaaccaaaattgtcaccagatattgcctaacgtcccccagggtgca

SEQ ID NO: 53786 - DNA, 201 bp, Homo sapiens
gtgaaagttatcagagaccgaatctcaaatttgatgagttagttactgttctttggtaaaagtgaatgaaaattttaaagaatatgaaacttgttgatcargtaagttccaatcatctctctggcacccgttcatttagccaacaaatgtgtattgaaccctgactatgtgccagcatagcataagatagtgggtacatga

SEQ ID NO: 53787 - DNA, 201 bp, Homo sapiens
ggctctagagcagaagtgtgtgaactccaaattcccgttaccattttgaccaactcattttgaatcctaggacctcggaaagtattcctggggaagcccamtctgccccatgccccccatcacaagccatccatccctgacctctgtgactccagctcatcctttgacgctgtgacaatgctggggaaggagctcctgctc

SEQ ID NO: 53788 - DNA, 201 bp, Homo sapiens
tgctgccattgcatgaagtcctcggtgtgtgcacctgagtagactgcatttcactgaaacctgagaaatgccataccaaaactttgttctgtcggcttttwaaaaaaaaaaaacaaactaaaactgggtatccttactaagatttttttaagtggtaaactatatcccttattttgttcttcctcctcctcttctattaaa

SEQ ID NO: 53789 - DNA, 201 bp, Homo sapiens
gcctcatctccactcccagacaaacgtcgtcccacaggtccttgttgctgccttgtatgaagatcatgcagaaatgctgtcctatgcagcagaagggtggkaggcaggggtctttgggggagatagagaactgccaaaactactgtttgtggtgcacctactgtggtcttgctactgtgctaagttatgtccatatatgga

SEQ ID NO: 53790 - DNA, 201 bp, Homo sapiens
caacatggtgaaaccccgtctccaccaaaaatataaaaattagcccggcgtggtggcgggcacctataatcccagctactcaggaggctgaggcaggagartcaattgaacctgggaggcagtggttgcagtgagcagagatcatgccattgcactccagcctgggcgacaagagcaaaactccatctcaaaaaaaaaaaa

SEQ ID NO: 53791 - DNA, 201 bp, Homo sapiens
agaactgccaaaactactgtttgtggtgcacctactgtggtcttgctactgtgctaagttatgtccatatatggacaatatttattgtaacctttttcacygtagagattagaatccctaatgtgcagataaagaaagcagctcaaagacagcaagcaagtttcccaaggtgacagttaaatggctgagctaggacaccag

SEQ ID NO: 53792 - DNA, 201 bp, Homo sapiens
ccctgctgtgctcagggtacggagtctggaattccctctcccacagccagacctgattctgggagccagcgcagacttcctccccaggttggtccaaccaagggcaaactatgtatggtacctgcccctcagcctgaggtaggggtggatggtgcctgcctgcgtgggcctcatgcatgacagatgggtgcaggtcagaaa

SEQ ID NO: 53793 - DNA, 201 bp, Homo sapiens
ccactcttagccccaagctcccctcactccttccctgccctctttcttccctcccctaatcctctggcttcatcccttataaaccaaggggacacacccarccagaacctctgtccctccctgctgtgctcagggtacggagtctggaattccctctcccacagccagacctgattctgggagccagcgcagacttcctcc

SEQ ID NO: 53794 - DNA, 201 bp, Homo sapiens
aaattcccgttaccattttgaccaactcattttgaatcctaggacctcggaaagtattcctggggaagcccactctgccccatgccccccatcacaagccwtccatccctgacctctgtgactccagctcatcctttgacgctgtgacaatgctggggaaggagctcctgctcttcaaggaccggtaagcctcagacacgc

SEQ ID NO: 53795 - DNA, 201 bp, Homo sapiens
ttgtgtgactgtaaggaacatggctgtgctgcagccaagcgggcataggccaaggtaaacatcctgcgtgactcagcgagtttagggtgcaggcgtacatytccacttgttatcacagccatgtagccataacatgggaaggccatcacttagctctaagccactattgtctgtaaaaggtataattgccctgctgacatt

SEQ ID NO: 53796 - DNA, 201 bp, Homo sapiens
ccagctcatcctttgacgctgtgacaatgctggggaaggagctcctgctcttcaaggaccggtaagcctcagacacgccaccgactctcattgggcctcayctccactcccagacaaacgtcgtcccacaggtccttgttgctgccttgtatgaagatcatgcagaaatgctgtcctatgcagcagaagggtggtaggcag

SEQ ID NO: 53797 - DNA, 201 bp, Homo sapiens
tagataattccaaggccagcattcttccgaaactgctccttttcagtgcctccgggcctttcacagagaaggcagatccctcttctcccccaactctggtwtcttggggagtaaggctgttgtctccatgatgctggttactccaaatacttctttccatggaggcaaagagaaacatagcaacattcaccccattcctcc

SEQ ID NO: 53798 - DNA, 201 bp, Homo sapiens
ggcaaagagaaacatagcaacattcaccccattcctccctttgctggggacagaattcaatcacaccagaataggcagaggcatctcaggagcattcatgygtggcattattttttcttcttcttcactattgcaaaagtgtttatggagcccattgtggttttcaagcagtgtagtctcatgtatgagaaggtgtatgag

SEQ ID NO: 53799 - DNA, 201 bp, Homo sapiens
gagtctcgctctgtggccaggctggactgcagtggcgcgatctctgctcactgcaacttctgcctcccagattcgagcgattctcctacctcagcctcccragtagctgggactacaggcgctggccaccaggcccagctaatgtttgtatttttagtggagatggagtttcaccatgttggccacctaatggaaagtttt

SEQ ID NO: 53800 - DNA, 201 bp, Homo sapiens
gccgccctttcttgcattctctttaagcatcctttagctgactcagttccccatttagtgcttctaagagggtagaatggagtcagttatgcccttgacakgtgactgaaatcagcacaatcaaaacaccaaaaatacctaacaaatctaagttctaagcatgcagattaggttaaacaaaaatgcaggcactttatcaaa

SEQ ID NO: 53801 - DNA, 201 bp, Homo sapiens
gtgcagcaaatagatgctgctgtctacctcagggagccacagaagacccttttctttgtgggagatgaatactacaggtatggcttttttcctttttactrtctatctttatttaatgagaatgattttaaaaagataaaaacccttccacgaaagaatgcaaagcaagtttgcgataggcccgttgactcttctcggcca

SEQ ID NO: 53802 - DNA, 201 bp, Homo sapiens
caaggagaaagctcagaaatgactgagaagttcaggagtcaggttctagggcatgaagacagaagacaagctaactgccacctgacaaattcacaattccyctttggtgacactttaagaaagtgacagtgacaaattcttccatttatatatgtgctggacatcttcagtaacccaatttcaactttgtctcttttaggc

SEQ ID NO: 53803 - DNA, 201 bp, Homo sapiens
tctaagttctaagcatgcagattaggttaaacaaaaatgcaggcactttatcaaaacagtccctgagtccttagaatacaaatgtggagagtaagataacrtatctgaaaaactacatcagatatctgttgcaggcaatgatttatttaatatatattaaatgtaaataccttgaatcaatattaaatgatgtaacaaatg

SEQ ID NO: 53804 - DNA, 201 bp, Homo sapiens
ctcagccctggtgatatgactgggatggtgtgactagataccacttatgtttataaacatggctcatgttgtaacagcagtggtaaacacggcaaacatgytttccacttaatttatcatgagcatcttcccttatataacctattttgtgaaacaaaaactagaatgtagagtgtaatacataacctaacaggagaacaa

SEQ ID NO: 53805 - DNA, 201 bp, Homo sapiens
tacatgagtgaattatatgttatgttaactatatcttgataaagctgttacattaaaaaaaagaaggagatcaaagtagtgtgatgatccatggaggtcaygcattctggcaactgtgtcagggaccacatgacaatgaagcaccagcctgaggacatccagtgctgcacgcaaccagccagatgtcctcctcatgtccag

SEQ ID NO: 53806 - DNA, 201 bp, Homo sapiens
tttttttgtttatattttaaatccattcacagatgtataaggaagttacttgctatcattgtttttgtgagttttacttcacttattactacaatctatargtctaaggatgcaaattgtctgagtatgttactgttttattgccacaagacatcatttttttcattagtttactgaaatttttcatgactacagattctt

SEQ ID NO: 53807 - DNA, 201 bp, Homo sapiens
tgtctgccatcccccaggctgatataattaccaagctactgtgaggggatgaaggtgctccctgcatctggccttgctgtcttcctcatcatggctttgamgttttccactgcagccccctccctagttgcagcctcccccaggacctggaggaacaactaccgcctcgcacaggtttgtgaatttttgcccaattccttc

SEQ ID NO: 53808 - DNA, 201 bp, Homo sapiens
ctgatctcaggggagtgagcagtaattaaacagagaatcaaaaagatagaggccggcatggtggctcatgcctgtaatcccagcactttgggaagccgagrcaggcagatcacttgaggtcaggaattcaagaccagcctggccaacatggtcaaaccccatctctactgaaaaaaatacaaaaattagctgggcaggtgt

SEQ ID NO: 53809 - DNA, 201 bp, Homo sapiens
tctattaataaatttgtggagtaaaaacatgtctttttaaagtgtctacaaataagaatagtcctgaatttataaaacactttcatatgcattatttcaaytgatccttttaagtgtttgtgcagatattattctcactcttatttgacagtaggaaattgagtctcagaaaaattgaatgactcacacgaggtcacacag

SEQ ID NO: 53810 - DNA, 201 bp, Homo sapiens
tgcaccactgcactccagcctgggtgacagagcgagaccctatcttaaaataaataaataaataataaaaagcaaatggggggaaacaaaagagttgagayagatcattcatttgagaagcttgttaataacaaaagaagttaagataatagttggcagtggcagcagggccaagacaggatttcaaagagggaactgttc

SEQ ID NO: 53811 - DNA, 201 bp, Homo sapiens
gtgagctgagattgcaccactgcactccagcctgggtgacagagcgagaccctatcttaaaataaataaataaataataaaaagcaaatggggggaaacamaagagttgagatagatcattcatttgagaagcttgttaataacaaaagaagttaagataatagttggcagtggcagcagggccaagacaggatttcaaag

SEQ ID NO: 53812 - DNA, 201 bp, Homo sapiens
ggccactggggtgcgatttacagatggttgactgtcttcaagatatggaaccatcaaaatgatgagtgaaaccttcattcaataatcccattgtttggtcygtaggacttgacacatcctgatctttcaatgcactcattaaccggacacctagtggcctaaaagcgtagatgcagcatcaccaaatccctaactacccac

SEQ ID NO: 53813 - DNA, 201 bp, Homo sapiens
aggttgcagtgagctgagattgcaccactgcactccagcctgggtgacagagcgagaccctatcttaaaataaataaataaataataaaaagcaaatgggrggaaacaaaagagttgagatagatcattcatttgagaagcttgttaataacaaaagaagttaagataatagttggcagtggcagcagggccaagacagga

SEQ ID NO: 53814 - DNA, 201 bp, Homo sapiens
tgcactcattaaccggacacctagtggcctaaaagcgtagatgcagcatcaccaaatccctaactacccactgagaatgcctgactttgctgttttgtgascatcaaatgcatcccacaatactccatgatttggggcaaaatggagatggtcctgaccatgggtctctttgaaggatagttctgctggaaggaaaaggcc

SEQ ID NO: 53815 - DNA, 201 bp, Homo sapiens
atcatggggcccccaccctcatgacctcatgagtcaggaatgtcctcttccagcactaaccctaattacttcttgaaggtaataccatcccattgaaggtwaaggcttcagcataggaatttggagggcacataacacagagcattcccattgttaagcatattgttttatgtccctcctgacgttttctctggatagaga

SEQ ID NO: 53816 - DNA, 201 bp, Homo sapiens
ttctgcccatcttctgccttctctgttttgccaaccatattccagctctgcaccctggagcctcatgtcagtcctgccctttggatctgcagcttgtgcgrgaaattgctctctggctttccctttgaccaaggttcacccggcaaatgactcctggcctctgcttttctgtgtcagtacctggaactgtgggtgagaggc

SEQ ID NO: 53817 - DNA, 201 bp, Homo sapiens
ctcatcctttatatattatatgttattccaatgaatagatatatcattacttaatcaatcccatactggattatttctaatttttaaaaattagaaacagyttgaactaaatctttgacaatggacagacattcacttttcaaaggcaaattagagctgagcccaggaacccaggctttcacagcagagtcagtgggtggc

SEQ ID NO: 53818 - DNA, 201 bp, Homo sapiens
tatttttaatggcgtagtccaggaagtcctctcggaggaagtgaactttgagatgaacctgagctgcatgaaagagccagtcacgtgaagacctggagatrgggcagtccagacggaggaaacagcagctgcttggaatgcaatcatcaggcccatgtgactagagctcagaggtcaggaaagagggtcccagaggagtcc

SEQ ID NO: 53819 - DNA, 201 bp, Homo sapiens
atctgcctatgccctcaccccctccctgaggattctttcagctatctgccacccacccattcccctcagacctcagcatgggctggaacctgacactgagmatgacatttagtgtagtcgtggccccaaacctgaccctggaacctgacagtgactttgccaaaaaagaaaaatgttgaggaaatgtaccttaagtttcac

SEQ ID NO: 53820 - DNA, 201 bp, Homo sapiens
tttcagctatctgccacccacccattcccctcagacctcagcatgggctggaacctgacactgagcatgacatttagtgtagtcgtggccccaaacctgaycctggaacctgacagtgactttgccaaaaaagaaaaatgttgaggaaatgtaccttaagtttcaccctgttctggagcgtacttaaactgagttttaaac

SEQ ID NO: 53821 - DNA, 201 bp, Homo sapiens
atgtgataaattcatacaatggaatattatttggccacaaaaatgaatgaaatgctggtacatggtacgacatggatgaatcttgagagcattatactaartgaaagatgtcagtcatgaaaatctgcatattgtataaaatgtccataataggcaagttaaaacagacagaaagtagatagtgattgtctaggtctggtt

SEQ ID NO: 53822 - DNA, 201 bp, Homo sapiens
tgggtctctttgaaggatagttctgctggaaggaaaaggccttattgcttagtccttttatccagcctagaatatgaaaatccttcttatccaaaggaaamcatataatttcaattcctgtcctcaggggcttcgtatgagcaagtctgaatcagatgtcatctgtcatccaatcactgcacatagggtcacaccttatct

SEQ ID NO: 53823 - DNA, 201 bp, Homo sapiens
tttaacctgaatgaacatatgcccattgactgttatgcatttgagttagtaggaagagcacttccgagctgttcctttgcttccacaccctctgcttgcargtggggcaaccagccacaaagaggaggatgttcatagactatctaggtttcccaaggatgtctaatatgtttcttcacatttttttttccaaaataggat

SEQ ID NO: 53824 - DNA, 201 bp, Homo sapiens
cctagcactaatatagaaagctttctgcctatgaaatggaaataccaagaaaagcactgaaatttaacctgaatgaacatatgcccattgactgttatgcrtttgagttagtaggaagagcacttccgagctgttcctttgcttccacaccctctgcttgcaagtggggcaaccagccacaaagaggaggatgttcataga

SEQ ID NO: 53825 - DNA, 201 bp, Homo sapiens
ccttttatccagcctagaatatgaaaatccttcttatccaaaggaaaacatataatttcaattcctgtcctcaggggcttcgtatgagcaagtctgaatcwgatgtcatctgtcatccaatcactgcacatagggtcacaccttatcttagctactgagtttctatccttagttgactcatgttgaggaatgagaggagct

SEQ ID NO: 53826 - DNA, 201 bp, Homo sapiens
aagtgtttttctttttttttcttttttttttttttttttttttttttgagacagagtcttgcttgtcccccaggctggagtgcagtggcatgatctcggcycactgcaacctccgcctcccggtttcacgccattctcctgccccagcctcccaagtagctgggactacaggctccggccaccgcatccggctaatttttt

SEQ ID NO: 53827 - DNA, 201 bp, Homo sapiens
gactgacacatggtaggtgctccgttaatgttaccttttaaaaagattgctggggagagaccaggaccaaaagtgtttttctttttttttctttttttttyttttttttttttttttgagacagagtcttgcttgtcccccaggctggagtgcagtggcatgatctcggctcactgcaacctccgcctcccggtttcacgc

SEQ ID NO: 53828 - DNA, 201 bp, Homo sapiens
tagcataatgactgacacatggtaggtgctccgttaatgttaccttttaaaaagattgctggggagagaccaggaccaaaagtgtttttctttttttttcytttttttttttttttttttttttttgagacagagtcttgcttgtcccccaggctggagtgcagtggcatgatctcggctcactgcaacctccgcctcccg

SEQ ID NO: 53829 - DNA, 201 bp, Homo sapiens
gcataactgtgggagcgtgagcttagccctctgtgtttgtagaagcagaaacaaacctggaagattttggattattaacattatactttcttgcttcaatstcagagtcaggaggtcaggtgttgaccttccccctgccctccaagaggtgtgtgacactggggaagtcacttcccctctctgagcctcagggtttttcac

SEQ ID NO: 53830 - DNA, 201 bp, Homo sapiens
gggtctcagtatatgaatttggagggcacacaactcagtctatagcactgatgcctccatcaaaaataccccatgtgacagctggttgaggaggattaacmtcgaaccaccttattctcaatgccatttaggctgtagcacactttcttccaatcttatgctttttgtttccaagtagaaaagaaacgctttactgaagag

SEQ ID NO: 53831 - DNA, 201 bp, Homo sapiens
agacaccagtcctgtaggattagggccctacccttacgactctctttaaattaatgacttccttaaaggctcaatctccaaatatagttactggggtttarggtctcagtatatgaatttggagggcacacaactcagtctatagcactgatgcctccatcaaaaataccccatgtgacagctggttgaggaggattaaca

SEQ ID NO: 53832 - DNA, 201 bp, Homo sapiens
caactgatgtattttctcacagttctggaggcaaaaagtccaaggtgaaggtgccagcagggttgatgtctggggagggctctgctcctggcttacagagkctgcctcagggctgtgtcctcacatggccttcccagtgtggggggtgtatgtgtgtgtgtgtgtgtgtgtgtgtgtgagtgtgagagagagagagagaga

SEQ ID NO: 53833 - DNA, 201 bp, Homo sapiens
ttccctggtgaatcactcttctcaggatgccttagtaaaacgccacaggctgggtggctccaacaactgatgtattttctcacagttctggaggcaaaaaktccaaggtgaaggtgccagcagggttgatgtctggggagggctctgctcctggcttacagaggctgcctcagggctgtgtcctcacatggccttcccagt

SEQ ID NO: 53834 - DNA, 201 bp, Homo sapiens
tgtgactttcactttcccttttgggttccagggtatatctcagagactggagaacgtgtctggttattatgcagatgcacggctggaggtgggatccacayagctcagaacagctggatcttgctcacactctttcaagagaagcttccttggtaagttaggggtggtctgaccttccccatctccccatcctcacagcag

SEQ ID NO: 53835 - DNA, 201 bp, Homo sapiens
tcaggaggtcaggtgttgaccttccccctgccctccaagaggtgtgtgacactggggaagtcacttcccctctctgagcctcagggtttttcacctgccakagggggttaggatgccctaccctgctgacccccagcaggctgctgaccccatctggggtgaggtgggaggcggggcagtgcgagtcaggggaaagttgac

SEQ ID NO: 53836 - DNA, 201 bp, Homo sapiens
tctctccaatgctaatagtagttcaatcagatgggcatgtggttaaagcctgagaatgaacagcaggtcaaaggtggggaaccaagtagcatgatgccatscaaagacccagagagacgtttcaggggcagagccaggggtcaggatggggcaggggtgggcctgggttggaggagcagcaggaaggctcgggcaccaagg

SEQ ID NO: 53837 - DNA, 201 bp, Homo sapiens
gtcgctgaacatctgtttcagttttcttatctgaaaatggaaatacaaatggtacccacttaataggctcttggaagaggactgtgagttattatttatamcatcttagagcaattagtggtgcaaagtcgagtccacaaatgttcacccctatttctcattgactgttattatacctataagtgccttgactaacactgt

SEQ ID NO: 53838 - DNA, 201 bp, Homo sapiens
ggctgctggcaccatggactcaggtaggcttgcttcttcctcttccctggctggttcctactcgcacctagaatggagggtggcgtttccacaactcagtsagccccagaggaacccggatggtcaagcaggccgatgagtcttccctgagccccaaaagaggccacatggagtcccccgacccaagggtctgtgggggca

SEQ ID NO: 53839 - DNA, 201 bp, Homo sapiens
agacacttgggcatagagtgcaagacacagatttggaatgaggagtcatttacagtaagcatgtatgcatgagtcaatatttttatatatttaagggagtrgagcccagtcatggaagacatgggatttgaatcagaagtcctggctctacccctattgtgaaaacatggcaaggttgcttaacatttgaggtttcttctg

SEQ ID NO: 53840 - DNA, 201 bp, Homo sapiens
ggtataaaccaaaagtaagattctaagcctccccctcatttaaaggacttcctcctcagccagggctcttaaaatttaacctgaaagactggttcaggccrtgaagggaaatgggggtcagacatgcttcattatgcctctctggcattaatatcaacacaggctttcagtctaataagaaacattttacagcctgtttct

SEQ ID NO: 53841 - DNA, 201 bp, Homo sapiens
cagtctaataagaaacattttacagcctgtttctctgtgaagcctgctagctgaaagcttcatctgcaggataaaactttggtctccacaacctcttatcrcaactcaaacattccttcctattgatctccggtctttagacaaactcaaccaattgtcaaccagaaaacgtttcaatttacctgtagcctggaaacgccc

SEQ ID NO: 53842 - DNA, 201 bp, Homo sapiens
gccaacccctacctttgaggggcctgacagggccacctcacagctgcctgggcttgttgttgcctcctcactacagaaaccatggaagtctctagagtcartgtttccaggctggggctgccagatcactcctgtaggtggttgaaccagttgagttcattcttctcagtgagggggacacaggtggaggtccatcggcac

SEQ ID NO: 53843 - DNA, 201 bp, Homo sapiens
cccagttaaggggttgaacttgaccctggcaggtcattaaagattcctcaggagacctaggtattgtggctcagggctgtaattcccgtgctaatgcacgraggctaatgcaggaggatccctcgaacccaggagttcaggacaagcctgggcagcatagcacgaccccatctctgcaaaaatgaaaataaaaagattgac

SEQ ID NO: 53844 - DNA, 201 bp, Homo sapiens
ctctgtgtcgtggcctcgaagggtctttgattctgtgcagcttcttttcctcctcatttctttaagggaggcatcgcattcattagtcttttttttctgayggagtcttgctctgtcgcccaggctggagtgcaagtagcaccatcggctcactgcaccctccgcctcctgggttcaagtgattctccagctcaccctcct

SEQ ID NO: 53845 - DNA, 201 bp, Homo sapiens
ccctccaagaggtgtgtgacactggggaagtcacttcccctctctgagcctcagggtttttcacctgccagagggggttaggatgccctaccctgctgacycccagcaggctgctgaccccatctggggtgaggtgggaggcggggcagtgcgagtcaggggaaagttgacattgcagcccagatgcctgcaggggctgca

SEQ ID NO: 53846 - DNA, 201 bp, Homo sapiens
gtcaggaggtcaggtgttgaccttccccctgccctccaagaggtgtgtgacactggggaagtcacttcccctctctgagcctcagggtttttcacctgccwgagggggttaggatgccctaccctgctgacccccagcaggctgctgaccccatctggggtgaggtgggaggcggggcagtgcgagtcaggggaaagttga

SEQ ID NO: 53847 - DNA, 201 bp, Homo sapiens
tccacaaagcaccatggcacttccctggtgaatcactcttctcaggatgccttagtaaaacgccacaggctgggtggctccaacaactgatgtattttctyacagttctggaggcaaaaagtccaaggtgaaggtgccagcagggttgatgtctggggagggctctgctcctggcttacagaggctgcctcagggctgtgt

SEQ ID NO: 53848 - DNA, 201 bp, Homo sapiens; identical to SEQ ID NO: 11833

SEQ ID NO: 53849 - DNA, 201 bp, Homo sapiens
gatcactggaatatttcccgtacatggggagaaagcatggtggaaagctcactttctggtgattctcagctgaaatagatcggttcctccacaaagcaccrtggcacttccctggtgaatcactcttctcaggatgccttagtaaaacgccacaggctgggtggctccaacaactgatgtattttctcacagttctggagg

SEQ ID NO: 53850 - DNA, 201 bp, Homo sapiens
ccaaccaccttgggcacatgtcatcaggacttcctgaggctgtgtcacaggcatacgtcctcaaccttggcaaaataaactttctaaattaactgacaccwgtctcagattttccgggttcacagcggttgggactgaccagtgggcatccctttgaacactgctctgaacatctttggaagcgtccttgctttctggggt

SEQ ID NO: 53851 - DNA, 201 bp, Homo sapiens
ggcacatggcagaaggaagcgatcactggaatatttcccgtacatggggagaaagcatggtggaaagctcactttctggtgattctcagctgaaatagatyggttcctccacaaagcaccatggcacttccctggtgaatcactcttctcaggatgccttagtaaaacgccacaggctgggtggctccaacaactgatgta

SEQ ID NO: 53852 - DNA, 201 bp, Homo sapiens
taattgatgtctcatgctccctaagtgtataaaatcaagctacaccccaaccaccttgggcacatgtcatcaggacttcctgaggctgtgtcacaggcatrcgtcctcaaccttggcaaaataaactttctaaattaactgacaccagtctcagattttccgggttcacagcggttgggactgaccagtgggcatcccttt

SEQ ID NO: 53853 - DNA, 201 bp, Homo sapiens
tcgaaactcagattttgaagacactggtgtaaagcgtttgacaataggcacatggcagaaggaagcgatcactggaatatttcccgtacatggggagaaarcatggtggaaagctcactttctggtgattctcagctgaaatagatcggttcctccacaaagcaccatggcacttccctggtgaatcactcttctcaggat

SEQ ID NO: 53854 - DNA, 201 bp, Homo sapiens
gtcaaccagaaaacgtttcaatttacctgtagcctggaaacgcccactttgagttgtcccgcctttctagaccaaaccgatgtatttctcaagtgtacttrattgatgtctcatgctccctaagtgtataaaatcaagctacaccccaaccaccttgggcacatgtcatcaggacttcctgaggctgtgtcacaggcatac

SEQ ID NO: 53855 - DNA, 201 bp, Homo sapiens
gaagcctgctagctgaaagcttcatctgcaggataaaactttggtctccacaacctcttatcgcaactcaaacattccttcctattgatctccggtctttrgacaaactcaaccaattgtcaaccagaaaacgtttcaatttacctgtagcctggaaacgcccactttgagttgtcccgcctttctagaccaaaccgatgt

SEQ ID NO: 53856 - DNA, 201 bp, Homo sapiens
tgctcttgacaaaatgaactattttcataacccactgatgggtcgaaactcagattttgaagacactggtgtaaagcgtttgacaataggcacatggcagraggaagcgatcactggaatatttcccgtacatggggagaaagcatggtggaaagctcactttctggtgattctcagctgaaatagatcggttcctccaca

SEQ ID NO: 53857 - DNA, 201 bp, Homo sapiens
agaaacgctttactgaagaggccaccaaatacttccgggagagagtcagcccagtgcatctgcaaatcctgctgactaacaatgaagcctggaagagattygtgactgcggctgaattgcccaggtaacctccgtggggttacctccatggggcgccccggctatgccatcctgatctcccctgggctagttttctctggc

SEQ ID NO: 53858 - DNA, 201 bp, Homo sapiens
cctaaacacatctagatcccaggaatttacataagggtatatatatatacacccttatgtatatatatattatatatatttcaaatatcttacaaaagaawactcactcttgctgtgttcaatacactctgatattttcaatgctcttttctttttaaaatgctgctcttgacaaaatgaactattttcataacccactga

SEQ ID NO: 53859 - DNA, 201 bp, Homo sapiens; identical to SEQ ID NO: 11837

SEQ ID NO: 53860 - DNA, 201 bp, Homo sapiens
tttgtagcgttgaccagtgtgggagtggtcagtgatacagcatatgcaccctgtgtcatattgacacagattgaaaatgctgccatcctaaacacatctakatcccaggaatttacataagggtatatatatatacacccttatgtatatatatattatatatatttcaaatatcttacaaaagaatactcactcttgctg

SEQ ID NO: 53861 - DNA, 201 bp, Homo sapiens
ttgtggctcagggctgtaattcccgtgctaatgcacggaggctaatgcaggaggatccctcgaacccaggagttcaggacaagcctgggcagcatagcacraccccatctctgcaaaaatgaaaataaaaagattgactgacatagtgatgcacttgtagttcccactactcagaaggatgaggcaggaggatcgattgat

SEQ ID NO: 53862 - DNA, 201 bp, Homo sapiens
atgtcccagtgcatacataaatccatactgcttcccagtcccttctctgcagttccataattcccaaatccctgcaaaccacacatttttggggcaactcmtctgggcagtaatcctgctgtgtactaagatgctttgtactgataatattatgtatcccatttaaggtgaatattcattggtttctctgttgaaacattt

SEQ ID NO: 53863 - DNA, 201 bp, Homo sapiens
gcaccacagccttggggaagtggaaacagcagggtcggggagtagggggagagcagggtccaggaggtgcggagggctgagagaggaggttgaccagcagycccgacctctgacctcccgctctgctcccagctgaccctggggtgtttccagcacaggccagtcccctccctccagctcttgccctgcaccagcccctct

SEQ ID NO: 53864 - DNA, 201 bp, Homo sapiens
gggagccacggttgcacccatctcctggcctgtgtgtgatcatcgaatgaggcacatatgaggagccctgcagatcacagacacccagtacacactggctrttatcaattagttatcacacatgttgccaggcccaggtcattgtcagaacgttccttcccatctctatttcggtgtatagactctgtagtttctgtgatt

SEQ ID NO: 53865 - DNA, 201 bp, Homo sapiens
tcaccatgttagccaggatgttctcgatctcctgaccttgtgatccacccacctccgccacccaaagtgctgggattacaggcatgagccaccgtgccagrcgcattccttagtcttaatgggcatagtgttagggacccgcctactccctatggcaggagatttagtgatttctccctttttggtgatagaaacaacgct

SEQ ID NO: 53866 - DNA, 201 bp, Homo sapiens; identical to SEQ ID NO: 11834

SEQ ID NO: 53867 - DNA, 201 bp, Homo sapiens; identical to SEQ ID NO: 11835

SEQ ID NO: 53868 - DNA, 201 bp, Homo sapiens
gagaacatgccaggcaaggtgatctcttccagtctgaggttttatttgatagcttaaggactcagagttagtcaaaatgcaatgtctgaaggcacccttcyttctgacaccagttgcagatttgaaggtgtttcttaagcccccactcaggtttgataattcactacaaagacttacgtaactcactgataactgttattg

SEQ ID NO: 53869 - DNA, 201 bp, Homo sapiens
gataacaggcatgcaccaccatgcccggctaattttttcatttttttagtagagacagagttgctccatgttggtcaggctgctctcgaactcccaacctsaggtgatccacccacctcagcttcctaaagtgctgggattacagatgtgaaccagtgtgcctagccagcttttctttagggagtaaatcattttctttac

SEQ ID NO: 53870 - DNA, 201 bp, Homo sapiens
catgggatttgaatcagaagtcctggctctacccctattgtgaaaacatggcaaggttgcttaacatttgaggtttcttctgtttcaaaatgggagccacrgttgcacccatctcctggcctgtgtgtgatcatcgaatgaggcacatatgaggagccctgcagatcacagacacccagtacacactggctgttatcaatt

SEQ ID NO: 53871 - DNA, 201 bp, Homo sapiens
attatactgactggtaacaagtagatttagttctcatatgtaaatgttctgttttgttctaaaagttaaaagttaaccaagtgtttacattttggtgacgytttaaatcttgcttactgttgagctgagttgtacaatatggttgcacatgttttgctgcacggctttagtttttcctgatgtttctaattgcctttgttt

SEQ ID NO: 53872 - DNA, 201 bp, Homo sapiens
agtgtatacggttcagacaaatcatttaataaagagggctccactcactcccttcccaattaaaagcagctaattttgatgttcagattttcctttttttwttttctgagacagaatttcactcttgttgcccaggctggagtgcaatgtagctatcttggctcaccacaaactccacctcctgggttcaagcgattctcc

SEQ ID NO: 53873 - DNA, 201 bp, Homo sapiens
ggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttctt

SEQ ID NO: 53874 - DNA, 201 bp, Homo sapiens
aggtgcaattacatttgacatgctggcaaccaaataaaaggcaaaccttgcatatgccacacacacactcacaaattcacacacacacacacacacacacacgcacactcacacctgctattcagatttcacttcatggagccctgtgtttctcacctctgtgtcgtggcctcgaagggtctttgattctgtgcagcttct

SEQ ID NO: 53875 - DNA, 201 bp, Homo sapiens
acttcttcagtgatccagccagcatttgccctgacacttagagttgaaatgccatcaggctacctgcatttgatgcaattccactgtactgctagtattgyttaaaaatttttcaattgcaagcaacagaaacagaaactatctgtcttaaacaaaatagaagattcattggatgaaaactagagcaggtcagaggatgga

SEQ ID NO: 53876 - DNA, 201 bp, Homo sapiens
agaggttgtttcacccaccctgactctgagcacctacttgagccaggccctgtgggtaaactgaggccatgggagatgagtgactcgctgagggtcccatrtcaggaagttgagcaggtagatcacaggactccatgtccctgacactcacctggttccttttcaggcctctgggtgatagagaagaaagaagctgtgctg

SEQ ID NO: 53877 - DNA, 201 bp, Homo sapiens; identical to SEQ ID NO: 11840

SEQ ID NO: 53878 - DNA, 201 bp, Homo sapiens
cataataatcacaatcaattattactgttgaatataagcggtataaaccaaaagtaagattctaagcctccccctcatttaaaggacttcctcctcagccrgggctcttaaaatttaacctgaaagactggttcaggccatgaagggaaatgggggtcagacatgcttcattatgcctctctggcattaatatcaacacag

SEQ ID NO: 53879 - DNA, 201 bp, Homo sapiens
ttggaccaagtaaacatgatcataataatcacaatcaattattactgttgaatataagcggtataaaccaaaagtaagattctaagcctccccctcatttmaaggacttcctcctcagccagggctcttaaaatttaacctgaaagactggttcaggccatgaagggaaatgggggtcagacatgcttcattatgcctctc

SEQ ID NO: 53880 - DNA, 201 bp, Homo sapiens
caaatgttctcacttgaatgttagtatcaacccaaggcctttcacagattcatcttggaccaagtaaacatgatcataataatcacaatcaattattactrttgaatataagcggtataaaccaaaagtaagattctaagcctccccctcatttaaaggacttcctcctcagccagggctcttaaaatttaacctgaaaga

SEQ ID NO: 53881 - DNA, 201 bp, Homo sapiens; identical to SEQ ID NO: 11842

SEQ ID NO: 53882 - DNA, 201 bp, Homo sapiens
caatagacacctggatgcaagatccctaagacagaggcaggaaataggaagagggaggtgagaggctttcgatgaggatgcttctacacatgaccttgagratgaaaacgcatcagggggtcccgggaaccactgcgttgttaacataaagtctgggagcaaagaccagcggctggaatggatgtgcctgggagccagctg

SEQ ID NO: 53883 - DNA, 201 bp, Homo sapiens
aagatgaggagagggcagggaagattagaagccgggacctaccagccaaccccggaatccttcagaagggcttggctgggaggctcaaggaagaaactctstctccgaaacaagatgatctgtggtttaataacgcggccagctgggttcagaggtgatagtggggagccatgtcccctgagaccagcctgcagaggacag

SEQ ID NO: 53884 - DNA, 201 bp, Homo sapiens
gtttttctttttttttcttttttttttttttttttttttttttgagacagagtcttgcttgtcccccaggctggagtgcagtggcatgatctcggctcacygcaacctccgcctcccggtttcacgccattctcctgccccagcctcccaagtagctgggactacaggctccggccaccgcatccggctaattttttttgt

SEQ ID NO: 53885 - DNA, 201 bp, Homo sapiens
acaggtggctcacattcagtcccacaatttgctttctcctcctcaagggttaagaaaaaaaacgaacccttccagtcaggtcagtgactggagagctccawggaaagtctctcagtgacctggctgctggcaccatggactcaggtaggcttgcttcttcctcttccctggctggttcctactcgcacctagaatggaggg

SEQ ID NO: 53886 - DNA, 201 bp, Homo sapiens
gggggacaaagggtgtccagcacagcaccagtgaattcaccaagacagacacttgggcatagagtgcaagacacagatttggaatgaggagtcatttacartaagcatgtatgcatgagtcaatatttttatatatttaagggagtggagcccagtcatggaagacatgggatttgaatcagaagtcctggctctacccct

SEQ ID NO: 53887 - DNA, 201 bp, Homo sapiens
ggacaaaacacatggggtgttgccaaccagagaagctcacccagttaaggaaaaattcctgtgaatcacattagatcaggaagcctttattcaggattgttgttacaggggagggagactgagcccagctcccaatatagtaaagacagagggggagtcacagccaacaccagggtgaggagtgggagatggaccagttct

SEQ ID NO: 53888 - DNA, 201 bp, Homo sapiens
cttggctctgtccctgcacagctctggggctgttgttttatgtcttggagactgggacctgccatctctccaatgctaatagtagttcaatcagatgggcrtgtggttaaagcctgagaatgaacagcaggtcaaaggtggggaaccaagtagcatgatgccatccaaagacccagagagacgtttcaggggcagagccag

SEQ ID NO: 53889 - DNA, 201 bp, Homo sapiens
ggtatgcacacaggtgaagctgtcacctgctaaggcattagtttggctggcgacatgtgacagtgagaccctgaagcttggaggtgccaggtcaggaggcmgtcaagtggcttgagagttcatgtgcagccaggactaatagccaggcctttcacttttcagtcaaagggggcagtggctggacccagtggccttcagtca

SEQ ID NO: 53890 - DNA, 201 bp, Homo sapiens
tcaaagtctcatgagtccataagaggttccatgaaattgcacatggcattggtatgcacacaggtgaagctgtcacctgctaaggcattagtttggctggygacatgtgacagtgagaccctgaagcttggaggtgccaggtcaggaggcagtcaagtggcttgagagttcatgtgcagccaggactaatagccaggcctt

SEQ ID NO: 53891 - DNA, 201 bp, Homo sapiens
tgtccaaatgcaggtcttttcagcattagtgatttatagagatgattttcaaagtctcatgagtccataagaggttccatgaaattgcacatggcattggyatgcacacaggtgaagctgtcacctgctaaggcattagtttggctggcgacatgtgacagtgagaccctgaagcttggaggtgccaggtcaggaggcagt

SEQ ID NO: 53892 - DNA, 201 bp, Homo sapiens
gagagggatatttcttccctccctgatttgatcccatcactgatgggcatagtgggccatgggtgactgtttccctgacagcatgcctgggaactggggcrttctgaactgccatttgggaccctcttctgttctacatagagtagaggaagtgtttcttcgggccagcttggagagttggaacaagtgtctgccaactgg

SEQ ID NO: 53893 - DNA, 201 bp, Homo sapiens
ggatggggcaggggtgggcctgggttggaggagcagcaggaaggctcgggcaccaaggctgggagtagggtgagaagagggaggcactgagggcatgaaakgtaacgtggccatggacttgcagaggaccagtgagtgggagagggatatttcttccctccctgatttgatcccatcactgatgggcatagtgggccatgg

SEQ ID NO: 53894 - DNA, 201 bp, Homo sapiens
gttttatgtcttggagactgggacctgccatctctccaatgctaatagtagttcaatcagatgggcatgtggttaaagcctgagaatgaacagcaggtcaraggtggggaaccaagtagcatgatgccatccaaagacccagagagacgtttcaggggcagagccaggggtcaggatggggcaggggtgggcctgggttgg

SEQ ID NO: 53895 - DNA, 201 bp, Homo sapiens
atcttgacctgatcaatgtgtgttcctggagatgctgtccggggcccttttcttccacctctgaggaactgcacaaacacagcaggatcctcctgctgacmcagaacacagagaggctggaatggagttggacagagctgggggtggatcttggctctgtccctgcacagctctggggctgttgttttatgtcttggagac

SEQ ID NO: 53896 - DNA, 201 bp, Homo sapiens
gaaaaaaaattgcaaaacgatcttcagaagctgtgctgctgcctatggcagtgtggcagggagggggcctcgggtggggtgagtgcccaaaagggtgggcraggacgatttggggagttctccaaaggttatgacccactatgggcctacccttcgttcccggctgtaaacctctaaacttagcatttatccaagctatcc

SEQ ID NO: 53897 - DNA, 201 bp, Homo sapiens
ttggctcagagctgaggcaggagggagggctccctgtctgggcctcctccaggaactaaagtccctttccgggaattgaccaaactgcaggcttgcccagrgaggacatgctgtgtcctagttcagctcgaggggcagtatccagcttcaaccctcagcggatgccccagacaagattccgagccaggccaacaacgccta

SEQ ID NO: 53898 - DNA, 201 bp, Homo sapiens; identical to SEQ ID NO: 11838

SEQ ID NO: 53899 - DNA, 201 bp, Homo sapiens
ggcctgggccattgccgtgggggaggggaggcttggaaaccatggctatgattcagaggttagctggctcgcgtgtttttagaaatttcttttttctttcycctcgtacaaaagtaataagactggggaggacacgggagaaaataaatggaaactcagaaacctgatagagccaccaaaagtacatgaaatcagagtcat

SEQ ID NO: 53900 - DNA, 201 bp, Homo sapiens
agcaataaatacacagatctagtgctggaggttccctccatccaaccctggtttccttcatcctttcagtgaaggaggaaaaaataaaagcaaaatacccstcacccaagtcagcactgtgttcatttccctaaggcctgttttctcccctcactgagttgccttggcaaccaagtcacatctgctcaggagccgccctgg

SEQ ID NO: 53901 - DNA, 201 bp, Homo sapiens
ctggccgaagttaagttttgtttgtgcctaacgtaagcacccatctgaaacgactccagttaagttccccatagttggcagtttaaggggggttacagccwttctgaaggcctgtttgcttttgtttgcccaggtgttcattttaagtttgctttaacaccctggtactcccaccccagcaataaatacacagatctagtg

SEQ ID NO: 53902 - DNA, 201 bp, Homo sapiens
cctccctccagctcttgccctgcaccagcccctctgctctgagtggccctgtgaaaagagtgactcagcgtcccactgaactgagccccattctggccttygccacgtcttctctgtgtcacctggagcttcttacctcccctcacctggaatgcgagtataatatttccccatgtggtcatgaggatcaaatagtacatg

SEQ ID NO: 53903 - DNA, 201 bp, Homo sapiens
cccccgacccaagggtctgtgggggcatctatgtcctgacctctcctcaggggagcatggcccaggtgcccacttcctccctgccctggcacctagcaaaygactcaagtggggcaccacagccttggggaagtggaaacagcagggtcggggagtagggggagagcagggtccaggaggtgcggagggctgagagaggag

SEQ ID NO: 53904 - DNA, 201 bp, Homo sapiens
gggtttcatcgtgttagccaggatggtcttgatctcctgacctcgtgatcctcccgcctcggcctcccaaggtgctgggattacaggcatgagccgctgcrcccgaccaagtgtttttcttagagttggatgcccagcaggactttctttgaaaaaagccagaaaaatcttgacctgatcaatgtgtgttcctggagatgc

SEQ ID NO: 53905 - DNA, 201 bp, Homo sapiens
ctcggctcactgcaacctccgcctcccggtttcacgccattctcctgccccagcctcccaagtagctgggactacaggctccggccaccgcatccggctawttttttttgtatttttagtacagacggggtttcatcgtgttagccaggatggtcttgatctcctgacctcgtgatcctcccgcctcggcctcccaaggtg

SEQ ID NO: 53906 - DNA, 201 bp, Homo sapiens
ccctctcatttcacccagactcctgcaaaagcttccagaatggtcttccctgttatacagcccttgccactatccctgcccatcctccacactgggccaakttgccccgtaagaacatagatttcttcaagcccatgcttccatgtcttcaatggcttcctattactcttagcacaaaagcccagagccttcatgctgtct

SEQ ID NO: 53907 - DNA, 201 bp, Homo sapiens
tgtttttctttttttttcttttttttttttttttttttttttttgagacagagtcttgcttgtcccccaggctggagtgcagtggcatgatctcggctcaytgcaacctccgcctcccggtttcacgccattctcctgccccagcctcccaagtagctgggactacaggctccggccaccgcatccggctaattttttttg

SEQ ID NO: 53908 - DNA, 201 bp, Homo sapiens
ggagtgggcaggggggaggaggaggccctgccccaccttcaccatggccagtgcttcatgtgcctgacccgcagagctggcagctgagcagtgtggctctrgggtgcagcccgggttggagctcagccctcgcctggctcttcttgcaggccctgggcatgttcagcgcagccttggcctcggggcagctgggccccctca

SEQ ID NO: 53909 - DNA, 201 bp, Homo sapiens
ccagggtgtcctccactgtgtgctcagggagtgggcaggggggaggaggaggccctgccccaccttcaccatggccagtgcttcatgtgcctgacccgcasagctggcagctgagcagtgtggctctggggtgcagcccgggttggagctcagccctcgcctggctcttcttgcaggccctgggcatgttcagcgcagcct

SEQ ID NO: 53910 - DNA, 201 bp, Homo sapiens
tcgctcctgccacgcaggtgccacggtgttaagggaggggcagtggggaatcctggcccagcaccctggaccctgcgagtaggccctgccgtgtggggcgygtccgctccagcggtgccctctctcttcgcagctcccggagccagtcggcagcggtcaccccgtcatccaccacctcttccacccgtgccaccccagccc

SEQ ID NO: 53911 - DNA, 201 bp, Homo sapiens; identical to SEQ ID NO: 11873

SEQ ID NO: 53912 - DNA, 201 bp, Homo sapiens
ctttcgtttaagaagctataacttaaaccatcttcagaaacaagatctgtcacccgtagagcttagagtccaaatagacacctatgaggcgagcacaaggrgcggtgtgaggcagctgcaggggcctgaccaggggccggggttggctgtgtcctaggcggctgggcagccactggcccccactgccccgtggacctccac

SEQ ID NO: 53913 - DNA, 201 bp, Homo sapiens
caggggcagggtccattcctgtccccctggatctgcagaagtggggctgagggggtaaaggtcacagcccttctgcccttgatcccatcgctttgatcccmagttctgggcaagggttagacaccaccttgtgtctttaacgtgttctagatgtggaagcgtttgccaaagccatgcagaacaacgccaagcccgagcaga

SEQ ID NO: 53914 - DNA, 201 bp, Homo sapiens
ttcctgggaggccagagtctactgtggatgactcgccccctcagcacaggttgtttggaagtggaaatagaagattctaaaagttagagaccctgtgagckccctgggtcactccccactcccaccttcacggggtaggacgggtctgcatcccaccgtcgcctcacttcaagtggtgccccctgtagggttcaggggcag

SEQ ID NO: 53915 - DNA, 201 bp, Homo sapiens
agtcgctgccgcagaccgcggatgagatccagaataccctgacctcgccccagttccagcaggtagaggccgggcccagggtgtcctccactgtgtgctcmgggagtgggcaggggggaggaggaggccctgccccaccttcaccatggccagtgcttcatgtgcctgacccgcagagctggcagctgagcagtgtggctc

SEQ ID NO: 53916 - DNA, 201 bp, Homo sapiens
cttgccatctggggagtcgctgccgcagaccgcggatgagatccagaataccctgacctcgccccagttccagcaggtagaggccgggcccagggtgtccyccactgtgtgctcagggagtgggcaggggggaggaggaggccctgccccaccttcaccatggccagtgcttcatgtgcctgacccgcagagctggcagct

SEQ ID NO: 53917 - DNA, 201 bp, Homo sapiens
gaggccagagtctactgtggatgactcgccccctcagcacaggttgtttggaagtggaaatagaagattctaaaagttagagaccctgtgagctccctggrtcactccccactcccaccttcacggggtaggacgggtctgcatcccaccgtcgcctcacttcaagtggtgccccctgtagggttcaggggcagccgagtg

SEQ ID NO: 53918 - DNA, 201 bp, Homo sapiens
aatcctggcccagcaccctggaccctgcgagtaggccctgccgtgtggggcgtgtccgctccagcggtgccctctctcttcgcagctcccggagccagtckgcagcggtcaccccgtcatccaccacctcttccacccgtgccaccccagccccttctgctccagcagctgcctcagcaactagcccgagccccgcgccca

SEQ ID NO: 53919 - DNA, 201 bp, Homo sapiens
acagcagccagcccgacccagcccatccagctgagcgacctccagagcatcctggccacgatgaacgtaccagccgggccagcaggcggccagcaaggtarcgtgtgctgtcgcctggagctgggtggggggcatggggcctgctgaccctcgcacgctcaccttccaaggcatctgcctagtgtgcgcgcctggggtgct

SEQ ID NO: 53920 - DNA, 201 bp, Homo sapiens
ctggactgaatcttctaatctaagcacatgaattgtgtaatgggatggaacagaaatgaccttgcttccagaacacagccgcaagtgtccacccgccccaygccgctcctccaggcctgtgggtccccaccgccccgcttcttcctggctttggtgttgggaattcctgctcctctggcctggggaggggccaggctcttt

SEQ ID NO: 53921 - DNA, 201 bp, Homo sapiens
aggaccccagctgggtacttcagaggagggtggctggccgagcggtggggctggaggactggagggagctggggttcctgcgccctgggtcccctggcccyacatggctgcctgcctgctgccagctcatggagtgcagacccgtgtgcttggcccttcagaaatgcttgtccctttgggtgggatctggactgaatcttc

SEQ ID NO: 53922 - DNA, 201 bp, Homo sapiens
cctcagcattgtgtggccaggcacacgcgcctctgcgtctcaggtccctcacctggaagccaggtcagaggatggctgtggtggccctgggtgagctggcrccagctcctgcccttacatgcccttcctcttgcaggaacccaagacagaccaggatgaggagcattgccggaaagtcaacgagtatctgaacaacccccc

SEQ ID NO: 53923 - DNA, 201 bp, Homo sapiens
cagacccgtgtgcttggcccttcagaaatgcttgtccctttgggtgggatctggactgaatcttctaatctaagcacatgaattgtgtaatgggatggaayagaaatgaccttgcttccagaacacagccgcaagtgtccacccgccccatgccgctcctccaggcctgtgggtccccaccgccccgcttcttcctggctt

SEQ ID NO: 53924 - DNA, 201 bp, Homo sapiens
accaccttgtgtctttaacgtgttctagatgtggaagcgtttgccaaagccatgcagaacaacgccaagcccgagcagaaagagggcgacacgaaggacamgaaggacgaagaggaggacatgagcctggactgagccacgcgccgtcctccgaggaactgggcgcttgcagtgcgttgcacaccctcacctcccacccac

SEQ ID NO: 53925 - DNA, 201 bp, Homo sapiens
cgcctgagctgcagtgttttccaggtgagggtggcctgcagagcctgctgggaaacatgagccacagccagctcatgcagctcatcggaccagccggcctyggaggactgggtaacgtgcgccacccgggctctcgggcagcttctgctgggaatgctttgaggcccggtctctgtttcctttaaacttctgctggctctg

SEQ ID NO: 53926 - DNA, 201 bp, Homo sapiens
ggtaggacgggtctgcatcccaccgtcgcctcacttcaagtggtgccccctgtagggttcaggggcagccgagtgcggtgctcagcagaggcgcaggcagygcggtggggcccgcgtggatctggctggggcaggcccgcctgagctgcagtgttttccaggtgagggtggcctgcagagcctgctgggaaacatgagcca

SEQ ID NO: 53927 - DNA, 201 bp, Homo sapiens
caggcgccggccacacccggccacacggcctgagatgccacctcagggctgcggtgcatgctacctggggccgaggtcctctcccagagtacggaggctcyaggctgggctgcgggcaaccgattgcggtgtgaaatttccaggcagacagacatgctggccctggttctaacgatgcccagtgccctctctctgcccctt

SEQ ID NO: 53928 - DNA, 201 bp, Homo sapiens; identical to SEQ ID NO: 11878

SEQ ID NO: 53929 - DNA, 201 bp, Homo sapiens
cttacatgcccttcctcttgcaggaacccaagacagaccaggatgaggagcattgccggaaagtcaacgagtatctgaacaaccccccgatgcctggggcrctgggggccagcggaagcagcggccacgaactctctgcgctaggcggtaactgtcacatgtgtcacgtgagctcagggtttcctgggaggccagagtcta

SEQ ID NO: 53930 - DNA, 201 bp, Homo sapiens
gctcatcggaccagccggcctcggaggactgggtaacgtgcgccacccgggctctcgggcagcttctgctgggaatgctttgaggcccggtctctgtttcstttaaacttctgctggctctgtctgcgtagtgtcggggagcctgtgtgtccgcaagctggttcccctttgggaatgcgcttgtttgcctgtggctagagc

SEQ ID NO: 53931 - DNA, 201 bp, Homo sapiens
ccacccgtgccaccccagccccttctgctccagcagctgcctcagcaactagcccgagccccgcgcccagttccgggaatggagccagcacagcagccagmccgacccagcccatccagctgagcgacctccagagcatcctggccacgatgaacgtaccagccgggccagcaggcggccagcaaggtagcgtgtgctgtc

SEQ ID NO: 53932 - DNA, 201 bp, Homo sapiens; identical to SEQ ID NO: 11881

SEQ ID NO: 53933 - DNA, 201 bp, Homo sapiens; identical to SEQ ID NO: 11872

SEQ ID NO: 53934 - DNA, 201 bp, Homo sapiens
gaacgtgtttttccacggttttgccaagaaatagtgtccaactgttaccaccatctcccttttttccccgattttcctgttggtggcttttaagtcccccrtccctgctttgccatgagagcagggactcccagtgtccctggcgccctgcagcttccatagccattcggggtgtgcgtgggtgctctgctcccagctctg

SEQ ID NO: 53935 - DNA, 201 bp, Homo sapiens
gcctggcaccttccatcgtttgctaagttccagcaggtgtatttcatttgcatttccctcatgaataatggtgttgagcagcttgccatggtgcctttgcygcctgtgacctctttggtgaaacatccggaggtgtcttctgcccacgtggaggcgcagcctgggctctgccgcccacctttcacccgaggagcctgcagc

SEQ ID NO: 53936 - DNA, 201 bp, Homo sapiens
tccactctggggccggtccccacaggcctccggaacagcttaattctgtctctctggagaccctaatccagaaggctgtgggcaagatctggaggtggggsggggtctggccgcctggatcccggccctgacggtccttctgtctgcagctcccccttccgccccctggcttgctgcattttgtccaagcctctctggagc

SEQ ID NO: 53937 - DNA, 201 bp, Homo sapiens
cccccgggagtgccagctgggctcctggcctgggtcccgctgcgcccagccgtggaggggttctctctccaagggtggggcctcaggaagaggctccagcrctggtcactggtgactcagggggcagtttccgagttccagacgtgaccttccccagggggtccttctagggggttcttgcgtatctccttgcatcctccg

SEQ ID NO: 53938 - DNA, 201 bp, Homo sapiens
gccccctggaggcgggcctgttcttcccaggcagcgggggagttatcactttaggtctgtgggtgctggcatcccaggccccagcagggcagggcaggggkctccaggaggttctggggaggggccccccctttcttctccatcacaacccctccccgcagacctcccaggagctacactgcctgatgtgggcctggaact

SEQ ID NO: 53939 - DNA, 201 bp, Homo sapiens
agacagagatgtgggagacaccaggaggtctcatgaatgctgctgcctcctcacgcccccgaaagctgctgtttggcttggagtggcctcccctgagcagycagggcccagggctgggctgggctgggctgctgctgccaggactctgagctgcctgcaggaccctggtcccagccagcctctgggggcctccccgctgca

SEQ ID NO: 53940 - DNA, 201 bp, Homo sapiens
gggtccctgaatccaccccaggcccagctctgttgaggtgcgggcagccccctggctgggaacccatcctctccctccagctggggagctcctgtcccccygcccactcctggaagttttcctgtcctgcttaggacatctgtagttgggcatggcggcgtccaaccccagagttgggggttctggcctcagagttgttat

SEQ ID NO: 53941 - DNA, 201 bp, Homo sapiens
gggaggtagacgatgacctcagagcctggcagccggtgaataggcctgtgccccgcccccaccccggaaggctgcgcttggctcccacagtccccgcaacrccaagccctccgagaagggtgggatttggacctgggatgtctggagtcctggaaccttgccccctacctggagtctgggcagctggtgcccccaagggct

SEQ ID NO: 53942 - DNA, 201 bp, Homo sapiens
agcccctgctgtggccaggcctgcgagggaccactacctcccggacctgcaccacctgcgcctggagctggaggaggctgccacacctgagggtcacgccrtgcgctttggcttcaaccccctcgagttcgagaacttcagctggaggggctacgcgcagatggcacctgtccaggtgggcgctgtgctccccctcccagg

SEQ ID NO: 53943 - DNA, 201 bp, Homo sapiens
tggggggcagtgcagtccaacgggccaggccccttcagccagtgagctgtggtctctgtcacgcggcctcttggcctgtgggagcctcagtggcaaggccsggagacgtcaaggggcccgggcaccgcggggacccaggcttttctggtgatccagcgccctcccctcctgccattccccgcagcctccaagagggactgt

SEQ ID NO: 53944 - DNA, 201 bp, Homo sapiens
gccactctgcatgcggctagggacaccctggccagcgtcttcagattgctgcacagcctggaccaggctaaggaggtgagtgcagcccctggcccctgtcrccaccccatccacggccaactccctcccaggcccgtgggcagctttgtgtgcacacttgcgtgcagagcccgccctcagggtcgtggatcaggtggctgt

SEQ ID NO: 53945 - DNA, 201 bp, Homo sapiens
ctgctaccgtgagcacctgccaggggcatccaaacagacaccactgcctgctggactccgggagccctgcagggggtggaggggttccccgggatggaccrtgttatcctgcctgcatctccgattgtgctgagagaccaagggtggcagggggtgtagggtgctagggttctgagcagacctggccaacatgcgtgtctc

SEQ ID NO: 53946 - DNA, 201 bp, Homo sapiens
cccaagctgctaccgtgagcacctgccaggggcatccaaacagacaccactgcctgctggactccgggagccctgcagggggtggaggggttccccgggayggaccatgttatcctgcctgcatctccgattgtgctgagagaccaagggtggcagggggtgtagggtgctagggttctgagcagacctggccaacatgcg

SEQ ID NO: 53947 - DNA, 201 bp, Homo sapiens
agggtgctagggttctgagcagacctggccaacatgcgtgtctcttcccctcagcgacgccctcgtcctccaatgacaccagggagcaggtgctgccagcyggccagattgtgagtaagtgtccttgaggcccccaggtccccggcctgccctggagccatgggggcggcttcacagaaagttcctggagaaagggaggat

SEQ ID NO: 53948 - DNA, 201 bp, Homo sapiens
cagtgttccagccctggagtggccgatgaccgctgtgaccctgacacaggccagtgcaggtgccgagtgggcttcgagggggccacatgtgatcgctgtgyccccggctactttcacttccctctctgccagtgtgagtggtgcctctccacgtgggcgtgggtaggggaggcccgtgggcctggcctaccgtgacacccg

SEQ ID NO: 53949 - DNA, 201 bp, Homo sapiens
ccgtgagtgcctagggaggaagtggtggggaggcaggtgcagtctccactgcgtgcccacagctatccttgtctgcagcctgccactgctctgctgaaggstccctgcacgcagcctgtgacccccggagtgggcagtgcagctgccggccccgtgtgacggggctgcggtgtgacacgtgtgtgcccggtgcctacaact

SEQ ID NO: 53950 - DNA, 201 bp, Homo sapiens
atgaggccggccgctgcctatgccagcctgagtttgccggacctcattgtgaccggtgccgccctggctaccatggtttccccaactgccaaggtgagcaragggtcagggcaggaaggggttctgccacccacatggcgccagggcctgaccccattgtccctctgcagcatgcacctgcgaccctcggggagccctgga

SEQ ID NO: 53951 - DNA, 201 bp, Homo sapiens
aggaagagggctatgggaggagccgcataggcctgtgggcccaggaactggccaacacgctggtctgcggttggggtttgtgcagctggaggaggagcaakggcatcttggaaagagcagggctcggtcggacgcctgggtttgcagtttcctgggtctgagctgtgtgaccggcccccccatcgtaccgcctgcaccccc

SEQ ID NO: 53952 - DNA, 201 bp, Homo sapiens
cctgccactgctctgctgaaggctccctgcacgcagcctgtgacccccggagtgggcagtgcagctgccggccccgtgtgacggggctgcggtgtgacacrtgtgtgcccggtgcctacaacttcccctactgcgaaggtgagcaggcaggtggctgtgtgcaccaggtgccgggcctgtgtgtgggtctgtgctgttcac

SEQ ID NO: 53953 - DNA, 201 bp, Homo sapiens
ttggccaggctattctcaaactcctgacctcaggtgatccgccctcttgggcctcccaaaatgctgggattacagacaggagccaccatacctggcctggmactttctataaatgccacacaacatgttctgtgcagccgcgtctcccaccgttgtgtcagcggataagttgccgtgttccgagacaccaacctcacatgg

SEQ ID NO: 53954 - DNA, 201 bp, Homo sapiens
ccccccacagcaccctgtgccggggcactgcccgggatacccaggaccacctggctgtcttccacctggactcggaggccagcgtgaggctcacagccgarcaggcacgcttcttcctggtaaggacccctcaggtccccaccccaaggggtcagcttctttcagaagatttgaaacatgcatgagaggggagaggacagt

SEQ ID NO: 53955 - DNA, 201 bp, Homo sapiens
cagtggcccagctggggtcacagccagggaggaaaaagcaccactccttccaaacgggctgtttccagaccctgcctaggccaggaaggccggactatccsttggccccatccttctggcagcaggaacctgcagaccctcggaggctggaggcaggtggcagccctgggggaaggcaggctccaggcctgggggaggggt

SEQ ID NO: 53956 - DNA, 201 bp, Homo sapiens
caggtactgagcgtcctggccttccctccccaacccgggccagtgcaggccttcaccttccgcctcccacagagccagctccggagccccctgggcccccrccatgagacggcacagcagctggaggtgctggagcagcagagcacaagcctcgggcaggacgcacggcggctaggcggccaggcaggagccccaagaccc

SEQ ID NO: 53957 - DNA, 201 bp, Homo sapiens
ggcaggtgcagccttatccccactctttggatggggacattgaggctcagcagttactgtgacttggcctcttcccaggactcggaagcagcagccaggaggcccaggcccacctgccgctgtccacacgtccactctggggccggtccccacaggcctccggaacagcttaattctgtctctctggagaccctaatccag

SEQ ID NO: 53958 - DNA, 201 bp, Homo sapiens
ctgtgacttggcctcttcccaggactcggaagcagcagccaggaggcccaggcccacctgccgctgtccacacgtccactctggggccggtccccacaggcctccggaacagcttaattctgtctctctggagaccctaatccagaaggctgtgggcaagatctggaggtggggcggggtctggccgcctggatcccggcc

SEQ ID NO: 53959 - DNA, 201 bp, Homo sapiens
tggttttgctgcatcgtggttagacttggcacactgatagtttctgccttttgtctttggaatttgagattttctttgtttctaacctagaatgtgacgayttttattttttaattttatttatttatttatttatttatttatttatttatttattttgacacagagtctcactctgtcacccaggctggcgtccagttg

SEQ ID NO: 53960 - DNA, 201 bp, Homo sapiens
ggggaccgggtaagcagggcatcaggtctgggggaggcactttgaggatggccaggacgcctgagagggttgggagccaggagtggggtctgtccagggarggggagctccatgggggtccgtgagggtgcccaggccctgtcccggtagggaatgagcgcaagtatccaggcccagcacagggctctgtgctgggggtgc

SEQ ID NO: 53961 - DNA, 201 bp, Homo sapiens
ccttctagggggttcttgcgtatctccttgcatcctccggaagcttctggaactgagcggccacatcactggcctcaggctccttcttccgagaaccacaccccaggccccaggccccaggcccagggaagggtgagcgcgttcatgactgcccaggcacatggccagcgggtcctggcttgagctcccccaccccctggc

SEQ ID NO: 53962 - DNA, 201 bp, Homo sapiens
ataagacctgctgaggtttttctttctttagttgggaggagagattttcctttctaatattcaatttctttaatccactttctttgatttatcactttttwaaaatagcttcttgagttattatttttagtctgtcttcattcccaacaaaaaggcttaaagcagtggttctcagccagtggtgactttgatgcacaggaa

SEQ ID NO: 53963 - DNA, 201 bp, Homo sapiens
caccgctgtggaccctgatgcagagcccaccctgctgcgtgagccccaggtgagggccatagtctctagagggacgggggtgtcagggcaggactccgggycccaacccagggcaggttgtccagggggcggcaggggctcatagctcagcctgctcactagggcctatccctgcaggccaccgtggtcttcaccacccat

SEQ ID NO: 53964 - DNA, 201 bp, Homo sapiens
gtatttatttaaacaacccccagtggttggaaatctaggttctttttttttttaattatgctgtgataaagcattattaagatgaggtagaaaactggccsggcacagtggctcacacctgtaatcccagcactttgggaggctgaggcaggtggattacctgaggtcaggagttagacaccagcctggccaacatggtga

SEQ ID NO: 53965 - DNA, 201 bp, Homo sapiens
cacctggggacccgctactgcccagaggccactctctgcctcacacgggatctaaagcagctcagagccggactctgcgcctggactgcagattccttgaygtctccgccccctctccagccagcccctcccccacttggagcttctcctgccaaggggagccgcctcctctcccccctcccccaggtgggagaactaata

SEQ ID NO: 53966 - DNA, 201 bp, Homo sapiens
tcttctccaggactttttatggtctttttgccattggtgttctgcagatttattgtgatgtgttgaggattgggatttttttcttgctcaggactcacgctttttttttttttttttttttttgagatggagtctcactctgttgcccagactggcgtgcagtggcacgatctcggctcactgcaagctccgcctcccggg

SEQ ID NO: 53967 - DNA, 201 bp, Homo sapiens
ggaaaaccttcggaaatataggtcggcataaagccaaagaaaaaagttagcccaggcaacatggtaaaaccctgtctctacagcaaatacaaaaattagcygggtgtagtgatgtgtgcctgtagttcgagctactccggaggctgaggtggaaggattgcttgagcctggaaggccgaagctgcagtgagccatgatcac

SEQ ID NO: 53968 - DNA, 201 bp, Homo sapiens
caggtggattacctgaggtcaggagttagacaccagcctggccaacatggtgaaaccccatttctactaaaaatacaaaaattagccaggcgtggtggtgygtgcctgtaatcccagctacttggggggctgaggcaggagaatcatttgaacctggttgcagtgagctgagaaccaccatcacactccagcctaggtgac

SEQ ID NO: 53969 - DNA, 201 bp, Homo sapiens
gctccatggcacgtggcgaattgagggcttgccccaggatgccgctggcagcacatgtggccctgtgtgtttgtctggttcctggctcggccaagcctggkgtcccgcacatggagttgaccggtacctagaggtgtcccgcatgacatctgtaggtcatgatgcggccaacccccgtgacatgaggggccggccttgcag

SEQ ID NO: 53970 - DNA, 201 bp, Homo sapiens
ctacaggcacccaccaccacgcctggctatttttttttgtatttttagtagaaacggggtttcaccatgttagccaagatggtctcgatctcctgacctcrtgatccacctgcctcggcctcccaaagtgctgggattacaggtgtgagccactgcgcctggccatgtgttcattattaattcaagaccatccttggccat

SEQ ID NO: 53971 - DNA, 201 bp, Homo sapiens
gctgctaatctgccctgctaatctgtctgtctgctgtaactttgctccttctgtatgaggaggtttgtggttgaatacctcctagaaggagtggaaagagyaggccctggtccacatggagtgggtggtcaccagccccaaggcctggtcattcccgagacaggacatccgtgtggctttgagagctatgtcctcaaacag

SEQ ID NO: 53972 - DNA, 201 bp, Homo sapiens
gccaggctgttggggcggtaggctgggcttggaggtggcgccctgacccgcatccccgcttccccacagcctgcgacggctcttccccaccggaggctcastccgtggctgcgtcaaaggcatcaaggccctgggcaagtatgtggacctcaagcggctgaacacgacaggcgtgagcgccggctgcaccgccgacctgct

SEQ ID NO: 53973 - DNA, 201 bp, Homo sapiens
tcagctccacggcaagctggggcccagagtgacaggagcagtacacccagcaggcgacaggcacgggcaaagacctggaggcgggacttggcgggcaggcrcgggcacggctggttgtgagcgcaggaggctggagagccaggccgagggcgtctgcgcttacccactccttcgaccctcccttccgctgcagcatcatcc

SEQ ID NO: 53974 - DNA, 201 bp, Homo sapiens
acaggcacgggcaaagacctggaggcgggacttggcgggcaggcacgggcacggctggttgtgagcgcaggaggctggagagccaggccgagggcgtctgygcttacccactccttcgaccctcccttccgctgcagcatcatcctggacgtcaaccaggaccgcctcacccagagggccatcgaggcctccaacgcctac

SEQ ID NO: 53975 - DNA, 201 bp, Homo sapiens
tctgtggtcttttcatgggggaccccacagcagtctcagtccggctcagtccagtgggatgactgtaggtcttgtgcagctctgggggaccccactctccyccttggggccctaggcttccaggcctacctggccaacagcacccagctgttcccaggcgtacctgctgtggggagaaactctccggaggagtgggcactg

SEQ ID NO: 53976 - DNA, 201 bp, Homo sapiens
ctgtggaagagacccccacagtgggcagctggggccagacacagaaagcctaccagggaggtgccagggctgcagatagcacagacagccccagccgtcgrgagcctggcaagcttggaagtgctttgggtagaaatggaggtataggtgggagggctgtaggccttgggggggattggggcacaccctgcaggaagggca

SEQ ID NO: 53977 - DNA, 201 bp, Homo sapiens
tagtggaggccgccgaggcccacgcacagcagctgggccagctggcactcaatctgtccaggtgggtggccaggagaggaggggccctgggcccaccctgrggatgcagacagggccttgggagggccagctggtctgggaaggctcctaggggctgaggccgttgtcctcaaagaagccaggccttcctcagctccacgg

SEQ ID NO: 53978 - DNA, 201 bp, Homo sapiens
tccctgcctgtccttgtcacccctgcctaacctgagggtgggtgacctggttccatggcccaccacaaccctgctgtctgtgtgacctgcactgaccaccrccgtgtgcctcagtttcctcatctgtgcagtgatgtggaggccagggcatgtgcagcctccccagggtgccctatcttggtttggggggccttgccctac

SEQ ID NO: 53979 - DNA, 201 bp, Homo sapiens
ggcgccaggaatctctggtgccatctcttggctgcctctggatggcttcatgcaccggcagctcccgtggtgacaaaaggggcctggcagctcccacctcrcctcctgccagcctagccacctgcgtcaagagtactggagtcctagcccggatgctggccgtccctggccccgtgccaccctgaccagtcatgctggtgg

SEQ ID NO: 53980 - DNA, 201 bp, Homo sapiens
cccgtcaggggaggtgtgggccgggacaggcaggccacacctgtgctgtgggtccatgagttgcctctctcccccggcacccgggcctcctcgcacaggcsggggagaggttcgtgtttcctccgcctccctgccaggtccctgtggagcctctgcctgggagagccctttcccctttgtttgagaggggctggggagggg

SEQ ID NO: 53981 - DNA, 201 bp, Homo sapiens
cacctgtgagcagaggaggggctggtccccactgccgcccacaaagagttgggctgagtactgaggtttcccaaggtctccatcgtggaccctgtgggccygtcaggggaggtgtgggccgggacaggcaggccacacctgtgctgtgggtccatgagttgcctctctcccccggcacccgggcctcctcgcacaggcggg

SEQ ID NO: 53982 - DNA, 201 bp, Homo sapiens
ttcagtggctgcatcagcaacgtcttcgtgcagcggtgagcctggtgggcgctgggggacaaggtcccagctggccttccgcagctgctgaccgcctgccygccctgcacaggctcctgggcccacagcgcgtatttgatctgcagcagaacctgggcagcgtcaatgtgagcacgggctgtgcacccgccctgcaagccc

SEQ ID NO: 53983 - DNA, 201 bp, Homo sapiens
cctgctggcctttttagggcccacctgggggcccacctgtgagcagaggaggggctggtccccactgccgcccacaaagagttgggctgagtactgaggtytcccaaggtctccatcgtggaccctgtgggcccgtcaggggaggtgtgggccgggacaggcaggccacacctgtgctgtgggtccatgagttgcctctct

SEQ ID NO: 53984 - DNA, 201 bp, Homo sapiens
tgggcactggcgggtcagggtcccgaggaggtgtggtgggtggccctggggtgtggcatgaccctcggaggcctgctggcctttttagggcccacctgggkgcccacctgtgagcagaggaggggctggtccccactgccgcccacaaagagttgggctgagtactgaggtttcccaaggtctccatcgtggaccctgtgg

SEQ ID NO: 53985 - DNA, 201 bp, Homo sapiens
agccggtgagtctgaggaccaaggtgtgggggatttgggggcacactggtcaggaccctcccctgccccacttcacctcctcccttggcccccagggcacyggccagtgcttctgcaagccccacgtgtgcggccaggcctgcgcgtcctgcaaggatggcttctttggactggatcaggctgactattttggctgccgca

SEQ ID NO: 53986 - DNA, 201 bp, Homo sapiens
gaccctcccctgccccacttcacctcctcccttggcccccagggcaccggccagtgcttctgcaagccccacgtgtgcggccaggcctgcgcgtcctgcamggatggcttctttggactggatcaggctgactattttggctgccgcagtgagtgcccactcgctcgtcccagaccacagccctgcctcccctcggtttat

SEQ ID NO: 53987 - DNA, 201 bp, Homo sapiens
gagtgcccactcgctcgtcccagaccacagccctgcctcccctcggtttatgctggggaacccaaggcccggagggacaagtgcagcctgggcagcatgargcccgggtgatggatggctgccccttggtgccagcctgtgccagggtgtgggagagggggtgcagctcccacccagatgcgtggcttcctctcccctgtc

SEQ ID NO: 53988 - DNA, 201 bp, Homo sapiens
tatgctggggaacccaaggcccggagggacaagtgcagcctgggcagcatgaggcccgggtgatggatggctgccccttggtgccagcctgtgccagggtrtgggagagggggtgcagctcccacccagatgcgtggcttcctctcccctgtcctacacctgggcagacggcactaacagatcccagcgccctcaccctcg

SEQ ID NO: 53989 - DNA, 201 bp, Homo sapiens
tgccggtgccgccccaacacccagggccccacctgcagcgagtgggtaccccttccccactgggtggtggggagcggggcaggcagcttgtcctccgggcmtctccgtgtccctcaccatgggcccacgtgaggcctcaccctccctggagatccggggccgctgtgcagggctaggtaggatggccaagctgcacctgac

SEQ ID NO: 53990 - DNA, 201 bp, Homo sapiens
ggaccccacggagcaatgggtgttgcaggaccttggcctgggggctgggggtcctgtggcggtggcaggttataggagcagggcgctgcctcaggcaatgsagcccagcacccaggcagggcgcccctgcctcctgcctcctgcctcctgcctcctgcctcctgcctcctgcctcctgcctcctgcctcctgcctcctgcc

SEQ ID NO: 53991 - DNA, 201 bp, Homo sapiens
ccacagcaccctgtgccggggcactgcccgggatacccaggaccacctggctgtcttccacctggactcggaggccagcgtgaggctcacagccgagcagkcacgcttcttcctggtaaggacccctcaggtccccaccccaaggggtcagcttctttcagaagatttgaaacatgcatgagaggggagaggacagttggg

SEQ ID NO: 53992 - DNA, 201 bp, Homo sapiens
agcagccatagaacgcgtattcatgagtggggttggcggcgttccaataaaactttatttacaaaagcaagcgaggagtccatagactagtttgctaatcsctggtgtaaactgacaatttatcttttcgctactgggccatagtaagcactcagtaattacctgtggctgtacagtattcactttcaatgtgttcattac

SEQ ID NO: 53993 - DNA, 201 bp, Homo sapiens
ctctgcagggccagtactgtgacatctgcacggctgccaacagcaacaaggcacaccccgcgagcaatgccatcgatggcacggagcgctggtggcagagyccaccgctgtcccgcggcctggagtacaacgaggtcaacgtcaccctggacctgggccaggtagggacccttctttgcgtgctgcagcccccatctctgt

SEQ ID NO: 53994 - DNA, 201 bp, Homo sapiens
acagcaaatacaaaaattagctgggtgtagtgatgtgtgcctgtagttcgagctactccggaggctgaggtggaaggattgcttgagcctggaaggccgargctgcagtgagccatgatcacaccacagcactccagcctgggcaacagagtgagaccttgtttcaaaaaagaaaactgggcatggcacatgtatacatat

SEQ ID NO: 53995 - DNA, 201 bp, Homo sapiens
cctgatacctgtttttcttttcttttttttttgtttttttgtttttgtttgagacggagtctcgctctgtcgcccagactggagtgcagtggcacgatctyggctcactgcaagctctgccttccaggttcacgccattctcctgcctcagcctcctgagtagctgggactacaggtgcccgccaccacgcccggctaatt

SEQ ID NO: 53996 - DNA, 201 bp, Homo sapiens
gagaaagggaggattttcatttggtcactttatttttggcttatttctttttatgcaaattatgcctattcacactggaaaaccttcggaaatataggtcrgcataaagccaaagaaaaaagttagcccaggcaacatggtaaaaccctgtctctacagcaaatacaaaaattagctgggtgtagtgatgtgtgcctgtag

SEQ ID NO: 53997 - DNA, 201 bp, Homo sapiens
ggtcacctgaggtcgggagttcgagacgagcctgaccaacatggagaaaccccgtctctactaaaaatacaaaataagctgtgcatggtggcgcatgcctrtaatcccagctactcgggaggctgaggcgggagaatggctcgaacccgggaggtagggtttgcagtgagctgagatggcgccactgcactccagcctggg

SEQ ID NO: 53998 - DNA, 201 bp, Homo sapiens
gctgggctgggctgggctgctgctgccaggactctgagctgcctgcaggaccctggtcccagccagcctctgggggcctccccgctgcaggctctgggccygcgggagagtgaccaggcctcaccccctaggattatgtactcgtggtccctgagaacgtctacagctttggctacctccgggaggagcccctggataaat

SEQ ID NO: 53999 - DNA, 201 bp, Homo sapiens
tacgaccctgaggtggaccggcgccgcgccagccagagcctggatggcacctatcagggtgggggtgtctgtatcgactgccaggtgggctgggctagagkgctgggaatgggctggccccgaggtggggcagggacctccccagactcaacggccattgcactcccagcaccacaccgccggcgtcaactgtgagcgctg

SEQ ID NO: 54000 - DNA, 201 bp, Homo sapiens
gtgggagacaccaggaggtctcatgaatgctgctgcctcctcacgcccccgaaagctgctgtttggcttggagtggcctcccctgagcagccagggcccabggctgggctgggctgggctgctgctgccaggactctgagctgcctgcaggaccctggtcccagccagcctctgggggcctccccgctgcaggctctgggc

SEQ ID NO: 54001 - DNA, 201 bp, Homo sapiens
gaccaggatgcctaggagtcctgcctgctaagcgaaatctgagccttggggggtgcaaatggacccctttcccttctggctcagggaggttttgggcttaygctcgagtcctggccgaagtggaaagggcataactcagttttggagaacgcaggtctccatcctgacctgcaggcaagggggactctactgacccctgag

SEQ ID NO: 54002 - DNA, 201 bp, Homo sapiens
ggcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcaca

SEQ ID NO: 54003 - DNA, 201 bp, Homo sapiens
cccccggggctcagcggggagcgctgcgacacctgcagccagcagcatcaggtgcctgttccaggcgggcctgtgggccacagcatccactgtgaaggtgygtcctcaacaccccacttccccacacctgatggagtaggaatccaagtcccacacagcctggtgaccccagtgttaacgtcgacctcccagagtggtccc

SEQ ID NO: 54004 - DNA, 201 bp, Homo sapiens
gcagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacac

SEQ ID NO: 54005 - DNA, 201 bp, Homo sapiens
cagcattgctgccccatctgcgggcctgggcccaggacttcagcttgcgggccatgcagaaggtttcagggaccagcaggtggtccacagtctctgacgatgatgttgattctgagcagctgcctccatgtcaggagctgtccaaggctcagcacccggggcaggggtccctgttcttgtctcccccgcccccgtcacact

SEQ ID NO: 54006 - DNA, 201 bp, Homo sapiens
gggcatccacccatgtgcagccacacgtgtgtgcccacagttcgtggatatggagggatgggtgctgctgagcactgaccggcaggtggtgccccacgagyggcagccagggacggagatgctccgtgcagacctgcggcacgtgcctgaggctgtgcccgaggctttccccgagctgtactggcaggccccaccctccta

SEQ ID NO: 54007 - DNA, 201 bp, Homo sapiens
gtgtgcacacttgcgtgcagagcccgccctcagggtcgtggatcaggtggctgtgagcaggatgaggggctaagtccactcaaattccaggagctggagcrcctcgccgccagcctggacggggctcggaccccactgctgcagaggatgcagaccttctccccggcgggcagcaagctgcgtctagtggaggccgccgag

SEQ ID NO: 54008 - DNA, 201 bp, Homo sapiens
gagcccgccctcagggtcgtggatcaggtggctgtgagcaggatgaggggctaagtccactcaaattccaggagctggagcgcctcgccgccagcctggayggggctcggaccccactgctgcagaggatgcagaccttctccccggcgggcagcaagctgcgtctagtggaggccgccgaggcccacgcacagcagctgg

SEQ ID NO: 54009 - DNA, 201 bp, Homo sapiens
gggatgactgtaggtcttgtgcagctctgggggaccccactctcccccttggggccctaggcttccaggcctacctggccaacagcacccagctgttcccrggcgtacctgctgtggggagaaactctccggaggagtgggcactggcgggtcagggtcccgaggaggtgtggtgggtggccctggggtgtggcatgaccc

SEQ ID NO: 54010 - DNA, 201 bp, Homo sapiens
gtctgggcagctggtgcccccaagggctgaagctatgaggggtctgtggtcttttcatgggggaccccacagcagtctcagtccggctcagtccagtgggrtgactgtaggtcttgtgcagctctgggggaccccactctcccccttggggccctaggcttccaggcctacctggccaacagcacccagctgttcccaggc

SEQ ID NO: 54011 - DNA, 201 bp, Homo sapiens
tccctgctgggcagggcatgtctccctgccccccacccacagggaggtagacgatgacctcagagcctggcagccggtgaataggcctgtgccccgccccmaccccggaaggctgcgcttggctcccacagtccccgcaacgccaagccctccgagaagggtgggatttggacctgggatgtctggagtcctggaaccttg

SEQ ID NO: 54012 - DNA, 201 bp, Homo sapiens
cagtgctgctgtgcccattctccgtggtggaaaagagcccaggagcagaagcggggtgggggctggggaggtccccacacccattgtcagatatcttctgygctggtcaccctggggggtgtcatgctgtcttcccacctgctttgtgagtccctgatccctgaggggtgagcagctgctcagtagctgttggcttcctcc

SEQ ID NO: 54013 - DNA, 201 bp, Homo sapiens
tctagcgggtccttccctgtccaggcacaggggccactggcccccacctggggctctctggaatgcttgtggtcaggcccacagggggctgctgaggcccrggtgtggggctgggtatagggtctgtccctgaagaggctcatacccctccctgctgggcagggcatgtctccctgccccccacccacagggaggtagacg

SEQ ID NO: 54014 - DNA, 201 bp, Homo sapiens
tgatcagtgtcttcaagtcaatatttgtgcaagtgctctcagctgggaaaaatgtgactggcctgctgaaggggagggaggaggacagatcgggccgaggrgagcgcagcctccatccaggcactcagggaacagcgggggcggctcccagggggctcagtcgggacctttagtctccttcggagcctttggtgggagggg

SEQ ID NO: 54015 - DNA, 201 bp, Homo sapiens
accttcatgccctcatgaaaggcattttatcctgatgcccctctctgcagctcttcccactgccctgtgcccaggaaggggaagtgtccgctccagggccrcacaacccctgaagcctggagccggcctgggccctgggtcctgggccccgtactcctggggctcttgcccaccccctgtgaggcagtggtcaccgggcag

SEQ ID NO: 54016 - DNA, 201 bp, Homo sapiens
gacagtggtggggcaggtggaggaggctgggcctgagagcagccagtgcctggagtgggggccccagggctgacccagaggcctgcatcccagccggctcygccgctgccccagtcccagtgtgtgacacatcggtcttcacccctgtctgagcctctgtccctgccattgtcccgagggtgttagagatagaggaggtct

SEQ ID NO: 54017 - DNA, 201 bp, Homo sapiens
ttgtgtggacaaacagcagatctggtttcctgggggggcgggggagcagccaggacccagctctgccccctctcctcatccctgccccggctcccagcackacccctcccctgccaggatgcaggccaggattctgctgggagcctcctctcttccccactcacccatgcaggacaggcccccagcagatggcaggcccgg

SEQ ID NO: 54018 - DNA, 201 bp, Homo sapiens
actttctcaaactcagattgaggcctctggggcctcaatcaaccccaagcctgggagggcgcctttgtgtggacaaacagcagatctggtttcctgggggrgcgggggagcagccaggacccagctctgccccctctcctcatccctgccccggctcccagcactacccctcccctgccaggatgcaggccaggattctgc

SEQ ID NO: 54019 - DNA, 201 bp, Homo sapiens
ggctatggggcctggggctgggcagtgtgttctcaaggctgcaggccaggggctctcagggaccctctgtaggagatgcacattagctgggcatcccagawgggggtcggggtgaaccctgctgggcagctggagcaggcagagggcagggggaggttgtggccctcacagccccaggtgggcatcaggggatccctggcc

SEQ ID NO: 54020 - DNA, 201 bp, Homo sapiens
cacggagcgctggtggcagagtccaccgctgtcccgcggcctggagtacaacgaggtcaacgtcaccctggacctgggccaggtagggacccttctttgcrtgctgcagcccccatctctgtgtctgtgcccgtcgggcctaccttgggccacaggaccagaaggcgaggtctccaccgtgagcgagacctggggcctggg

SEQ ID NO: 54021 - DNA, 201 bp, Homo sapiens
ttcagcccggagttcgtggagccccgggtcagctgcatcagcagccacggcgcctttggccccaacaggtaatggcaggtaatggggctgggaggggcgcrgccgagggcccggcggcagggccggctctgactcacccactgtgctctcaccagtgccgcctgtctgccctcgcgcttcccaaagccgccccagcccatc

SEQ ID NO: 54022 - DNA, 201 bp, Homo sapiens
ttcccaaagccgccccagcccatcatcctcagggactgccaggtgatcccgctgccgcccggcctcccgctgacccacgcgcaggatctcactccagccaygtccccagctggaccccgacctcggccccccaccgctgtggaccctgatgcagagcccaccctgctgcgtgagccccaggtgagggccatagtctctaga

SEQ ID NO: 54023 - DNA, 201 bp, Homo sapiens
cagctggaccccgacctcggccccccaccgctgtggaccctgatgcagagcccaccctgctgcgtgagccccaggtgagggccatagtctctagagggacrggggtgtcagggcaggactccgggtcccaacccagggcaggttgtccagggggcggcaggggctcatagctcagcctgctcactagggcctatccctgca

SEQ ID NO: 54024 - DNA, 201 bp, Homo sapiens
cctgctgcgtgagccccaggtgagggccatagtctctagagggacgggggtgtcagggcaggactccgggtcccaacccagggcaggttgtccagggggcrgcaggggctcatagctcagcctgctcactagggcctatccctgcaggccaccgtggtcttcaccacccatgtgcccacgctgggccgctatgccttcctg

SEQ ID NO: 54025 - DNA, 201 bp, Homo sapiens
ctgtccacatggctacggctgccgcaccctggtggtgtgtgagggccaggccctgctggacgtgacccacagcgagctcactgtgaccgtgcgtgtgcccragggccggtggctctggctggtgagtcccagctgatgtcctgctcagggaccagctgtccttatacttgtcattaccactgtggtacacttgggctgggt

SEQ ID NO: 54026 - DNA, 201 bp, Homo sapiens; identical to SEQ ID NO: 11931

SEQ ID NO: 54027 - DNA, 201 bp, Homo sapiens
gcccgccacgcaccatcccgcccgactgcctactgtgccagccccagacctttggctgccaccccctggtcggctgtgaggagtgtaactgctcagggccyggcatccaggagctcacagaccctacctgtgacacagacagcggccagtgcaagtgagagcccagagcggcgtcagcgcggcccctggtggccttaagga

SEQ ID NO: 54028 - DNA, 201 bp, Homo sapiens
cagctgtatgttgagcgcctaacacacgctgggccgttttcctgggaatgggaacacagggtgggaccccagcccggcctcaggagcacctgttccggggraggcagctgggaaacacgcaaaccagtactcagcgtggtgcccggagggtgtaacaccctagggtggcagtgcaggcatggggctggacagaagccactc

SEQ ID NO: 54029 - DNA, 201 bp, Homo sapiens
agacccaacgtgactgggcgccgctgtgatacctgctctccgggcttccatggctacccccgctgccgcccctgtgactgtcacgaggcgggcactgcgcytggcgtgtgtgaccccctcacagggcagtgctactgtaaggtgagtgagggctgggcccagatctggcctctccctccggcctcatcagctgaaagtgtc

SEQ ID NO: 54030 - DNA, 201 bp, Homo sapiens
gggcagccaacaccccacatctgctgtgccctgtgtgcctgctttcgggggcagccgagggcactgcagagcatccacctcccgggagcccctcacaggaygggcagcagccctggtgctggcaccggcacattcctgggcctcacccagagtcctcagtaaggtagggccgggctcattctgcggagaagcaaccccagg

SEQ ID NO: 54031 - DNA, 201 bp, Homo sapiens
ggggtgcctacgaggtctcactttggtgtgagtgacctggggtggagggggctcagctcccgcccctgccacaggtgcagacccaacgtgactgggcgccrctgtgatacctgctctccgggcttccatggctacccccgctgccgcccctgtgactgtcacgaggcgggcactgcgcctggcgtgtgtgaccccctcaca

SEQ ID NO: 54032 - DNA, 201 bp, Homo sapiens
gcccgcccagctcccccaacctttcaggacacaacagacaacttccctgctgccccagccctgaccttcactccagtcaagcagggaccaaggcccaggayggggatggcagggtgggggcagccaacaccccacatctgctgtgccctgtgtgcctgctttcgggggcagccgagggcactgcagagcatccacctcccg

SEQ ID NO: 54033 - DNA, 201 bp, Homo sapiens
tccttttagagttctttgttattcttggtgcttaccctctgtcagacttcagagtaacaaccgtcttctcccctctcacagctcatctggtttttctttgtttttttttttttgtttgtttgttttttgagacagtcttgctctgtcgcccaggctggggtgcagtggtgcaatctcggcttactgcagcctctgcctccc

SEQ ID NO: 54034 - DNA, 201 bp, Homo sapiens
gatggtcgtcgaggggggtcactcgcactcaaagcgtgcaagggagagcggtggggggcagtgcagtccaacgggccaggccccttcagccagtgagctgyggtctctgtcacgcggcctcttggcctgtgggagcctcagtggcaaggcccggagacgtcaaggggcccgggcaccgcggggacccaggcttttctggtg

SEQ ID NO: 54035 - DNA, 201 bp, Homo sapiens
gtcacgaggcgggcactgcgcctggcgtgtgtgaccccctcacagggcagtgctactgtaaggtgagtgagggctgggcccagatctggcctctccctccrgcctcatcagctgaaagtgtccttacgggcctttcggggcagctggggcttcctagaagcttttgggagagtcatccccattggcaggtgggtaccagga

SEQ ID NO: 54036 - DNA, 201 bp, Homo sapiens
aatcagaccctccccataccaggatcacatcccccctcccctacccatgatcaggcccccaccttcaccatcagaccctccccccaacccatgaccagcgccccccccacctcacgatcacatcccctctccccccacaatcagtcccccctcatggttagacaccaccaccaatgccccaccactggcagcggacaccag

SEQ ID NO: 54037 - DNA, 201 bp, Homo sapiens
ccatcttaggagctgctgacctgtcagagggactagggggttggacctttggacctgcctggtggcagggaccactgtctggccaccaggcctggctggaygtgagggctgtggggacactggggtgtgttcctgcctccaccctggccagtccctgcctgggccgcaggtaggcctctccctagcttgctccatctgcag

SEQ ID NO: 54038 - DNA, 201 bp, Homo sapiens
ggcccccaccttcaccatcagaccctccccccaacccatgaccagcgccccccccacctcacgatcacatcccctctccccccacaatcagtcccccctcrtggttagacaccaccaccaatgccccaccactggcagcggacaccagccgtcagagcagggcaggccatggcagggagtctgcaggtccctcgggcccag

SEQ ID NO: 54039 - DNA, 201 bp, Homo sapiens
accggcaggtggtgccccacgagcggcagccagggacggagatgctccgtgcagacctgcggcacgtgcctgaggctgtgcccgaggctttccccgagctrtactggcaggccccaccctcctacctgggggaccgggtaagcagggcatcaggtctgggggaggcactttgaggatggccaggacgcctgagagggttgg

SEQ ID NO: 54040 - DNA, 201 bp, Homo sapiens
aagagggcccccagcctgcaaggctgagccccgcttgctccctgcagcccagtccctgggggctcagtgggcccctggctgtgggctggtcagcatgggastgagcagagcctggggaggggtgcccggtgtgaggtgggggcaggggccccatcttaggagctgctgacctgtcagagggactagggggttggacctttg

SEQ ID NO: 54041 - DNA, 201 bp, Homo sapiens
aggggctccctgggggggtgagagggcccagggctgcagtcacggaccccttctgcagggtgcgactgtaccccatgtgggacagaggcctgcgacccccrcagcgggcactgcctgtgcaaggcgggcgtgactgggcggcgctgtgaccgctgccaggtagggctgtggggtaagcagggctgggtgggtggggcctag

SEQ ID NO: 54042 - DNA, 201 bp, Homo sapiens
tcaggctgacacacggggagaaagtaggcagagccaaggtggggctggggcaggggcttggggtttcgggggcctgggaaggagcagctttcctctgccckgggcagggctgccctgacgtgcaccgggccacagcagtgctactgccccagtgcctgggctggtggagtctccgaggcagactcagcttcaagagggccc

SEQ ID NO: 54043 - DNA, 201 bp, Homo sapiens
agtgtgggtgtgcgtgttcatgtcctttcacgggcgtgtgggtgtgttagtgcacgtgtagtgggtgcatcttcacgtgcgtttgtgtgcttgttcagacrtgtgtcacacactgcgtgtggaatgtacacgggtaccccacgcggtgcacgtttgcgtgcatgtccatgagcaggtgctgtgtggtgggatggcacgtcc

SEQ ID NO: 54044 - DNA, 201 bp, Homo sapiens
cacagacacatgggctgtccctgggtggaggtcaggctgacacacggggagaaagtaggcagagccaaggtggggctggggcaggggcttggggtttcggrggcctgggaaggagcagctttcctctgcccggggcagggctgccctgacgtgcaccgggccacagcagtgctactgccccagtgcctgggctggtggagt

SEQ ID NO: 54045 - DNA, 201 bp, Homo sapiens
gctgtgaggagtgtaactgctcagggcccggcatccaggagctcacagaccctacctgtgacacagacagcggccagtgcaagtgagagcccagagcggcrtcagcgcggcccctggtggccttaaggacagcatttcctctagccagagggtcctggcacccaccctgctcccatttgtgctccctgggtgcagcagcgc

SEQ ID NO: 54046 - DNA, 201 bp, Homo sapiens
ggggagatgtccgcagctgagggttagggggaggggctgcagtcagggaaggcttctctgaggaggtgtacaaagcgtcctgtgaagactgagccaggctstcccccagccccgaggcacagacacatgggctgtccctgggtggaggtcaggctgacacacggggagaaagtaggcagagccaaggtggggctggggcag

SEQ ID NO: 54047 - DNA, 201 bp, Homo sapiens
tgagaggggctggggaggggctcaccctcccttggagcctccaggcttgtgacagggcctggagacaacttccctcctttgcccccaggtagggggagccyagggctcccctcagaggctatggcgggtgggagcacttggctgcagcaggggctgagccctggcttgcatgagtgtgaaggcggggtgctgcttgggcac

SEQ ID NO: 54048 - DNA, 201 bp, Homo sapiens
cgccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccatgcccactcgccacccctcgtctctccgtgcccactcgccacccctcatctctc

SEQ ID NO: 54049 - DNA, 201 bp, Homo sapiens
gccacccctcgtctctgtgcccacccgccacccctcgtctgtgcccactcgccatccctcgtctctccgtgcccactcgccacccctcgtctctgtgcccactcgccacccctcgtctctgtgcccactcgccacccgtctctccatgcccactcgccacccctcgtctctccgtgcccactcgccacccctcatctctcc

SEQ ID NO: 54050 - DNA, 201 bp, Homo sapiens
tgcagacccaacgtgactgggcgccgctgtgatacctgctctccgggcttccatggctacccccgctgccgcccctgtgactgtcacgaggcgggcactgygcctggcgtgtgtgaccccctcacagggcagtgctactgtaaggtgagtgagggctgggcccagatctggcctctccctccggcctcatcagctgaaagt

SEQ ID NO: 54051 - DNA, 201 bp, Homo sapiens
tgagggctgggcagggcagtgaccagcctgtgccacaggagggacattttggtttcgatggctgcgggggctgccgcccgtgtgcttgtggaccggccgcygagggctccgagtgccacccccagagcggacagtgccactgccgaccagggaccatgggaccccagtgccgcgagtgtgcccctggctactgggggctcc

SEQ ID NO: 54052 - DNA, 201 bp, Homo sapiens
agatgggcaggacccctggcttccaggttggtctgggacagtcttgagggctgggcagggcagtgaccagcctgtgccacaggagggacattttggtttcratggctgcgggggctgccgcccgtgtgcttgtggaccggccgccgagggctccgagtgccacccccagagcggacagtgccactgccgaccagggaccat

SEQ ID NO: 54053 - DNA, 201 bp, Homo sapiens
cgttgttaggtcaaataactaactgtctctgggaccctacagcagctccccacgctagcacctgtccagccgaaactccctttgggcaaagaaactaagcrttggcaggtaaaagaaaagactttattaataatcagtgggtgggaggtgagggtgtgcaacgcactgcaagcgcccagttcctcggaggacggcgcgtgg

SEQ ID NO: 54054 - DNA, 201 bp, Homo sapiens
ggggaggtagagactgccacatcttggagcccaccccttgagtcctggtagctccaggcttacccggctcctgcccctgcccaggctgcaactgcgagtcygacttcacggatggcacctgcgaggacctgacgggtcgatgctactgccggcccaacttctctggggagcggtgtgacgtgtgtgccgagggcttcacgg

SEQ ID NO: 54055 - DNA, 201 bp, Homo sapiens
cccaaggtggacgggtcgaccagaaagcagggtcaggagaatgttctagagcctggcagggcagcattgctgccccatctgcgggcctgggcccaggactycagcttgcgggccatgcagaaggtttcagggaccagcaggtggtccacagtctctgacgatgatgttgattctgagcagctgcctccatgtcaggagctg

SEQ ID NO: 54056 - DNA, 201 bp, Homo sapiens
ggcgccacgggccactgacggcccctccccaccctgctcccaggtgtgcgcccggattctttgggaacccactggtgctgggcagctcctgccagccatgygactgcagcggcaacggtgaccccaacttgctcttcagcgactgcgaccccctgacgggcgcctgccgtggctgcctgcgccacaccactgggccccgct

SEQ ID NO: 54057 - DNA, 201 bp, Homo sapiens
cgaggggaggcacacagcaggagcgggcaagggctgggctggcccaggactctgggcatcgagggggctgggtgccccggtgccctgtccgagcagtgcgrtcagggtgctggcccggacgcctggggctaggaggggcttttcctgccccgggaattggcacaacgcccttcttcctgcagggcgggggctgagtcacag

SEQ ID NO: 54058 - DNA, 201 bp, Homo sapiens
cgctgcttctgctttggggccacggagcgctgccggagctcgtcctacacccgccaggaggtgcgcctgcaggactgagggcattgccttctcggggaggkcttaggtgggactggatgcaagatggggccctgtgatgtgtgggcatccacccatgtgcagccacacgtgtgtgcccacagttcgtggatatggagggat

SEQ ID NO: 54059 - DNA, 201 bp, Homo sapiens
caggaggtgcgcctgcaggactgagggcattgccttctcggggagggcttaggtgggactggatgcaagatggggccctgtgatgtgtgggcatccacccrtgtgcagccacacgtgtgtgcccacagttcgtggatatggagggatgggtgctgctgagcactgaccggcaggtggtgccccacgagcggcagccaggga

SEQ ID NO: 54060 - DNA, 201 bp, Homo sapiens
gctgacgggctctgagcctgtggccagagtctggccaggtcacctctgtctgtcctgcctccaggtgtcatcctacggtgggaccctccgttatgaactgyactcagagacccagcggggagatgtctttgtccccatggagagcaggccggatgtggtgctgcaggtgagggagctgagatgatgtggcagggtggttgg

SEQ ID NO: 54061 - DNA, 201 bp, Homo sapiens
gggagatgtctttgtccccatggagagcaggccggatgtggtgctgcaggtgagggagctgagatgatgtggcagggtggttgggtgggcgtggcgcagtrgcaccgtggtccaggcccgtgccaaccctcacctccccatgtgccttcccagggcaaccagatgagcatcacattcctggagccggcataccccacgcct

SEQ ID NO: 54062 - DNA, 201 bp, Homo sapiens
gggccagcctgtagtcaacgcccctctcctctgcctcagctgtgtggcttccctctgtcagcctcaagctgtctttaaaatgggcacagcgtgctggcccscctcacctgagactgtgagcttggcccgaggagcctgggaagtggccacagtttcagtggcagctgtgggctgtggtgctccatgcctcagagccagctt

SEQ ID NO: 54063 - DNA, 201 bp, Homo sapiens
atgggggtccgtgagggtgcccaggccctgtcccggtagggaatgagcgcaagtatccaggcccagcacagggctctgtgctgggggtgcccagaccactrctgacgggctctgagcctgtggccagagtctggccaggtcacctctgtctgtcctgcctccaggtgtcatcctacggtgggaccctccgttatgaactgc

SEQ ID NO: 54064 - DNA, 201 bp, Homo sapiens
gttggggggtctgttctaggctccctgttctgtcccattgagtgtggccccactgaggtgccatcctggacccacaggggaacttccggcatacggagackcgcaacactgtgtcccgcgaggagctcatgatggtgctggccagcctggagcagctgcagatccgtgccctcttctcacagatctcctcggctgtctccc

SEQ ID NO: 54065 - DNA, 201 bp, Homo sapiens
ccaccttagggagagtctaggggccctgagggcctgtgtaacctgagctgtctcctccctggtacctctgccttcccggaaggagaggctggggcaggggygagtagctggagatttgctgggtgggggcagagggccctggagcaagacgttatggggatgaatggaggagcctgggctgggcccgccccctctgcctgc

SEQ ID NO: 54066 - DNA, 201 bp, Homo sapiens
gagaggctaccacacacgatgaggctggaatgccggcgccacagcgtggcctgtgctacctgctatgagcgacaggcaacatgactctgtcctgccatcarttctcaaactagctgcccttgcagcccgcagcccctacccgcccgctcccgttcccagaaaagcctgggtctcgcctctgtctcgtgcgttgggaagccc

SEQ ID NO: 54067 - DNA, 201 bp, Homo sapiens; identical to SEQ ID NO: 11953

SEQ ID NO: 54068 - DNA, 201 bp, Homo sapiens
gccggtggggagggggcgcagctccgccctacccgggacaggctggaacctgttggcctctggatggggtgggaggggccagccacctgaggctcccactrgcccctctcggaggagtctagggactcgaggagacctccaaagtaggggagggccagctgcgaagttttgactggggctgggaacacgtggctcccagga

SEQ ID NO: 54069 - DNA, 201 bp, Homo sapiens
aaggggaagtgtccgctccagggccacacaacccctgaagcctggagccggcctgggccctgggtcctgggccccgtactcctggggctcttgcccacccsctgtgaggcagtggtcaccgggcagaggcctcctctgggaaccgtggccctcccagggcaagctgggtagtggggactggagggtgcagtggctgagagg

SEQ ID NO: 54070 - DNA, 201 bp, Homo sapiens
gacacccgctccgctctgcagtgtgtggctgcagccctgcaggaaccttgcccgagggctgcgatgaggccggccgctgcctatgccagcctgagtttgcyggacctcattgtgaccggtgccgccctggctaccatggtttccccaactgccaaggtgagcagagggtcagggcaggaaggggttctgccacccacatgg

SEQ ID NO: 54071 - DNA, 201 bp, Homo sapiens
cctttgttctgggatctggagcggatgccctgggacgggggtgggggcggctggcactgggcatcgggaaggcttcctgctcctggaaggctgaggagggyggggtgggctgcatcacggttcggatctcatacccctggtgtgcggtggggcaggggctggcgcaggggaggggagactagtccctgtggtgtccaccca

SEQ ID NO: 54072 - DNA, 201 bp, Homo sapiens
gccctgctgcccggcaactgcacccgtaggcgtcgggctgggagggatgcaccctggggagggttgcgcggggaggagggaggcctgctgggcgtaccccrtaagtaggctgtgtgcctgatgctggggcccagccaggacaagtcggagccagccttctgggttcatggtcaaccctttctcccccgctatgatccggtc

SEQ ID NO: 54073 - DNA, 201 bp, Homo sapiens
ctagggcagtggggcagggcctgagtgctgaccccaggatatgcgagggtgggcgccacgggccactgacggcccctccccaccctgctcccaggtgtgcrcccggattctttgggaacccactggtgctgggcagctcctgccagccatgcgactgcagcggcaacggtgaccccaacttgctcttcagcgactgcgacc

SEQ ID NO: 54074 - DNA, 201 bp, Homo sapiens
agcactacccctcccctgccaggatgcaggccaggattctgctgggagcctcctctcttccccactcacccatgcaggacaggcccccagcagatggcagkcccgggacagaagcggctgccaggctgtgtgtgtgagccattactcctcacggtggccccaggcaggtgcagccttatccccactctttggatggggaca

SEQ ID NO: 54075 - DNA, 201 bp, Homo sapiens
gccagcagcctttgttctgggatctggagcggatgccctgggacgggggtgggggcggctggcactgggcatcgggaaggcttcctgctcctggaaggctraggagggcggggtgggctgcatcacggttcggatctcatacccctggtgtgcggtggggcaggggctggcgcaggggaggggagactagtccctgtggtg

SEQ ID NO: 54076 - DNA, 201 bp, Homo sapiens
gaggtggggcctccaggaaggagagggaagaggaaggcgtggccagcagacagagatgtgggagacaccaggaggtctcatgaatgctgctgcctcctcaygcccccgaaagctgctgtttggcttggagtggcctcccctgagcagccagggcccagggctgggctgggctgggctgctgctgccaggactctgagctgc

SEQ ID NO: 54077 - DNA, 201 bp, Homo sapiens
ggccactgacggcccctccccaccctgctcccaggtgtgcgcccggattctttgggaacccactggtgctgggcagctcctgccagccatgcgactgcagyggcaacggtgaccccaacttgctcttcagcgactgcgaccccctgacgggcgcctgccgtggctgcctgcgccacaccactgggccccgctgcgagatct

SEQ ID NO: 54078 - DNA, 201 bp, Homo sapiens
gcaggaatgcagaggaggctggcgcaagtggacattcctgggatacctgtgccgaggtggcggccactgagggttaggtggggtcgggtgcctgctctccrgtccccagctctgggctctccttggccttggaggcccctgcacaagcaggaggctgcagctgggtgcctccaagcgaagagtgaaacccccaaggtgggc

SEQ ID NO: 54079 - DNA, 201 bp, Homo sapiens
ggacttgtctcggggcagcagggtgactgtggaggaggaagggggccccggcccttctcggctatctgaccctcccgttccctctgcagggccagtactgygacatctgcacggctgccaacagcaacaaggcacaccccgcgagcaatgccatcgatggcacggagcgctggtggcagagtccaccgctgtcccgcggcc

SEQ ID NO: 54080 - DNA, 201 bp, Homo sapiens
ctgagctggcccacgcgaacagttcagaaccagccttgctgcccgctcccagcttctctatttcatggacagggatggaggttcttaccagccggctccayggaagggcatcccagcagccctgagaaagggactgtggcctccgatatcccaaaccacagcgctggcgttcctccagacctcatcccgctgagacaacat

SEQ ID NO: 54081 - DNA, 201 bp, Homo sapiens
ccccactctttggatggggacattgaggctcagcagttactgtgacttggcctcttcccaggactcggaagcagcagccaggaggcccaggcccacctgcygctgtccacacgtccactctggggccggtccccacaggcctccggaacagcttaattctgtctctctggagaccctaatccagaaggctgtgggcaagat

SEQ ID NO: 54082 - DNA, 201 bp, Homo sapiens
cctccttcatctgagagccgcgggtctgctgaccgccctggccgcggattgggcgtgtgagaagtccttgccggccggtctggagtggagctgcggttggrgcaaggcaggcaggcacaggaggtgcccaggcgatgaagccgcagctccatctgagggggctcactaaggctatggggcctggggctgggcagtgtgttc

SEQ ID NO: 54083 - DNA, 201 bp, Homo sapiens
cccaccccaccttccccgtggaagtcctcatcaacgccggccgcgtgtggcagggtgagtgtctggtgtggggggtggagaggctaccacacacgatgagrctggaatgccggcgccacagcgtggcctgtgctacctgctatgagcgacaggcaacatgactctgtcctgccatcagttctcaaactagctgcccttgca

SEQ ID NO: 54084 - DNA, 201 bp, Homo sapiens
gtggcttccctctgtcagcctcaagctgtctttaaaatgggcacagcgtgctggcccgcctcacctgagactgtgagcttggcccgaggagcctgggaagyggccacagtttcagtggcagctgtgggctgtggtgctccatgcctcagagccagcttggatgagaaaccagccggcctcgcccagctcatgtctagcaat

SEQ ID NO: 54085 - DNA, 201 bp, Homo sapiens
tggagccccccagccagaacagggtccagcgggggttagctgtgggaacctgggtgcctcctggctgcccccttatctggtcaactcagaggggccgggtytcaggacggagggcctgtgactgtctccttacctgctgccacacctcaccacagagggcctggctgagtgtccccagctgagattttgccgttctggcag

SEQ ID NO: 54086 - DNA, 201 bp, Homo sapiens
tgaggcgttggtttaaggtacgctctttcaagaggctatggctggagtttcctcttggtcacgctgacgtcttcggtttttatctcatgaaggagacagcscagccccacgatcgtccttgcctctgtcagttctggctggctcctgcccttgtatcatttctccttttctgctgaaacatttcctttcctgactttcaca

SEQ ID NO: 54087 - DNA, 201 bp, Homo sapiens
aaaagtgtaagaaaatgagtttgtggagagggaaggtttgccaggaggggcgtactggggtctgcagggcatctgagactcccctgcctgtccccaccctscagattgtgactgcagcgcggcagggacccagggcaacgcctgccggaaggacccaagggtgggacgctgtctgtgcaaacccaacttccaaggcaccca

SEQ ID NO: 54088 - DNA, 201 bp, Homo sapiens
ggagcgcctcgccgccagcctggacggggctcggaccccactgctgcagaggatgcagaccttctccccggcgggcagcaagctgcgtctagtggaggccrccgaggcccacgcacagcagctgggccagctggcactcaatctgtccaggtgggtggccaggagaggaggggccctgggcccaccctggggatgcagaca

SEQ ID NO: 54089 - DNA, 201 bp, Homo sapiens
ggcctccgatatcccaaaccacagcgctggcgttcctccagacctcatcccgctgagacaacattcccagttctggagtgggagccacaaggcctcacccrcaggcccggccctagcaggagcccagcctccagccctccttcttgctcagcccccgcttcctcttgggggcttctcccgagggtacagcacccacttgga

SEQ ID NO: 54090 - DNA, 201 bp, Homo sapiens
tagactctggcctcccaggaaaccctgagctcacgtgacacatgtgacagttaccgcctagcgcagagagttcgtggccgctgcttccgctggcccccagygccccaggcatcggggggttgttcagatactcgttgactttccggcaatgctcctcatcctggtctgtcttgggttcctgcaagaggaagggcatgtaag

SEQ ID NO: 54091 - DNA, 201 bp, Homo sapiens
tgtgcagccacacgtgtgtgcccacagttcgtggatatggagggatgggtgctgctgagcactgaccggcaggtggtgccccacgagcggcagccagggayggagatgctccgtgcagacctgcggcacgtgcctgaggctgtgcccgaggctttccccgagctgtactggcaggccccaccctcctacctgggggaccgg

SEQ ID NO: 54092 - DNA, 201 bp, Homo sapiens
tgccgtggctgcctgcgccacaccactgggccccgctgcgagatctgtgcccccggcttctacggcaacgccctgctgcccggcaactgcacccgtaggcrtcgggctgggagggatgcaccctggggagggttgcgcggggaggagggaggcctgctgggcgtaccccgtaagtaggctgtgtgcctgatgctggggccc

SEQ ID NO: 54093 - DNA, 201 bp, Homo sapiens
actgccaacagtgccaacgagtgccagtgtgagtgcctcctcccacacacgtgtgtcctgcccacaccctggcccatgagagggccccggtgcccgggccygtggagggcgtgccaacagctgcgctcccctctctctagcctgtaactgctacggccatgccaccgactgttactacgaccctgaggtggaccggcgccg

SEQ ID NO: 54094 - DNA, 201 bp, Homo sapiens
aggtgtgaacccagtggcagcctttgggtcgggcctcggggagtgggcaggcgtgaggcatgtcacctgcacgggtgacttgtctcctggagccctaaggyggtggccatgctcctggcatggtgcctggcctggaaggctttgaagagccccaagtctgtggagggcctgccccgtgagtggtgcctggggctgcgtggc

SEQ ID NO: 54095 - DNA, 201 bp, Homo sapiens
tgacggcccctccccaccctgctcccaggtgtgcgcccggattctttgggaacccactggtgctgggcagctcctgccagccatgcgactgcagcggcaayggtgaccccaacttgctcttcagcgactgcgaccccctgacgggcgcctgccgtggctgcctgcgccacaccactgggccccgctgcgagatctgtgccc

SEQ ID NO: 54096 - DNA, 201 bp, Homo sapiens
atgcaagatggggccctgtgatgtgtgggcatccacccatgtgcagccacacgtgtgtgcccacagttcgtggatatggagggatgggtgctgctgagcaytgaccggcaggtggtgccccacgagcggcagccagggacggagatgctccgtgcagacctgcggcacgtgcctgaggctgtgcccgaggctttccccgag

SEQ ID NO: 54097 - DNA, 201 bp, Homo sapiens
aatagataaggggcccctcttccctgggaccctcggcgctcccccagaccccaggccctcccttgccaccccgaccctcgcctaccagcagcgtgggctartgggctcttcctccacaggccgtggggacccgagaccaggcgagccaattgctggccggcaccgaggccacactgggccatgcgaagacgctgttggcgg

SEQ ID NO: 54098 - DNA, 201 bp, Homo sapiens
ccctcttccctgggaccctcggcgctcccccagaccccaggccctcccttgccaccccgaccctcgcctaccagcagcgtgggctagtgggctcttcctcyacaggccgtggggacccgagaccaggcgagccaattgctggccggcaccgaggccacactgggccatgcgaagacgctgttggcggccatccgggctgtg

SEQ ID NO: 54099 - DNA, 201 bp, Homo sapiens
ccctgggaccctcggcgctcccccagaccccaggccctcccttgccaccccgaccctcgcctaccagcagcgtgggctagtgggctcttcctccacaggcygtggggacccgagaccaggcgagccaattgctggccggcaccgaggccacactgggccatgcgaagacgctgttggcggccatccgggctgtggaccgca

SEQ ID NO: 54100 - DNA, 201 bp, Homo sapiens
ggctggggtcttgggcttggaagccagcaggcagaggtgcactagtacgggcggccccaggctctgacgaacccctgccccacagagctcatgtcccagaygggccacctggggctggccaatgcctcggctccatcaggtgagcagctgctccggacactggccgaggtggagcggctgctctgggagatgcgggcccgg

SEQ ID NO: 54101 - DNA, 201 bp, Homo sapiens
cgtcagacccctcgacagcctccccaggaaatgtgccggttagatgttcgcgctcacagatatcccgtagtgcacactgagacatgggactcaggagagayttggctccctgagcctgcctaacaggacctgccagcccagcctgggggtcggcagggggtgccatgtcagagagagctggccagggagcagggtgggcca

SEQ ID NO: 54102 - DNA, 201 bp, Homo sapiens
gagagctcattgcccaggcccggggggctgccagtaaggtgggtgagagtcccaggggaaggtggacatcagggagggtggtggtggacgctgatggaccrtgccccgcaggtcaaggtgcccatgaagttcaacgggcgctcaggggtgcagctgcgcaccccacgggatcttgccgaccttgctgcctacactgccctc

SEQ ID NO: 54103 - DNA, 201 bp, Homo sapiens
gtcagatcagcaccaccaagcgcttcgagcaggagctgcggctcgtgtcctacagcggggtgctcttcttcctgaagcagcaggtgcgccaggcacacccrtcctgccatccccacttgcactgaccctgccccacactaaccctgccctgtttctgcagagccagttcctgtgcttggccgtgcaagaaggcagcctcgt

SEQ ID NO: 54104 - DNA, 201 bp, Homo sapiens
tcgagcaggagctgcggctcgtgtcctacagcggggtgctcttcttcctgaagcagcaggtgcgccaggcacacccgtcctgccatccccacttgcactgrccctgccccacactaaccctgccctgtttctgcagagccagttcctgtgcttggccgtgcaagaaggcagcctcgtgctgttgtatgactttggggctgg

SEQ ID NO: 54105 - DNA, 201 bp, Homo sapiens
aagcagcaggtgcgccaggcacacccgtcctgccatccccacttgcactgaccctgccccacactaaccctgccctgtttctgcagagccagttcctgtgyttggccgtgcaagaaggcagcctcgtgctgttgtatgactttggggctggcctgaaaaaggccgtcccactgcagcccccaccgcccctgacctcggcca

SEQ ID NO: 54106 - DNA, 201 bp, Homo sapiens
tgagggggcccagctgccccgaggccaaggctgcgctgaacatgcccagggcctgcaagaagagccaggcgagggctgagctccaacccgggctgcacccyagagccacactgctcagctgccagctctgcgggtcaggcacatgaagcactggccatggtgaaggtggggcagggcctcctcctcccccctgcccactcc

SEQ ID NO: 54107 - DNA, 201 bp, Homo sapiens
tccctgggcaggccctccgtgaccaggcttctgaaggtctccgaatacccagccctgccctcacacccggctgctgcggtcatgactgtcagacgaggacycgaaggctcatggggatttattggctcctgtccctggcgtcgggcacagccaagtccaggggctgtggcgccaggaatctctggtgccatctcttggctg

SEQ ID NO: 54108 - DNA, 201 bp, Homo sapiens
cccgtgccaccctgaccagtcatgctggtgggagtgggtgctcctccccaatagggcaggcctggtcacgtgtcccccaaaattccctggcctgagaatgkgggaggggcgggtcagtgatgggcagtaggcgtctgtccccaaggaagggggtgaggatggtcgtcgaggggggtcactcgcactcaaagcgtgcaaggg

SEQ ID NO: 54109 - DNA, 201 bp, Homo sapiens
caggccccttcagccagtgagctgtggtctctgtcacgcggcctcttggcctgtgggagcctcagtggcaaggcccggagacgtcaaggggcccgggcacygcggggacccaggcttttctggtgatccagcgccctcccctcctgccattccccgcagcctccaagagggactgtctggagcggttcgggccacagacgc

SEQ ID NO: 54110 - DNA, 201 bp, Homo sapiens
gcctgccactgctctgctgaaggctccctgcacgcagcctgtgacccccggagtgggcagtgcagctgccggccccgtgtgacggggctgcggtgtgacaygtgtgtgcccggtgcctacaacttcccctactgcgaaggtgagcaggcaggtggctgtgtgcaccaggtgccgggcctgtgtgtgggtctgtgctgttca

SEQ ID NO: 54111 - DNA, 201 bp, Homo sapiens
tgggcgcggggctcgggctagttgctgaggcagctgctggagcagaaggggctggggtggcacgggtggaagaggtggtggatgacggggtgaccgctgcmgactggctccgggagctgcgaagagagagggcaccgctggagcggacacgccccacacggcagggcctactcgcagggtccagggtgctgggccaggatt

SEQ ID NO: 54112 - DNA, 201 bp, Homo sapiens
tggcctccccgcaggtggggcgcgccatgactttccatggccacggcttccttcgcctggcgctctcgaacgtggcaccgctcactggcaacgtctactcyggcttcggcttccacagcgcccaggacagtgccctgctctactaccgggcgtccccggtgagacctcacacccgtgcccattccccaccccgcggtggcc

SEQ ID NO: 54113 - DNA, 201 bp, Homo sapiens
gtgggtgggaggtgagggtgtgcaacgcactgcaagcgcccagttcctcggaggacggcgcgtggctcagtccaggctcatgtcctcctcttcgtccttcktgtccttcgtgtcgccctctttctgctcgggcttggcgttgttctgcatggctttggcaaacgcttccacatctagaacacgttaaagacacaaggtggt

SEQ ID NO: 54114 - DNA, 201 bp, Homo sapiens
cagagccagcagaagtttaaaggaaacagagaccgggcctcaaagcattcccagcagaagctgcccgagagcccgggtggcgcacgttacccagtcctccraggccggctggtccgatgagctgcatgagctggctgtggctcatgtttcccagcaggctctgcaggccaccctcacctggaaaacactgcagctcaggcg

SEQ ID NO: 54115 - DNA, 201 bp, Homo sapiens
tggctcatgtttcccagcaggctctgcaggccaccctcacctggaaaacactgcagctcaggcgggcctgccccagccagatccacgcgggccccaccgcrctgcctgcgcctctgctgagcaccgcactcggctgcccctgaaccctacagggggcaccacttgaagtgaggcgacggtgggatgcagacccgtcctacc

SEQ ID NO: 54116 - DNA, 201 bp, Homo sapiens
gcagttctttgcctgtgagtctctgccgccgtggggcctggggggagaggcaggggggtccctgggcaggccctccgtgaccaggcttctgaaggtctccraatacccagccctgccctcacacccggctgctgcggtcatgactgtcagacgaggacccgaaggctcatggggatttattggctcctgtccctggcgtcg

SEQ ID NO: 54117 - DNA, 201 bp, Homo sapiens
ttgggcaaagaaactaagcgttggcaggtaaaagaaaagactttattaataatcagtgggtgggaggtgagggtgtgcaacgcactgcaagcgcccagttsctcggaggacggcgcgtggctcagtccaggctcatgtcctcctcttcgtccttcttgtccttcgtgtcgccctctttctgctcgggcttggcgttgttct

SEQ ID NO: 54118 - DNA, 201 bp, Homo sapiens; identical to SEQ ID NO: 11912

SEQ ID NO: 54119 - DNA, 201 bp, Homo sapiens
tctgcagggtgcgactgtaccccatgtgggacagaggcctgcgacccccacagcgggcactgcctgtgcaaggcgggcgtgactgggcggcgctgtgaccrctgccaggtagggctgtggggtaagcagggctgggtgggtggggcctagggactagagttggggcctggggagaatctgataggtggggctgaggggcag

SEQ ID NO: 54120 - DNA, 201 bp, Homo sapiens
ggtatcgccagcccggcaccacttttcctatcaatttcttgaccatgtggatttttgaaaaatggaacaccagttcaggcccttgcttataggtacttggrgctggtgtgacgacagagcagcttctttgttgatcacctgtgctgacgggcagtttatttcccaattcctctcattgagggtatggccctcccagatgtt

SEQ ID NO: 54121 - DNA, 201 bp, Homo sapiens
cggtgtacagcgtggagcaggacaatgatctggagctggccgacgcctactacctggggggcgtgccgcccgaccagctgcccccgaggtaagcactgtgygcagctggggctccgaggccaggctgttggggcggtaggctgggcttggaggtggcgccctgacccgcatccccgcttccccacagcctgcgacggctct

SEQ ID NO: 54122 - DNA, 201 bp, Homo sapiens
ttctggcgtgccctgggattgggatggttttgggagagcttttgctatacaccccagggtatcgccagcccggcaccacttttcctatcaatttcttgacyatgtggatttttgaaaaatggaacaccagttcaggcccttgcttataggtacttggggctggtgtgacgacagagcagcttctttgttgatcacctgtgc

SEQ ID NO: 54123 - DNA, 201 bp, Homo sapiens
actgtgcgcagctggggctccgaggccaggctgttggggcggtaggctgggcttggaggtggcgccctgacccgcatccccgcttccccacagcctgcgayggctcttccccaccggaggctcagtccgtggctgcgtcaaaggcatcaaggccctgggcaagtatgtggacctcaagcggctgaacacgacaggcgtgag

SEQ ID NO: 54124 - DNA, 201 bp, Homo sapiens
ccggaggctcagtccgtggctgcgtcaaaggcatcaaggccctgggcaagtatgtggacctcaagcggctgaacacgacaggcgtgagcgccggctgcacygccgacctgctggtgagcagccctccccgggctgggggtggcatctgtggacatgcaggggcacccgcgggcactcagggatggcctccccgcaggtggg

SEQ ID NO: 54125 - DNA, 201 bp, Homo sapiens
ggctgaacacgacaggcgtgagcgccggctgcaccgccgacctgctggtgagcagccctccccgggctgggggtggcatctgtggacatgcaggggcaccmgcgggcactcagggatggcctccccgcaggtggggcgcgccatgactttccatggccacggcttccttcgcctggcgctctcgaacgtggcaccgctcac

SEQ ID NO: 54126 - DNA, 201 bp, Homo sapiens
ccgggcctggggcctagaggactgcaggccaccgcccggaaggtgggcaccccaggggtgagcaggcagagctggggtggctggaagggtggcccctgtgygggcggcccctgcattcaccatccacgcccccaggcctcccgccgcagccgtcagcccgcccggcatcctgcctgcatgctgcccccacacctcaggacc

SEQ ID NO: 54127 - DNA, 201 bp, Homo sapiens
cctgtgtgggcggcccctgcattcaccatccacgcccccaggcctcccgccgcagccgtcagcccgcccggcatcctgcctgcatgctgcccccacacctsaggaccacccgagactcctaccagtttgggggttccctgtccagtcacctggagtttgtgggcatcctggcccgacataggaactggtaaggccaggccc

SEQ ID NO: 54128 - DNA, 201 bp, Homo sapiens
cagcagaacctgggcagcgtcaatgtgagcacgggctgtgcacccgccctgcaagcccagaccccgggcctggggcctagaggactgcaggccaccgcccrgaaggtgggcaccccaggggtgagcaggcagagctggggtggctggaagggtggcccctgtgtgggcggcccctgcattcaccatccacgcccccaggcc

SEQ ID NO: 54129 - DNA, 201 bp, Homo sapiens
gagaagcaagtaagcctggcagaggtggcgtgccagggcagggtttgcctccccattctggtgacctcgggggcatagcctgaccctcccttcctacccckccaggtcctgctgcgggcggatgacggagcaggggagttctccacgtcagtgacccgcccctcagtgctgtgtgatggccagtggcaccggctagcgggt

SEQ ID NO: 54130 - DNA, 201 bp, Homo sapiens
gcacattcctgggcctcacccagagtcctcagtaaggtagggccgggctcattctgcggagaagcaaccccagggcacgtccgtcctttcctccctccctkcgttggttctttcagccagcagctgtatgttgagcgcctaacacacgctgggccgttttcctgggaatgggaacacagggtgggaccccagcccggcctc

SEQ ID NO: 54131 - DNA, 201 bp, Homo sapiens
gggcccgtctgcacaggctgaacgcctccatcgctgacctgcaggtactgagcgtcctggccttccctccccaacccgggccagtgcaggccttcaccttycgcctcccacagagccagctccggagccccctgggcccccaccatgagacggcacagcagctggaggtgctggagcagcagagcacaagcctcgggcagg

SEQ ID NO: 54132 - DNA, 201 bp, Homo sapiens
acccccacccttctgcagagcgggagccaggcgggactctgggtggggtggcttcttttggggctggagagaggctgggctgaggaccacctggcctcagragtccccctttctcccagtgatgaaaagcgggaatgtgctccggctggaggtggacgcgcagagcaaccacaccgtgggccccttgctggcggctgcagc

SEQ ID NO: 54133 - DNA, 201 bp, Homo sapiens
tccagcgccctcccctcctgccattccccgcagcctccaagagggactgtctggagcggttcgggccacagacgctggagcgcatcacacgggacgacgcrgccatctgcaccaccgagtactcacgcatcgtgcccctggagaacggagaggtgggccggggaggggcagggcggtacgggggctggagaacggagaggt

SEQ ID NO: 54134 - DNA, 201 bp, Homo sapiens
aggatgtgggtgtccaccatagctctgactgtccactctgccccaggactgccagcacaacaccgaaggggcccactgtgagcgctgccaggctggcttcrtgagcagcagggacgaccccagcaccccctgtgtcagctgcccctgccccctctcagtgccttccaacaagtaagccagcctcctcccgggacgaggccc

SEQ ID NO: 54135 - DNA, 201 bp, Homo sapiens
ccccaccctcctacctgggggaccgggtaagcagggcatcaggtctgggggaggcactttgaggatggccaggacgcctgagagggttgggagccaggagyggggtctgtccagggagggggagctccatgggggtccgtgagggtgcccaggccctgtcccggtagggaatgagcgcaagtatccaggcccagcacaggg

SEQ ID NO: 54136 - DNA, 201 bp, Homo sapiens
cactcgccatccctcgtctctccgtgcccactcgccacccctcgtctctgtgcccactcgccacccctcgtctctgtgcccactcgccacccgtctctccrtgcccactcgccacccctcgtctctccgtgcccactcgccacccctcatctctccgtgcccactcgccacccctcatctctctgtgcccactcgccaccc

SEQ ID NO: 54137 - DNA, 201 bp, Homo sapiens
gggctggggtggcacgggtggaagaggtggtggatgacggggtgaccgctgccgactggctccgggagctgcgaagagagagggcaccgctggagcggacrcgccccacacggcagggcctactcgcagggtccagggtgctgggccaggattccccactgcccctcccttaacaccgtggcacctgcgtggcaggagcga

SEQ ID NO: 54138 - DNA, 201 bp, Homo sapiens; identical to SEQ ID NO: 11926

SEQ ID NO: 54139 - DNA, 201 bp, Homo sapiens
cttggcctgtgggagcctcagtggcaaggcccggagacgtcaaggggcccgggcaccgcggggacccaggcttttctggtgatccagcgccctcccctccygccattccccgcagcctccaagagggactgtctggagcggttcgggccacagacgctggagcgcatcacacgggacgacgcggccatctgcaccaccgag

SEQ ID NO: 54140 - DNA, 201 bp, Homo sapiens
gacgacgcggccatctgcaccaccgagtactcacgcatcgtgcccctggagaacggagaggtgggccggggaggggcagggcggtacgggggctggagaayggagaggtgggtaggggaggggcagtgccgagcggggctggagaagggaaaggtgggcccgggaggggcagtgctgagcaggggctagggccacactggc

SEQ ID NO: 54141 - DNA, 201 bp, Homo sapiens
agcaccccaggcgcgcacactaggcagatgccttggaaggtgagcgtgcgagggtcagcaggccccatgccccccacccagctccaggcgacagcacacgytaccttgctggccgcctgctggcccggctggtacgttcatcgtggccaggatgctctggaggtcgctcagctggatgggctgggtcgggctggctgctgt

SEQ ID NO: 54142 - DNA, 201 bp, Homo sapiens
gagaggctgggtgcctgtcctggcatggagggggcgtctggtggaggcatttaggatgggtttggattgcactgagcagcggggtgtgagggtctcacacratccatagggggttggatgtccctgttgctggcccaacagaaagacttggggacatgaagccaggatggtccccgctggcccctgctgagcctgccctct

SEQ ID NO: 54143 - DNA, 201 bp, Homo sapiens
ggtgccatgtcagagagagctggccagggagcagggtgggccaggcggagaggggcaggacgagaaggctcagaagctggctgagcagactggtgtcaggrtgttggaggcactgcaggaggtgagggccgggcaggtgaggcagctgtggcctttcgccaggtgctctaggggccacccaggtgcgctcaggttccgggc

SEQ ID NO: 54144 - DNA, 201 bp, Homo sapiens
gacagcacacgctaccttgctggccgcctgctggcccggctggtacgttcatcgtggccaggatgctctggaggtcgctcagctggatgggctgggtcggkctggctgctgtgctggctccattcccggaactgggcgcggggctcgggctagttgctgaggcagctgctggagcagaaggggctggggtggcacgggtgg

SEQ ID NO: 54145 - DNA, 201 bp, Homo sapiens
acagccgtgtggccagacaggtggccccgggagacgtcagacccctcgacagcctccccaggaaatgtgccggttagatgttcgcgctcacagatatcccrtagtgcacactgagacatgggactcaggagagacttggctccctgagcctgcctaacaggacctgccagcccagcctgggggtcggcagggggtgccatg

SEQ ID NO: 54146 - DNA, 201 bp, Homo sapiens
tggctcgatctcggcttaccataacctctgcctcccgggttcaagcgattctcctgcctcagcctcctgagtagctgggattacaggcacacgccaccacrcccagctaattttgtatttttagtacagatggggtttctccatgttggtcaggctggtcttgaactcctgacctcaggtgatctgcccatctcagcctcc

SEQ ID NO: 54147 - DNA, 201 bp, Homo sapiens
aggaccagagggctgtctcttctgagcctctattgtttcatctgtacaatggggacagctatgcctgcagtgggaccagaggccttcagggaacagaggcyacgctgagactcaacacctccccacaggctaagggactccatgtctgagtgtccctgtccatctgtctgctgtgtgtcagccttggtcctcctggggtca

SEQ ID NO: 54148 - DNA, 201 bp, Homo sapiens
cagatgggcaggacccctggcttccaggttggtctgggacagtcttgagggctgggcagggcagtgaccagcctgtgccacaggagggacattttggtttygatggctgcgggggctgccgcccgtgtgcttgtggaccggccgccgagggctccgagtgccacccccagagcggacagtgccactgccgaccagggacca

SEQ ID NO: 54149 - DNA, 201 bp, Homo sapiens
ttccccactgggtggtggggagcggggcaggcagcttgtcctccgggcatctccgtgtccctcaccatgggcccacgtgaggcctcaccctccctggagayccggggccgctgtgcagggctaggtaggatggccaagctgcacctgaccagcccctgctgtggccaggcctgcgagggaccactacctcccggacctgca

SEQ ID NO: 54150 - DNA, 201 bp, Homo sapiens
gcctccctggctctggcgtctgtgtggtgagtaggggctggtggggccaggggggcagcattcactgaaggcacagtcaagtgtgccagggaagaccaggrgctgcacttccaggtcaactgaggtctggggaagggtgttgcccagtgggggaccatctggccttgggcacagagtctgaggcaggggtggtgggagctg

SEQ ID NO: 54151 - DNA, 201 bp, Homo sapiens
ctcggggagggcttaggtgggactggatgcaagatggggccctgtgatgtgtgggcatccacccatgtgcagccacacgtgtgtgcccacagttcgtggayatggagggatgggtgctgctgagcactgaccggcaggtggtgccccacgagcggcagccagggacggagatgctccgtgcagacctgcggcacgtgcctg

SEQ ID NO: 54152 - DNA, 201 bp, Homo sapiens
agggaggcctgctgggcgtaccccgtaagtaggctgtgtgcctgatgctggggcccagccaggacaagtcggagccagccttctgggttcatggtcaaccytttctcccccgctatgatccggtcctcccgccccagcgatcaggccctcccgccccagcgatcaggccccttcaccatcaggcctcccccggaccatcac

SEQ ID NO: 54153 - DNA, 201 bp, Homo sapiens
agtggcaaggcccggagacgtcaaggggcccgggcaccgcggggacccaggcttttctggtgatccagcgccctcccctcctgccattccccgcagcctcyaagagggactgtctggagcggttcgggccacagacgctggagcgcatcacacgggacgacgcggccatctgcaccaccgagtactcacgcatcgtgcccc

SEQ ID NO: 54154 - DNA, 201 bp, Homo sapiens
aacgggccaggccccttcagccagtgagctgtggtctctgtcacgcggcctcttggcctgtgggagcctcagtggcaaggcccggagacgtcaaggggccygggcaccgcggggacccaggcttttctggtgatccagcgccctcccctcctgccattccccgcagcctccaagagggactgtctggagcggttcgggcca

SEQ ID NO: 54155 - DNA, 201 bp, Homo sapiens
gggggtcactcgcactcaaagcgtgcaagggagagcggtggggggcagtgcagtccaacgggccaggccccttcagccagtgagctgtggtctctgtcacrcggcctcttggcctgtgggagcctcagtggcaaggcccggagacgtcaaggggcccgggcaccgcggggacccaggcttttctggtgatccagcgccctc

SEQ ID NO: 54156 - DNA, 201 bp, Homo sapiens
tgccaggtgggctgggctagagggctgggaatgggctggccccgaggtggggcagggacctccccagactcaacggccattgcactcccagcaccacaccrccggcgtcaactgtgagcgctgcctgcccggcttctaccgctctcccaaccaccctctcgactcgccccacgtctgccgccgtgagtgggctcagctggg

SEQ ID NO: 54157 - DNA, 201 bp, Homo sapiens
agccacaggctcggggacgctgagtctgggcgagcgcttgctgccggacagctggagaaacagcagcggggggccgtgtccatgtggcaagccaagccatsgaggggatcacaggccccttcagggaagggactgagcacctgccacctgcctccaggatgggcctgatcccccctcctgtgtaccccacaggctgcagtg

SEQ ID NO: 54158 - DNA, 201 bp, Homo sapiens
ccctgcagcagggccgtgtgagcctacagctcctgaggactgaagtgaaaactcaagcgggcttcgccgatggtgccccccattacgtcgccttctacagyaatgccacggggtgagcctggccgctgggccctcatcgtgaaggtctggagggacgcccgcctgcacttgcctggacctctgtctcctctgaggtggggg

SEQ ID NO: 54159 - DNA, 201 bp, Homo sapiens
cctgcgcctggagctggaggaggctgccacacctgagggtcacgccgtgcgctttggcttcaaccccctcgagttcgagaacttcagctggaggggctacrcgcagatggcacctgtccaggtgggcgctgtgctccccctcccaggctcagcctagaagtggagccaggcgtggctggcagggaggggtgggcaggcccc

SEQ ID NO: 54160 - DNA, 201 bp, Homo sapiens
gcatgtccatgagcaggtgctgtgtggtgggatggcacgtccgttgctgcggagggagcagggaggtgcgtgttttcaggccgtccatgtggatgagaggyacctgtgctggtcctcagctcctgtgggaccgtgggttctggctgggcctgggacacccttggccttccgggttggtcactgggaaatgaccgaggcatg

SEQ ID NO: 54161 - DNA, 201 bp, Homo sapiens
ggtcacaccctgcatcttgggccccctggaggcgggcctgttcttcccaggcagcgggggagttatcactttaggtctgtgggtgctggcatcccaggccycagcagggcagggcagggggctccaggaggttctggggaggggccccccctttcttctccatcacaacccctccccgcagacctcccaggagctacactg

SEQ ID NO: 54162 - DNA, 201 bp, Homo sapiens
gtggagggcgtgccaacagctgcgctcccctctctctagcctgtaactgctacggccatgccaccgactgttactacgaccctgaggtggaccggcgccgygccagccagagcctggatggcacctatcagggtgggggtgtctgtatcgactgccaggtgggctgggctagagggctgggaatgggctggccccgaggtg

SEQ ID NO: 54163 - DNA, 201 bp, Homo sapiens
gcgccgcgccagccagagcctggatggcacctatcagggtgggggtgtctgtatcgactgccaggtgggctgggctagagggctgggaatgggctggcccygaggtggggcagggacctccccagactcaacggccattgcactcccagcaccacaccgccggcgtcaactgtgagcgctgcctgcccggcttctaccgct

SEQ ID NO: 54164 - DNA, 201 bp, Homo sapiens
tattgtattcaattttctacctcatcttttttttttgagatggagtttcactctgtcgtccaggctggagtgcagttgcacgatctcggctcacttcaacytctgcctcctgggttcaagcgattctcctgcctcagtctcccgagtagctgggattacaggcacctgccaccacgcctggccaattttttgtatttttag

SEQ ID NO: 54165 - DNA, 201 bp, Homo sapiens
ttacaacttcagtggctgcatcagcaacgtcttcgtgcagcggtgagcctggtgggcgctgggggacaaggtcccagctggccttccgcagctgctgaccrcctgcccgccctgcacaggctcctgggcccacagcgcgtatttgatctgcagcagaacctgggcagcgtcaatgtgagcacgggctgtgcacccgccctg

SEQ ID NO: 54166 - DNA, 201 bp, Homo sapiens
tttttgtttttgtttgagacggagtctcgctctgtcgcccagactggagtgcagtggcacgatctcggctcactgcaagctctgccttccaggttcacgcyattctcctgcctcagcctcctgagtagctgggactacaggtgcccgccaccacgcccggctaatttttttgtacttttagtagagatggggtttcaccgt

SEQ ID NO: 54167 - DNA, 201 bp, Homo sapiens
ggagctggcttgggcacccaggtccctcatggacctcagctcatctgggaaggccggaaggggtcccagtgctgctgtgcccattctccgtggtggaaaasagcccaggagcagaagcggggtgggggctggggaggtccccacacccattgtcagatatcttctgcgctggtcaccctggggggtgtcatgctgtcttcc

SEQ ID NO: 54168 - DNA, 201 bp, Homo sapiens
tggtccaggcccgtgccaaccctcacctccccatgtgccttcccagggcaaccagatgagcatcacattcctggagccggcataccccacgcctggccacrttcaccgtgggcagctgcagctggtggaggtgaggggagctggcttgggcacccaggtccctcatggacctcagctcatctgggaaggccggaaggggtc

SEQ ID NO: 54169 - DNA, 201 bp, Homo sapiens
acagacagagaaagagatacagagatagagacagaaacagagacagacagatggagacagagaggcagagagtcagagggagagagtcaggagagggaggrgtgggagggggacgcttccctctgccccagggaccctggctagccaaggcacacaccagggcgcaggcagaggggatgaagccccgtgggcgtccatgag

SEQ ID NO: 54170 - DNA, 201 bp, Homo sapiens
acagttcgtggatatggagggatgggtgctgctgagcactgaccggcaggtggtgccccacgagcggcagccagggacggagatgctccgtgcagacctgyggcacgtgcctgaggctgtgcccgaggctttccccgagctgtactggcaggccccaccctcctacctgggggaccgggtaagcagggcatcaggtctggg

SEQ ID NO: 54171 - DNA, 201 bp, Homo sapiens
cctgtacccgccccacagcctgtgactgcggtgcccgcctctgtgacgagctcacgggccagtgcatctgcccgccacgcaccatcccgcccgactgcctrctgtgccagccccagacctttggctgccaccccctggtcggctgtgaggagtgtaactgctcagggcccggcatccaggagctcacagaccctacctgtg

SEQ ID NO: 54172 - DNA, 201 bp, Homo sapiens
gggcgggtccccagccctcatgtccccccagggggcctggctgtagccctcatccccatggccctggctggggaggtagagactgccacatcttggagccyaccccttgagtcctggtagctccaggcttacccggctcctgcccctgcccaggctgcaactgcgagtccgacttcacggatggcacctgcgaggacctga

SEQ ID NO: 54173 - DNA, 201 bp, Homo sapiens
tgtgcaaacccaacttccaaggcacccattgtgagctctgcgcgccagggttctacggccccggctgccagcgtgagtcccctctccccgctcaacctctrcctgcgctcgaggtggacacctgaggcctggtgcctctgaccaagcatgtgggccaccctttcctgcagcctgccagtgttccagccctggagtggccga

SEQ ID NO: 54174 - DNA, 201 bp, Homo sapiens
aaggcagctaggggtgaggccacaggcagtaggcccggctcattcttccctctctctctaccgtccctttcccacacactctgcagaaggtggtgttgtcytctgggtcggggccagggctggatctgcccctggtcttgggactccctcttcagctgaagctgagtatgtccagggtggtcttgagccaagggtcgaaga

SEQ ID NO: 54175 - DNA, 201 bp, Homo sapiens
agcagtgagccgagatcacgccactgcactccagcctgggtgatagagcaagactctgtctaaaataaaataaaataaaataaaataaaataaaataaaawgggtcagggagtgggtgatttctactgctagactgtttaggccctgtaataaatggataagggaagataactgagaggcggggggcaggtcccttcttaa

SEQ ID NO: 54176 - DNA, 201 bp, Homo sapiens
cgcctgagacaggtctctgggcccctgaccagcaaacgccatcccatcatgaggattgcgcttggggggctgctcttccccgcttccaaccttcggttgcyggtaactacaccccaggggtggaaccctagccaagacttggtaaagcactgctgggtggctggccgtgggaatctaagtccacacttttagggagaaggg

SEQ ID NO: 54177 - DNA, 201 bp, Homo sapiens
agcgattctcctgcctcaccctcggagtagctgggattacaggcatgggcaaccatacctggctaatttttgtatttttagtagagacggggtttcactaygttggccaggctggtctggaactcctgacctcaagtgatctgcccgcctcagccttctaaagtgctgggattacagatgtgacccaccaagcccggtctg

SEQ ID NO: 54178 - DNA, 201 bp, Homo sapiens
agggcactcagctcatgcagtcttcccttctctcctctggccctgtagcagggcctctccctctgtctgtctctgacatgtccctactcagctttgtttgytttctctttctgatagagtgcccacgaccctccggctgtccacctcagcaatggcccaggacaagagcctatcgctgtcatgacctttgacctcaccaag

SEQ ID NO: 54179 - DNA, 201 bp, Homo sapiens
gagccgccgagtggacagtggctgattatggagagcagaggcccactggctacctcgcgcctgctgctgttgctgctgttgctactactgcgtcacacccrccagggatgggccctgagacctgttctccccacccaggtgcaggagcgggacagggcactcagctcatgcagtcttcccttctctcctctggccctgtag

SEQ ID NO: 54180 - DNA, 201 bp, Homo sapiens
caaactcaggttggaggagtggaaaagtggggagaagattctggatccgagccaccttaatgctctaatgccacctttgcactacctccctctaggagaaractcttccacctctttttgcctgaatggcctttgggcacaaggtcagaggctggatgtggaccaggccctgaacagaagccatgagatctggactcacag

SEQ ID NO: 54181 - DNA, 201 bp, Homo sapiens
acgcaggggaggactgtttctagacctcaggcctgtgaatgcaggctccccgagtggacagaaatcttggaggacctagatcaggccctagaggaggagargggagatggaatatcctctcccagttcagaaactttctcggcagtggaggatgatagtggaggggactctgtccttcaccccattgatccccagaggggt

SEQ ID NO: 54182 - DNA, 201 bp, Homo sapiens
aagcagaagaagtgccagccctcagcttccgtcagatcttgggctcctagggccttgtacaagtccatggccctctggttccagtccaggacggccaggcrgaattgggagcagcccttatccaaggccacctgtgggagaagacaacactaacttttctggggtcaaaaaagaaaaaggttttctcactccctctttcaa

SEQ ID NO: 54183 - DNA, 201 bp, Homo sapiens
ggttgagagctgcaagggggaggccaaatgctcagaggggagtcaactgagggcagggaggtcgggactgcggctccgatgccctgatttctacatccccrtatcttatctctgtcacactccagctggttcctgccctggatggctgcctgcgccgggattcctggctggacaaacaggccgagatctcagcatctgccc

SEQ ID NO: 54184 - DNA, 201 bp, Homo sapiens
tcagaccagatgccaggcactgtgcctgcattttctcaatgaaccctctttcacagtcaccccgtaaagtattattttcctcattttacagacaaggacaytgaagcacaaaggtgaagtgacttgcccaaggtcactcagctagaaatttaggattccattatctcatttctagtcctgatacaggatgctacttgggac

SEQ ID NO: 54185 - DNA, 201 bp, Homo sapiens
cctttgacctcaccaagatcacaaagtatggggttggcctagcccttgacccagtcccctggttctgccctctctccatcagctcttctcttttccctgtyttcctttccttatctgtgaacaccatctcccccaaacccacactggttctcaaaggacacatgacatacacaatctttccttctgtgtccttccagaacc

SEQ ID NO: 54186 - DNA, 201 bp, Homo sapiens
atgggagatggcaccaggtaagctagctctggtcctcaggggagggatgtctggagctggtctgaggaaagggaacaaaaccaagttattgggcatccctytaccactgtcatctcgtttaatccacacgaacccccacaaagtagctattcttggccccatcttttctgatgggaattctaaggctcagtcagtatataa

SEQ ID NO: 54187 - DNA, 201 bp, Homo sapiens
cctctgggagggaagaagaataggccacaagaagaagatatgggggcagtggaaggtagtgcttttgcaaactcaggttggaggagtggaaaagtggggakaagattctggatccgagccaccttaatgctctaatgccacctttgcactacctccctctaggagaagactcttccacctctttttgcctgaatggccttt

SEQ ID NO: 54188 - DNA, 201 bp, Homo sapiens
tgccaggcactgtgcctgcattttctcaatgaaccctctttcacagtcaccccgtaaagtattattttcctcattttacagacaaggacactgaagcacaraggtgaagtgacttgcccaaggtcactcagctagaaatttaggattccattatctcatttctagtcctgatacaggatgctacttgggacgcaggggagg

SEQ ID NO: 54189 - DNA, 201 bp, Homo sapiens
agtcttgtgactgggcccctgggcaggggtcaagggtcagtgcccctgtttcctttaccccctcctccccgggcaacctttaaccctccaccgcccacacrcaaggctgcctgcctctacacattctcccaagagttgtctgagccgccgagtggacagtggctgattatggagagcagaggcccactggctacctcgcgc

SEQ ID NO: 54190 - DNA, 201 bp, Homo sapiens
acactctgcagaaggtggtgttgtcttctgggtcggggccagggctggatctgcccctggtcttgggactccctcttcagctgaagctgagtatgtccagrgtggtcttgagccaagggtcgaagatgaaggcccttgccctgcctcccttaggcctggctcccctccttaacctctgggccaagcctcaagggcgtctct

SEQ ID NO: 54191 - DNA, 201 bp, Homo sapiens
caagttcatgagcacaacattggaaacagctcaagggaggcggcacattttgaggggaaggaaacctctgggagggaagaagaataggccacaagaagaakatatgggggcagtggaaggtagtgcttttgcaaactcaggttggaggagtggaaaagtggggagaagattctggatccgagccaccttaatgctctaatg

SEQ ID NO: 54192 - DNA, 201 bp, Homo sapiens
gccctgaacagaagccatgagatctggactcacagctgcccccagagcccaggcaatggcactgacgcttcccattaaagctccacctaagaaccccctttgaaagttactgattattcatttattcaacaaatattcactgtgcactagcaatgtaccaggcactgtgccaagtattgagttgtcttaatgagcaaaaac

SEQ ID NO: 54193 - DNA, 201 bp, Homo sapiens
tccccagcctgccctagattccaggattcctgattaccatccagagctgtctacactctttcattaagactgacttcgctttgacatcgactttgccaggyccccaaccaagggcacctacgatgcctgcccagtgtcccctgccttccccacacccccaaaaacttttcagagcttggcagcacacactaaagcctctgg

SEQ ID NO: 54194 - DNA, 201 bp, Homo sapiens; identical to SEQ ID NO: 12055

SEQ ID NO: 54195 - DNA, 201 bp, Homo sapiens
atctctttaaaaaaaaaaaaaaaaaaaaaaagctggcagccaagatggccaaataggaacagctccggtctacagctcccagcatgagcaacgcagaagaygggtgatttctgcattttccatctgaggtactgggttcatctcactagggagtgccagacagtgggcacaggacagtgggtgcagcgcaccgtgcgcaag

SEQ ID NO: 54196 - DNA, 201 bp, Homo sapiens; identical to SEQ ID NO: 12057

SEQ ID NO: 54197 - DNA, 201 bp, Homo sapiens
aaactgcatctgaactgagaaaaccataactacctggtgagaagtcttcctcagggcctccttgagtgcagtgactcctcctggtcctgcctcctacctamtaagttgttacaggagatacttttgtagggcatatgaggttttgaagccagggtcattcttttgtctgtatgatgtggatctcaactctttttttttttt

SEQ ID NO: 54198 - DNA, 201 bp, Homo sapiens
agtctcctttatgagcttatttccatacagccatagttttgttcctttgtaccttatatgcaaagggtgtatacaagaaccaaagtttgtcagaagtcatmtttgtggtgctgcgtatgatggccaggttacttttcctgcatttgggcactgagggtgttcttgttttttttgtttgtttgttttctttgttttgttttg

SEQ ID NO: 54199 - DNA, 201 bp, Homo sapiens
tacttatcctcttagcaagcttaaatgcagaatcagacctgtcttgccgctctgctgagtgatcacttaaatagacatacttggaaccaacagaggttgcrcgcacgtgaggactcattctccaggctgctgtgtggactggccagctctttcgttcttgcccagacatcatctcatttggctttaatagtgtctaagggc

SEQ ID NO: 54200 - DNA, 201 bp, Homo sapiens
atcctcttagcaagcttaaatgcagaatcagacctgtcttgccgctctgctgagtgatcacttaaatagacatacttggaaccaacagaggttgcacgcaygtgaggactcattctccaggctgctgtgtggactggccagctctttcgttcttgcccagacatcatctcatttggctttaatagtgtctaagggcaataa

SEQ ID NO: 54201 - DNA, 201 bp, Homo sapiens
taggtactgatatgattcccacttcacaaccgaggaaaccaaatcttgcagtggttaaataacttggtcagggctggcagagctgggatctgaaccaagcsagtctggctccagatgctggattctcaaccactggctgaacctgctttttttaaggaacaatcgccctcttgatgtttatagacaccatcagacatgata

SEQ ID NO: 54202 - DNA, 201 bp, Homo sapiens
agcaacgcagaagatgggtgatttctgcattttccatctgaggtactgggttcatctcactagggagtgccagacagtgggcacaggacagtgggtgcagygcaccgtgcgcaagccgaagcagggcgaggcattgcctcactcgagaagtgcaaggggtcagggagttccctttcctagtcaaagaaaggggtgacagat

SEQ ID NO: 54203 - DNA, 201 bp, Homo sapiens
ggtgacagatggcacctggaaaatcgggtcactctcaccctaatactgcgcttttccgacaggcttaaaaaacggcgcaccaggagattatatcccgcacmtggctcagagggtcctacgcccacggagtcttgctgattgctagcacagcagtctgagatcaaactgcaaggcggcagccaggctgggggaggggcgcct

SEQ ID NO: 54204 - DNA, 201 bp, Homo sapiens; identical to SEQ ID NO: 12067

SEQ ID NO: 54205 - DNA, 201 bp, Homo sapiens
gcagtgttaaatatccctgtctgacagctttgaagagagcagtggttctcccagcacacctctggagatctgagaatgggcagactgcctcctcaagtggktccctgacccctgacccccgagcagcctacctgggaggcaccccccagtaggggcagattgacagcccacacggccgggtactcctctgagacaaaactt

SEQ ID NO: 54206 - DNA, 201 bp, Homo sapiens; identical to SEQ ID NO: 12068

SEQ ID NO: 54207 - DNA, 201 bp, Homo sapiens
agatgaatgtataactagaataaccaatacagagaagtgcttaaaggagctgatggagctgaaagccaaggctcgagaactatgtgaagaatgcagaagcytcaggagccgatgcgatcagctggaagaaagggtatcagtgatggaagatgaaatgaatgaaatgaagtgagaagggaagtttagagaaaaaagaataaa

SEQ ID NO: 54208 - DNA, 201 bp, Homo sapiens
agtctctgataaaacagactttaaaccaacaaagatcaaaagagacaaagaaggccattacataatggtaaagggatcagttcaacaagaagagctaactrtcctaaatatatatgcacccaatacaggagcacccagattcataaagcaagtcctgagtgacctacaaagagacttagactcccacacaataataatggg

SEQ ID NO: 54209 - DNA, 201 bp, Homo sapiens
gggcttaaaatgttaaaatatttctaaagaggactattttgggactctacagtgtacctctttaatgagaacacccacagtttaggcctattaaggcatamttcctttattttactaaagaattaaaataataaagatttgataattttctttcttttttttttttattgatcattcttgggtgtttctcgcagaggggga

SEQ ID NO: 54210 - DNA, 201 bp, Homo sapiens
aatcaacagaatatacatttttttcagcaccacaccacacctattccaaaattgaccacatacttggaagtaaagctctcctcagcaaacgtaaaagaacrgaaattataacaaactgtctctcagaccacagtgcaatcaaactagaactcaggattaagaaactcactcaaaaccgctcagctgcatggaaactgaaca

SEQ ID NO: 54211 - DNA, 201 bp, Homo sapiens
ctcctcagcaaacgtaaaagaacggaaattataacaaactgtctctcagaccacagtgcaatcaaactagaactcaggattaagaaactcactcaaaaccrctcagctgcatggaaactgaacaacctgctcctgaatgactactgggtacataacgaaatgaaggcagaaataaagatgttctttgaaaccaacaagaac

SEQ ID NO: 54212 - DNA, 201 bp, Homo sapiens
gaaactattccaatcaatagaaaaagagggaatcctccctaactcattttataaggccagcagcatcctgataccaaagccgggcagagacagaaacaaaraagagaattttagaccaatatccttgatgagcattgatgcaaaaaccctcaataaaatactggcaaaccaaatccagcagcacatccaaaagcttatcca

SEQ ID NO: 54213 - DNA, 201 bp, Homo sapiens
acccacagccaatatcatactgaatgggcaaaaactagaagcattccccttgaaaactggcacaagacagggatgccctctctcaccactcctattcaacrtagtgttggaagttctggccagggcaattaggcaggagaaggaaataaagggtactcagttaggaaaagaggaagtcaaattgtccctgtttgcagatga

SEQ ID NO: 54214 - DNA, 201 bp, Homo sapiens
aatcaatatcacgaaaatggccatactgcccaaggtaatttatagattcaatgccatccccatcaagctaccaatgactttcttcacagaattggaaaatrctactttaaagttcatatggaaccaaaaaagagcccgcatcgccaagtcaatcctaagccaaaagaacaaagctggaggcatcatgctacctgacttcaa

SEQ ID NO: 54215 - DNA, 201 bp, Homo sapiens
gacaagggggccaacaggccaccctggggaggttaaatctcctgtgagcggtggcctatgctcagccaaggtcagctttcttgaggaggtagtgctgcaarccattagtagccagtactcacagcagctggggcaggatgcacaatggtccagtgagggggatctgggtcggcatcagtggcatctactacaatatctctg

SEQ ID NO: 54216 - DNA, 201 bp, Homo sapiens
gtcaggcaggaatacacccaggctggagtacagtggtgtgatcacggctcattgcagccttgaattcctgggctcaagcaatcctcccacttcaacctccygagtagctgggaccacaggcatgcatcaccgtttccagctaatttttgtattttttgtagggacagaatctttgttgtccaggttggtctcaaattcctg

SEQ ID NO: 54217 - DNA, 201 bp, Homo sapiens
ccttatacaaaaatcaattcaagatggattaaagacttaaatgttagacctaaaaccataaaaaccctagaggaaaacctaggcattaccattcaggacakaggcatgggcaaggacttcatgtctaaaacaccaaaagcaatggcaacagaagccaaaattgacaaatgggatctaattaaactaaagagcttctgcaca

SEQ ID NO: 54218 - DNA, 201 bp, Homo sapiens
catggcacctgacctgcactcctgtttctacttcatgggtttattggtcttgttcttggggcagaaaaactgttgtattattgtggctttgtagtatgtcwgtattagttggctagggctgccataagaatgtgccacagaatgggtggcttaagcaacagaaatttattttctcacagttctggaggctaaaagtctgcg

SEQ ID NO: 54219 - DNA, 201 bp, Homo sapiens
gggactcagggcagtgcagaggaagaaggataagtgaggatatggtcttgtctggagtctacttcagctccatcctggtggggaggtggggctctggaacrtgaattataccacagagctgattttaccttgggacaagggggccaacaggccaccctggggaggttaaatctcctgtgagcggtggcctatgctcagcca

SEQ ID NO: 54220 - DNA, 201 bp, Homo sapiens
ctcaaacaaatttacaagaaaaaaacaaccccatcaaaaagtgggtgaaggacatgaacagacacttctcaaaagaagacatttatgcagccaaaagacayatgaaaaaatgctcatcatcactggccatcagagaaatgcaaatcaaaaccacaatgagataccatctcacaccagttagaatggcaatcattaaaaagt

SEQ ID NO: 54221 - DNA, 201 bp, Homo sapiens
tcccccaagttctttccatgtgaactcctcttagtacaggtcctccatttgaaatgtatgcaatttatttgtgaacctaaatgggaaacttcaccattatscccatgaaacatgctcttgttagcttgggtttgtttgggcttgttaatgttagtctaatacccagctgtctccagccctaggtcagtgccatttgctaaa

SEQ ID NO: 54222 - DNA, 201 bp, Homo sapiens
agaaaaaaacaaccccatcaaaaagtgggtgaaggacatgaacagacacttctcaaaagaagacatttatgcagccaaaagacatatgaaaaaatgctcaycatcactggccatcagagaaatgcaaatcaaaaccacaatgagataccatctcacaccagttagaatggcaatcattaaaaagtcaggaaacaacaggtg

SEQ ID NO: 54223 - DNA, 201 bp, Homo sapiens
catttttctagctcccagcaggtgagaaccaacccatactctctgttcctttattctttgcttaaagtggagaaaaagaggctgggtcctaactgaatgakgtctggtcagagttaaggtcagcacagggacatgggaaaagaacacagggcatggttgagagcacgtgggcatgagtctggacagctagagggcaggaga

SEQ ID NO: 54224 - DNA, 201 bp, Homo sapiens
aatgagataccatctcacaccagttagaatggcaatcattaaaaagtcaggaaacaacaggtgctggagaggatgtggagaaataggaacacttttacackgttggtgggactgtaaactagttcaaccattgtggaagtcagtgtggtgattcctcaaggatctagaactagaaataccatttgacccagccatcccatt

SEQ ID NO: 54225 - DNA, 201 bp, Homo sapiens
tggtcctgcctcctacctactaagttgttacaggagatacttttgtagggcatatgaggttttgaagccagggtcattcttttgtctgtatgatgtggatctcaactcttttttttttttttcttttttttgagacagagtcttgctctgtcacccaggctggagtgcagtggtgcaatcttggctcactgcaacccccgg

SEQ ID NO: 54226 - DNA, 201 bp, Homo sapiens
ggagatatcttctccccatctgggtctggggatgactgtcttgtgtagccagtctgcgagtatgagtggagatggaaccagagtcttttgattagtttctytgctgtccaccccaccaccattccagtccctcatccattctgctctgagctgggattttctagcatttggttaggaaaactggtcctcacatcttcagag

SEQ ID NO: 54227 - DNA, 201 bp, Homo sapiens
cctcctacctactaagttgttacaggagatacttttgtagggcatatgaggttttgaagccagggtcattcttttgtctgtatgatgtggatctcaactcttttttttttttttcttttttttgagacagagtcttgctctgtcacccaggctggagtgcagtggtgcaatcttggctcactgcaacccccggctcccagg

SEQ ID NO: 54228 - DNA, 201 bp, Homo sapiens; identical to SEQ ID NO: 12039

SEQ ID NO: 54229 - DNA, 201 bp, Homo sapiens
ttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggc

SEQ ID NO: 54230 - DNA, 201 bp, Homo sapiens
tcatccatgttaatgtgcatagatagctattagctgttaattttcattgtactgtgatattccatcacatgattatacaaccatttatccatttgctatgrcctgactgtgtctccccaaattcacatgttaaaaacttaatccccaatgtgacagtgttgggagatgggcctgatggaaggtgtttaggtcatgagggct

SEQ ID NO: 54231 - DNA, 201 bp, Homo sapiens
gtctggagtttgagaccagcctggccaacatggtgaaaccctgtttctactaaaaatacaaaaaaattagctggacgtggtggcaggcatggtgacaggcmccgtgtatgctgcacgcctgtaatcctagctagctgggaggctgaggcaggagaattgcttgaactgtggagagggaggtttcggtgagccaagatcgcg

SEQ ID NO: 54232 - DNA, 201 bp, Homo sapiens
aaggacatgagtcatactggattaaggcccattctaatgacttcattttaacttaattgcctttttaaaggccctgtctccaaataatcacaatccaaggmcctcggggttaggatttcagcatatgagttttaggggcagagggggcacaattcagtccgtaacactgtggacttgctggttttgaggcaccctcgtgag

SEQ ID NO: 54233 - DNA, 201 bp, Homo sapiens
gtgtatgctgcacgcctgtaatcctagctagctgggaggctgaggcaggagaattgcttgaactgtggagagggaggtttcggtgagccaagatcgcgccmctgcactccagcctggacaacagagggagagcctgtctcaaaaaaaaaaaaaaaaaaaaaaaaaaaaggaagtctggaagtgtgttgtttaatctccaga

SEQ ID NO: 54234 - DNA, 201 bp, Homo sapiens
catctcccaacctcgtgatctgcctgcctcagcctcccaaagtgctgagattacaggcgtgagccaccacacctggccaagttgtcgctattattgccacrcacagatatttatgtcattgaatttcccagtctcttttattgcttctagattttgagtcatagttcaaaaggccttcctcactccaaaattatgaaggaa

SEQ ID NO: 54235 - DNA, 201 bp, Homo sapiens
aagggtggggctgtaaggctgtccttggcttctgctctgagcagaacatcaggccatagctatgtcttctgtccccaccaagcccctggtgacagcatcaragagggcagcctctaccctggtgcatccccgttcacagcctctgccccaggcacaaggaaaagtccccagtgtctgggcaggcctgagcagggagggtct

SEQ ID NO: 54236 - DNA, 201 bp, Homo sapiens
cctctgaggaatggctcaccacagtagaacctctgtgtccttttcaggtgcttgcagatgtgtttgatgccccggtgtatgttatagacactgccaactcsgcctgtgtgggttctgcataccgagcttttcatggtaggttgatggagggagacagctatctctggaagtggccaggacatggggtgggctgaggagggt

SEQ ID NO: 54237 - DNA, 201 bp, Homo sapiens
catttgctaaacatacttcctaaatcttctgccttgtctttggtgaaatggctaaaaagtacagggacagcctggggagctgtggctctccactacggacytcccccagctcatcctgactctattatcaccagggtagcatgaccaagcatactcctcttaaggcagtcgaggtggaatggaaggggtcagaagacatat

SEQ ID NO: 54238 - DNA, 201 bp, Homo sapiens
tcttctcttcctcctcctctcctctgggtagccctgaagccactcctggaggggcccttggatctctgaaggaaggccaggtgggctacactgaataacamcctaactactacccctcaacctcacccccaccccaggaaaagtaagtctttttctaacgatccaccagattagggttacatttaacagtaactagaaagg

SEQ ID NO: 54239 - DNA, 201 bp, Homo sapiens
tctggacagagccaaggggctggatggaaagcagcaggtcttaaaaacaactatttgttttaaaatacataacgaatggatgtctttttatcacaaaagaktcatgcaaaacagaaatatggaataagaagcaaatgcccccttcatatgcctcccagactcctttccagactgtgacttccttcctgtgagtttctgtgt

SEQ ID NO: 54240 - DNA, 201 bp, Homo sapiens
gtggactttaccctgtgaccgcccttcgttgacaccagcttgcctggtctgtgcacccaggactgctggccagaggagcagtgtgctgctgccaacgcccygcagacaggcaagcaaatcaaaatttgccttcaaagagggcatggggtgaccgggggcaccttttcctttaaagtacttgggaaatatacacagttgcag

SEQ ID NO: 54241 - DNA, 201 bp, Homo sapiens
gtggcccagtgcccattaatagtagacagaaaaaatgcattgtggtgcatttgtacaacaggatactacacacaaatgaaaatgaaccagcctcagtgatmcacaatgaaatgggtgaatctcaccaaatgtaacactgagcaaaagaggccaaacatggacatacatatggcaggggtctctgtacatcaaattcaaaag

SEQ ID NO: 54242 - DNA, 201 bp, Homo sapiens
tggtggcccttgctccccagagcctgctgtctaggagggagagggacagtagacgactgaatgagcacgtacatgaatgcagcaggtgctaaggctaggtkgcagaagaacagagtgccgcaaaggaaagcagctggtgggcgggttggagacttaccctgggtggggtgatcaagcctgggcgtctctgagaaggtggcc

SEQ ID NO: 54243 - DNA, 201 bp, Homo sapiens
cagggaagcactgtagcgcacacacacacacacacacacacacacacacacacacacactctgcacacacccttatttgttcactcacccacaggcatacmcatgcagggtcttcagtttagcctaagatgtaagtcagtgtctggatcagtgccttgcacacagtaggtgctcaggtacatgccttatggtcagcgggac

SEQ ID NO: 54244 - DNA, 201 bp, Homo sapiens
attagaatagggataaaaatggcaggtgattgcatagctaaagaaaaagtgcacagagtgctgaaattctagggactactgatgaagcttgaaggaggcasccttggggaaaatagaaataccagcggggctggcacagcacaggccctggcactggacagcatgggactgaattctggttctatcagctttgtgactttg

SEQ ID NO: 54245 - DNA, 201 bp, Homo sapiens
gagctggagaccagcctgggcaaacatgagacctcatctctttaaaaaaaaaaaaaaaaaaaaaaagctggcagccaagatggccaaataggaacagctcsggtctacagctcccagcatgagcaacgcagaagatgggtgatttctgcattttccatctgaggtactgggttcatctcactagggagtgccagacagtgg

SEQ ID NO: 54246 - DNA, 201 bp, Homo sapiens
ggctctggaacatgaattataccacagagctgattttaccttgggacaagggggccaacaggccaccctggggaggttaaatctcctgtgagcggtggccyatgctcagccaaggtcagctttcttgaggaggtagtgctgcaagccattagtagccagtactcacagcagctggggcaggatgcacaatggtccagtgag

SEQ ID NO: 54247 - DNA, 201 bp, Homo sapiens
ttgctcttttttccctagtttcctcaagtggaaacttagaggattgatttaagaccttcttttctaatatatgcatttaatgctataaatttctctgtaarcacaaatgctttttatgggatgccttagcagcatcccatacattttgataagttatagtttcatttttttcgttcaaaatattttttagttctcttgaga

SEQ ID NO: 54248 - DNA, 201 bp, Homo sapiens
ttttgtagcttctttaaaatttctacattacaaaataaatatttcattcttaaaaatgtatgtgcataccatttttaatgactgtataatattctatctgrgtagaccaggcacggtggctcatacctataatcccagcactttgggaggctgaggcgggaggatcacttgaggccaggagctggagaccagcctgggcaa

SEQ ID NO: 54249 - DNA, 201 bp, Homo sapiens
ctggttctatcagctttgtgactttgtgtctcggtttcctcatctggaacaaggggaatgatgctattcatcttacagggctgttgtgcaaattagatgarttaatacttttaaagcacttaaaaaatagtgcctggtcccacaggtaatgggaaaaacatttacccatcacagcggccccacccatttgcagtggacact

SEQ ID NO: 54250 - DNA, 201 bp, Homo sapiens
gattggtctcctctgggacctctctccttggcttgcaggtgaccactctcttgctgtgtcttcacatggtggtcactcggtgcaggagtgcttggtgtctstgtcatctgtatcctaatcttcttataaggacatgagtcatactggattaaggcccattctaatgacttcattttaacttaattgcctttttaaaggccc

SEQ ID NO: 54251 - DNA, 201 bp, Homo sapiens
ctcggtttcctcatctggaacaaggggaatgatgctattcatcttacagggctgttgtgcaaattagatgagttaatacttttaaagcacttaaaaaatartgcctggtcccacaggtaatgggaaaaacatttacccatcacagcggccccacccatttgcagtggacactggctgtgaatgccctggggtgttctactt

SEQ ID NO: 54252 - DNA, 201 bp, Homo sapiens
tcaagggaggcaggcctctggccagtccttgggggaacgtcctgtgggactctggatgactcgagttgccttgctggacctcagttttcccatctgtccargaaaggagttatactcccaagcttggagattgcttcagtgggacattaatgtctctggaccacaatcatggcctgtgagaatagcccatggccttgcctg

SEQ ID NO: 54253 - DNA, 201 bp, Homo sapiens
ctggaacaaggggaatgatgctattcatcttacagggctgttgtgcaaattagatgagttaatacttttaaagcacttaaaaaatagtgcctggtcccacmggtaatgggaaaaacatttacccatcacagcggccccacccatttgcagtggacactggctgtgaatgccctggggtgttctacttggccagccctgttc

SEQ ID NO: 54254 - DNA, 201 bp, Homo sapiens
aacaaggggaatgatgctattcatcttacagggctgttgtgcaaattagatgagttaatacttttaaagcacttaaaaaatagtgcctggtcccacaggtwatgggaaaaacatttacccatcacagcggccccacccatttgcagtggacactggctgtgaatgccctggggtgttctacttggccagccctgttctcca

SEQ ID NO: 54255 - DNA, 201 bp, Homo sapiens
aatacttttaaagcacttaaaaaatagtgcctggtcccacaggtaatgggaaaaacatttacccatcacagcggccccacccatttgcagtggacactggytgtgaatgccctggggtgttctacttggccagccctgttctccattgtcctgtggggacagtggagtagagagagagagaaaaagatctgggtgctgccc

SEQ ID NO: 54256 - DNA, 201 bp, Homo sapiens
acagaggttggttaaatgttcctgtttgattgaaagtcacagttgaattcttttcataatatgttagaatagatacatcttacgtgcagtgactgaaaacrttgataagcagacattaacaaatgatatatttgatttgcttttttctcattgtcaggacatttccaaagaggagggaaagaatggaatgtgggaaagaga

SEQ ID NO: 54257 - DNA, 201 bp, Homo sapiens
cgtggcctgaagggtgggtggctgtgctgggcaggcgggatttacctcaacagagcacctttgctttgtccccgtccctcagggagccatttcttcctacwacgtccagcgctacggatttcctccaggatgcaaagtggtggccttcactggggacaacccaggtgagtatctcggggagtttcactctccagtgagcct

SEQ ID NO: 54258 - DNA, 201 bp, Homo sapiens
cctagggtgtgggtgggggttggaggtgggggctctgcgcctgcctggagagccctgtggtttgctttgtggttcccatgtggccgccagctaaccagaakctcccctcccattctcagcgtcgctggcaggcatgagactggaggaaggtgacattgcggtaaggcgacttcccacacccataggctctttctgtttcca

SEQ ID NO: 54259 - DNA, 201 bp, Homo sapiens
ataggccatggtatagagtttgtctttattctaaaagctatggtcagccactaagggccataaggggtaggggtatgggtgaggtatgaatgacaggttgyatttttgttttgaaaatatctctctgggggcattgggagaacagattcggagcattgctggaatggacgtggggaactattaaagaggtttttgctggtc

SEQ ID NO: 54260 - DNA, 201 bp, Homo sapiens
cacgaggtcaggagatcgagaccatcctggctaatgcagtgaaaccccgtctctactaaaaatacaaaaatttagccaggcttggtgccgggcgcctgtartcccagctgctcgggaggctgaggcaggagaatggggtgaacctgggaggcagagtttgtagtgagccgagataatgccactgcactccagcctgggtga

SEQ ID NO: 54261 - DNA, 201 bp, Homo sapiens
gatcgagaccatcctggctaatgcagtgaaaccccgtctctactaaaaatacaaaaatttagccaggcttggtgccgggcgcctgtagtcccagctgctcrggaggctgaggcaggagaatggggtgaacctgggaggcagagtttgtagtgagccgagataatgccactgcactccagcctgggtgacagagcaagactc

SEQ ID NO: 54262 - DNA, 201 bp, Homo sapiens
ggctaatgcagtgaaaccccgtctctactaaaaatacaaaaatttagccaggcttggtgccgggcgcctgtagtcccagctgctcgggaggctgaggcagragaatggggtgaacctgggaggcagagtttgtagtgagccgagataatgccactgcactccagcctgggtgacagagcaagactctgtctcaaaaaaaaa

SEQ ID NO: 54263 - DNA, 201 bp, Homo sapiens
tttcatttctattgggtatattacctaaaagtggaattgcggggtcacatggtaactctgtgttcaacattttgaagaattgccaaactgttttccaaagkggctgtactattttccattcccaccagtggtagatggtgcctctagtttctctacatcctttttttttttttgagatggagtcttgctctgtcacccagg

SEQ ID NO: 54264 - DNA, 201 bp, Homo sapiens
ttcaggtgctctagaacaatttaaatagtattagaaatatttgctatttaaaggtttggtcccagcactttgggaggccgaggcgggtggatcatgaggtyaggagatcgagaccatcctggctaacaaggtgaaaccccgtctctactaaaaatacaaaaaattagctgggcgcggtggcgggcgcctgtagtcccagct

SEQ ID NO: 54265 - DNA, 201 bp, Homo sapiens
gaccatcctggctaacaaggtgaaaccccgtctctactaaaaatacaaaaaattagctgggcgcggtggcgggcgcctgtagtcccagctactcgggaggytgaggcaggagaatggcgtgaacccgggaagcggagcttgcagtgagccgagattgcgccactgcagtccgcagaccgacctgggcgacagagcaagact

SEQ ID NO: 54266 - DNA, 201 bp, Homo sapiens
tctcccaagtagctgggattacaggtgccctccaccatgcctggctaatttttgtatttttgtagagatggggtttcaccatattggccaggttggtcttkaactcccgacttcaggtgatctgcctgccttggcctcccaaagcactgggattataggtatgagccaccgtgcccagctgaaatgccagttttaagttgt

SEQ ID NO: 54267 - DNA, 201 bp, Homo sapiens
aacatctgcagtcaggccctgtggcctcccttgtaccatgaaatatacaaacatagactgggcatggtggctcatgcctgtaatcccagcactttgggagrccgaggcaggtggatcacctgaggtcaggagttcaagaccagcctggccaacatggtgaaaccttgtctctactaaaaatacaaaaaattagccgggcgt

SEQ ID NO: 54268 - DNA, 201 bp, Homo sapiens
ttgtaccatgaaatatacaaacatagactgggcatggtggctcatgcctgtaatcccagcactttgggagaccgaggcaggtggatcacctgaggtcaggrgttcaagaccagcctggccaacatggtgaaaccttgtctctactaaaaatacaaaaaattagccgggcgtggtggcccatgcttgtaatcccagctactc

SEQ ID NO: 54269 - DNA, 201 bp, Homo sapiens
ttgcttactggtgtcctgttacctttttttttttaatgctatatccagaatttggagcttataaagcaagcacaagttaggggttggtttgttctctctaycttaaatctcaagatcagcagtttttgaaatgacctcatgctcgtggtttccaaacctgcactggacttctctggcgatttgtgaacaggagggacatgc

SEQ ID NO: 54270 - DNA, 201 bp, Homo sapiens
ggcttttagttggatgtgaaattcagagcaggctttgtttgccttatgcgagaacacatgcctccaagaaggagcctgtgcagacaagcagcttgaggatygggaaagaactgactctgaaaaggcattttcatttgtcacgtaggtgtcacatgtgggggaaccactcaagacccatgtttttcgtcatccctctttttg

SEQ ID NO: 54271 - DNA, 201 bp, Homo sapiens
gctcctaagccctaagaaccattggagaatgtggctagttaatctagccctccctgcctcattgtgcccatggtagaatgtgcagaaacccaagctccctstctctacctggggctcctctgcgtcagcctcctgtgtaaacagcccaagacaagggcgtttccggcacctcccagggacattcaggggcctgaatctgag

SEQ ID NO: 54272 - DNA, 201 bp, Homo sapiens
tggagaatgtggctagttaatctagccctccctgcctcattgtgcccatggtagaatgtgcagaaacccaagctccctctctctacctggggctcctctgygtcagcctcctgtgtaaacagcccaagacaagggcgtttccggcacctcccagggacattcaggggcctgaatctgaggaagagcctccgatacctaagt

SEQ ID NO: 54273 - DNA, 201 bp, Homo sapiens
aggctgcaatgagctgtgattgcaccacttcactctagcctgggcgacagagcgagaccatgtctcaaaaaaataaaggaaaatgactcataatcccatcycctctctccaaccactggtatcatttagggacattttctcccagtctcctttatgagcttatttccatacagccatagttttgttcctttgtaccttata

SEQ ID NO: 54274 - DNA, 201 bp, Homo sapiens
ggaggtctctaggttgaactgctcctagggtgtggggcctcatctggtgacgttagtaccccctggaccagtgtagaagctgaggaaaattctacacttcmttttttaaaatgcctttcaggtaaaggttgttgctgttgatgcagagttgaatgtcttctatgaggaaagtgtgcattttgacagagatcttccagaatt

SEQ ID NO: 54275 - DNA, 201 bp, Homo sapiens
tatacaagaaccaaagtttgtcagaagtcatctttgtggtgctgcgtatgatggccaggttacttttcctgcatttgggcactgagggtgttcttgttttytttgtttgtttgttttctttgttttgttttgttttgtttttctggagacagggtttcactcctgttgcccagactggagtgcagtggtgtgatcttggct

SEQ ID NO: 54276 - DNA, 201 bp, Homo sapiens
gggacagaatctttgttgtccaggttggtctcaaattcctgagctcaagcaatcctcctcctgccttggcctactgaagtgctaggattagtaggcataakccactatgctcagtcagtttattgtgaaaaatatcatgtatacagtagagtatatgtatcttacagcaagttataaaacatattaatcaaacatctgatg

SEQ ID NO: 54277 - DNA, 201 bp, Homo sapiens
tctgtttccacactcacacccacactctgataagtagcagaggtgctgctgagacccagatcccagggtcccagggtctgggtcccagcaggatctctgckacttatcagagtgtctgccggttccaaaagacagtggagggaggggatgggggcgcacatctttctcagaaagtcattgttctttgctagatgggcagga

SEQ ID NO: 54278 - DNA, 201 bp, Homo sapiens
ggttaatttcttcttaggcctctttccttagcttgtagatggtcaccttcttcctgtgtctccacatggtctcctcctgtgtgtccctgtgtcttcatttkctcttctcataaggacatcagtcatactggattagggcccacccctaatgactttatttttaacttaattacctctttaaagaggtaatatctgtcttta

SEQ ID NO: 54279 - DNA, 201 bp, Homo sapiens
cttcaaatacactcacattctgagatactggggtttaggacttccacatataaatttagggtagacacacttcagcccataataatgttttaatatgtagkatagcaattatcccctccttgcttttctttttaaaatattgtctgagctgtttataggtcttcatttttccacaaatattttataagaaattggtctagt

SEQ ID NO: 54280 - DNA, 201 bp, Homo sapiens
cactggtccctgatggatggagggtggtgttgcttcagtgtttgggcagtgcagacgatgttgagattcacattcggtctcgtctctttgttgttataggwtaagttctcaaaggtgggattcctagatccaaggcttctgacacacacactgctgattgaacctcagtggcagtgtttgagtgcacctgttcctcactcc

SEQ ID NO: 54281 - DNA, 201 bp, Homo sapiens
tcaaaatacttttcctgagaactgtgaagatactcttccataatcttctggccttcagggttgctgatgagaagtatggggtctgcttcataattcttttrtggaagtgggaaaggagtttccctttagggacttcactgccatcctgcactgtgttttgttttattctttttccctttctgtgcttgccaaagggtacct

SEQ ID NO: 54282 - DNA, 201 bp, Homo sapiens
tgtccaccccaccaccattccagtccctcatccattctgctctgagctgggattttctagcatttggttaggaaaactggtcctcacatcttcagagggcmcttcttcactcctggtggtggtggtgtttgtatatctgacgctactacctaccttccctagaaattgctcattgtttcttgcccaccaatggcaaccttc

SEQ ID NO: 54283 - DNA, 201 bp, Homo sapiens
accttgtctctactaaaaatacaaaaaattagccgggcgtggtggcccatgcttgtaatcccagctactcaggaggctgaggtaggagaatcacttgaacytgggaggtggaggttgcagtgagctgagaccgcaccattgcactccagcctggataacaagagtgaaactccatctcaaaaaaaaagaaaaaaaagaaat

SEQ ID NO: 54284 - DNA, 201 bp, Homo sapiens
gccgggcgtggtggcccatgcttgtaatcccagctactcaggaggctgaggtaggagaatcacttgaacctgggaggtggaggttgcagtgagctgagacygcaccattgcactccagcctggataacaagagtgaaactccatctcaaaaaaaaagaaaaaaaagaaatacaaacatagcccttagggtcttagtgctca

SEQ ID NO: 54285 - DNA, 201 bp, Homo sapiens
tcttgaactcctgagctcaagtgatcctcctgccttggcctccaaaagtgctgggattacaggtgtgaggtgatggcatgcacccgtagttccagccactygggaggctgagatggaaggatcacttgggcctgggaggttgaggctgcagtgagctgagattgcaccactccatttcagtctgggaaccagagcgagacc

SEQ ID NO: 54286 - DNA, 201 bp, Homo sapiens
tgaggtgatggcatgcacccgtagttccagccactcgggaggctgagatggaaggatcacttgggcctgggaggttgaggctgcagtgagctgagattgcrccactccatttcagtctgggaaccagagcgagaccctgtctcgaagaaaaaaaaatggagaagtaaaatttgaggattggtggtttatgattccatttat

SEQ ID NO: 54287 - DNA, 201 bp, Homo sapiens
actcacttctctatcctgtgggtgcagagccattgtttactgcctgagtatttgattactaaggacattttaaggattcaaaggccaagatcacattgttwagtagatatcaaacagatttaatgcttatttttaaaatatttaattattagaaacgaggtctcactgtgttgcccaggctggactcctgggctccagagc

SEQ ID NO: 54288 - DNA, 201 bp, Homo sapiens
tagtcccagctacttgggaggctgaggcaggagaatcgcttgaacccgggaggttgaggttgcagcgagctgagatctcgccactgcactccagcttgggyaacagagtgagacttcatctcaaaaaaaaaaaaaaaaaagtatatatatcaggccgggcgtggtgtctcatgtctgtaatcctagaactttaggaaaccg

SEQ ID NO: 54289 - DNA, 201 bp, Homo sapiens
accagtaccatcatgctcagttgtggtaggtctcctttctggtgatgtggctcatttaagagctggcagctaccagggaagcactgtagcgcacacacacrcacacacacacacacacacacacacacacactctgcacacacccttatttgttcactcacccacaggcatacacatgcagggtcttcagtttagcctaag

SEQ ID NO: 54290 - DNA, 201 bp, Homo sapiens
gattgtgattaggccagcttgggttacatgacctcgctggagtagaagttttggggatagggccaactctacttgggccacctgaaataacaatatgtggrtggggaaaataccccgatccctcacctggtgccttggtcagaacagtcaccgtgctgtgtgaagagcaagggttattcactcagggttgtccagtcctga

SEQ ID NO: 54291 - DNA, 201 bp, Homo sapiens
cagagaaagggcagacagaaaacagccaagccaccgggactggtaatccacacacggcttttagttggatgtgaaattcagagcaggctttgtttgccttrtgcgagaacacatgcctccaagaaggagcctgtgcagacaagcagcttgaggattgggaaagaactgactctgaaaaggcattttcatttgtcacgtagg

SEQ ID NO: 54292 - DNA, 201 bp, Homo sapiens
cagtaccatcatgctcagttgtggtaggtctcctttctggtgatgtggctcatttaagagctggcagctaccagggaagcactgtagcgcacacacacacrcacacacacacacacacacacacacacactctgcacacacccttatttgttcactcacccacaggcatacacatgcagggtcttcagtttagcctaagat

SEQ ID NO: 54293 - DNA, 201 bp, Homo sapiens
tatttgtaacccggggattacaacaggacttacgttttgggtaggtttgaagctgaaagaagtcagtgcatgtaaggcacttagtgtagtgcctggcaatrttaaaaaaaaaaaaaaaaggaaaaaaaataatagtgtctctgttccacaggttcaaccttgtccccaggggtgattgtgattaggccagcttgggttaca

SEQ ID NO: 54294 - DNA, 201 bp, Homo sapiens
cgttgggagtctcagccacagaagcacttttgttttcttttcagagacagagtctcaccttgtcacccaagttggagtgcagtggcatgatcatagctackgcagccaccaactcctgggctcaagtgatcctcctgcctcagcttcctgagtagctgggaccataggcttgctccaccatgcacagctaatttttttttt

SEQ ID NO: 54295 - DNA, 201 bp, Homo sapiens
tagctgggaccataggcttgctccaccatgcacagctaattttttttttttttgagacagagtctcgcttttgtcacccaggctggagtgcagtggcgcartctcggctcactgcaagctccgcctcctgggttcacgccattctcctgcctcagcctcccgagtagctgggactataggtgcccgccaccacgcctggct

SEQ ID NO: 54296 - DNA, 201 bp, Homo sapiens
ctcctgggttcacgccattctcctgcctcagcctcccgagtagctgggactataggtgcccgccaccacgcctggctaatttttttatatttttagtagaracggggtttcaccgtgttagccaggatggtctcgatctcctgacctcgtgatctgcccgcctcggccttccaaagtgctgggattacaggcgtgagccac

SEQ ID NO: 54297 - DNA, 201 bp, Homo sapiens
cttgggtttcccaacagcaacacggaagtatatactggaaggctggagcccagcaggcactgacaagcttatcaccagacctccggctacaccagcagctkcaggtaactgtggctacgtggtgtgagtgtgagaaacttctgcagagtcccaagtcctgtgggtcctgaagcctgctcatctcagtgttgcagctgtgct

SEQ ID NO: 54298 - DNA, 201 bp, Homo sapiens
tgatgagctctgtgactaagaagtggcaggggcaggtgtggagcccagttctttggcatgtggtctggggtctttctgtgtcttcaggaggctgtgacacyggtgtgtggtcatgtgaccatgtgcttgggtttcccaacagcaacacggaagtatatactggaaggctggagcccagcaggcactgacaagcttatcacc

SEQ ID NO: 54299 - DNA, 201 bp, Homo sapiens
cttgaaggaggcagccttggggaaaatagaaataccagcggggctggcacagcacaggccctggcactggacagcatgggactgaattctggttctatcasctttgtgactttgtgtctcggtttcctcatctggaacaaggggaatgatgctattcatcttacagggctgttgtgcaaattagatgagttaatactttta

SEQ ID NO: 54300 - DNA, 201 bp, Homo sapiens
taggacttccacatataaatttagggtagacacacttcagcccataataatgttttaatatgtagtatagcaattatcccctccttgcttttctttttaaratattgtctgagctgtttataggtcttcatttttccacaaatattttataagaaattggtctagttccttaaaagagtccagctggaatttttatttagg

SEQ ID NO: 54301 - DNA, 201 bp, Homo sapiens
gacttccacatataaatttagggtagacacacttcagcccataataatgttttaatatgtagtatagcaattatcccctccttgcttttctttttaaaatmttgtctgagctgtttataggtcttcatttttccacaaatattttataagaaattggtctagttccttaaaagagtccagctggaatttttatttaggttg

SEQ ID NO: 54302 - DNA, 201 bp, Homo sapiens
ttataacacagttgccagactgttactgtccttctggtccttcattatgccagaaacatatgaccaaaagtagaatcaacctgcagatgtctgacactcaractgtcacctgtggggctgtcagagcctgttatggagacattgtgcatttttgggtgtagcctggggctgccttaactgttagagtaactgtattagctg

SEQ ID NO: 54303 - DNA, 201 bp, Homo sapiens
ctctccactacggacctcccccagctcatcctgactctattatcaccagggtagcatgaccaagcatactcctcttaaggcagtcgaggtggaatggaagrggtcagaagacatatgagggagagagcctggaaagtgcatcccacaatgtctgtgttccctctgaggaatggctcaccacagtagaacctctgtgtcctt

SEQ ID NO: 54304 - DNA, 201 bp, Homo sapiens
ggtccatttttgggcttttgtttttgttccatggtttggtagatctgttcataagccagtaacacattgtttcaattatcccagctctgtaatatgtttgyttgtttgtttatttacttttgagttggagtctcgctctgtcgcccaggctggagtgcagtggcatgatctcggctcactgcaacctctgcctcctgggtt

SEQ ID NO: 54305 - DNA, 201 bp, Homo sapiens
gtggactttacagctcagcaaaagagggatcttaaaccaataatcactgaaatatatgggcacaagttgggaaaagtgctctgaggaaaagcagatggtgytgagcgctaaggagggcctcctgagcaagtgatggtcttaggtgcatcttagctgaggagaagggaacaggcatgtgaagagtggaaagaacattccata

SEQ ID NO: 54306 - DNA, 201 bp, Homo sapiens
accaataatcactgaaatatatgggcacaagttgggaaaagtgctctgaggaaaagcagatggtgctgagcgctaaggagggcctcctgagcaagtgatgktcttaggtgcatcttagctgaggagaagggaacaggcatgtgaagagtggaaagaacattccatacagtgaaaaggctctgaggcagaatgagtggagag

SEQ ID NO: 54307 - DNA, 201 bp, Homo sapiens
caataatcactgaaatatatgggcacaagttgggaaaagtgctctgaggaaaagcagatggtgctgagcgctaaggagggcctcctgagcaagtgatggtyttaggtgcatcttagctgaggagaagggaacaggcatgtgaagagtggaaagaacattccatacagtgaaaaggctctgaggcagaatgagtggagagaa

SEQ ID NO: 54308 - DNA, 201 bp, Homo sapiens
atctttgttttgtttgtagttgtattagttatctattgccatgtaacaaattatctcaaaatttagcagcttaaaacagtaataaatgtttattctcttayacagtttctttgggtcaagaatttggtttcagcatggttgggtgattctgattgaggatatctcctgaggttgcagtcacaatgtcatctggggctgcag

SEQ ID NO: 54309 - DNA, 201 bp, Homo sapiens
catattggccaggttggtctttaactcccgacttcaggtgatctgcctgccttggcctcccaaagcactgggattataggtatgagccaccgtgcccagcygaaatgccagttttaagttgttaaatacatggcagaatgtctggttacagtttttatctgttttgtgaaggcaacattttttggtgagcttttattgtct

SEQ ID NO: 54310 - DNA, 201 bp, Homo sapiens
tattgttttggttcttgttaaacacaacagagattccctgggtgatcttgtccacttctctctcccgaatcccaggcctggacacccatctccctcctagstaatccccgacccccatggctggatatcccacagatgcctcaggcttagcatgtcccagactgagttctgtctcccttcagacctcctcctttctgggtt

SEQ ID NO: 54311 - DNA, 201 bp, Homo sapiens
aataaatgaatttcaggtaatattacaagcaatgtctttaaatgcagttttacaaaaggcatcaaaatccagaccaataattagttcttggaccttttctrtaagttgtagggtagacagggcagagttcctccccattttcttgaagtggaaaccaagtcccaggagggtgatgagctctgtgactaagaagtggcaggg

SEQ ID NO: 54312 - DNA, 201 bp, Homo sapiens
gaatgaatgaatgaatgaatgaatggggtgagtgaataaataaatgaatttcaggtaatattacaagcaatgtctttaaatgcagttttacaaaaggcatyaaaatccagaccaataattagttcttggaccttttctgtaagttgtagggtagacagggcagagttcctccccattttcttgaagtggaaaccaagtccc

SEQ ID NO: 54313 - DNA, 201 bp, Homo sapiens
gttaggtgcctctgttcccacgaccctgtcactgcagctccatagttgtacatttgtgtccttttccctgactcaactccagtagcctgaagaatagggaygaaagtatcctattcatctgtcgcaagcctggcatgatctatgtgcttaataaatgttcattgaatgaatgaatgaatgaatgaatggggtgagtgaata

SEQ ID NO: 54314 - DNA, 201 bp, Homo sapiens
cacaactcaagtgtcatccctgcctcctccaccttcccaccccacatccaagggtcctcacgtcccactgatttgtctgtgactcttgactctaccatctyttctccagcgctatctgcttgtcattcttctccaggtctctaccgcagcctccttgcctccagcctaccttccccgtgactcccacaagcctttaataca

SEQ ID NO: 54315 - DNA, 201 bp, Homo sapiens
aggtctttgagcagcagatttccaagctaactgtagtgtttgagttgatgaggaatatttggaggaggtgtggtgccgtgtgtttccaagggcccctcttrtctctggttctctggttctagaacaacacaagcatatataccttccatgaagaaagagctccaggtacaagttgtggcaagagaattatctgctctgtgc

SEQ ID NO: 54316 - DNA, 201 bp, Homo sapiens
atcttgtccacttctctctcccgaatcccaggcctggacacccatctccctcctagctaatccccgacccccatggctggatatcccacagatgcctcagrcttagcatgtcccagactgagttctgtctcccttcagacctcctcctttctgggttctctttctcagggaattctccccatccacccagggcacaactca

SEQ ID NO: 54317 - DNA, 201 bp, Homo sapiens
cccaagatcacacagtgctgggagtgggagtcaggacctgagtctatctcatccagtcccttggctgtgctgggatcacttttctccatgctggattactrtattttcaaatcctcactaggatgtaactaatttttctgaagatgcttcttcctccatgacctaacaggaatttattgttttggttcttgttaaacacaa

SEQ ID NO: 54318 - DNA, 201 bp, Homo sapiens
ttattatcgttgatatttacatgaggcacggagaggtgatgtcacttacccaagatcacacagtgctgggagtgggagtcaggacctgagtctatctcatycagtcccttggctgtgctgggatcacttttctccatgctggattactatattttcaaatcctcactaggatgtaactaatttttctgaagatgcttcttc

SEQ ID NO: 54319 - DNA, 201 bp, Homo sapiens
catgaagcttttgaaatttggtgtgcatttaacacttatagttctgggcatgcttcaagtatgcaaaggtatacatggcttgcagctactgtattggataktgcagctctggatgtgctccacatggtgacaggacagctatagctgccccaaacatcatgtcttcacagctgtattcgaaggcagggatcagaaggtgac

SEQ ID NO: 54320 - DNA, 201 bp, Homo sapiens
aatggagaagtaaaatttgaggattggtggtttatgattccatttatttaaaatatttttagcatagttgacctttttatttgattgatgcctacttgttwaattaatgtactctagtgcttacaaatcccaagtcatgagtttcttcatcatctgcccagagtactctgctgtaatggcaggcacttgcgtttcaattct

SEQ ID NO: 54321 - DNA, 201 bp, Homo sapiens
aggatgggctgacggtcacttctccagtactaatgtgggtccaggtaagcgcagggattcctgttctccttctatccccaggctgtctcactggcagactyggtgatttgctaggaagtccaaaggtggcagccaatgagagcatctgttgacaccaggtcctcatgggaaagtggagttggcatgactcctgggatcagg

SEQ ID NO: 54322 - DNA, 201 bp, Homo sapiens
tcaacagttcccacttggggttggggaaggttctccttcatctggacatttccagagtcatccaccatagggtttctcctggctttgcaatggtctgcctkccctgaggctctggtctacattctctgttgttcttgcaggactcagggcggtgttcatgtgcacaaggatgggctgacggtcacttctccagtactaatg

SEQ ID NO: 54323 - DNA, 201 bp, Homo sapiens
tctatccactccctccagcctctggctcctggacacagggagtctgggcctgatgctttgctctcatgggagctctctcctttgctcttcacttccctgtkgcagtgaagtcagatcactaatatagagggttgaaaatgcaaataaaagaaggcaaaagttggctgccttactttgttagtttttgagacaaggtctcac

SEQ ID NO: 54324 - DNA, 201 bp, Homo sapiens
ctggaataggggcctggaacaggtggccatcatctctatccactccctccagcctctggctcctggacacagggagtctgggcctgatgctttgctctcaygggagctctctcctttgctcttcacttccctgtggcagtgaagtcagatcactaatatagagggttgaaaatgcaaataaaagaaggcaaaagttggctg

SEQ ID NO: 54325 - DNA, 201 bp, Homo sapiens
gtggagggatgtttggaccccttcagggaagagacttcacagctcaaatcagcggccctgctaacagagacttcaccccgtgacccctatgaccttctcckcttagggcctcctgagcgctcagctcccctgctcctgcctccaccctagggtgtgggtgggggttggaggtgggggctctgcgcctgcctggagagccct

SEQ ID NO: 54326 - DNA, 201 bp, Homo sapiens
ggtgatttctgatctgatgcagcctccaggaccaaacttgatcctagctctgccagcccctgctccggctgcaccccactgcctgcccaaggtttgatggrcacagatagagatggcagccacagccagggctgaaagaagccctcccagcaaaggctgggggtggtggagtcaggcaaaagtgagagagtcttctctgcc

SEQ ID NO: 54327 - DNA, 201 bp, Homo sapiens
gatgtcgagggcatctcataggccaaggccttcacctggggaggtgagcagtgggtgagaaccaggcttgggggccgggccaaggtgatttctgatctgaygcagcctccaggaccaaacttgatcctagctctgccagcccctgctccggctgcaccccactgcctgcccaaggtttgatggacacagatagagatggca

SEQ ID NO: 54328 - DNA, 201 bp, Homo sapiens
tgatgatgtcgagggcatctcataggccaaggccttcacctggggaggtgagcagtgggtgagaaccaggcttgggggccgggccaaggtgatttctgatytgatgcagcctccaggaccaaacttgatcctagctctgccagcccctgctccggctgcaccccactgcctgcccaaggtttgatggacacagatagagat

SEQ ID NO: 54329 - DNA, 201 bp, Homo sapiens
gtcttccttcttagctggaaatgccagttttgttttgtgtgtgtgtgtgtgtgtgtgtgtgtgtgtgtgtgtgtgtgtgtgtgtgtgtttttgagacagarccttgctctgttgcgcccaggctggagtgcagtggcaagatctcagctcattgcatcctccgcctcctgggttcaaacaattctcccaccttagtctccc

SEQ ID NO: 54330 - DNA, 201 bp, Homo sapiens
ttgaacctgggaggtggaggttgcagtgagctgagaccgcaccattgcactccagcctggataacaagagtgaaactccatctcaaaaaaaaagaaaaaaragaaatacaaacatagcccttagggtcttagtgctcagcctctaagatcccttagctccctaatcacctagaatggcaagttatggcctggccagtcaga

SEQ ID NO: 54331 - DNA, 201 bp, Homo sapiens
cttagctccctaatcacctagaatggcaagttatggcctggccagtcagactcatatcaatgccaagccaggcctgcctgctgaggatcaacaggaaaggmgaatgcctgtagcaggatctggtgacctagggggccacaggagcagggatgtggacagcatagacaggcgtggtagctccaggggctacctcatcatatg

SEQ ID NO: 54332 - DNA, 201 bp, Homo sapiens
tcaaggcctctgccttccaatgtaaccatcgctgattctccaaccagtcctcttataacacagttgccagactgttactgtccttctggtccttcattatrccagaaacatatgaccaaaagtagaatcaacctgcagatgtctgacactcagactgtcacctgtggggctgtcagagcctgttatggagacattgtgcat

SEQ ID NO: 54333 - DNA, 201 bp, Homo sapiens
gggggtgcgcttcgaaggaaagcgggctgcgtgggggcaccgtcgattgcacaggacgcggtcccggctcgcgtagccccgcaggcggcgccagagcgcargcccgcctcgtgactccggtccacagtccggccgggcggagctaggggcgggcccctgcgtctctgggcgctggagcgcggcgactatcacgccgcgtgg

SEQ ID NO: 54334 - DNA, 201 bp, Homo sapiens
cagtgagatccttcgtggtgtttttggttaacgtcttcacttgcaacatgcactaatgtgaagtgacctttcccttctaggtcttgcaggtggaacagatrtgcccttttcagaggttgtgaagttagctccaaatcccagactagctgctaccccaagcccgggagcttctcaggtgagagaccatcagaatttgtttgt

SEQ ID NO: 54335 - DNA, 201 bp, Homo sapiens
gtcagtgtcaggaggtcccagtgatgatgtcgagggcatctcataggccaaggccttcacctggggaggtgagcagtgggtgagaaccaggcttgggggcmgggccaaggtgatttctgatctgatgcagcctccaggaccaaacttgatcctagctctgccagcccctgctccggctgcaccccactgcctgcccaaggt

SEQ ID NO: 54336 - DNA, 201 bp, Homo sapiens
taactggtatgatttcttttttattggtgtaaccctgattcatacactggagaattggggtaaaggatggattttatccagataaactggctagaatgtamttcagagggggctgagccagaccaaggggcagagtgggagggtcgggggttagagacaatggtcagtgtcaggaggtcccagtgatgatgtcgagggcat

SEQ ID NO: 54337 - DNA, 201 bp, Homo sapiens
ttgttaaaaataactggtatgatttcttttttattggtgtaaccctgattcatacactggagaattggggtaaaggatggattttatccagataaactggstagaatgtacttcagagggggctgagccagaccaaggggcagagtgggagggtcgggggttagagacaatggtcagtgtcaggaggtcccagtgatgatg

SEQ ID NO: 54338 - DNA, 201 bp, Homo sapiens
tccctgaaactggaggccagctaagtgtgtgtcttccaaaagcttttttcagtcctccaatacctatctaaccaattccctatattacattctttttgttmaaaataactggtatgatttcttttttattggtgtaaccctgattcatacactggagaattggggtaaaggatggattttatccagataaactggctagaa

SEQ ID NO: 54339 - DNA, 201 bp, Homo sapiens
tgcagggtccccgagtccctgaaactggaggccagctaagtgtgtgtcttccaaaagcttttttcagtcctccaatacctatctaaccaattccctatatwacattctttttgttaaaaataactggtatgatttcttttttattggtgtaaccctgattcatacactggagaattggggtaaaggatggattttatccag

SEQ ID NO: 54340 - DNA, 201 bp, Homo sapiens
attgcactccagcctggataacaagagtgaaactccatctcaaaaaaaaagaaaaaaaagaaatacaaacatagcccttagggtcttagtgctcagcctcyaagatcccttagctccctaatcacctagaatggcaagttatggcctggccagtcagactcatatcaatgccaagccaggcctgcctgctgaggatcaaca

SEQ ID NO: 54341 - DNA, 201 bp, Homo sapiens
tagacactgccaactcggcctgtgtgggttctgcataccgagcttttcatggtaggttgatggagggagacagctatctctggaagtggccaggacatggrgtgggctgaggagggtggaaaggggagagtgaggtgtacccagtctttggggacattggagtcttggggacttcagcttcatttttctagctcccagcag

SEQ ID NO: 54342 - DNA, 201 bp, Homo sapiens
ctggattagggcccacccctaatgactttatttttaacttaattacctctttaaagaggtaatatctgtctttatcttcaaatacactcacattctgagawactggggtttaggacttccacatataaatttagggtagacacacttcagcccataataatgttttaatatgtagtatagcaattatcccctccttgcttt

SEQ ID NO: 54343 - DNA, 201 bp, Homo sapiens
gtcctccaatacctatctaaccaattccctatattacattctttttgttaaaaataactggtatgatttcttttttattggtgtaaccctgattcatacamtggagaattggggtaaaggatggattttatccagataaactggctagaatgtacttcagagggggctgagccagaccaaggggcagagtgggagggtcgg

SEQ ID NO: 54344 - DNA, 201 bp, Homo sapiens
gcgtgtctgattcagtggttctgtacagtcatggtgggttctgtttttcttcttaggcactggatatcatcttggagaagatgaaggcttcgggcttcgamttctctcaagtcctagccttgtccggggcgggccaggttcgtttgcagcagactctgtctgccatgtgagggtgactgtcctgggcaatggtgtgggtgt

SEQ ID NO: 54345 - DNA, 201 bp, Homo sapiens
ctatccccaggctgtctcactggcagactcggtgatttgctaggaagtccaaaggtggcagccaatgagagcatctgttgacaccaggtcctcatgggaargtggagttggcatgactcctgggatcaggctcagcctcagctggtgtcaacactcccaggctcagaggacttacaaaaaacttccaggtactggagctac

SEQ ID NO: 54346 - DNA, 201 bp, Homo sapiens
cagggattcctgttctccttctatccccaggctgtctcactggcagactcggtgatttgctaggaagtccaaaggtggcagccaatgagagcatctgttgwcaccaggtcctcatgggaaagtggagttggcatgactcctgggatcaggctcagcctcagctggtgtcaacactcccaggctcagaggacttacaaaaaa

SEQ ID NO: 54347 - DNA, 201 bp, Homo sapiens
ccctctgaggaatggctcaccacagtagaacctctgtgtccttttcaggtgcttgcagatgtgtttgatgccccggtgtatgttatagacactgccaactyggcctgtgtgggttctgcataccgagcttttcatggtaggttgatggagggagacagctatctctggaagtggccaggacatggggtgggctgaggaggg

SEQ ID NO: 54348 - DNA, 201 bp, Homo sapiens
gcgttagtagtgggccttacaccatggcctctcccatatctgttatgtctaagagccagagactggataggaaggacagcctccattcccactcctgcagraatggggagctcttagctcacactccaggaagcagctctgttgccttacagctcacactgtgagtgggatctgtctcacatgcaggtgaattctatggct

SEQ ID NO: 54349 - DNA, 201 bp, Homo sapiens
ctggggcagatctccaagtcagcggatggagcttaagcctgtgcctttgccctccttcccaggactgtttctccatcagcgactgcccggtgtggatggamtccagcaccacagcccagtgccgccagctggaggctgctgtgggtggtgctcaggctctcagctgcctcacggggtcccgtgcctatgaggtaggctgag

SEQ ID NO: 54350 - DNA, 201 bp, Homo sapiens
ttgtaacccggggattacaacaggacttacgttttgggtaggtttgaagctgaaagaagtcagtgcatgtaaggcacttagtgtagtgcctggcaatattwaaaaaaaaaaaaaaaggaaaaaaaataatagtgtctctgttccacaggttcaaccttgtccccaggggtgattgtgattaggccagcttgggttacatga

SEQ ID NO: 54351 - DNA, 201 bp, Homo sapiens
cacggaagtatatactggaaggctggagcccagcaggcactgacaagcttatcaccagacctccggctacaccagcagcttcaggtaactgtggctacgtkgtgtgagtgtgagaaacttctgcagagtcccaagtcctgtgggtcctgaagcctgctcatctcagtgttgcagctgtgctcacgcgccctcaccagaaga

SEQ ID NO: 54352 - DNA, 201 bp, Homo sapiens
ttgggttcctaagaatttatattccttttccagcgttttacagggaaccaaattgcaaaaatttaccagcagaaccccgaggcctactcacatacagaggytggttaaatgttcctgtttgattgaaagtcacagttgaattcttttcataatatgttagaatagatacatcttacgtgcagtgactgaaaacgttgataa

SEQ ID NO: 54353 - DNA, 201 bp, Homo sapiens
ttcagtcctccaatacctatctaaccaattccctatattacattctttttgttaaaaataactggtatgatttcttttttattggtgtaaccctgattcawacactggagaattggggtaaaggatggattttatccagataaactggctagaatgtacttcagagggggctgagccagaccaaggggcagagtgggaggg

SEQ ID NO: 54354 - DNA, 201 bp, Homo sapiens
gaggatgcggggggtgcagggggtggtctggttgcaagctccggaggcatagtgggtgacctgcctctggggggatcacatgaggtcatggaggtgttgtrgagccagcaacaggcactctggcccctgggtcctgatccaggccacctgctgccctgtgtgttcccaggccaggctgggtgtgcacatggctgtgctcct

SEQ ID NO: 54355 - DNA, 201 bp, Homo sapiens
ctgagtgtctgagcaggctgtgtctgctcactttcctatgtggttaacgcaggagggctaccaggcacatgattggcatagagtcagtattttctttggawatgtataggactgggcatttgtgtccccagctgtggcccttcagccagagcctctgtcacaggaacccaggttcattcctggctccacagttgctgaagc

SEQ ID NO: 54356 - DNA, 201 bp, Homo sapiens
gcacctttttaatcttagaaattaacatgtggtttattatttaatgatttgaggttccagattattctgcagcattagccattaatgtaggctttgggtaraggggtgaaaaccctccctaaattctgtgtgtggaacgaagtttgcctgacagaggacaggaggtgataacattctctccacagttccaaaggcccatga

SEQ ID NO: 54357 - DNA, 201 bp, Homo sapiens
tccggatggaaatgcagcttccctaagccctttctcatagggcttttggtttttgtctcttttgaacttggcagttttatggcccatcagaaactgtagaraatgaatgctctcccgaggagtctgctcatggtattccagctgctcctatctgagatgcacagtctccaccattacttgggccttttgttcaaagtttcc

SEQ ID NO: 54358 - DNA, 201 bp, Homo sapiens
cagctgggccctccactctgccccccttcactcacctgagatgtcacctcctcatttcacctgggcaggtgacaccatcagcatcccagcccacctctgtytgcctccaccttggcccagtggaggaggagttctctccacccatgctctgggttccctgtcctttcccatcctcagggaagccttgggagaaggaggatg

SEQ ID NO: 54359 - DNA, 201 bp, Homo sapiens
agacctttccttgaaaagttagatgagattgagaaatccctgggggctgacctggaaacctaagggacatggagagtggttcctggtcagtgtgttgctgstagttccaggccccctgggaggtctttgagcagcagatttccaagctaactgtagtgtttgagttgatgaggaatatttggaggaggtgtggtgccgtgt

SEQ ID NO: 54360 - DNA, 201 bp, Homo sapiens
gcagcagatttccaagctaactgtagtgtttgagttgatgaggaatatttggaggaggtgtggtgccgtgtgtttccaagggcccctcttatctctggttytctggttctagaacaacacaagcatatataccttccatgaagaaagagctccaggtacaagttgtggcaagagaattatctgctctgtgccagatttgtg

SEQ ID NO: 54361 - DNA, 201 bp, Homo sapiens
tttccaagctaactgtagtgtttgagttgatgaggaatatttggaggaggtgtggtgccgtgtgtttccaagggcccctcttatctctggttctctggttstagaacaacacaagcatatataccttccatgaagaaagagctccaggtacaagttgtggcaagagaattatctgctctgtgccagatttgtgcattttca

SEQ ID NO: 54362 - DNA, 201 bp, Homo sapiens
atgcctgccctggaaggccacatcttctgcaacccggttgactcccagcactacatggcactcctgtggtgagcttgggtgttggttggcaccattccctrggtgaggaggtgtgggcaggtctggcaccatcttgaggaccccaagtcattccactaagctctggaatgactccctccactttcccgggctctgctgggc

SEQ ID NO: 54363 - DNA, 201 bp, Homo sapiens
ttgttcttgcaggactcagggcggtgttcatgtgcacaaggatgggctgacggtcacttctccagtactaatgtgggtccaggtaagcgcagggattcctrttctccttctatccccaggctgtctcactggcagactcggtgatttgctaggaagtccaaaggtggcagccaatgagagcatctgttgacaccaggtcct

SEQ ID NO: 54364 - DNA, 201 bp, Homo sapiens
ttccagagtcatccaccatagggtttctcctggctttgcaatggtctgcctgccctgaggctctggtctacattctctgttgttcttgcaggactcagggyggtgttcatgtgcacaaggatgggctgacggtcacttctccagtactaatgtgggtccaggtaagcgcagggattcctgttctccttctatccccaggct

SEQ ID NO: 54365 - DNA, 201 bp, Homo sapiens
tcttatctagaaggcttctttagaagatgcttctgagaattgccacatctgggccactctgggcaatttgcctgtcttctctttccatctttgcagccctygtgcctgttcaatcaacagttcccacttggggttggggaaggttctccttcatctggacatttccagagtcatccaccatagggtttctcctggctttgc

SEQ ID NO: 54366 - DNA, 201 bp, Homo sapiens
taggaaagagctagtaggttgatctcagtgaccagaaggaagtttagaggactctgagacctttccttgaaaagttagatgagattgagaaatccctgggrgctgacctggaaacctaagggacatggagagtggttcctggtcagtgtgttgctgctagttccaggccccctgggaggtctttgagcagcagatttccaa

SEQ ID NO: 54367 - DNA, 201 bp, Homo sapiens
tttctatgggcttagactttcatttctcttggctggatacttaggaattgaatggctagatcacatggttatctaatagcatcttggtgtggattctgagmctggttttctctttcctaacacatagttaaaagggttggattttatcagatcagctctttgcactagagtcttctaggggtgaggtgggtggggagaggg

SEQ ID NO: 54368 - DNA, 201 bp, Homo sapiens
cagcatcccagcccacctctgtctgcctccaccttggcccagtggaggaggagttctctccacccatgctctgggttccctgtcctttcccatcctcaggraagccttgggagaaggaggatgttttaggaaagagctagtaggttgatctcagtgaccagaaggaagtttagaggactctgagacctttccttgaaaagt

SEQ ID NO: 54369 - DNA, 201 bp, Homo sapiens
cggtaaaccagcaacctccagtgtgagtgtcatagccatcgggaacatgtcacattgctgcagaaatcctgtttatggccagtttctttaaggcctgtttrtgacaggcttagggcctgttcccagcacccactagacttagacaaccactgatctccttttctcagtatagatgaatttgcgtcttctagtctgttccta

SEQ ID NO: 54370 - DNA, 201 bp, Homo sapiens
aagagtgtggacagaacgggggtagagaatgcagggcaggagcccagagccatggatatggcttcagaatggagcctgggatgctctgagcctcgtgggarttcatgggaagttttcgagggctgttgtatgccaggctttattctggtttcaggagagagagtgactaaggagtgctgttaagcttccctcacaatctgg

SEQ ID NO: 54371 - DNA, 201 bp, Homo sapiens
agcattcttttcaagaagcagagaaacaggctgtggctgattatctgcagcaggaacatgtccgtaaggcacagatcgcttatgccattgtttttggtttwggaatgccttgagtggttttccgccctggatgggccaggtgttccttgccctcattccggtaaaccagcaacctccagtgtgagtgtcatagccatcggg

SEQ ID NO: 54372 - DNA, 201 bp, Homo sapiens
agctgggaggaggttgctgcaggaacccttggatgagcctaagtgtgagaagagtgtggacagaacgggggtagagaatgcagggcaggagcccagagccrtggatatggcttcagaatggagcctgggatgctctgagcctcgtgggagttcatgggaagttttcgagggctgttgtatgccaggctttattctggtttc

SEQ ID NO: 54373 - DNA, 201 bp, Homo sapiens
gaaacaaagcattcttttcaagaagcagagaaacaggctgtggctgattatctgcagcaggaacatgtccgtaaggcacagatcgcttatgccattgtttktggttttggaatgccttgagtggttttccgccctggatgggccaggtgttccttgccctcattccggtaaaccagcaacctccagtgtgagtgtcatagc

SEQ ID NO: 54374 - DNA, 201 bp, Homo sapiens
aaaataaattgcagttgatgccagtgaggagggaaagctgggaggaggttgctgcaggaacccttggatgagcctaagtgtgagaagagtgtggacagaaygggggtagagaatgcagggcaggagcccagagccatggatatggcttcagaatggagcctgggatgctctgagcctcgtgggagttcatgggaagttttc

SEQ ID NO: 54375 - DNA, 201 bp, Homo sapiens
tagagctgagagccacaaacagagttttgcccacatatttattgacagtaagcctgtgataaacattgtttctaaagattatagattagctgaaagcattycttatgggaaacaaagcattcttttcaagaagcagagaaacaggctgtggctgattatctgcagcaggaacatgtccgtaaggcacagatcgcttatgcc

SEQ ID NO: 54376 - DNA, 201 bp, Homo sapiens
tcatgagatttgtgagcttctagaatcaaaaccccgaaaaaaataaattgcagttgatgccagtgaggagggaaagctgggaggaggttgctgcaggaacycttggatgagcctaagtgtgagaagagtgtggacagaacgggggtagagaatgcagggcaggagcccagagccatggatatggcttcagaatggagcctg

SEQ ID NO: 54377 - DNA, 201 bp, Homo sapiens
ccatccattaaaaatgtataattaaaggtactttgccagatatagacctatagctgtgaaactaccaccacaatcaagatacagaatgtttatatcacccyccaaaagatcgcttttttccctgcttaccgagacaagctcggttgtggagactccaacgcaccagcactagaggaatgaagacaaagacccagaaataaa

SEQ ID NO: 54378 - DNA, 201 bp, Homo sapiens
atggtattccagctgctcctatctgagatgcacagtctccaccattacttgggccttttgttcaaagtttccacttccctctccaattttttttcatgctktgtgtgtgtcagaagcattcagtagcgtagggtatgtggaagtgaggcacctctcactgtttctttcctttacagagaatttctttggtcagtagctttg

SEQ ID NO: 54379 - DNA, 201 bp, Homo sapiens
tctgtggcttctgaggagccagctttcctgacgccctgagagtgtcctggttggttctgaggccacacatccacttcccttgtaaccagaaggaaatgccmaggagatagaggaaggaaatcagggcacacattccccagcatgtggattccggatggaaatgcagcttccctaagccctttctcatagggcttttggttt

SEQ ID NO: 54380 - DNA, 201 bp, Homo sapiens; identical to SEQ ID NO: 12051

SEQ ID NO: 54381 - DNA, 201 bp, Homo sapiens
gtacagacccttagggtggcattgaaaatccatcatctatttctctggctagtgctcagggtctgtggcttctgaggagccagctttcctgacgccctgaragtgtcctggttggttctgaggccacacatccacttcccttgtaaccagaaggaaatgccaaggagatagaggaaggaaatcagggcacacattccccag

SEQ ID NO: 54382 - DNA, 201 bp, Homo sapiens
ggcagcatgtgtcccggggtgggggctcagggccagctcactcgcaggggccagggctagtggggcaatatctactaaagttttcttacagggggacttgygcaggagggaggtggagcctgacctcagggatggggtgagaaagtgtcaattggcacttgtaggcaagcatagaatagcagacaggttgttcccgcttct

SEQ ID NO: 54383 - DNA, 201 bp, Homo sapiens
tgaatggaagatctgagtgtctgagcaggctgtgtctgctcactttcctatgtggttaacgcaggagggctaccaggcacatgattggcatagagtcagtrttttctttggaaatgtataggactgggcatttgtgtccccagctgtggcccttcagccagagcctctgtcacaggaacccaggttcattcctggctccac

SEQ ID NO: 54384 - DNA, 201 bp, Homo sapiens
gttaaagagcccagctatgagtttcaaatctgggctgttgtttaaaaagatcacacacagacacacacatacacacacgaatggacaatgagagttccttmctctgtgcccaccttttcctggagacaggttgcagcattccctggggatgtggaggttcgagcactaattgaaggacaattcatggccaagaggattcac

SEQ ID NO: 54385 - DNA, 201 bp, Homo sapiens
ttctggacatttcgtagacatgaatatatataatatgtgacagccttcttttacttagcataatgttttctttttaaaaatttttcatagctttttgcttrtttcaaataccaacttgaaccagatacctggcataatgttttcaaagttcatccatgtcatagcgtgtgtcagtacttcattcctttttgtggttcagta

SEQ ID NO: 54386 - DNA, 201 bp, Homo sapiens
aaactcatgggtccagtcagcaagcaccagctccctccctcagagctatgccctcttctgcagctttaaaaatggctccctcatgagagagaagatccgcracgagtctgtatcccgttcctggagcgatttctctaaggcactgcagtccacagagatgggcaacggtggaaacctgggtaggccagttggtggtgccca

SEQ ID NO: 54387 - DNA, 201 bp, Homo sapiens
tgattctggacatttcgtagacatgaatatatataatatgtgacagccttcttttacttagcataatgttttctttttaaaaatttttcatagctttttgyttgtttcaaataccaacttgaaccagatacctggcataatgttttcaaagttcatccatgtcatagcgtgtgtcagtacttcattcctttttgtggttca

SEQ ID NO: 54388 - DNA, 201 bp, Homo sapiens
ttaaaatgcctttcaggtaaaggttgttgctgttgatgcagagttgaatgtcttctatgaggaaagtgtgcattttgacagagatcttccagaatttgggyatgtacttgatgtgcatgtgtgtgtgatgggggtgttggttttggggtcctcccgcaaacttttgtattcgcagaccgcactgttgaggctttgccaaat

SEQ ID NO: 54389 - DNA, 201 bp, Homo sapiens
aggctgctgtgggtggtgctcaggctctcagctgcctcacggggtcccgtgcctatgaggtaggctgaggatgcggggggtgcagggggtggtctggttgyaagctccggaggcatagtgggtgacctgcctctggggggatcacatgaggtcatggaggtgttgtggagccagcaacaggcactctggcccctgggtcct

SEQ ID NO: 54390 - DNA, 201 bp, Homo sapiens
ggactgtttctccatcagcgactgcccggtgtggatggactccagcaccacagcccagtgccgccagctggaggctgctgtgggtggtgctcaggctctcmgctgcctcacggggtcccgtgcctatgaggtaggctgaggatgcggggggtgcagggggtggtctggttgcaagctccggaggcatagtgggtgacctgc

SEQ ID NO: 54391 - DNA, 201 bp, Homo sapiens
gggcagtgtgaccgccagccctggggcagatctccaagtcagcggatggagcttaagcctgtgcctttgccctccttcccaggactgtttctccatcagcractgcccggtgtggatggactccagcaccacagcccagtgccgccagctggaggctgctgtgggtggtgctcaggctctcagctgcctcacggggtcccg

SEQ ID NO: 54392 - DNA, 201 bp, Homo sapiens
attttatattgttaacaggcattacattgcacttaatatgtaactcaaatgaaaagtatacagtgaaaagtctttttttttctttttttctttcttttttwgagacagagtctggctctgtcgcgcaggctggagtgcagtggcacgatctcggctcactgcaagttccgcctcccgggttgtcctccattaggaaatggt

SEQ ID NO: 54393 - DNA, 201 bp, Homo sapiens
ggaaacaagtcccttgttagatatgtgatctcaaaatttttgtcccattctgtgggttgtcttttcactttcttgatgatcctttgaagcaatgtttttarttttgataaagtctaatcttcctacttttttccttttgctatttgtgctttggtgcagtattggttaggttttggtatcaattttatatttacttcacta

SEQ ID NO: 54394 - DNA, 201 bp, Homo sapiens
tggacttctagcctccagaactgtgagaaaataaatgcctgttgtttaaaccatctagtttatggtattttgttatagcaacctgagcaaactaatacaaygtatacgtttttgtgtggacatatattttcatttctattgggtatattacctaaaagtggaattgcggggtcacatggtaactctgtgttcaacattttg

SEQ ID NO: 54395 - DNA, 201 bp, Homo sapiens
ttgataagcagacattaacaaatgatatatttgatttgcttttttctcattgtcaggacatttccaaagaggagggaaagaatggaatgtgggaaagagawgtcaggggttctcctgaccagaagggtgagggtgagggtccaggtgggagcactggggactgacgtgttcctgaggccacctgaatggaagatctgagtg

SEQ ID NO: 54396 - DNA, 201 bp, Homo sapiens
tctatctctggatttgctgattctggacatttcgtagacatgaatatatataatatgtgacagccttcttttacttagcataatgttttctttttaaaaawttttcatagctttttgcttgtttcaaataccaacttgaaccagatacctggcataatgttttcaaagttcatccatgtcatagcgtgtgtcagtacttca

SEQ ID NO: 54397 - DNA, 201 bp, Homo sapiens
aaccacaatcaactctctatctctggatttgctgattctggacatttcgtagacatgaatatatataatatgtgacagccttcttttacttagcataatgytttctttttaaaaatttttcatagctttttgcttgtttcaaataccaacttgaaccagatacctggcataatgttttcaaagttcatccatgtcatagcg

SEQ ID NO: 54398 - DNA, 201 bp, Homo sapiens
tcttacgtgcagtgactgaaaacgttgataagcagacattaacaaatgatatatttgatttgcttttttctcattgtcaggacatttccaaagaggagggraagaatggaatgtgggaaagagatgtcaggggttctcctgaccagaagggtgagggtgagggtccaggtgggagcactggggactgacgtgttcctgagg

SEQ ID NO: 54399 - DNA, 201 bp, Homo sapiens
taatatgtttaacatacagcttttgctcactttggtagattgcacaaatgaccacaatactccacccatccctgtacccacaccctttgcaatgtgactgyaattcctcccatcaaggagtcgtttccctacctgttgatttgctttatccagtagaacaggggaagtggcattgtgccagttctaagcctaagcctcaag

SEQ ID NO: 54400 - DNA, 201 bp, Homo sapiens
aggatttgggttcctaagaatttatattccttttccagcgttttacagggaaccaaattgcaaaaatttaccagcagaaccccgaggcctactcacatacrgaggttggttaaatgttcctgtttgattgaaagtcacagttgaattcttttcataatatgttagaatagatacatcttacgtgcagtgactgaaaacgtt

SEQ ID NO: 54401 - DNA, 201 bp, Homo sapiens
atttaatttattttttttatttgagacaggagctggctgtcacccaagctggagtgcagtggtgtgattcagctcactgctatctatgcctcccgggctcragcaatcctccctccttagcctcccaagtagctggaaccacaggtgcgcccctaccatgaccagctaatttttttgtattttttttgtagagatggggtc

SEQ ID NO: 54402 - DNA, 201 bp, Homo sapiens
gcacactactgtgcctggttggggcttacttttaaaagcttttatggtacctactcctatccagagcatgctacattaaactcactttgtggaggtaattrttcattctgtgtaggatttgggttcctaagaatttatattccttttccagcgttttacagggaaccaaattgcaaaaatttaccagcagaaccccgaggc

SEQ ID NO: 54403 - DNA, 201 bp, Homo sapiens
cagtagatatcaaacagatttaatgcttatttttaaaatatttaattattagaaacgaggtctcactgtgttgcccaggctggactcctgggctccagagytcctctcgcttcagcctcctgagtagctgggattacaagcgcacactactgtgcctggttggggcttacttttaaaagcttttatggtacctactcctat

SEQ ID NO: 54404 - DNA, 201 bp, Homo sapiens
ctcgctggagtagaagttttggggatagggccaactctacttgggccacctgaaataacaatatgtggatggggaaaataccccgatccctcacctggtgscttggtcagaacagtcaccgtgctgtgtgaagagcaagggttattcactcagggttgtccagtcctgatgtgggagaggccctccaggaaggcccagaag

SEQ ID NO: 54405 - DNA, 201 bp, Homo sapiens
ttggctatttggggaacaaagattccttgagacatgtgggtgttcctacttagcctcagtttcttcattttactaaatctttgagtgttaccccagatgartcctctgttaccacgattacggtgaggcagccctgccttcaaggaggtctctaggttgaactgctcctagggtgtggggcctcatctggtgacgttagta

SEQ ID NO: 54406 - DNA, 201 bp, Homo sapiens
gtcgtggtccagcctgacctgcagttcctctgcctgagtctcttcactgaaactcatgggtccagtcagcaagcaccagctccctccctcagagctatgcyctcttctgcagctttaaaaatggctccctcatgagagagaagatccgcaacgagtctgtatcccgttcctggagcgatttctctaaggcactgcagtcca

SEQ ID NO: 54407 - DNA, 201 bp, Homo sapiens
gtgaacatcttcctctagagggtcttggctttggctatttggggaacaaagattccttgagacatgtgggtgttcctacttagcctcagtttcttcatttkactaaatctttgagtgttaccccagatgagtcctctgttaccacgattacggtgaggcagccctgccttcaaggaggtctctaggttgaactgctcctag

SEQ ID NO: 54408 - DNA, 201 bp, Homo sapiens
tttgtgaacaggagggacatgcccagtttgtgacaggaagtgatgtgactccaggctctgcaaaagattccttcaggtctggtgacctggagactgtagcrttttcgtggcctgaagggtgggtggctgtgctgggcaggcgggatttacctcaacagagcacctttgctttgtccccgtccctcagggagccatttcttc

SEQ ID NO: 54409 - DNA, 201 bp, Homo sapiens
tgcttccctgttccttggctcttactcccctattgactacagtgatggtgagcctcggggtatggggtgggtgcctgggcagtgtgcatgtggcatgtggstgtgcaagcagtgggagccccacctaccccgagtgggtgccaatcttgtagccctgtcatctgttgccaggaaggaagtgtattcattatcttttaccac

SEQ ID NO: 54410 - DNA, 201 bp, Homo sapiens
gcccagcaggcactgacaagcttatcaccagacctccggctacaccagcagcttcaggtaactgtggctacgtggtgtgagtgtgagaaacttctgcagartcccaagtcctgtgggtcctgaagcctgctcatctcagtgttgcagctgtgctcacgcgccctcaccagaagagctttcaacctcaggcttttggggaga

SEQ ID NO: 54411 - DNA, 201 bp, Homo sapiens
gaagtcagctactgtaaggcaggggaacagacaggcgggtagccctgcgcacatgcacaaccagtgacctggaagcagattatagcccaaaaccttttttwaaaaattgaaatggcccaggcctggtggctcttgccggtaatcccagcactttgggaggccgaggcgagtggatcgcttgagcccaggagttcgagacca

SEQ ID NO: 54412 - DNA, 201 bp, Homo sapiens
caacacggaagtatatactggaaggctggagcccagcaggcactgacaagcttatcaccagacctccggctacaccagcagcttcaggtaactgtggctaygtggtgtgagtgtgagaaacttctgcagagtcccaagtcctgtgggtcctgaagcctgctcatctcagtgttgcagctgtgctcacgcgccctcaccaga

SEQ ID NO: 54413 - DNA, 201 bp, Homo sapiens
cccggggcccccgcgcccctgccctgcgcgcggccgtggggcgccggtgccctcgcccggagatgccctgccaatgccacccgctcgcaagatgcggcctsgaccccgcctggacccagctaccccaggaaactgcaggcgctcctcggcaggacccccggtgcccagaggggccggaggactcggcgggttcctgcgctg

SEQ ID NO: 54414 - DNA, 201 bp, Homo sapiens
ccaggagggtgatgagctctgtgactaagaagtggcaggggcaggtgtggagcccagttctttggcatgtggtctggggtctttctgtgtcttcaggaggstgtgacaccggtgtgtggtcatgtgaccatgtgcttgggtttcccaacagcaacacggaagtatatactggaaggctggagcccagcaggcactgacaag

SEQ ID NO: 54415 - DNA, 201 bp, Homo sapiens
ctacctctcgggcttcccggggcccccgcgcccctgccctgcgcgcggccgtggggcgccggtgccctcgcccggagatgccctgccaatgccacccgctygcaagatgcggcctcgaccccgcctggacccagctaccccaggaaactgcaggcgctcctcggcaggacccccggtgcccagaggggccggaggactcgg

SEQ ID NO: 54416 - DNA, 201 bp, Homo sapiens
cccagatgattcttcagttgttgtaacaccaaccatgtttttatttaatttattttttttatttgagacaggagctggctgtcacccaagctggagtgcaktggtgtgattcagctcactgctatctatgcctcccgggctcaagcaatcctccctccttagcctcccaagtagctggaaccacaggtgcgcccctaccat

SEQ ID NO: 54417 - DNA, 201 bp, Homo sapiens
acatttgtatccaactttaatttttcccagatgattcttcagttgttgtaacaccaaccatgtttttatttaatttattttttttatttgagacaggagckggctgtcacccaagctggagtgcagtggtgtgattcagctcactgctatctatgcctcccgggctcaagcaatcctccctccttagcctcccaagtagct

SEQ ID NO: 54418 - DNA, 201 bp, Homo sapiens
aaaaatatttggagtttatccaggtacgtagtatgacatttgtatccaactttaatttttcccagatgattcttcagttgttgtaacaccaaccatgtttktatttaatttattttttttatttgagacaggagctggctgtcacccaagctggagtgcagtggtgtgattcagctcactgctatctatgcctcccgggct

SEQ ID NO: 54419 - DNA, 201 bp, Homo sapiens
attatgaaggaactcacctatgtttttatctagttcttgtaagatttcagctttcttacataaaaatatttggagtttatccaggtacgtagtatgacatwtgtatccaactttaatttttcccagatgattcttcagttgttgtaacaccaaccatgtttttatttaatttattttttttatttgagacaggagctggct

SEQ ID NO: 54420 - DNA, 201 bp, Homo sapiens
tgctctcccgaggagtctgctcatggtattccagctgctcctatctgagatgcacagtctccaccattacttgggccttttgttcaaagtttccacttccytctccaattttttttcatgctgtgtgtgtgtcagaagcattcagtagcgtagggtatgtggaagtgaggcacctctcactgtttctttcctttacagaga

SEQ ID NO: 54421 - DNA, 201 bp, Homo sapiens
tcacatacagaggttggttaaatgttcctgtttgattgaaagtcacagttgaattcttttcataatatgttagaatagatacatcttacgtgcagtgactraaaacgttgataagcagacattaacaaatgatatatttgatttgcttttttctcattgtcaggacatttccaaagaggagggaaagaatggaatgtggga

SEQ ID NO: 54422 - DNA, 201 bp, Homo sapiens
caaaaatttaccagcagaaccccgaggcctactcacatacagaggttggttaaatgttcctgtttgattgaaagtcacagttgaattcttttcataatatrttagaatagatacatcttacgtgcagtgactgaaaacgttgataagcagacattaacaaatgatatatttgatttgcttttttctcattgtcaggacatt

SEQ ID NO: 54423 - DNA, 201 bp, Homo sapiens
aggtgacattgcggtaaggcgacttcccacacccataggctctttctgtttccacactcacacccacactctgataagtagcagaggtgctgctgagaccsagatcccagggtcccagggtctgggtcccagcaggatctctgctacttatcagagtgtctgccggttccaaaagacagtggagggaggggatgggggcgc

SEQ ID NO: 54424 - DNA, 201 bp, Homo sapiens
ccgaaggaagtcagctactgtaaggcaggggaacagacaggcgggtagccctgcgcacatgcacaaccagtgacctggaagcagattatagcccaaaaccytttttaaaaaattgaaatggcccaggcctggtggctcttgccggtaatcccagcactttgggaggccgaggcgagtggatcgcttgagcccaggagttcg

SEQ ID NO: 54425 - DNA, 201 bp, Homo sapiens
gttttacagggaaccaaattgcaaaaatttaccagcagaaccccgaggcctactcacatacagaggttggttaaatgttcctgtttgattgaaagtcacakttgaattcttttcataatatgttagaatagatacatcttacgtgcagtgactgaaaacgttgataagcagacattaacaaatgatatatttgatttgctt

SEQ ID NO: 54426 - DNA, 201 bp, Homo sapiens
ctcctgcctcagcctcccgagtagctgggactataggtgcccgccaccacgcctggctaatttttttatatttttagtagagacggggtttcaccgtgttwgccaggatggtctcgatctcctgacctcgtgatctgcccgcctcggccttccaaagtgctgggattacaggcgtgagccaccgcacccggcctaattttt

SEQ ID NO: 54427 - DNA, 201 bp, Homo sapiens
gcctcagcctcccgagtagctgggactataggtgcccgccaccacgcctggctaatttttttatatttttagtagagacggggtttcaccgtgttagccargatggtctcgatctcctgacctcgtgatctgcccgcctcggccttccaaagtgctgggattacaggcgtgagccaccgcacccggcctaattttttttta

SEQ ID NO: 54428 - DNA, 201 bp, Homo sapiens
tgaaagagctgctgagcccaggaggtactaacgtttattgagcccatttggtgccaggcattgtgctcatggttttctataccttcctcatttacttttcttttttttttttttttaattttttgagatggagtctcactctgttgcccaggcttgagtgcagcgggacgatctcggctcactgcaacccccacctcgtgg

SEQ ID NO: 54429 - DNA, 201 bp, Homo sapiens
tctataccttcctcatttacttttcttttttttttttttttaattttttgagatggagtctcactctgttgcccaggcttgagtgcagcgggacgatctcrgctcactgcaacccccacctcgtgggttcaaacgatcctcctgcctcagcctcctgagtagctgggattatagatgcaagccaccacacctggctaattt

SEQ ID NO: 54430 - DNA, 201 bp, Homo sapiens
ctccaacctccacctgctgggctcaagcgcttctcctgcctcagcctcctgagttgctgggactacaggcaagcgccaccacatctggctaattttttgtrtttttagtagagatggggtttcaccatgttaggcaggctggtcttgaactcctgacctcaggtgatccgcctgcctcagcctcccaaagtgctgggatta

SEQ ID NO: 54431 - DNA, 201 bp, Homo sapiens
ttcacatgcagttgttaaataaatagctaatgtttacctgcagaaaaggcttgcccttctatcaggaagtgcgggtgaggtggtggtttttttttgttttkttttttttttttttttacttttatcatttaatttttatttttaaaaatgtatatagtaaaaaagctgggttgcggagatgtcggtcagtggattaaaaat

SEQ ID NO: 54432 - DNA, 201 bp, Homo sapiens
tcacatgcagttgttaaataaatagctaatgtttacctgcagaaaaggcttgcccttctatcaggaagtgcgggtgaggtggtggtttttttttgttttgttttttttttttttttacttttatcatttaatttttatttttaaaaatgtatatagtaaaaaagctgggttgcggagatgtcggtcagtggattaaaaatt

SEQ ID NO: 54433 - DNA, 201 bp, Homo sapiens
tgaaatatgtactttattcttttaattagggcttaaaatgttaaaatatttctaaagaggactattttgggactctacagtgtacctctttaatgagaacrcccacagtttaggcctattaaggcataattcctttattttactaaagaattaaaataataaagatttgataattttctttcttttttttttttattgatc

SEQ ID NO: 54434 - DNA, 201 bp, Homo sapiens
tccaaagtgggctgtcagctgagggctctctgccaacagcactcccatcagttgggagaataagttcttcattcccgaggtgaatctggatggcacaccayagcatccgccacaccactgcacctatttacagaagggtctggcagcccagcagcaggggtgggtgcatcttgtaaggaactgtgaagggtctgagattta

SEQ ID NO: 54435 - DNA, 201 bp, Homo sapiens
gtggagtgcttggtacacactcagggcatactgtctgggtttgatccctggctctgccatttacaggcagtgacctgggatacgtcatctggctttctggkgcccccgtattctcatctgtcatagggtcattgtgagtgtaagtacatagcacagtgcctcctattaatacgcagtaaacattattaaagcttgggcttc

SEQ ID NO: 54436 - DNA, 201 bp, Homo sapiens
caactatttgttttaaaatacataacgaatggatgtctttttatcacaaaagattcatgcaaaacagaaatatggaataagaagcaaatgcccccttcatwtgcctcccagactcctttccagactgtgacttccttcctgtgagtttctgtgttagattgaatcatacggaattgccaatattgaagaagttttgattta

SEQ ID NO: 54437 - DNA, 201 bp, Homo sapiens
tttctagatggagaggttgagactcagaggctcaggctaaataatctgcccagagtcaagcaaggtcatagatggtggagggggctcaaacccattcctctctggctctgaagctgctgttttctttctcctccacaatgtgacctttctcgggaaggatttagttggttcttgctcctcaaaattgacattgctgctgga

SEQ ID NO: 54438 - DNA, 201 bp, Homo sapiens
ggtctctggttttcctaggcagaggaccctgcggccttccgcagtgtttgtgtccctgggtacttgagattagggagtggtgatgactcttaacgagcatkctgccttcaagcatctgtttaacaaagcacatcttgcaccgcccttaatccatttaaccctgagtggacacagcacatgtttcagagagcacagggttgg

SEQ ID NO: 54439 - DNA, 201 bp, Homo sapiens
gtcatcaccacattttgggttgtacctgagagatgtttctgaccccagtaaatggggggtttatgtaagacactctgtctggaaactgtaactgtcagagytggcgttggattcagtggcagatgatggcactacatgttggattatgaatggaaagctttgtataaagtaggaagttcatctcaatcttctgatggagga

SEQ ID NO: 54440 - DNA, 201 bp, Homo sapiens
gctgttgggtacacctcccagatggggtggtggccgggcagaggggctcctcacttcccagaaggggcggccgggcagaggcaccccccacctccctcccrgacggggcggctggccgggtttttttttgtttaatcaggggttggatcagtactagttagttttagttcaccagtagttgcagtgtcttgggatcaggat

SEQ ID NO: 54441 - DNA, 201 bp, Homo sapiens
caggcaccggggacacaaaggagaacaaaacattggtggcccttgctccccagagcctgctgtctaggagggagagggacagtagacgactgaatgagcaygtacatgaatgcagcaggtgctaaggctaggtggcagaagaacagagtgccgcaaaggaaagcagctggtgggcgggttggagacttaccctgggtgggg

SEQ ID NO: 54442 - DNA, 201 bp, Homo sapiens
gtatgagccactgtgcccagcctattatatttttttggagacaaagtctggctttgtcaggcaggaatacacccaggctggagtacagtggtgtgatcacrgctcattgcagccttgaattcctgggctcaagcaatcctcccacttcaacctcccgagtagctgggaccacaggcatgcatcaccgtttccagctaattt

SEQ ID NO: 54443 - DNA, 201 bp, Homo sapiens
ctgcctccctttaacttgctaattgtgaggcttaaaaagaatccttgaccaaaatggctttataatctaataggaaatctgggggtagaattggttcagtrgttcaacatgagaactctggtcatgttccctgcaattccttaggtcagcagtggacaatgggaacataatgtgagccacatatgtcatttaaaatattcg

SEQ ID NO: 54444 - DNA, 201 bp, Homo sapiens
attggcacttgtaggcaagcatagaatagcagacaggttgttcccgcttctcagctgtgtccacaatagcctgaccttttggccaggacctgtaagacttsggaatggtctttctgaaaccctaagctccaagctgcagatgagctgtcctgagctctggactgcaaagacataggcagtgcaaggtctggggacatgaat

SEQ ID NO: 54445 - DNA, 201 bp, Homo sapiens
tgaggcttaaaaagaatccttgaccaaaatggctttataatctaataggaaatctgggggtagaattggttcagtagttcaacatgagaactctggtcatsttccctgcaattccttaggtcagcagtggacaatgggaacataatgtgagccacatatgtcatttaaaatattcggttgcctcattttttaaagtaaaag

SEQ ID NO: 54446 - DNA, 201 bp, Homo sapiens
taaagcttcaacatgagttttggaggggacacatattcaaaccatagcaactggcatggagagggcagacccagggccgggggaggcaaaaggaggagaargggatttctgacaacttgagctgtagaataatcagcattaggatgtcagtgagttccccttacaggtggcgttggaatggtctaagggtctgtaaggagg

SEQ ID NO: 54447 - DNA, 201 bp, Homo sapiens
acccaggaggcggaggttgcagtgagccaagatcaccccattgcactccagcctgggagacagagcgagacttcatctcaaaaacaacaacaacaacaacmacaacaaaaagaagaaatagaacactagaaccttggagtcttgctgtgctcctcttccactgtatcctcatcttcccctcatccctgcagagatcatttc

SEQ ID NO: 54448 - DNA, 201 bp, Homo sapiens
aaagtaaaagtaaaaataaaaataaatgattaaaattaattttaatacattttatttaatccactatatctgaaatattgtcatgtcaacgtgataaattwgaagttactaatgtggggccggatgcagtggctcacacctgtaatcccagcactttgggaagccaaggtgggcagattgcttgagcccaggagttcgaga

SEQ ID NO: 54449 - DNA, 201 bp, Homo sapiens
tgctcatcagggagaaaaatactggcctatccctcccctatcccacacacgcccaacaggctaccacttggtcatatggtcaattctggttgtaggaaagkctagggtagggtctggctctttcattctatctagaaggaggccagcaaggaggaagataattggggaaagttttagggcagcacagcagcgtctgcctca

SEQ ID NO: 54450 - DNA, 201 bp, Homo sapiens
agctgttaattttcattgtactgtgatattccatcacatgattatacaaccatttatccatttgctatggcctgactgtgtctccccaaattcacatgttaaaaacttaatccccaatgtgacagtgttgggagatgggcctgatggaaggtgtttaggtcatgagggctcttgtgtattaatgccactataaaagtgctt

SEQ ID NO: 54451 - DNA, 201 bp, Homo sapiens
ttgatcctgtcagctgaggaggatatatcgcctcaggaccctgtaataattgcattaactgcacaaattgtacagcatgtgtgtttgagcaatgtgaagtrtgggcaccttgaaaaaagaacaggataacagcaattgttcagggaataagagagataaccttaaactctgactgctggtgagctgggcagaacagaacca

SEQ ID NO: 54452 - DNA, 201 bp, Homo sapiens
taccacttggtcatatggtcaattctggttgtaggaaaggctagggtagggtctggctctttcattctatctagaaggaggccagcaaggaggaagataaytggggaaagttttagggcagcacagcagcgtctgcctcatctagagtacggagtggccaatcctctgagctgtatgtgcctcatcactctccctggcctg

SEQ ID NO: 54453 - DNA, 201 bp, Homo sapiens
cgtagcctgtctcttatggttgaggctgcagagatgaaataaactccagtctcccatagtgctcccaggcttattaggaagaggaaattcccacctaatamattttggtcagactggttgatcccaaaaccctgtctcctgataagatgttaccaatgacaatggtgcccgaaacttcattagcaattttaatttcacctc

SEQ ID NO: 54454 - DNA, 201 bp, Homo sapiens
gcaccaagagtaggccccagttgcataatcagttgttaaaatacttggcttccagctgggcgtggtgactcactcctgtaatcccagcactttcggaggcygaggcggatggatcacatgaggtcaggagttagagaccagcctggccaacatggtgaaaccccatctctactaaaaaagaaaaaaacacaaaaattagct

SEQ ID NO: 54455 - DNA, 201 bp, Homo sapiens
actaggattacaggcatgaatcctagtgctaggattaccgcacccaggctgtatggtagttttgttggaatatacaacctaaataaatattttaagagagaaattcaataggtgatggttttgaggcctgacatgtccaacaaggcctttgtttcatcctcccaaatactggctgggtaaaagactctatgttcaaaatac

SEQ ID NO: 54456 - DNA, 201 bp, Homo sapiens
taaaggtctgcaaagacttccaagttccctgaaaatgagactgggtgagcagggcagggttggtgctggagttggtggagtgcctggcaggggtcctccgrctgtcagaagagaaccccagggaacggaacagcccagcatacagggagaagcagttagggcaaaaggcccccatgggctcaggaggagctgatgggattg

SEQ ID NO: 54457 - DNA, 201 bp, Homo sapiens
tgagaggttcaggcacgagaatcacttgaaaccaggaggtggaagcttcagttaatcaagattgcaccactgcacctccagcctgggtaacagagtgagamcctgtctcaaaaaataaaaaaacaaaacttaactttggagcaaattaaaccaaattaagaaggaatggggttggcatgagctcctacttgtgtttacttg

SEQ ID NO: 54458 - DNA, 201 bp, Homo sapiens
gaagctgagatgacctttagagttttacccagttggtctaaggggctgggcctttataccccatgtcaatcagtcatcacatgtgggccaccccaggatgsggtgaggcagctctttatagctaaagcagtctccaaagtgggctgtcagctgagggctctctgccaacagcactcccatcagttgggagaataagttctt

SEQ ID NO: 54459 - DNA, 201 bp, Homo sapiens
gaatagctcaattcctccaacccttcctctaggacatggttttaagtctctgccctgtcatctgatctgcagcaatgacttgtttctcgtccagacacctyatctccttccctagcctcttctcttcctcctcctctcctctgggtagccctgaagccactcctggaggggcccttggatctctgaaggaaggccaggtgg

SEQ ID NO: 54460 - DNA, 201 bp, Homo sapiens
aggctgaggtgggaggattacttgagcccagaaggtggaggttgcagtaagccaagatcacaccactgcactccagcctgggcgacagagaccctgtctcaaaaaaaaaaaaaaaaaagttactaatatgatattttacatttccttttttgcatgaagcttttgaaatttggtgtgcatttaacacttatagttctgggc

SEQ ID NO: 54461 - DNA, 201 bp, Homo sapiens; identical to SEQ ID NO: 12072

SEQ ID NO: 54462 - DNA, 201 bp, Homo sapiens; identical to SEQ ID NO: 12090

SEQ ID NO: 54463 - DNA, 201 bp, Homo sapiens
tggtgctggtcaaggacaatggcgagcctccgcgctcggccaccgccacgctgcacgtgctcctggtggacggcttctcccagccctacctgcctctccckgaggcggccccgacccaggcccaggccgacttgctcaccgtctacctggtggtggcgttggcctcggtgtcttcgctcttcctcttttcggtgctcctgt

SEQ ID NO: 54464 - DNA, 201 bp, Homo sapiens; identical to SEQ ID NO: 12093

SEQ ID NO: 54465 - DNA, 201 bp, Homo sapiens
tggatggtggctctccgcccagatctggcactgctcaggtctacatcgaagtcctggatgtcaacgataatgcccctgaatttgagcagcctttctatagrgtgcagatctctgaggacagtccggtaggcttcctggttgtgaaggtctctgccacggatgtagacacaggagtcaacggagagatttcctattcacttt

SEQ ID NO: 54466 - DNA, 201 bp, Homo sapiens; identical to SEQ ID NO: 12095

SEQ ID NO: 54467 - DNA, 201 bp, Homo sapiens; identical to SEQ ID NO: 12097

SEQ ID NO: 54468 - DNA, 201 bp, Homo sapiens
cccaggacccgcacctgcccctcacatccctggtctccatcaacgcggacaacggccacctgttcgccctcaggtctctggactacgaggccctgcagggkttccagttccgcgtgggcgcttcagaccacggctccccggcgctgagcagcgaggcgctggtgcgcgtggtggtgctggacgccaacgacaactcgccct

SEQ ID NO: 54469 - DNA, 201 bp, Homo sapiens
gaccgtgctgatcgccgatgtcaatgacaacgctcccgccttcacccaaacctcctacaccctgttcgtccgcgagaacaacagccccgccctgcacatcsgcagcgtcagcgctacagacagagactcaggcaccaacgcccaggtcacctactcgctgctgccgccccaggacccgcacctgcccctcacatccctggt

SEQ ID NO: 54470 - DNA, 201 bp, Homo sapiens
ccgagcagcgaccgaccggggccgccctgctcctcctgcacagccgcaccgccacgaacaggagcaccgagaagaggaagagcgacgacactgaggccaargccaccaccaggtagacagtgagcgagtcggcctgggcctgggccggggccgcctccgggagaggcaggtagggctgggagaagccgtccaccaggagca

SEQ ID NO: 54471 - DNA, 201 bp, Homo sapiens
gacttcactacctgtgctctggggtaggaagttggggataattggtttcagaaatttgaacttatttgacctggagcctccagtcacacacacctcatagrggtagctctgggacagggtcccggtgccactcacgtccaccagatgtcctggaaaggggccctcaggcaccgagcagcgaccgaccggggccgccctgct

SEQ ID NO: 54472 - DNA, 201 bp, Homo sapiens
taagtgttatcacttgattcgaaagggtcagaagaccagttttttagtatcctttcctcattcatcctggagaggattgtgcaggcacattaatattgtgrccaatcacagaatctgggaatatgaagctataattttttaattaatgtcacaaagctctagtgcaatctagttgaatgcagatgcctgtgcccaaataat

SEQ ID NO: 54473 - DNA, 201 bp, Homo sapiens; identical to SEQ ID NO: 12094

SEQ ID NO: 54474 - DNA, 201 bp, Homo sapiens
aagtatcagagagcagtcctcctgggactacgtttcctctgaagaatgccgaagacttagatgtaggccaaaacaatattgagaactatataatcagcccyaactcctattttcgggtcctcacccgcaaacgcagtgatggcaggaaatacccagagctggtgctggacaaagcgctggaccgagaggaagaagctgagc

SEQ ID NO: 54475 - DNA, 201 bp, Homo sapiens
ggagctcggtctgttcggcgtgtgggcgcacaatggcgaggtgcgcaccgccaggctgctgagcgagcgcgacgcggccaagcacaggctggtggtgctgrtcaaggacaatggcgagcctccgcgctcggccaccgccacgctgcacgtgctcctggtggacggcttctcccagccctacctgcctctcccggaggcggc

SEQ ID NO: 54476 - DNA, 201 bp, Homo sapiens
acaaagcgctggaccgagaggaagaagctgagctcaggttaacactcacagcactggatggtggctctccgcccagatctggcactgctcaggtctacatrgaagtcctggatgtcaacgataatgcccctgaatttgagcagcctttctatagagtgcagatctctgaggacagtccggtaggcttcctggttgtgaagg

SEQ ID NO: 54477 - DNA, 201 bp, Homo sapiens
tccagttccgcgtgggcgcttcagaccacggctccccggcgctgagcagcgaggcgctggtgcgcgtggtggtgctggacgccaacgacaactcgcccttygtgctgtacccgctgcagaacggctccgcgccctgcaccgagctggtgccccgggcggccgagccgggctacctggtgaccaaggtggtggcggtggacg

SEQ ID NO: 54478 - DNA, 201 bp, Homo sapiens
acaacagccccgccctgcacatccgcagcgtcagcgctacagacagagactcaggcaccaacgcccaggtcacctactcgctgctgccgccccaggaccckcacctgcccctcacatccctggtctccatcaacgcggacaacggccacctgttcgccctcaggtctctggactacgaggccctgcaggggttccagttcc

SEQ ID NO: 54479 - DNA, 201 bp, Homo sapiens
tcaatcccttgacaggagaaattgaactaaaaaaacaactcgatttcgaaaaacttcagtcctatgaagtcaatattgaggcaagagatgctggaaccttytctggaaaatgcaccgttctgattcaagtgatagatgtgaacgaccatgccccagaagttaccatgtctgcatttaccagcccaatacctgagaacgcgc

SEQ ID NO: 54480 - DNA, 201 bp, Homo sapiens
ccccaataactttgggttcaatattcagtgaccatagttgacttttacattccataggtattttattttgtggcatttccatgccaatgtttatttccccyaatttgtgtgtatgtaatattgtacggatttactcttgatttttctcatgttctttctccctttgttttaaagtgaacatttacctttattcctggttct

SEQ ID NO: 54481 - DNA, 201 bp, Homo sapiens; identical to SEQ ID NO: 12096

SEQ ID NO: 54482 - DNA, 201 bp, Homo sapiens; identical to SEQ ID NO: 12099

SEQ ID NO: 54483 - DNA, 201 bp, Homo sapiens; identical to SEQ ID NO: 12098

SEQ ID NO: 54484 - DNA, 201 bp, Homo sapiens; identical to SEQ ID NO: 12100

SEQ ID NO: 54485 - DNA, 201 bp, Homo sapiens
gctcggtgcccgagggcccctttccagggcagatggtggacgtgagcggcaccgggaccctgtcccagagctaccagtacgaggtgtgtctgactggaggmtccgggacaaatgagttcaagttcctgaagccaattatccccaacttcgttgctcagggtgcagagagggttagcgaggcaaatcccagtttcaggaaga

SEQ ID NO: 54486 - DNA, 201 bp, Homo sapiens
ggctggtggtgctggtcaaggacaatggcgagcctccgcgctcggccaccgccacgctgcacgtgctcctggtggacggcttctcccagccctacctgctkctcccggaggcggcaccggcccaggcccaggccgacttgctcaccgtctacctggtggtggcgttggcctcggtgtcttcgctcttcctcttctcggtgc

SEQ ID NO: 54487 - DNA, 201 bp, Homo sapiens
tgctcggtgcccgagggcccctttccagggcagatggtggacgtgagcggcaccgggaccctgtcccagagctaccagtacgaggtgtgtctgactggagrctccgggacaaatgagttcaagttcctgaagccaattatccccaacttcgttgctcagggtgcagagagggttagcgaggcaaatcccagtttcaggaag

SEQ ID NO: 54488 - DNA, 201 bp, Homo sapiens; identical to SEQ ID NO: 12101

SEQ ID NO: 54489 - DNA, 201 bp, Homo sapiens; identical to SEQ ID NO: 12102

SEQ ID NO: 54490 - DNA, 201 bp, Homo sapiens; identical to SEQ ID NO: 12103

SEQ ID NO: 54491 - DNA, 201 bp, Homo sapiens; identical to SEQ ID NO: 12104

SEQ ID NO: 54492 - DNA, 201 bp, Homo sapiens; identical to SEQ ID NO: 12105

SEQ ID NO: 54493 - DNA, 201 bp, Homo sapiens; identical to SEQ ID NO: 12106

SEQ ID NO: 54494 - DNA, 201 bp, Homo sapiens; identical to SEQ ID NO: 12107

SEQ ID NO: 54495 - DNA, 201 bp, Homo sapiens; identical to SEQ ID NO: 12108

SEQ ID NO: 54496 - DNA, 201 bp, Homo sapiens; identical to SEQ ID NO: 12109

SEQ ID NO: 54497 - DNA, 201 bp, Homo sapiens; identical to SEQ ID NO: 12110

SEQ ID NO: 54498 - DNA, 201 bp, Homo sapiens; identical to SEQ ID NO: 12111

SEQ ID NO: 54499 - DNA, 201 bp, Homo sapiens
taagcacggccctggaccgggagaccagatccgaatacaacatcaccatcaccgtcaccgacttcgggacacccaggctgaaaaccgagcacaacataacmgtgctggtctccgacgtcaatgacaacgcccccgccttcacccaaacctcctacaccctgttcgtccgcgagaacaacagccccgccctgcacatcggca

SEQ ID NO: 54500 - DNA, 201 bp, Homo sapiens; identical to SEQ ID NO: 12112

SEQ ID NO: 54501 - DNA, 201 bp, Homo sapiens; identical to SEQ ID NO: 12113

SEQ ID NO: 54502 - DNA, 201 bp, Homo sapiens; identical to SEQ ID NO: 12114

SEQ ID NO: 54503 - DNA, 201 bp, Homo sapiens
gagttcaagttcctgaagccaattatccccaacttcgttgctcagggtgcagagagggttagcgaggcaaatcccagtttcaggaagagctttgaattcasttaagtgttaataaggatctactgaggctagtctcgtttaatttgtggaaagtccttttttactgctttgcccattggaggtgtctccttttattagaaa

SEQ ID NO: 54504 - DNA, 201 bp, Homo sapiens; identical to SEQ ID NO: 12115

SEQ ID NO: 54505 - DNA, 201 bp, Homo sapiens
tgtcgtaccagctgctcaaggccacggagcccgggctgttcggcgtgtgggcgcacaatggcgaggtgcgcaccgccaggctgctgagggagcgcgacgckgccaagcagaggctggtggtgctggtcaaggacaatggcgagcctccgcgctcggccaccgccacgctgcacgtgctcctggtggacggcttctcccagc

SEQ ID NO: 54506 - DNA, 201 bp, Homo sapiens; identical to SEQ ID NO: 12116

SEQ ID NO: 54507 - DNA, 201 bp, Homo sapiens; identical to SEQ ID NO: 12118

SEQ ID NO: 54508 - DNA, 201 bp, Homo sapiens
ttcaatattttatgtgcttatattggccaaaatatggacacaaatatagactaatatgggtaattaccctttggtttatctaaagtgtgttcatgatgacygaggaaaaaaattaaacctatgccatttaaaaaactgactgttcttttccatttgacacaaaaacgttgtttagtaagacatctggtggaacaactattt

SEQ ID NO: 54509 - DNA, 201 bp, Homo sapiens; identical to SEQ ID NO: 12120

SEQ ID NO: 54510 - DNA, 201 bp, Homo sapiens; identical to SEQ ID NO: 12119

SEQ ID NO: 54511 - DNA, 201 bp, Homo sapiens; identical to SEQ ID NO: 12121

SEQ ID NO: 54512 - DNA, 201 bp, Homo sapiens
caagcgcccattatttggccttggtttaccttttcagccttcctttccacttactcttgagacattaagttttgtattcactgtccttcattcattatctmttaatagctatgctttgctctctcagggccttcacacattctacagtcttagcctggcacacttctcctatttcatgtttcagattaaatggtgcacctt

SEQ ID NO: 54513 - DNA, 201 bp, Homo sapiens; identical to SEQ ID NO: 12122

SEQ ID NO: 54514 - DNA, 201 bp, Homo sapiens; identical to SEQ ID NO: 12123

SEQ ID NO: 54515 - DNA, 201 bp, Homo sapiens
ggaggagctgtgcggccccacagagccctgtgtcctacctttccaggtgttactagaaaatcccttgcagttttttcaggcggagctacggattagggacrtaaatgatcattccccagttttcctagacaaagaaatacttttgaaaattccagaaagtatcactcctggaactactttcttaatagaacgtgcccagga

SEQ ID NO: 54516 - DNA, 201 bp, Homo sapiens
cgctaaccctctctgcaccctgagcaacgaagttggggataattggcttcaggaacttgaactcatttgtcccggagcctccagtcagacacacctcgtartggtagctctgggacagggtcccggtgccgctcacgtccaccatctgccctggaaaggggccctcgggcaccgagcagcgacccaccgaggccgccctgc

SEQ ID NO: 54517 - DNA, 201 bp, Homo sapiens; identical to SEQ ID NO: 12125

SEQ ID NO: 54518 - DNA, 201 bp, Homo sapiens
ccatctgccctggaaaggggccctcgggcaccgagcagcgacccaccgaggccgccctgctcctcctgcacagccgcaccgccacgaacaggagcaccgayaagaggaagagcgaagacaccgaggccaatgccaccaccaggtagacggtgagcaagtcggcctgggcctgggccggtgccgcctccgggagaggcaggt

SEQ ID NO: 54519 - DNA, 201 bp, Homo sapiens
agaacgcctggctgtcgtaccagctgctcaaggccacggagcccgggctgttcggcgtgtgggcgcacaatggcgaggtgcgcaccgccaggctgctgagsgagcgcgacgctgccaagcagaggctggtggtgctggtcaaggacaatggcgagcctccgcgctcggccaccgccacgctgcacgtgctcctggtggacg

SEQ ID NO: 54520 - DNA, 201 bp, Homo sapiens
cccaacttcgttgctcagggtgcagagagggttagcgaggcaaatcccagtttcaggaagagctttgaattcacttaagtgttaataaggatctactgagsctagtctcgtttaatttgtggaaagtccttttttactgctttgcccattggaggtgtctccttttattagaaagtaaccatcttattccaattctatgca

SEQ ID NO: 54521 - DNA, 201 bp, Homo sapiens
ttgaactcatttgtcccggagcctccagtcagacacacctcgtattggtagctctgggacagggtcccggtgccgctcacgtccaccatctgccctggaayggggccctcgggcaccgagcagcgacccaccgaggccgccctgctcctcctgcacagccgcaccgccacgaacaggagcaccgaaaagaggaagagcgaa

SEQ ID NO: 54522 - DNA, 201 bp, Homo sapiens; identical to SEQ ID NO: 12128

SEQ ID NO: 54523 - DNA, 201 bp, Homo sapiens; identical to SEQ ID NO: 12129

SEQ ID NO: 54524 - DNA, 201 bp, Homo sapiens; identical to SEQ ID NO: 12130

SEQ ID NO: 54525 - DNA, 201 bp, Homo sapiens; identical to SEQ ID NO: 12132

SEQ ID NO: 54526 - DNA, 201 bp, Homo sapiens; identical to SEQ ID NO: 12131

SEQ ID NO: 54527 - DNA, 201 bp, Homo sapiens
cctcccaaagtgctgagattacaggcgtgagccaccgtgcccggctatgggcatcttttcccacaggaattgacttaaaggacccatccattctgaactcytagtcctcatatttttattctaatgatttatatatcagtacctctagtccctgtgcttaaactgtgttctgctaccttacttagctccacggaggacagt

SEQ ID NO: 54528 - DNA, 201 bp, Homo sapiens
aactgtacaatacaaaatgggcaagatggtaaatgtaatattatgcacttttgctacaataagaaaaagttaacaataaagattaaaagtgtccttttttwaaaaaaagaatgaaagatgattgagtttttttgataggacaagagtctgggatacagtttaagtgactgaaagcgaaaagaaactacatgtgatgttcat

SEQ ID NO: 54529 - DNA, 201 bp, Homo sapiens
ctacctcctgaggttattatgcagattaaatgagtatgtgtgcaccatgtaggccactgcctggcacatgctaagtgctatgtagataaatgctcatcatrtaataagggctctgtgtttctgctcattgtcagcatcattagcagcattattacatgactcagcaatttccttgtgttctgtgtcaatcagcttcatgca

SEQ ID NO: 54530 - DNA, 201 bp, Homo sapiens; identical to SEQ ID NO: 12134

SEQ ID NO: 54531 - DNA, 201 bp, Homo sapiens; identical to SEQ ID NO: 12135

SEQ ID NO: 54532 - DNA, 201 bp, Homo sapiens
tgtgattacaggcatgcaccaccatgcccggctaattttgtatttctagtagagacggggtttctccttgttggtcaggctggtctcgaactcccgacctyaggtgttccgcctggcttggcctcccaaagtgctgagattacaggcgtgagccaccgtgcccggctatgggcatcttttcccacaggaattgacttaaag

SEQ ID NO: 54533 - DNA, 201 bp, Homo sapiens
gtgaatgttgaatgagtgaccatgtactcattgcttttccaaggcttctgcagaacccccaggtcaggccacatcattgaggctgcaggatctctcttcayagcccagtacgactctccgccgtgtccctggttggaaaatccaaacacctatccagcttctggctcctgggaaaagtggagttgtcagcaagagagaccg

SEQ ID NO: 54534 - DNA, 201 bp, Homo sapiens; identical to SEQ ID NO: 12138

SEQ ID NO: 54535 - DNA, 201 bp, Homo sapiens; identical to SEQ ID NO: 12139

SEQ ID NO: 54536 - DNA, 201 bp, Homo sapiens; identical to SEQ ID NO: 12141

SEQ ID NO: 54537 - DNA, 201 bp, Homo sapiens; identical to SEQ ID NO: 12143

SEQ ID NO: 54538 - DNA, 201 bp, Homo sapiens
gtcgcccaggctggagtgcagtggcacgatcttggctcactgcaagctccgcctcccgggttcacgccattctcctgcttcagcctcccgagtagctgggrctaaaggcgcccgccaccacaccaagctaattttttgtatttttagtagagatggggtttcaccgtgttagccaggatggtctcaatctcctgacctcgt

SEQ ID NO: 54539 - DNA, 201 bp, Homo sapiens
gaatcgcctgaacccgggaggtggaggttgcagtgatccaagatcatgccattgcattccagcctgggcaacaagagtgaaactccatctcaaaaaaaaaraagcaagccccagaatgggaaaagattcttgttacacatacagctgacaaaaggttcctataaaacgttgaggacggctgggcgtggtggcttatgccta

SEQ ID NO: 54540 - DNA, 201 bp, Homo sapiens
gtgatggcaccactgcactccatcctgggtgacagagtgacatcctgtctcaaaaaacaaaaacgaaaacaaaagacctgagaggtttacatatatgagcrtgacatgaaagtgaaatgatatgaaaatgaatgatatgaaaatgtcacgccaaaaagcaaagatcatatatttgcatatttaatagaaagatgtcacgga

SEQ ID NO: 54541 - DNA, 201 bp, Homo sapiens
aaagtggaattgtccattgaccaatgaattggtaaacaaaatgtggtctatacatacaatgaaatattattcagccttaaaaaggaagaggaattatgaarcatgttgcagtgcggatgaatcttatcatgatgctaagtgaataagccagacacaaaaaatccaaatgtatcattctacctgtatgaggtactttaagta

SEQ ID NO: 54542 - DNA, 201 bp, Homo sapiens
atgactcttttatcggtttgtcctggattgtttgtttcttttgggcaccttctagtattattttgtgcccagtggaaaatgttgacttttctaatgagccrgtgtaaagcttcattgaatggcctctaaaactgaagaagctacacccaaatccagtatcctttctaattaacagggtatcacattcccaacccagaggtc

SEQ ID NO: 54543 - DNA, 201 bp, Homo sapiens
gatgctggagctctatagccatctcttcgcagtgggtgagcacaactgacctgggaatcttggctggatcctgttgaggagatttccttcctcctcattgyagaacgcagtgggatatcaaagtatgtcatgactcttttatcggtttgtcctggattgtttgtttcttttgggcaccttctagtattattttgtgcccag

SEQ ID NO: 54544 - DNA, 201 bp, Homo sapiens
aatgaattggtaaacaaaatgtggtctatacatacaatgaaatattattcagccttaaaaaggaagaggaattatgaaacatgttgcagtgcggatgaatsttatcatgatgctaagtgaataagccagacacaaaaaatccaaatgtatcattctacctgtatgaggtactttaagtagtcaattcatagagacagaata

SEQ ID NO: 54545 - DNA, 201 bp, Homo sapiens
tgaatttatagccctactgataggtgaaagggctgtttcatttttttttgtttttggttttggtttttttgagacagagtctcactctgtcacctaggctrgggtgcagtggcacgatcttggcttactgcaacctctgcctcctgggttcaagtgattctcctgcctcagcctcccgagtagctgggactacaggcaccc

SEQ ID NO: 54546 - DNA, 201 bp, Homo sapiens
tactgataggtgaaagggctgtttcatttttttttgtttttggttttggtttttttgagacagagtctcactctgtcacctaggctagggtgcagtggcaygatcttggcttactgcaacctctgcctcctgggttcaagtgattctcctgcctcagcctcccgagtagctgggactacaggcacccgccaccacactcgg

SEQ ID NO: 54547 - DNA, 201 bp, Homo sapiens
ttcaaagatgatatacaagtggccaataataggaaaaaatgctcaacttcactaattatgtgggaaatgcaaatcaaaaccactgggtgatatccctttayatccattagaatggctacaattaaaaaaacagaataacaagtgttggcaaggatatagagaaactggaatccttgtgtattactagtgggaatgtaaaat

SEQ ID NO: 54548 - DNA, 201 bp, Homo sapiens; identical to SEQ ID NO: 12148

SEQ ID NO: 54549 - DNA, 201 bp, Homo sapiens; identical to SEQ ID NO: 12149

SEQ ID NO: 54550 - DNA, 201 bp, Homo sapiens; identical to SEQ ID NO: 12150

SEQ ID NO: 54551 - DNA, 201 bp, Homo sapiens; identical to SEQ ID NO: 12152

SEQ ID NO: 54552 - DNA, 201 bp, Homo sapiens
aggctgtgaggtgagtgacgggcttgttttggctgagcgatggggggtttctggggtgggtgatgggtgctgtggggtaagtggcgtttgctaattttagytggataattagcctgttaattttccctcttttcttgcttattttctgcttgtagtatttttgtgacttaaattccaagtgtactttaatatcggatttta

SEQ ID NO: 54553 - DNA, 201 bp, Homo sapiens
acaattaaattgacaactttctttttttaattcatatttatcacgtgccaggcaggcactgaggacttgacaagcttcatcttggttaagtttcccaacayctgtgataaatacctgcattttcattttggaaactacaactaaagtaatattttcatattctcacagtgaaaatgtggcaaagctgcaatgaattcacca

SEQ ID NO: 54554 - DNA, 201 bp, Homo sapiens
gggaggcagagatgggccgatcacttgaggccagagtttaagaccagcctggccaacataatgaaaccccgtgtctactaaaaatacaaaaattagccagkcatgttggcaggcacctgtaatcccagctacttgggaggctgaggcaggagaatcgcttgaacccaggagtcagaggctgcagtgagccaagagcatgcc

SEQ ID NO: 54555 - DNA, 201 bp, Homo sapiens
ccaggcatgttggcaggcacctgtaatcccagctacttgggaggctgaggcaggagaatcgcttgaacccaggagtcagaggctgcagtgagccaagagcrtgccagtgcactccagccttagtgacagagtagactccatctcaaaaaaaaaaaaaaaaaaaaaaagctggacatggtagtgcacgcctgtggtcccagc

SEQ ID NO: 54556 - DNA, 201 bp, Homo sapiens
ctgaggcaggagaatcgcttgaacccaggagtcagaggctgcagtgagccaagagcatgccagtgcactccagccttagtgacagagtagactccatctcaaaaaaaaaaaaaaaaaaaaaaagctggacatggtagtgcacgcctgtggtcccagctacttgggaagctgaggcaggaggatcgcttgagtctgagaggc

SEQ ID NO: 54557 - DNA, 201 bp, Homo sapiens
catgttttatttccattggatggctctcctctagaggcttgatcagagtccacttggatttctttgtttttggaaatgatacttaatagtttgcacaccaygtattttcctacctctctacttttatttttttattttgcatcatattaggtgcactttaatatctggttatctctctccttgtgataaaattgatgattg

SEQ ID NO: 54558 - DNA, 201 bp, Homo sapiens
gagtccacttggatttctttgtttttggaaatgatacttaatagtttgcacaccacgtattttcctacctctctacttttatttttttattttgcatcatrttaggtgcactttaatatctggttatctctctccttgtgataaaattgatgattgggttcagatattgtcagcctactcctccattataaagacccatca

SEQ ID NO: 54559 - DNA, 201 bp, Homo sapiens
actgaagaagctacacccaaatccagtatcctttctaattaacagggtatcacattcccaacccagaggtcatcttcagaatgctaaaagaaaaggagccrcgtgtggaggaggctgaagtctcacatcagaggtgtcaaggtgagtaagttgtacccgggcaaatgtagatatctttgcagggaaccattaccagtctac

SEQ ID NO: 54560 - DNA, 201 bp, Homo sapiens
tctaccatacttttctattccctccattcccccagtgatggcccgtagattgcctcctactcccagtttcccatcaaacactgtaaatgtgctataaatgytaaatgtcctataggggctgccttaagaattttccattggtgaatactcaggaatgggattgcctggtcctggagataagtatacttgactaaatcaacc

SEQ ID NO: 54561 - DNA, 201 bp, Homo sapiens
ttcacactccccatgtgcagtgcacaaggatttgcatttgcacatcttgcttgctaacacttggcattaacaaaattggtgaatttatagccctactgatrggtgaaagggctgtttcatttttttttgtttttggttttggtttttttgagacagagtctcactctgtcacctaggctagggtgcagtggcacgatcttg

SEQ ID NO: 54562 - DNA, 201 bp, Homo sapiens
cggctgggcgtggtggcttatgcctataaccccagcacattgggaggccaagatgggaggattgcttgagcccaggagtttgagacgatcctgagcgtcayagggagaccccatctttacaaaaaatagaaaaattagctaggtgtggtggtgtgtgcctgtgatcccagctactcaggaggctgacacgggagaatcact

SEQ ID NO: 54563 - DNA, 201 bp, Homo sapiens
gtccacgaaacttgctaacttgaggacagtgaacgtgcatcttaagagcgcctttgcggatggtgctggaggacgttcagggaagggattcactgtccgtrggactaggggagtcagtgattgattggcagccaagagcttcagaggttggaggactttgaggatcacactgtaacactctcaggggaccagtgatgggca

SEQ ID NO: 54564 - DNA, 201 bp, Homo sapiens
gatgaggggcttgttgggggtgggggtgcgtgataaagggatttctcggctgaagacgaggctgtgaggtgagtgacgggcttgttttggctgagcgatgrggggtttctggggtgggtgatgggtgctgtggggtaagtggcgtttgctaattttagttggataattagcctgttaattttccctcttttcttgcttatt

SEQ ID NO: 54565 - DNA, 201 bp, Homo sapiens
cagccctgtagtacactcattggggatttctgaaagtcagtcctgtcagtgattgcattcaggtgcggtgggggcaacttattgtggacaggcaagaaatrgtaactggaggccctgatgcatgtctgcaaattttctgtgtcaagatggggattgggacagtgattttaagttttagctctagtcagaagaggctggtct

SEQ ID NO: 54566 - DNA, 201 bp, Homo sapiens
gagcgtagcttcaaaagtgttagtgggcatgcgcgcctttcaacagcgcctacggaaatcctaacgggaatgtaacccaaaccggaagtggcctagagcgrccatttagcttctgttgttaagtggatctaagcctatgtcgcttactggacgctgaagtgattgggaatattagcagtgggggttctgtagggtcaggaa

SEQ ID NO: 54567 - DNA, 201 bp, Homo sapiens
ccttgggtcaagaaagaagaaactgtagtccctggtctgatcagaagccccagtcataggatggaaaagctgactctttcctgctaagcactggttctgcyccttcatccaccactgggtctttgaaaaatttcaagtggtcccccccaccaaattccttgcttggtccatggggtttggcccgtttttcctctgttctca

SEQ ID NO: 54568 - DNA, 201 bp, Homo sapiens; identical to SEQ ID NO: 12140

SEQ ID NO: 54569 - DNA, 201 bp, Homo sapiens
agaagaaactgtagtccctggtctgatcagaagccccagtcataggatggaaaagctgactctttcctgctaagcactggttctgctccttcatccaccaytgggtctttgaaaaatttcaagtggtcccccccaccaaattccttgcttggtccatggggtttggcccgtttttcctctgttctcataaggtgcggcaaa

SEQ ID NO: 54570 - DNA, 201 bp, Homo sapiens
tcctcaaaatgggtatgataatgcccatgatatttagctgacaattaaattgacaactttctttttttaattcatatttatcacgtgccaggcaggcactraggacttgacaagcttcatcttggttaagtttcccaacacctgtgataaatacctgcattttcattttggaaactacaactaaagtaatattttcatatt

SEQ ID NO: 54571 - DNA, 201 bp, Homo sapiens
cattataaagacccatcagtctttcatatggttttagcagtcattggtgatcagtaacagtgacatttttgttttgtccttcaggctgcatttatcatctrcagtacttctgtaatgaagatctttccatcatcagtcctttcattaacctaatattagttattacaggagagatcatcttgttgaaatattatatgatca

SEQ ID NO: 54572 - DNA, 201 bp, Homo sapiens
ccatgtactcattgcttttccaaggcttctgcagaacccccaggtcaggccacatcattgaggctgcaggatctctcttcatagcccagtacgactctccrccgtgtccctggttggaaaatccaaacacctatccagcttctggctcctgggaaaagtggagttgtcagcaagagagaccgagagtagaagcccagagtg

SEQ ID NO: 54573 - DNA, 201 bp, Homo sapiens
gttaatgaagacctacacactgagccccctccttcaagccttggctgcccacacatgttgccctgcaacacttgtctgttttatcctactcatcctactasatctgggtgtctagaccacttgcataagtgtcctcaggttgttgaaatctaatccccacagattagcaaagtgatcttggccaattacataaccattatg

SEQ ID NO: 54574 - DNA, 201 bp, Homo sapiens; identical to SEQ ID NO: 12144

SEQ ID NO: 54575 - DNA, 201 bp, Homo sapiens
ttttatgctctgtcattttctatttctttggttttggaccctctttctggaagaatttctcaactttattttctagccctccgataatcattactgccttaaaaaatttttaagagcttttagatatgaatactccttttaatgacatgatgtttttgtttaatgattgaactatcttacctaaggatatttgagatattt

SEQ ID NO: 54576 - DNA, 201 bp, Homo sapiens
atgtactcattgcttttccaaggcttctgcagaacccccaggtcaggccacatcattgaggctgcaggatctctcttcatagcccagtacgactctccgcmgtgtccctggttggaaaatccaaacacctatccagcttctggctcctgggaaaagtggagttgtcagcaagagagaccgagagtagaagcccagagtgga

SEQ ID NO: 54577 - DNA, 201 bp, Homo sapiens
taagtggatctaagcctatgtcgcttactggacgctgaagtgattgggaatattagcagtgggggttctgtagggtcaggaaggggcggctggctttgggkgagtgatgaggggcttgttgggggtgggggtgcgtgataaagggatttctcggctgaagacgaggctgtgaggtgagtgacgggcttgttttggctgagc

SEQ ID NO: 54578 - DNA, 201 bp, Homo sapiens
ttcataattttattggtcaattacttgtctttagtgagttactttttcttaccttttgatttatattttggtttggtttagcctccggatttttagagagktttttttttttttttttttttttttgagacggagtctcgctctgaagcgcaggctggagtgcagtggcgcaatctctgctcactgcaagctgcacctccc

SEQ ID NO: 54579 - DNA, 201 bp, Homo sapiens
gcctttcaacagcgcctacggaaatcctaacgggaatgtaacccaaaccggaagtggcctagagcggccatttagcttctgttgttaagtggatctaagcytatgtcgcttactggacgctgaagtgattgggaatattagcagtgggggttctgtagggtcaggaaggggcggctggctttgggggagtgatgaggggct

SEQ ID NO: 54580 - DNA, 201 bp, Homo sapiens
cctattgcttttttgtcttgatgcgattggacctggctgttctcctggcgcctcacgctgtcttctcatggtgctgtgttcaccatcacctgggaattctktttttctctgtcaagtgtccagttccttgtgtcttgaatcctttcttgaatcctttggctttctcttccacggtttaccgttactctcatttcgtgaaag

SEQ ID NO: 54581 - DNA, 201 bp, Homo sapiens
ataccattttctccaagtgtgtacacactgtcttcataaattgaatttgttactaggtaattgcaaaccctcgctatttcagggacagtttttttttttgkttttttttttttttgagacagagtttcgctcttgtctcccaggctggagtgcaatggcgcgatcttggctcactgcaacctctcctcctgggttcaagcc

SEQ ID NO: 54582 - DNA, 201 bp, Homo sapiens
gatattttaaaatgtaattttatgaatagataatacacagcattcacaaattaaaacatcatgaaaagtaatttttttacaaaatactcctttctctctcttttttttttttttttttgagatggagtctcactctgtcgcccaggctggagtgcagtggcacgatcttggctcactgcaagctccgcctcccgggttcac

SEQ ID NO: 54583 - DNA, 201 bp, Homo sapiens
tctctctcttttttttttttttttttgagatggagtctcactctgtcgcccaggctggagtgcagtggcacgatcttggctcactgcaagctccgcctccygggttcacgccattctcctgcttcagcctcccgagtagctgggactaaaggcgcccgccaccacaccaagctaattttttgtatttttagtagagatggg

SEQ ID NO: 54584 - DNA, 201 bp, Homo sapiens
aattctttttttctctgtcaagtgtccagttccttgtgtcttgaatcctttcttgaatcctttggctttctcttccacggtttaccgttactctcatttcrtgaaagtgcatcccctaggagttcttggggacggtacacggcagtaaatcctgtgagaacttatctgaacatgtctgttcagataacggagactaaactt

SEQ ID NO: 54585 - DNA, 201 bp, Homo sapiens; identical to SEQ ID NO: 12151

SEQ ID NO: 54586 - DNA, 201 bp, Homo sapiens
attcttaaaagagccaaacattaatattctacagctgcactccttgagggagttgcttaaagctgagtaccttataatttataaagtattccccccccccmagaaagcattttccataatggaaatcaaagtaatatatttaatcattcattttatttaatatattcattgtcttcaactttttattatccaattaaattc

SEQ ID NO: 54587 - DNA, 201 bp, Homo sapiens
aatttaacagagtttaacggaccaagaaaaaaaaatgattagcagatctggcagtctccagaatcacagcagattcagagagactccagggatgccacgtkgtcagaacaaatttatagacaacaaaaggaaagtgacatacagaaatcagaagtgaggtacagaaacagctggactggttcaaacaagtgtttgccttgt

SEQ ID NO: 54588 - DNA, 201 bp, Homo sapiens
caggcatagctgcagtttctattctctaaacaccagaaggctcattgcctggttttgagaaaggaaagacagtggtgtctctaaaataaggttggaaaacyttgtctgtgaaggaccagatagtaaatactttgactttgcaggccatgtacattctccagtttgcctttgtagcaagaaagcagccatagataacatgta

SEQ ID NO: 54589 - DNA, 201 bp, Homo sapiens
tgtctatgcatcaaatgaagagagccgaagtcagtggttgaaagcattacaaaaaggtaattcaaaaaaagaaatgttgaaagagaaaggtcaaaaaaagycataaaagagagtcgttttttgaggcttggtggaggaaagacatggcagtaaaaagactcaatgccaagagacaatctactgattttcctaccaacctca

SEQ ID NO: 54590 - DNA, 201 bp, Homo sapiens
gaggcaagtgtattctctgggtgggctggaaggggtctcaggcacatccggggtgattactgcatcaccactgggacaaagcttttttgagggaaagcaaytggtacagagcaggagagaatggtcctcagcccctgccctaaaatgtttgtaatctaaaacatgcgggtgccaaacaatttactgaacaacttacataca

SEQ ID NO: 54591 - DNA, 201 bp, Homo sapiens
acttttccctctctttctctgttcaagtgaaagagggtgggggtgggaattaaaacaaacagaaatctgagagcaactctttttcagtacatgtagaaaayggagtgtggagcattgaactttgaaaatctgttatttccaggaaactcagccatcccaagctggttaaattctatggagtgtgttcaaaggaatacccca

SEQ ID NO: 54592 - DNA, 201 bp, Homo sapiens
ttttaaaatttcattttcatttaattttggtgaaatatacataacataaagtttaccatcttaattatttttgagcatacagttcagtagtgttaagtacrtttacattgttgtgcaaattgcctgattatttttaatgtctgtaagtaccagttgtatagatactaggtaaacctaagtgatgcactattgatggacatt

SEQ ID NO: 54593 - DNA, 201 bp, Homo sapiens
gtgactaatttgaagctgggcttccaatagccaagtcatgtttctttatctacacctctgtgtttacactgaacccccagtgttttggaatgagaatctgstcaaatattgattcggatcttcttttaaatttctatgtgtgcaactcttttttagcagctagattgaatgatcgtctgccttggtgccttccccatgtgc

SEQ ID NO: 54594 - DNA, 201 bp, Homo sapiens
ctcttgtagctagttgtgttcatatgattgaatctagctacaacgtagaagttgcagggtggaacttttaggaaaattccttataagaggaggatggacasaagatgagtatcattttgcccttcccctcttcctcctttctttgccagagggtaaatggttgccatttccctaacagctgtcttggactataaggcgatg

SEQ ID NO: 54595 - DNA, 201 bp, Homo sapiens
tctgtgacagtttctcactctttccttgtttttcatgagcttgataattttgaagagtactggtgaagtattttatagaatactcctcaatggtgggtggkggtgccaacttttaaattcagattgtgaaaggtaaaaattatctactatggtcatcatttcataaaagaaaggccattctaacaaccaaaaaaaggaaga

SEQ ID NO: 54596 - DNA, 201 bp, Homo sapiens
cataatttttagcttacattcccaggaatataacatgattctctccttaatgccagaaagaatgaaattgagtaaactgggtgacttagaaagagaaattytctttataaaaatattcgtagggtttttctgtgtatagaagcaagaggattataaatttaaaatattatagaaatatatacatatcgttggatcatggac

SEQ ID NO: 54597 - DNA, 201 bp, Homo sapiens
tacagagtgcctacctacacttgagataataggatgtacctgaattgtcccacagcactttccaatgccagaatccatgtccccagtgtatctcatatatkattttgcacatggtaacacctggatgctggctaaagccaacccagtaagaatcaggagaagactttgttgactatcaaaagttttgtggccttctggccc

SEQ ID NO: 54598 - DNA, 201 bp, Homo sapiens
cttaattattttctaactttcatgcaatttgaaagtcctctgcctccacttctaaactcatgagtgcactcactattttaatatcctttcagctaggcaaygtgttgtggaggagaaagttatgcttttgatttaaggcactcctaaatctcatgcgcccctctaatggtgcacagatgttttctagagaaagtcctcatc

SEQ ID NO: 54599 - DNA, 201 bp, Homo sapiens
taacttattttagtttttcttttatgggcccttgttgtaaaacagcaattttcctggatactactgatcctcctaatattcttaattatatagggaaccaygaaagtaggaaaaaatcctctcaagtcttttgcctatcataatttttagcttacattcccaggaatataacatgattctctccttaatgccagaaagaat

SEQ ID NO: 54600 - DNA, 201 bp, Homo sapiens
agatatgcttaaaatccctcttacccctctccatgtatatatctgtctcccatgattccattttctctcactctaactcttcaaatcacttcaaaccatcwgaagacacctctttccttttctcctctcctctcaccttctgtatttactcttttctcttccactagtaagtctctgccctttccagtgaaaatcaaccaa

SEQ ID NO: 54601 - DNA, 201 bp, Homo sapiens
tcttgtagctagttgtgttcatatgattgaatctagctacaacgtagaagttgcagggtggaacttttaggaaaattccttataagaggaggatggacacmagatgagtatcattttgcccttcccctcttcctcctttctttgccagagggtaaatggttgccatttccctaacagctgtcttggactataaggcgatgc

SEQ ID NO: 54602 - DNA, 201 bp, Homo sapiens
tctacagaggctaaatcagtgaagaacaagattagtcaaggctatttgatgatattaagggatttttaaaatttttgtaagtatgataatgagattgtagttttttttttcaagttatcttttagagatacaaattgaaatatttataagtgaaataaaataatggctggaattctcttcaaaatactttgaggggagaaa

SEQ ID NO: 54603 - DNA, 201 bp, Homo sapiens
acacaccagggcctgttgggggatgaggggcaaggggtgggagagcattaggacagatacctaatgcatggggggcttaaaacctagatgatgggttgatrggtgcagcaaaccaccatggcacatgtatccctatgtaacaaacctgcacattctgcacatgtatcccagaacttaaagtaaaataaaaattaaaaaatt

SEQ ID NO: 54604 - DNA, 201 bp, Homo sapiens
gtgcattgggcagctcaaattttttgccactctacacatgcccacaaattactacaaaagcaccacaggtactgatttgggggttacaaatgaattttagsaagtaaatgaactgacaaataattacagttacagttttaaagaaaattcttaaaagagccaaacattaatattctacagctgcactccttgagggagttg

SEQ ID NO: 54605 - DNA, 201 bp, Homo sapiens
aggtactgatttgggggttacaaatgaattttagcaagtaaatgaactgacaaataattacagttacagttttaaagaaaattcttaaaagagccaaacaytaatattctacagctgcactccttgagggagttgcttaaagctgagtaccttataatttataaagtattcccccccccccagaaagcattttccataatg

SEQ ID NO: 54606 - DNA, 201 bp, Homo sapiens
atgacagttctgtaacctcctccatgccttccgagtctgccaccccacagcaatctttcatattaattagttatgcagcccatctctcaaacttgttcatygtcactcagggccacggacagctgatctttatttctggaaccagtcactcaatgttggacacactgtaggctcaaaatcaagcatgccaaatagaactgc

SEQ ID NO: 54607 - DNA, 201 bp, Homo sapiens
tagggtaggtgaaaggaatggcttccattattgctgcaaagcaagccacagcgccttcaacgtgttagcagagaagggaactggaaggcgaatggctaaaygaggaagggaaaagagtccaactaccctgatcctacttccagaaacttcttggttcattatccctttacactgtggtggtgccctttcccaaacatcttt

SEQ ID NO: 54608 - DNA, 201 bp, Homo sapiens
cagtgaaaatcaaccaagcaaatttgtttcctttcagtcttgtcattcatttttccacatcagcttattaaaagtccaggaacagaactgggattggtagraggagaggttgagaattctcataccttattatacattgctttctcctcacatgataatatataccttggaagattataaggattgaaaacaatgaatgta

SEQ ID NO: 54609 - DNA, 201 bp, Homo sapiens
acaaaagagaaacaaacacttatgtatatcattggttttggatgatgctttctgttacacacagttgaacctaatcctaactgataaaagggcaataatgyctatggtagtagccaagaatcaggtgattctaggtcagcctacatcaagacaatacgggagcagctgaaggaacaggctcctcaagattgactccaacac

SEQ ID NO: 54610 - DNA, 201 bp, Homo sapiens
ccaacacctcaggctaccttctgggtttactcggcctctagactggaacctggggataacaatgagaaggcagaaggaaactgcagcacatatcctagacygagatctagatacagccttgaatggacttgagctgtgactatatggcccacttccttgattcaatatctagagaccttgataatgaaaagcatcatctac

SEQ ID NO: 54611 - DNA, 201 bp, Homo sapiens
aaattagccaggcgtggtggcgcatgcctgtaatcccagggacttgggaggctgaggcaggagaatcacttgaaccagggaggtggaggttgcggtgagcygagatcatgccattgcactccagcctgggcaacaagagcgaaactccgtctcaaaaaaaaaaaaaaaaaaaaaagaaaagaaagaaaaagaaaaagaaag

SEQ ID NO: 54612 - DNA, 201 bp, Homo sapiens
acctggggtacaggagatctgaatcagtaaaatatggggatctgtaaagcataagttatcagccatggacttttacctggcaccactgatagaactcagargggttgtaaacttggactgctaaaaagttatatctctattgtcactaacctctactaatttttttgttttttttttattgtggtaaaatatacataacat

SEQ ID NO: 54613 - DNA, 201 bp, Homo sapiens
tgttttgagatgagaaatgtgaccctgtatattaagctttgagcacttttcacactgtcattgacatccagatcaagatgtggagtaggtggctaaatatrtgagtgtgtagatggactgttgatcacctttggaatcttgggaagcataaagaaaactcatgctgatatgacaatgaacaaagccttccctaaatgattc

SEQ ID NO: 54614 - DNA, 201 bp, Homo sapiens
atttttcagcagtgttttaaagtcgtccccattttagaggggcacacttttttagtgttttattttggtggcgttgctattataaatggggttttctcttmcatgataacttctaagtggttactgtaggtatatgtgaaggctattgattttgtatgttaattttatatcctgctctcctagtgaattcctttattcttt

SEQ ID NO: 54615 - DNA, 201 bp, Homo sapiens
cagatttactagattctgcaaacaaatttccaatgttgttgtaccacttcatactccaaccagcaaaatatgagttccagttgctccatatccttgctcayacctttcttctttccttgcctctttccttcctcccttcctccctcccttcctccctcccttctctccttcctttctctctctttcaagagctgatatact

SEQ ID NO: 54616 - DNA, 201 bp, Homo sapiens
ttattttaaaatatataagtgacagaatgcttgcatatatataagaaaatcagggcaaatccagtcaagatgatttattaatctagattttccattgtttragataattatgagccattattaacaattttcttttgtttagaagtgttgccagactactgcttttattggaatgcctgaaagaaccaaaatgtgaaagta

SEQ ID NO: 54617 - DNA, 201 bp, Homo sapiens
tattttaaaatatataagtgacagaatgcttgcatatatataagaaaatcagggcaaatccagtcaagatgatttattaatctagattttccattgtttargataattatgagccattattaacaattttcttttgtttagaagtgttgccagactactgcttttattggaatgcctgaaagaaccaaaatgtgaaagtaa

SEQ ID NO: 54618 - DNA, 201 bp, Homo sapiens
caatggccttgagtgaattgtatgctgacaccaaaagctgattaaacatttgcagcaaagagaagaaccatttctccttttgtacttgcaatttttactcrgttgatgttacagcaacaattttttaattttttagcttttattttaagttgattggtacatgtgacaggtttgttatataggtaaactcttgtcatgtgg

SEQ ID NO: 54619 - DNA, 201 bp, Homo sapiens
gttttggggtgaggatacccaacagcctaatcacctttacctctctcatttccacctccattattatcctataagataatttatgttcagaataatgatcytgaagaactacaagcctctctcgatcatcaaagaaagattccagttttatacacttactaagggaggagaagcctggaaagttggaattttactgtacat

SEQ ID NO: 54620 - DNA, 201 bp, Homo sapiens
caccaattcatacaccgggacttggtaagcaaagccattggaatttcaaagaaaagaaagcagtccacggctcccacttctggagatggggtcactggtakggaaggcaagaagggcaccatcacttctactttgctcacttgtgacttgtttaagcaaatgacatttttacaaaaatcaatgtaaaaatatttgaagtat

SEQ ID NO: 54621 - DNA, 201 bp, Homo sapiens
ttggaattttactgtacatgaaatctatatgtgcaccaaaagatacattgagttcagagaagaactctcttccataattacttttatagttacaccagatktcaagactgagaaaaacaccagatgccaagcctgagaaaacctccctgacttccctctccaaaatttgcaaatgcacctaaaataattatttaacccttg

SEQ ID NO: 54622 - DNA, 201 bp, Homo sapiens
agaaagaatgaaattgagtaaactgggtgacttagaaagagaaattctctttataaaaatattcgtagggtttttctgtgtatagaagcaagaggattatraatttaaaatattatagaaatatatacatatcgttggatcatggaccagttgtctattatgacagggttttttgcatgctgccactagcacttactaatc

SEQ ID NO: 54623 - DNA, 201 bp, Homo sapiens
ggtgctttgaagtgtgggcaaataaacttaggggctgtgtggtgggcatgtttggcgatatgcatgctgaggcagatagcatgtcagcccagggtggcacrccagtgtgcagagagaagcagagacatttcctgaagctcagctgcactttctgcccaagacctctgtattcacattacagaaaccccctttgggctgggg

SEQ ID NO: 54624 - DNA, 201 bp, Homo sapiens
tgtgtgacctgaggttttctgtggctcagttttatctgtaaaatggaatgataagaccgcctacctcaaaggggtgcagttagtgctatgagaatgttagytgctgttattcagaagggctctactccacaataccctccacttagtcaaggcctaccctaaaatgtatcctccctgaatagtaatcgataaatatttatt

SEQ ID NO: 54625 - DNA, 201 bp, Homo sapiens
cgcagaaacgagcttaatactcaaagcagtacaggccggtcatcacctacatcgaagcaaccagaaagtatctttatccccatctagattatgtctgggtycttccagactcctacgattaaattgtatgcatgtgaacaactgatgaggtacttagatctcagtgctttgcagaaagaaaagccgtctaccattttcacc

SEQ ID NO: 54626 - DNA, 201 bp, Homo sapiens
caaccataatgatggtgaacatgtatgcatacctactaggtgcccagtaccccaccaattatttacaactatctcatgtaatcctacagtaatcttgtgcraaggttagcgatacagtcatgtgcctgccacataatgacattcaggtcaacattacacagtcaacaatatatggactgtatgtatgacagtagtcccata

SEQ ID NO: 54627 - DNA, 201 bp, Homo sapiens
tggtgaacatgtatgcatacctactaggtgcccagtaccccaccaattatttacaactatctcatgtaatcctacagtaatcttgtgcgaaggttagcgayacagtcatgtgcctgccacataatgacattcaggtcaacattacacagtcaacaatatatggactgtatgtatgacagtagtcccataagactataatgc

SEQ ID NO: 54628 - DNA, 201 bp, Homo sapiens
atcattacctagcaggtcagattccagctttgacaatgccctaactttctggaaggagcaggaaaaaggccagagagagcactgccttgggattgccttcytaggctctgtctggatgacactcaccatgtgttctgggtgccacaggtgctgtgcctctgaggaaaactacagagtgtagaggtgttgcagctcctgagc

SEQ ID NO: 54629 - DNA, 201 bp, Homo sapiens
ttacaaagcagtgagggtgagagttaaggtggaggtcagcagaatgcatccatggagtcccaggatgtggaagtttcattcctcactccaagaggctagaragatattctattggaggtgacactcaagttgagaaggacaagtaaaatttaacccagcaaatatgagaaggacagtggtacaaaggaagcagcaggtgtc

SEQ ID NO: 54630 - DNA, 201 bp, Homo sapiens
tctgtagaggattttttaaaaaactgaagcagtacttctgagagttgacacaatccagatgattttttagggcattacataatcacaaacacctggagaaytgccgtgggtggctgacgaattgtgagtgttatgtttaaactcaagagttgcatgtgtctaattaagtaagaaatttgtaatctgaaacaggtgttttct

SEQ ID NO: 54631 - DNA, 201 bp, Homo sapiens
ctagattatgtctgggtccttccagactcctacgattaaattgtatgcatgtgaacaactgatgaggtacttagatctcagtgctttgcagaaagaaaagycgtctaccattttcaccaaatttcgtagtacaatttaagtatctcttgttatctcccctaggagtctaaagtgagctggggaaggcaggattttgcaaac

SEQ ID NO: 54632 - DNA, 201 bp, Homo sapiens
cctccactatccagagagtcaaatcttacttattggttaaggccttactaaatgggcaaattttccctgaagccctcccagatccttctgttagaagggayagcttctgcctcaaaacatgaaacttcttcaactatacccatcttgttcctccttaattattttctaactttcatgcaatttgaaagtcctctgcctcca

SEQ ID NO: 54633 - DNA, 201 bp, Homo sapiens
taggagctggaggaaggaagaatgagaaaagactgataatgagttcaggtttactttctgggctgatgaaagtgttctggaatcagcagtgatggttgtgyaatcctataagtacataaaccactactttttaaaaagctttgtaaatacatatttgtacctgttatgatgtgttcattttctctttaaacaccatcttct

SEQ ID NO: 54634 - DNA, 201 bp, Homo sapiens
atcaaagtaatatatttaatcattcattttatttaatatattcattgtcttcaactttttattatccaattaaattcagccagtagttactatctccacayagagaacacagagaatgatctcagctgaagcaatttatgatcctcttgggtatgtgaggggaggttgaggcaatccccaattctaatgcaagacagatag

SEQ ID NO: 54635 - DNA, 201 bp, Homo sapiens
agagatgttggtcaaaggatgcaaaatttcagtcaggaggaatgagttcaagagattcattgcacaaaatggtgactatagttaataacaatgtatactcraaattggctaagagagactttaagtgttctcatcacaaaaaaataagtatgtgaggtaatgaatatgttaattagcttgatttagccatcccacaatata

SEQ ID NO: 54636 - DNA, 201 bp, Homo sapiens
gttagaattgcgagaaaaggagtgcgggagtggggacgggcagccatacgtctttattcctgcctgaagagaaggcacactctagtggggagataattggytaagagtttgtatggtgttggaacacagtgggcaggcgttggagagtttttccagaagaatgaggagctggcacaagccagtgaggggatctagttgatt

SEQ ID NO: 54637 - DNA, 201 bp, Homo sapiens
catcatgtgttccattatttttatactatttattatttttcctaagtctccacaaagtacttgatcataatgaaagaatatcaggtttcttaacttacacwgtgaagatcctcttctatccacttatcacatgaccttttcttaatgaaagtataatgaattcaagataaaggattttaaaacattagttaactttactaa

SEQ ID NO: 54638 - DNA, 201 bp, Homo sapiens
caatgtatactcgaaattggctaagagagactttaagtgttctcatcacaaaaaaataagtatgtgaggtaatgaatatgttaattagcttgatttagccrtcccacaatatagacacctatcaaaacatcattttgtacatcataaatatatacaatttttatttgtcaatttaaaacataactaaaaaaattgaaccca

SEQ ID NO: 54639 - DNA, 201 bp, Homo sapiens
tcatcctcaccaacactgggtgctattagtcttctaaatttttgcctaatcaactggtggaaatacatctagaaataccctctgttttctagaatagtgcsacttaagagcagtggctggatgaatttccaacagtgagtaaaaataagccataagctcagcacttaatttgtgttactttatatgacttgattgcatgca

SEQ ID NO: 54640 - DNA, 201 bp, Homo sapiens
cattagttaactttactaaggcaaattataactttagaacagtggttctcaactgagggcatttttgctccccaggtgacattgggaaaagactggagatrttttgggttgttccaactgggggataggaacagtaagtgttaaagacatctagtgagtagaggccaagaatgcagctaaccatcctgcagtgcacaggac

SEQ ID NO: 54641 - DNA, 201 bp, Homo sapiens
gaggcctgatctatgctcaaccaatcagattctctctcctgggaatttggaattgagaatcagagttactccctggtgctttgaagtgtgggcaaataaayttaggggctgtgtggtgggcatgtttggcgatatgcatgctgaggcagatagcatgtcagcccagggtggcacaccagtgtgcagagagaagcagagaca

SEQ ID NO: 54642 - DNA, 201 bp, Homo sapiens
ggctggatgaatttccaacagtgagtaaaaataagccataagctcagcacttaatttgtgttactttatatgacttgattgcatgcatgtaggtgaattgrcctcacttctggctttcattttggctcttactgatgtttttcctttgccccaatttcctcaattgtttattttaacctgtagtacctcagaagtaccttt

SEQ ID NO: 54643 - DNA, 201 bp, Homo sapiens
catttattgagtgcctactgaatacctcagtcctgcaggagatactgatatgaataggatagtccctgctctcaaaatgaccacagtttagtctagagggyaagtagatatccctgacattgagacaaaatataactataaagttgtgctgactcaatatgtaattctgaaggtgaataatgcagtttaaaagagatctga

SEQ ID NO: 54644 - DNA, 201 bp, Homo sapiens
ccaaaatcaccatcaacatcccaccagtcccttctgaaaagaaaacaaggagcagccacccaactagcatacctcgggtctgccaatgcttctccggaccstcgctccaaccccttccgactgctcccggctgagcactgagagagtaactttcttggaggaccccatatcggagtctaaaaagagagtgttctgatgctg

SEQ ID NO: 54645 - DNA, 201 bp, Homo sapiens
ttattttggtaacagttttaccagcctggacaaaatatgcctggattacaatggctttaaagaattgaatgagatcagctacaaaatagaacttcatgaamtggaaaagatacaggcacataaaatattttttaaattcacttcatgacagtattgatacccaacaatcatgttaatgttaatactggtcattttaccccc

SEQ ID NO: 54646 - DNA, 201 bp, Homo sapiens
atgaacaagcttaggagaaaattcctaaaattctaactgagtaaagatgacaatgcagagtataatttgagtaaatgaagtcatattatcgtaatagcagrttgccaaaagttaggatgtaactaaactcatggaaaatacagagccaaagaaacaggagaagtagcagaggaagtgaatgaatagaataaagtaaataaa

SEQ ID NO: 54647 - DNA, 201 bp, Homo sapiens
tgctatggaataacaaagtattgtttcttatcgtcattgtaactagttctgcaactgtctcctctacctctgcagctgtaataggtgtactaggagtgaasgtttctcctctttgtctctcagaagccagttacaggtaaaagctaagtccaaggttgtacatggttagagcaatgcaggaattccatttacaggcccctg

SEQ ID NO: 54648 - DNA, 201 bp, Homo sapiens
gtctcaaaaaaaaaaaaaaaaaaaaaaaacaacacaaacacacacacacacacacacaaatatatatatatatatatatatatatatatatatatatatayacacacacacacacacacacatatatatatacctgctatgtactcacaaaaattaaaataaaaattacacctggacatttgacataaactggacttctgg

SEQ ID NO: 54649 - DNA, 201 bp, Homo sapiens
tgtacataaatatttgaaaagaaaaacatctagagatgtgctgtgtttttcttttccctgtctgtatctcttggctttatagaataaacatatattgcatrtgaatcttaaaatgaaagcaaaaaatgtataaagggcaggattttgaaatgaacaattatgttgaaatttcacaagttatatttcatcagatgcaacaac

SEQ ID NO: 54650 - DNA, 201 bp, Homo sapiens
tcttcagaaattatctgacgtcacttttagttctttcaacaatctgatactttctaaacttctaaataaattccatgaaagatcctaaatttaaatacaayatgttacagccacattattggattgttttactttcttttaaatttttttatttttaatttttgtgggtacatagtaggtatacatatttatggggtacat

SEQ ID NO: 54651 - DNA, 201 bp, Homo sapiens
ttcataacagcagaagattagtagcaatttacctggttaaataaattatgtttaattccttccataagaagaaataataagagggaatggtattcagccaytaaacatgatgctgcagtagaaatgtaaccgtatggggaaatgctcatgatataccattaaaggaaaaataaaagcaaatctcaatataacagaaaccct

SEQ ID NO: 54652 - DNA, 201 bp, Homo sapiens
agggtgggtttctgagtaattttatctttacttttttgtgtttttctatatttaccaaacattttgcattgaggttttgctgtattcagttagatattatyttttaaatgcttacaaaccataagcagcctccagctaagcccacacattgaaaggaaacaaaagttccagaaaactgaggcaatcgactgagactctggg

SEQ ID NO: 54653 - DNA, 201 bp, Homo sapiens
aggcagagtttacagtgagctgagattgtgccactgcactccagccttggcgacacagcaagaggctgtcttaaaaaaaaaaaattagttttgataatcaygcatcaattataagtgatagcaaaaaatcaatgccctaatttaataattacagcttgtttttgaccaaaaaatagtattacccagcttgattatttaccg

SEQ ID NO: 54654 - DNA, 201 bp, Homo sapiens
cttatgcatcaggaaacacactgaggtaagtactatcattgctgaaactaacagaagagtaaacaaggactcagaaaggttaagtgacttgtccaaggtcmcatagctagtaagaagtagactagctagtgccagcgtccctgttcttaactgcaacactatggagctcctcgagtagaaaataagtagcagaaaacatct

SEQ ID NO: 54655 - DNA, 201 bp, Homo sapiens
tattctttaagtctgttctaacattgatactctcagattttccaggtatacactaaaatgcttgcaaataaagagactttttcttttccagttattggggmtctaattgttcttgctttccaattgcattggttaacaccttcaacataatgttaagagtgattattatagtgagcgtccttgccttatttctgacctcaa

SEQ ID NO: 54656 - DNA, 201 bp, Homo sapiens
attgaatgaattagcattataaaggccttaggacaatgcctggtacacagtgctgtttttctgttattaatattgtgtgtgtgtgtgtatatatatatatwtttttttttttttacaaagcatctatgcaccaggcagtacgcttggtgctaagaataaattgacgcacacaacttaaatagtttctaaactcttgtaccg

SEQ ID NO: 54657 - DNA, 201 bp, Homo sapiens
gattttgttaatttgcccttcagggcagtgtagctgctattcattagatgacaaatgtctctgaaatattccatattataaagactcagactcactgaacycaggaaatcaattggctccaagtcaaggactgattattttataaatgctagtttacgaaggccataaatacactgggtggttaaagacatccaaagatat

SEQ ID NO: 54658 - DNA, 201 bp, Homo sapiens
gatctctttacaaattagggagagtaatactttaagttatcagctttatttgattgagggtgggtgggtttttttttctttttttgaccatgcagaaattyttcttaatatagctgaatatatcaatatttgttttcattgcttctggaaattgtcatagataggctttctcatgcccaaattataatgacttttgccagg

SEQ ID NO: 54659 - DNA, 201 bp, Homo sapiens
aatcaggtgattctaggtcagcctacatcaagacaatacgggagcagctgaaggaacaggctcctcaagattgactccaacacctcaggctaccttctggrtttactcggcctctagactggaacctggggataacaatgagaaggcagaaggaaactgcagcacatatcctagactgagatctagatacagccttgaatg

SEQ ID NO: 54660 - DNA, 201 bp, Homo sapiens
tgcatgctgaggcagatagcatgtcagcccagggtggcacaccagtgtgcagagagaagcagagacatttcctgaagctcagctgcactttctgcccaagrcctctgtattcacattacagaaaccccctttgggctggggctggtttgcccccaattgcaaactttaaagtttgcacttatgcactccacaggccagctc

SEQ ID NO: 54661 - DNA, 201 bp, Homo sapiens
tcctagtgttttgtggaaggtagaacctgtaagcaatgaaattggatgtttagctgatgctatttgtacacaaagcgttgagagaccgggttcctcttgayggcatatagtaaaatgcaagaagagagaaataatttaaaggcagaattgttaatcaaaagagaagcagaacttaaagatttgggaaattttcagcctacc

SEQ ID NO: 54662 - DNA, 201 bp, Homo sapiens
cctctggctatacaaaaataggtagtgggctacctactcattttggctgcaggcctagtatgcagatccctgctctaaaagaacaggttagtagaggaacraacacttttctctgggcttttaaaatatcagtggggcttaaacccgtcctcatcaccttacttaggcagttcaaggctagctgagataatacacatgaac

SEQ ID NO: 54663 - DNA, 201 bp, Homo sapiens
ggtttcaccatgttgctcaggctagtctcaaactcctgagctcaagtgatccacccacctcagcctcccaaagtggtaggattacaggcatgagccactgygcccggcctcaatcttcttaaagaatacctaagtaatcctgaacagattgttgtagaaatatggacagtaaaggccattctgatgaagtcttagacagaa

SEQ ID NO: 54664 - DNA, 201 bp, Homo sapiens
ttcctggcctcaagcaatgcgcccgcctcagtgccccaagtagctgggactacaggtgccagccaccatgcccagctaatttttgtattttttgtaaagaygaggtttcaccatgttgctcaggctagtctcaaactcctgagctcaagtgatccacccacctcagcctcccaaagtggtaggattacaggcatgagccac

SEQ ID NO: 54665 - DNA, 201 bp, Homo sapiens
gaagtattttaaacaatggtatggtatgtagtgtatgctggtagtaccttttggaagtggcctaatctaagtcatgccctacttttcttatagcataaaawcttacatttctgatccaaaggtagatggattgtctttcagatggcctgactacccagtgctagtattaggaacctgtggccaaaaatgaaatacaataat

SEQ ID NO: 54666 - DNA, 201 bp, Homo sapiens
cgctgcggtagcggcacctggagccttagcggcgggggtgacgcgaagagccgccgggagcgagtgcagggagggcaggttaagagagtgtgggtccagtmgcctcaccgtgactcagcgcttcgcggccggcggcctagaggaggcgggaggcgggagtctacgggtctcggaggccctggggctccgccctcgggaatg

SEQ ID NO: 54667 - DNA, 201 bp, Homo sapiens
tgcatttctcatagaaaccttcctgctaattatatagtcaagtcattgtagtgttgcttgtccagtctgtgggttgcccgactcttcatgtctagccactrcttctgtgtccattatgtattgctgcataataaaccactcctaaattgggtggcttgaaacagtgggatttatgatatctcatgattctgtgagtcagct

SEQ ID NO: 54668 - DNA, 201 bp, Homo sapiens
tagatttcttgttaatactgactgggtttaggatctcattttactataaaaggttttttgtttcaccttcccaactgaattttccctaaataagcataagragagcagggtttgctagttgttggacaggcatttgacttaacagtaagccctgtttatttattgtcacaatacgaggggggaagatattgcatttctaaa

SEQ ID NO: 54669 - DNA, 201 bp, Homo sapiens
tcccaccctccaccctcaagtaagcctcagtgtctactattttcctctatgtgtccatgtgttgtcatcatttatctcccacttacaagtaaaaatatgtrgtatctggttttctgttcctgtgttagtttgctatacagcaacaatttattaactgtttcttatatgccaggcataaccatataggtagctagcaagtga

SEQ ID NO: 54670 - DNA, 201 bp, Homo sapiens
agaccacaaatacttacctccgactagaaaaacaggagtaagattgacaaaatgccaacagtctatgtaaaggtttcatgggtgacaggacaggacatggstgataacaaaaggaaacaacaaacatttttgtgtctacctccacctcctactcacccatttcctttcattaaaaacagggcagtttgttccggcactgaa

SEQ ID NO: 54671 - DNA, 201 bp, Homo sapiens
tccgcccatctattggatctatggtgtcttgggtacttattttcagctacacacattcgcacacacttctctctttctaagtaaaagccacataattttcrtgaatcaacatgaaagacaaaaataatccattattgtagtagactgaataatgtcccccaaatttcatatccatgtagaacctcagaatgtgaccttatt

SEQ ID NO: 54672 - DNA, 201 bp, Homo sapiens
gaaagtatctgactttggaatgacaaggtaagccaattccgaaagggcaaccagtgaaagggggatttccattcacatttgaacaccatcataattgaagsctttgtggggatatagaaggtgctctgaattgggggcttagaaacctaagtccctcccatgggattgttcttcagaaattatctgacgtcacttttagtt

SEQ ID NO: 54673 - DNA, 201 bp, Homo sapiens
cacaggccaaggaacacctgtttcttagtccatttgtgctctactaaggaatacctgaggctgggtaattgataaagaaaagaggtttatttagctcaccrttctgcaggctgtacaagtagcatagcactggcatcggcatctgatgagggccttaggctgcttccactcatggcagaagggaaggggagctagtgtgtg

SEQ ID NO: 54674 - DNA, 201 bp, Homo sapiens
tgaaatgttgattttgacttctagcctctagaactgtgaaacaataaatttttgtggttctaatccaccaaacttgtagcaatttgtcatggtagccctargaaacaattataatcgttaggagttttactttgttattagcaacattgctgtttgggtttgaaaatatgtttcagtcctgaagcttgaaaagtatggccc

SEQ ID NO: 54675 - DNA, 201 bp, Homo sapiens
ctgggctgtggtgatagttatacaagttgataaatttacaaaagtcactgaattctgcactttaaaaaggatgaactaccaataaagtttgttttgacaastctaagagcagaagataattaagagccagaaaccattgcatctagtctccagcagggaactttttggccaatatattgaaaattatcagctaggcaaatc

SEQ ID NO: 54676 - DNA, 201 bp, Homo sapiens
atgtggatgatcaggaaatcctcctggtctacctcctttaaattcatcaaacagtaaaaacggatccagattttttaactgaaataaaaataaaatttgcwgattagatatgtcttttaagccatactaccaggggctacatttatgaacagatctagcaagcctcattgaaaactacatagccaatgggcaactttttac

SEQ ID NO: 54677 - DNA, 201 bp, Homo sapiens
agatgatttatcggaggccgtcaatgtagccattaacctcagctctgtcactgctcgttagcacctagaccagagtatagcagatgtgatacagaacatgwttatctgactttattactaattgatatggaatgccagtagcaaactcttttgatttctaaaaatgacactttgatatagtttaacctgataaaaacacta

SEQ ID NO: 54678 - DNA, 201 bp, Homo sapiens
tctaagcctggaaagaaaaaaaatagcaatggagcgtctatactctcagccctagccacctgctgagcaaagatgcctactccagtgtccagttcttagtaagcccttccactgggtgcagagttagcagaaggttgactcagtgctgctgtgttctctacacagcttccttccagggctctgtcctctttgtgtgactaa

SEQ ID NO: 54679 - DNA, 201 bp, Homo sapiens
caatgtagccattaacctcagctctgtcactgctcgttagcacctagaccagagtatagcagatgtgatacagaacatgtttatctgactttattactaaytgatatggaatgccagtagcaaactcttttgatttctaaaaatgacactttgatatagtttaacctgataaaaacactaaacattacacttatttctttg

SEQ ID NO: 54680 - DNA, 201 bp, Homo sapiens
tagtttttcttttatgggcccttgttgtaaaacagcaattttcctggatactactgatcctcctaatattcttaattatatagggaaccatgaaagtaggaaaaaatcctctcaagtcttttgcctatcataatttttagcttacattcccaggaatataacatgattctctccttaatgccagaaagaatgaaattgagt

SEQ ID NO: 54681 - DNA, 201 bp, Homo sapiens
aaggagaaacctaacaatctaaatgttatttaggtggataaaatcagggtgggatttgatattgcatggctacgcacttggattatttcttggtgcttttytgcactcacgtttttctcaactcttcttaagggaattccctgagtcaagttcatctgaagaagaggaaaacctggatgattatgagtgagtattgaaagt

SEQ ID NO: 54682 - DNA, 201 bp, Homo sapiens
aacacttgggcataaaagacaccccacagtcatctcatgcaaatcatcatcaaaatccttctccagagttttacaagccactttcttattggtagttagcyctttttttttccttctaatcgtcctccaaagcaaatgggaaagctgtttttatttataccatattgcagatgagaggattgaggttcaaaaagagcttat

SEQ ID NO: 54683 - DNA, 201 bp, Homo sapiens
agattctcttgatgggcattctaccaccacttaatgatgtggaacaattattttgattacgatcgtttttttaaagtcttcttttaccttaatcctgtatcctaatactatttaagcctcagagcaaattttcatagttttgcaaagaaaacgaagacatacacattaacctttctattcaacatttattgagtgcctact

SEQ ID NO: 54684 - DNA, 201 bp, Homo sapiens
tgttaatactgactgggtttaggatctcattttactataaaaggttttttgtttcaccttcccaactgaattttccctaaataagcataagaagagcaggrtttgctagttgttggacaggcatttgacttaacagtaagccctgtttatttattgtcacaatacgaggggggaagatattgcatttctaaaaattaatca

SEQ ID NO: 54685 - DNA, 201 bp, Homo sapiens
cttattggtagttagctctttttttttccttctaatcgtcctccaaagcaaatgggaaagctgtttttatttataccatattgcagatgagaggattgagkttcaaaaagagcttataaagacctacctggagctactaagtgactaatttgaagctgggcttccaatagccaagtcatgtttctttatctacacctctgt

SEQ ID NO: 54686 - DNA, 201 bp, Homo sapiens
accctgaatggatggcttttgggttctagtttttcttgaactgactattcctagccagcatccatgacatacaccagtagtagcaccaacattagtatacytgacccaggcatctctagcaggaagaaaagcaacctagagttgaataactcttccataagaatagctatatacacaacccaatttttttttaacttgata

SEQ ID NO: 54687 - DNA, 201 bp, Homo sapiens
gttacatgtttaattcagcatgagatgctagctcatggatttattactttttgcttttctcctaaggaagttgcccagagagagtgccctaagcagaggasagggagcagaaagaaagaggttactgaaaagaagaaaagacttagaaaagctctatggggcactgaagattaatctcacacctaaagcaaaacttagctc

SEQ ID NO: 54688 - DNA, 201 bp, Homo sapiens
cctgcataacatcatgtgaaataaggatctgtcaggttctgtgaagccagtatttgtctttggccagcatcctaagactttttgaaccactttacttgatyctcagtcaaactttttgttcttgtttaaacctaccatcacattttgttcagttatttagcacgaagataagcgggcctggcatttggacaaatatttgaa

SEQ ID NO: 54689 - DNA, 201 bp, Homo sapiens
cctgctctaaaagaacaggttagtagaggaacgaacacttttctctgggcttttaaaatatcagtggggcttaaacccgtcctcatcaccttacttaggcrgttcaaggctagctgagataatacacatgaacattaaaggtgctatggaataacaaagtattgtttcttatcgtcattgtaactagttctgcaactgtct

SEQ ID NO: 54690 - DNA, 201 bp, Homo sapiens
aaaatctgaattagagaagtctggtcaatgaagttttattgaattcaaaatgcctatcttttactacttgaagcaaaaaacatactttcagcctttggggaaaaaaaaatcagaaaccaaggaaaccactgaccttttacttattataaccttttatttgtttttttgctaagtagtgtaaatgctagactgagactttac

SEQ ID NO: 54691 - DNA, 201 bp, Homo sapiens
agattgttttgaggcttacaggtaacgtatcaacatatgaagcttctcatatatcagtagttaatactgttgcatggcaaatttccttcaagtttaatccygtgtagtcaggcctgtgattctaagagtctgttgattggatgactctgaagcagctttgttaatagtgtggacaatttgcatgaagctttttatcattta

SEQ ID NO: 54692 - DNA, 201 bp, Homo sapiens; identical to SEQ ID NO: 13739

SEQ ID NO: 54693 - DNA, 201 bp, Homo sapiens
atgggaatctgactgtaagcataggtaacaggagaaaacggtctgacttgtttgaagcaagtaagacttttccgactgtccagctttttcgtaagttcatraaacagaaatcctttagatgtgctgggctcctcgagttttaaaatatttccattttccttgtaaaacatcactttatctgatggtataataaaggagact

SEQ ID NO: 54694 - DNA, 201 bp, Homo sapiens
ctcacaggaacataaagtaattttggacttggtttctgtcagctgcatcatatgaaaacacgccagtaatttgaaaaaagaaatggagaataagagaaaawttttctggaattagggcaaagcaaaagcaaaatatggctattggtctaaggggagctgggagcaaaatgagatatagtcaaattgtcattgctcataatc

SEQ ID NO: 54695 - DNA, 201 bp, Homo sapiens
cgcatttaatctttgaaacaaatcaagagggtattttatgctcctttatagatgaggaaactgaggctcagagaggtaacttacttatccaagtttacacrgctgataaatagcagagctgggattcaaacccaggtctgtgggaggccagagcctgaactcttatcagttattgtctctctgatgctatgatgtcaagac

SEQ ID NO: 54696 - DNA, 201 bp, Homo sapiens
atcagaggagacctttctgattcagttatgtctctacagagtcctgaaggtaataagagagacagaggcaaccatcagtgcagtggccatggtgggcgcascaagttggcttcgatgtctgggtattagccagggagccggtgcagctggaggtggggtgagtggaggccagaagtgcagttgttgaggttggagaagtag

SEQ ID NO: 54697 - DNA, 201 bp, Homo sapiens
agacaatgttgtaaatcttgtatatgttttaactcatttaattctcacaacaaccctgtaatgtactattgttatttctttttttacaattacaaaatggrcacaccaagatatcgagtaatttcctcaaggtcacacagctgagagtgatagaagtggtcagattccagaaccctctgtaccataatcatatagtaagtc

SEQ ID NO: 54698 - DNA, 201 bp, Homo sapiens
gggctagcaggagcatgtgcttgcaatgatggtggaaatagaaaaacgtgcaatcatatgtgagtttcaagcctctccttgcatcatgtcttgtaatgtcytattggtcagtagggctgggaaatatatccctccctcagagagtcaggagtggaaatgaaaatgtttttaacaatagcctaatcaccataaaggctttgg

SEQ ID NO: 54699 - DNA, 201 bp, Homo sapiens
tgatagtagtagtaaaataataacagtaataataaaagtagcaacaatagcagcaaccgttattgagtacttagtatgaccagacaatgttgtaaatcttktatatgttttaactcatttaattctcacaacaaccctgtaatgtactattgttatttctttttttacaattacaaaatgggcacaccaagatatcgagta

SEQ ID NO: 54700 - DNA, 201 bp, Homo sapiens
ctgggggttagtttcaaagctgcctaccacaagagattttcaccagcaccacaaccccacacataataaataaactctacagttccatggcaagctacaargaagtctttgtgttgtctttatcataaaattgaatctttcccccaaaacacctgtagaaaggctatgcagcattaagtatcaaagggtcaaaatctaatt

SEQ ID NO: 54701 - DNA, 201 bp, Homo sapiens
gcccaccccaaccttaaatggccaggtttctggatttcagagaagcaagatcagacccttggcaggttccatctgagcagccacagcagccatagctacarcaataattattagcaagtgtgcgttctccctgccctagttagtacaccctataccatcaggtgtcatctgttctagttaaagtcagaccgtaataacaaa

SEQ ID NO: 54702 - DNA, 201 bp, Homo sapiens
aagactgcaatcttttttaacttcatcatggaagtggtatcccatcacttttgctgtattctcttcataagaagcaagttactaggttcagctcacacacraggggaaggcatttacacaagggcatgactatcaggagatggggaccactgggggttagtttcaaagctgcctaccacaagagattttcaccagcaccac

SEQ ID NO: 54703 - DNA, 201 bp, Homo sapiens
gtgtgcgttctccctgccctagttagtacaccctataccatcaggtgtcatctgttctagttaaagtcagaccgtaataacaaaacatcaaaatgtaaaawgtgggttgtttttttctttacacacttctaaagacatttaaagcctgagcagataccttaaaattcatcttctatctgaaaatacctcctagaaccattt

SEQ ID NO: 54704 - DNA, 201 bp, Homo sapiens
gttctgcacatgtatcccagaacttaaagtaaaataagctaaaaaaaaaaaaaaaaaaaaaagcctgcaagtggagaaggaggagagagagagagagagtktgtgtgagaaagtgagacagagtaagaaagaagggagcttgcaataagtagaaacaagactgcaatcttttttaacttcatcatggaagtggtatcccat

SEQ ID NO: 54705 - DNA, 201 bp, Homo sapiens
attttgaaaaattggttggtttggcttttggggaatttgagaggcaatttagtctgtcatttaggatggcatcatataaggcagccaacttcatcatgctrtttagcctgaaaagcgatattgttgatcttcaaccttgaaaaagtcgtacaggttgggagctgacctgcaaatggtcaggtatcttgagataggaaaagg

SEQ ID NO: 54706 - DNA, 201 bp, Homo sapiens
ccaccgtggcacatgcatacctgtgtaacaaacctgcacgttctgcacatgtatcccagaacttaaagtaaaataagctaaaaaaaaaaaaaaaaaaaaaagcctgcaagtggagaaggaggagagagagagagagagtgtgtgtgagaaagtgagacagagtaagaaagaagggagcttgcaataagtagaaacaagact

SEQ ID NO: 54707 - DNA, 201 bp, Homo sapiens
accattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaaaac

SEQ ID NO: 54708 - DNA, 201 bp, Homo sapiens
caccattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaaaa

SEQ ID NO: 54709 - DNA, 201 bp, Homo sapiens
tttctcatgccctaaattagtagtagagagacaatatagagagttcctatatagccctcacctatcttcctctaaggctaacacctgggaagttttttttwaaaaaatcctgatggcaaagctgcagcccagacccaaaaaatgagaatctgtgagatttaagattcgagcatcagtatttctttgaagcttattcccagg

SEQ ID NO: 54710 - DNA, 201 bp, Homo sapiens
gtcaatgacattgacattttctaaggagaaaaccattaaaatatcacggaatttgcaaaccctatgaatttatctcgtaatttctaggggatcatctgaarttatttactaagttagaagcagtcaataatgaaatcagcatgttacaccaattagaatttgttatcaactctcccttgtggatttcaaggtaatttcctg

SEQ ID NO: 54711 - DNA, 201 bp, Homo sapiens
gcaccattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaaa

SEQ ID NO: 54712 - DNA, 201 bp, Homo sapiens
aacccaggaagaataagtaaatcctctgattcaatcaaaaatgagcagaatgtaaaccaaaaatactagaagatatcctttttcctaggcactggcatacrtttcaatagtatctctaattacagatgtatttacacttctaagtgtcagaaatgaagattattatgacaaatttaaaatttagtaacttgtttttaaact

SEQ ID NO: 54713 - DNA, 201 bp, Homo sapiens
attccctagagcatagccaaaaaattgtgcaagaagatgaagtttatgcaaagtaaacactacaaaaacactctcactgagactcatggaagttccattayatattgagatgtcagaataaacacaaccttaatggattgcttccacttaatagatagttgagtactttattttgactgctgtactcaacaaatgattaat

SEQ ID NO: 54714 - DNA, 201 bp, Homo sapiens
ataatgttgttataaggggtaaatgagttaacatgaaagcacttacaacagggcctggcctacggaaagcgtagaaagaatgatatacatgttagctatarttatttgtttgggcatgatgatcttgtatcagtcagctattaatacacagtgctacgtaacaaacacactaaaactcagtggttccaaacaacaatgatt

SEQ ID NO: 54715 - DNA, 201 bp, Homo sapiens
aagtgtcagaaatgaagattattatgacaaatttaaaatttagtaacttgtttttaaactggtatttttgtttttttaagcgatcatctcagtccacattrgaacgatctgaacagcagatcagggctgcttctagtttggaggaactacttcgaattactcactctgaggactggaagctgtggagatgcaggctgaggc

SEQ ID NO: 54716 - DNA, 201 bp, Homo sapiens
cccatcggtccactaggtttgcggcaactttctatgacattgaaacactaaaaggtaggtgtgtggatgtggagacaaattctttctctttattagatagygacaaacacacttactttctccaaaagtctgcgtagggcagacacgtgtcagagggagaatgaaagtcggtctttgatttccagtattagtgcagaatct

SEQ ID NO: 54717 - DNA, 201 bp, Homo sapiens
atttctgctggagataattcttgggaaggcactcagccagtacacgtgtgtagagggtggtaagaagaatagggaagaagagaagtgctgttctaagcagsgggtatatgagcactcagggctggaggtgagagaacatactggaagaagttcagcatggtggggatataatgggtggggacataatggggaaggggctgg

SEQ ID NO: 54718 - DNA, 201 bp, Homo sapiens
tgggagagaagcagatttggggagaaaactactaaacatgtacgtccctccaaaaccttcaagaatgctaaagggacagagtcaagttcttccaaagtttmtgtctcttccatttattttgcaatgaatttcaacttgttaatcagaaatggatttggagtagtagctattcaattgttttatacaccttctagaagaaat

SEQ ID NO: 54719 - DNA, 201 bp, Homo sapiens
aaacaagaagaaatgaacgaaagagcaagttgataaaatggatgtccaataatattccattgttcaactatgcaacatttttcattgcctcccaaattggrtcaaagtagcctggtcttcatgcctccagtccttcctctttttaaaaattttatacaactatattaatatagaatttacatactataaaatttcattcaa

SEQ ID NO: 54720 - DNA, 201 bp, Homo sapiens
ggactagacctcaggatttttagatacccaggatcaggatatgaactactgcattaaatcatctccaacatctactctcatgatggcttgtctgacttcawgatttaaaaaaaattctaaagcatttttaaggcagtatattcaccctgtgctattttcctgtgggcataggatagggtttgtgtggatgtatcaaagact

SEQ ID NO: 54721 - DNA, 201 bp, Homo sapiens
tgcaccattgcactccaacctgggcaacaagagtgaaactccatcttaaaaaacaaaaaaacaaaacaaaacaaaacaaaaaaacaaagaaagaaagaaagaaaaccagtgtgagtaggtactgtcataatgaataaaatgcttgtcaagtaaagttctgtggtttctgattaggcacttaattttttgatgtcatgtcaa

SEQ ID NO: 54722 - DNA, 201 bp, Homo sapiens; identical to SEQ ID NO: 13839

SEQ ID NO: 54723 - DNA, 201 bp, Homo sapiens
gcggaggttgcagtgagccaagattgcaccattgcactccaacctgggcaacaagagtgaaactccatcttaaaaaacaaaaaaacaaaacaaaacaaaamaaaaaaacaaagaaagaaagaaagaaaaccagtgtgagtaggtactgtcataatgaataaaatgcttgtcaagtaaagttctgtggtttctgattaggca

SEQ ID NO: 54724 - DNA, 201 bp, Homo sapiens
gttaatatataaatttgttgaatggagtaacgaaggaaagcagctgaatttgcatgtgacagaaaacaagttgttacacgtggaggatgcagcattatatrcttactaatacgattagcaattttttttcagaatatatcagaatttcctttaaaaagtgaagctacatatactgaacttatatccaccctacccctcgct

SEQ ID NO: 54725 - DNA, 201 bp, Homo sapiens; identical to SEQ ID NO: 13794

SEQ ID NO: 54726 - DNA, 201 bp, Homo sapiens
cttatgtctccaagtcagctgggagtcagaggattaaggctcaaggcttaggtttggtgcaggtcagccccaggtgtctctcatcctcctttgatcagtgrgctagcaggagcatgtgcttgcaatgatggtggaaatagaaaaacgtgcaatcatatgtgagtttcaagcctctccttgcatcatgtcttgtaatgtcct

SEQ ID NO: 54727 - DNA, 201 bp, Homo sapiens
gtgattcccctgcctcagcctctcgagtagctggaattataggcacgtgccaccatgccgggctaattttttgtatttttagtagagacagggtttcactrtgttagccaggatggtctcgatctcctgacctgatgatctgcccgccttggcctcccatagtgctgggattacaggcgtgagccaccgcgcccggctggc

SEQ ID NO: 54728 - DNA, 201 bp, Homo sapiens
acaagaaagtatataatttttttattcccataggcttctttttttgttaccttcaaattaactatggtcaaaggattgctcattccagtaataagaacagrcttatttcatcatttacataaatatcagtatcgggcacttgcaaatgagaaaactctgatttgagtaaggattagtttcacttcaatttccatttatgcg

SEQ ID NO: 54729 - DNA, 201 bp, Homo sapiens
gcttatttcatcatttacataaatatcagtatcgggcacttgcaaatgagaaaactctgatttgagtaaggattagtttcacttcaatttccatttatgcrtttgccaagtttaaatcctactgtagttacttaagcaaccaacagaaacatatttcttgatgatgctaaaacctacctacacctggctttaaagcagaag

SEQ ID NO: 54730 - DNA, 201 bp, Homo sapiens
agtgattcccctgcctcagcctctcgagtagctggaattataggcacgtgccaccatgccgggctaattttttgtatttttagtagagacagggtttcacygtgttagccaggatggtctcgatctcctgacctgatgatctgcccgccttggcctcccatagtgctgggattacaggcgtgagccaccgcgcccggctgg

SEQ ID NO: 54731 - DNA, 201 bp, Homo sapiens
tgataaatagcagagctgggattcaaacccaggtctgtgggaggccagagcctgaactcttatcagttattgtctctctgatgctatgatgtcaagactcrgaaaaccatatggaagttactaggacaggatgttaaaaggaatgaagatagctgatggcaggttctgtgttgctcaaatggagtgattgagaaaaattta

SEQ ID NO: 54732 - DNA, 201 bp, Homo sapiens
catcaattctgagtagaaaaaaagcttgcataacgtaagagggtttagttcatgatcatgtgattccctagagcatagccaaaaaattgtgcaagaagatraagtttatgcaaagtaaacactacaaaaacactctcactgagactcatggaagttccattacatattgagatgtcagaataaacacaaccttaatggatt

SEQ ID NO: 54733 - DNA, 201 bp, Homo sapiens
atggccacgccccagccctgctccttccccattcctggactcggggaccttcccaagggcgttccttgccgacgctctccctctaggagcgtttgggtctstgtagacacccctcattccccattcgccattctcccgctcagggtcagtgtagacgctccagggctcggttctgcttctttcctccccgatgtctcttct

SEQ ID NO: 54734 - DNA, 201 bp, Homo sapiens
caggcaatgcacctgccttggctttccaaagtactgggattacaggtgtgagccaccgcgcccagccctctagttgtttttcaagacagtttttggggtgygggaagtatccacattcctacttcagtgtgtattttgttatgactatatattagtgcagtatggcttgtaaatgatggataaataaacagatatgcgctt

SEQ ID NO: 54735 - DNA, 201 bp, Homo sapiens
tgcacgacgttcatagttgactccacagatccggggtgaggagttcgcccctggactgaccccagagggtccgcggcccgctgaccccgcccgcggatggycacgccccagccctgctccttccccattcctggactcggggaccttcccaagggcgttccttgccgacgctctccctctaggagcgtttgggtctgtgta

SEQ ID NO: 54736 - DNA, 201 bp, Homo sapiens
tcagcctccctagtagctgggattacaggtgcctaccaccatgcccagctaattttttgtattttagtagagacgggatttcaccctgttgcccaggttgrtcttgaactcttgatctcaggcaatgcacctgccttggctttccaaagtactgggattacaggtgtgagccaccgcgcccagccctctagttgtttttca

SEQ ID NO: 54737 - DNA, 201 bp, Homo sapiens
ggctaggctggaaagtggaggatccggtttgctctgggcgggtctggaagcagagccggcggagggagcgccggggccctgggctgcaggaggttgcggcrgccgcggcagcatggtggtgccggagaaggagcaggtgagcgccggaccagggtctgcgggagcgcggagctggggacctcgcctccaggctcccagaga

SEQ ID NO: 54738 - DNA, 201 bp, Homo sapiens
agagctggatccccaagatcttcaagaagaagacctgcacgacgttcatagttgactccacagatccggggtgaggagttcgcccctggactgaccccagrgggtccgcggcccgctgaccccgcccgcggatggccacgccccagccctgctccttccccattcctggactcggggaccttcccaagggcgttccttgcc

SEQ ID NO: 54739 - DNA, 201 bp, Homo sapiens
aaatatgaagccctggccaaactcgacaaagcccgataccaggaagaaatgatgaattatgttggcaagaggaagaaacggagaaagcgggatccccaggmacccagacggcctccatcatccttcctactcttctgccaagaccactatgctcagctgaagagggagaacccgaactggtcggtggtgcaggtggccaag

SEQ ID NO: 54740 - DNA, 201 bp, Homo sapiens
cctggagaagcacccttatgagcaaagagtggctctcctgagagctaagtacttcgaggaacttgaactctaccgtaaacaatgtaatgccaggaagaagyaccgaatgtcagctagaaaccggtgcagagggaaaagagtcaggcagagctgatggatccagtttgaaaaaacaaaatgccattcaaccgtatttcctgt

SEQ ID NO: 54741 - DNA, 201 bp, Homo sapiens
gaaaagaaatccagctaaagcctaaggcaaatgtctcttcttacgttcactttttgctgaattacagaaacaaattcaaggagcagcagccaaatacctaygttggctttaaagagttctctagaaagtgttcggaaaaatggagatccatctcaaagcatgaaaaggccaaatatgaagccctggccaaactcgacaaag

SEQ ID NO: 54742 - DNA, 201 bp, Homo sapiens
gtgtggacatctctgggcagctcttgagtccaccttgtgccagatcagcagtgccacccaggctctgcctcctggtgttactctttgccaacagctttacrgacattggatgaagccgaagcatttagaatggtgcctggcacacagttggtgcgtgatatggttaagctttgtgtccccacccacatctcatcttgaatg

SEQ ID NO: 54743 - DNA, 201 bp, Homo sapiens
gtcatttccatcaccatgtgtctcagggcccccagggaagtcacctccctgtgcctgcaacacaggaagcacctaatacgcggtgggcactgtgatctgcrgcgtcccacagcacagggcttgagggcagccgccaagatgcaggcagaggagtggggaggaaggggcatttgggagaaggcggccactgaggggcttccc

SEQ ID NO: 54744 - DNA, 201 bp, Homo sapiens
ggtgcaggtgcagggaggtgaccatgtaactctgaccaatctgggaagtggagggtgggctcatgggccgtgctctgcccctgtctgctgctcccagtctytcgctctgcctgcctgctcagaagaggtggctttggcccagaggctcaggccgggactgagatggacagacccagggtggggtggggtccaggtcgggtg

SEQ ID NO: 54745 - DNA, 201 bp, Homo sapiens; identical to SEQ ID NO: 40098

SEQ ID NO: 54746 - DNA, 201 bp, Homo sapiens
ggcagaagaatcgcttgaatccaggaggcggaggttgccgtgagccgagatcgcgccattgcactccagcctgggcaacaagagcgaaactccatctcaamaaaaaaagaaaagaaaagaaaaaaaattccaaaaggttgactgactgttactaattactagtattgattactactgttttctagactggggtcagcaaat

SEQ ID NO: 54747 - DNA, 201 bp, Homo sapiens
ctctccccgaaaggtcttgacctgaatgatggccggggaagcctgcgtgtgcccctttcagagacggagcacctgagatgtgggaggtgcagcatgttccsctgggcccctcagaaagtcgagcttggaggccagcctggatctgtctctcccttcccctcctgggaccattctacctgtgttctttgaccctcggagcag

SEQ ID NO: 54748 - DNA, 201 bp, Homo sapiens
ctcactgcagactcaaactcttaggctcaagtcatcctcctgcctcagcatcctgagtagctgggagtacaggtgtgcaccaccactaattaaaaaaaaawtttttttttgtagagatggagttttgctttgttgcccaggctggtctcgcactcctggcctcaagtcatccttctgcctcagcctcccaaagtgctggaa

SEQ ID NO: 54749 - DNA, 201 bp, Homo sapiens
cttgaactcctactttagcctgtactcctgcctcagcctgcctagaactacaggcacacaccaccatgcctggctaattttttttttcttgtagagatggyatctcactctctggtttgcgacaagactagttgcaaactcctgggctcaaacaaccctcccacctcagcctcccaaagtactgggattcccggtgtgagc

SEQ ID NO: 54750 - DNA, 201 bp, Homo sapiens
ctcccaaagttctgggattacaggcatgagccaccgcgccgggcacttttacttaattttaacctaaataatacatgtgccccgtgatgagtatattggayatcctttggcagcttgcagtttctttccattcctttgggctgaatgataatcctgtggagtagaccagcaggattttgctccattttatagatgaggaaa

SEQ ID NO: 54751 - DNA, 201 bp, Homo sapiens
cctactttagcctgtactcctgcctcagcctgcctagaactacaggcacacaccaccatgcctggctaattttttttttcttgtagagatggtatctcacwctctggtttgcgacaagactagttgcaaactcctgggctcaaacaaccctcccacctcagcctcccaaagtactgggattcccggtgtgagccgccacac

SEQ ID NO: 54752 - DNA, 201 bp, Homo sapiens
aagcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtgg

SEQ ID NO: 54753 - DNA, 201 bp, Homo sapiens
agcttgcagctgccctgatggtgcaggtgcagggaggtgaccatgtaactctgaccaatctgggaagtggagggtgggctcatgggccgtgctctgcccctgtctgctgctcccagtctttcgctctgcctgcctgctcagaagaggtggctttggcccagaggctcaggccgggactgagatggacagacccagggtggg

SEQ ID NO: 54754 - DNA, 201 bp, Homo sapiens
agtctttcgctctgcctgcctgctcagaagaggtggctttggcccagaggctcaggccgggactgagatggacagacccagggtggggtggggtccaggtygggtgtggactgtcctcactgtcagtggagccccagaagctagatgggtaccaggtggggttaggttcccagaggactgagggaatcctgtacaggatgt

SEQ ID NO: 54755 - DNA, 201 bp, Homo sapiens
tttccccggctccctcctgccgccatgtgaagaaggtcgttgcttccccttcaccttccaccaccatgattgtaagttccttttttcttttcttttctttyttttttttttttgagatggagtctcgctctgtcgcccaggctggagtgcagtggcgcaatctcagctcactgcaagctctgcctcccaggttcgcgccat

SEQ ID NO: 54756 - DNA, 201 bp, Homo sapiens; identical to SEQ ID NO: 40091

SEQ ID NO: 54757 - DNA, 201 bp, Homo sapiens
ttggctcactgcaacctctgcctcccaggttcaagcgattctcctgcctcagcctccctagtagctgggactacaggtgtgcaccaccacacctggctaattttttttttttttttttgtatcttcagtagaaatggggtttcactatattggccaggctggtctcgaactcctgacctcaagtgatcagctcgcctcggc

SEQ ID NO: 54758 - DNA, 201 bp, Homo sapiens
cccagctacttgagaggttgaggcaggagaatcgtttgaacccaggaggtggaggttgcagtgagccgagatcgcaccactgcactctagcctgggtgacrgagcaagactctctctctcaaaaaaaaaaaaaaaaaaaaaaaaaaaaagaaagagagagagagaaccttcatctgggattttaagcctggatagccgcag

SEQ ID NO: 54759 - DNA, 201 bp, Homo sapiens
gaggttgaggcaggagaatcgtttgaacccaggaggtggaggttgcagtgagccgagatcgcaccactgcactctagcctgggtgacggagcaagactctytctctcaaaaaaaaaaaaaaaaaaaaaaaaaaaaagaaagagagagagagaaccttcatctgggattttaagcctggatagccgcaggggctattgggaa

SEQ ID NO: 54760 - DNA, 201 bp, Homo sapiens
agtgagccgagatagtgccatgcactccagcctgggctacagagcgagactccgtgtcaaaaaaaaaaaaaaaaaaaaaaaaaagtccccaacttattaaraagcccccagtgatgtaaagtctaccctgattcaccagcaatggccatattcagcaattctcttataatgtactccccatgagccttcggcaaatatacc

SEQ ID NO: 54761 - DNA, 201 bp, Homo sapiens
cccaagaggcatgaactcactgtccacggaggaattatgtttgactgtggtcatagatcacatatttccagccagggggaggcgtggattttgtgctgatrctgaaaggagtgagggacttgggactcatctggaatattgtcctgggccagatataacattagacaagtattttcaggacattgcaagagtgatggccct

SEQ ID NO: 54762 - DNA, 201 bp, Homo sapiens
tgatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctatttt

SEQ ID NO: 54763 - DNA, 201 bp, Homo sapiens
ctgtctcatcctcatgtcaccccaggtggcgggcttcaggactctctactctttcccctaagatgcagcttgttgagatgtttctagcactccattgcccyctgaggctcagatgagttccccttctccaagtacactctcccaggccaatgagccgaacacacatcacctcctccagatgtattctgtggcctgggctca

SEQ ID NO: 54764 - DNA, 201 bp, Homo sapiens
atataacattagacaagtattttcaggacattgcaagagtgatggccctttcttagtgggagagctgccttgaaagagtccattgtcctgacttgggggtktagtgacgttggactgcagtgagacagagttaaagcagtgcttccccaaatttaatgtgtagtggggtggcacgcacctgtagtctcagctacttggaag

SEQ ID NO: 54765 - DNA, 201 bp, Homo sapiens
gatgcaggagaatcaattgaacccaagaggcagagtttgcagtgagttgaaattgtgccactgcactccaacctgggagacagagtgaaactgtgtctcaaaaaaaaaaaaagtttctgtgacaacatgcattggagaactacaaattagatcctcagaattgacctttgagggagacaaagagatattggccctatttta

SEQ ID NO: 54766 - DNA, 201 bp, Homo sapiens
gttctagattccttctaaacaccagaacactcccagctgatgtctgttctgtgttccattttcattccaggcatggtctgagttctaggccagatgccaatttttttttttttttttttgagacggagtttcactcttgttgctcaggctggagtgcaatgctgcgatcttggctcaccacaacctctgcctcccgcgttc

SEQ ID NO: 54767 - DNA, 201 bp, Homo sapiens
agcccacgaagctgaggtcaacctgggcaacatagtaagaccctgtctctaaaaaataaacaaatacagccaggcgcggtggctcatgcctgtaatcccakcacgttgggaggctgaggtgggcggatcccttgaggtcaggagtttgagaccagcctggccaacatggtgaaacgccgtctctactaaaaaatacaaaaa

SEQ ID NO: 54768 - DNA, 201 bp, Homo sapiens
tttttttttttttgtttggagacggagtcttgctctgtcgcccaggctggagtgcagtggtgctatctcggctcactgcaagctccgcctcccaggttcaygccattctcctgcctcagcctccccagtagctgggactacaggcgcccaccaccacgcccggctaactttttgtattttcagtagagatggggtttcacc

SEQ ID NO: 54769 - DNA, 201 bp, Homo sapiens
ttggcttactgccacctctgcctcccgggttcaagagattctcctgcctcagcctcccaagtagctagaactacaggcacctgccaccatgcaccgctaattttttttttttttttttgtatttttagtagagatggggtttcactatgttggccaggctagtcttgaactcttgatccgcccacctcggcctcccaaagt

SEQ ID NO: 54770 - DNA, 201 bp, Homo sapiens
tctctactaaaaaatacaaaaattagccgggcgtggtggctcgtacctgtaatcccagctactcgaaggctgaggcaagagaattgcttgaacctgggatkgggaggttgcagtgagacgagatcgtgccaccgcgctccagcctgggtgacatagcagactctttcagaaagagagagagagagagagagagagagaaag

SEQ ID NO: 54771 - DNA, 201 bp, Homo sapiens
gaatcacttgagcttgggaggtggaagttgcagtaagccgagatccgtaccactgcactccagccagagtgctggttgctcatgcctgtaatcccagcacyttgggagaccaaggcaggcacatcacctgaggtcaggagttcaagactagcctggccaacatcgtgaaacccccgtctctactgaaaatacaaaaattag

SEQ ID NO: 54772 - DNA, 201 bp, Homo sapiens
ggagaggtcagaggcagggctccccagtgtacagcaacaataacccctcacaccagtggttttccaaagcaacctcagctttccctaaaggttcaaactcagggcaaaggggaggctgagtcactgggatcttgaaccctaactttcactttagtcagatctggtctacttttatttctcatgcgtcaagtttctgcatag

SEQ ID NO: 54773 - DNA, 201 bp, Homo sapiens
acagggccacacagcaaaatgcatggcagggtcccaattccaacctgaatttgttcaactccaaagtcacattgcctggtacatggcaggtgccctataakaagaatcattccttttctctgttactgcttgccccagaaagcaggagggacataaacgtgtggcccagggccttcaggaggacaccctccttcctctccc

SEQ ID NO: 54774 - DNA, 201 bp, Homo sapiens
ctggcactacaggtgtgagccaccacgcctggccacagttgttaatttcatttactattcactctgtattcaaatttccccaacatacttaaaatatgttyattgtttctcccccactaggacgaaaagtgtctgtcgtgtcccttgccatatcccacaccctatgacggtgactggtgcctgacactcaccagaagtaca

SEQ ID NO: 54775 - DNA, 201 bp, Homo sapiens
ccacccgcctctgcctcccgaagtgctagaccactctcagcctaatttttgtatttttagtagagatggggtttctccaggttggccaggctagtcttcartctccaaaagtgatgtgcccgcctcagcctcccaaagtgctggcactacaggtgtgagccaccacgcctggccacagttgttaatttcatttactattca

SEQ ID NO: 54776 - DNA, 201 bp, Homo sapiens
gcatccaaaaaaaaaaaagtttagaattttggagcattttggattttggattttcaggttggggatgctcagagacctgtacttgaatgtaattggagaargtcataacatcttagcccccaaaattactttagtgggtctttttcttccttgtaaacaccacatcctttatcacacctaagggcattcacattgttgtta

SEQ ID NO: 54777 - DNA, 201 bp, Homo sapiens
ctgtcagtctcctgttaaaggggccacgaccgcccgggagccgtggggggggagggggagggaggaggaatttttttggggggaaggtgggatttgggggscgctggtgggcacccctggatctggcggctgcggcctcgcggggggaggctgatcggtgacaggggcagggggctattttgggggtagaaggcagtgaga

SEQ ID NO: 54778 - DNA, 201 bp, Homo sapiens
ttcatgtcttcattcatttggtgatttatttagaatttggaaggaacacagcttgccaaggtaggcgggaggaggagggaaaaggaaagggcactctgggrcctgcttgggtgactgggtaggtaaaggaatttatttcctttacttatttttttgttgttttttggtttttgttgttgttgttttgagatggagtttcac

SEQ ID NO: 54779 - DNA, 201 bp, Homo sapiens
agggacgaatgggacccccaggccgggacagctcttctctgggtgagtacctcactctaacccttccctcctttgttccttcctcccttcctccctccctytctttcttctttgtatgttcatttgacatccattcatgtcttcattcatttggtgatttatttagaatttggaaggaacacagcttgccaaggtaggcgg

SEQ ID NO: 54780 - DNA, 201 bp, Homo sapiens
gatcttgaaccctaactttcactttagtcagatctggtctacttttatttctcatgcgtcaagtttctgcataggattttaaaaagtttctggctgggtgyggtggctcacgcctgtaatcccagcacttcgggaggccaaggtgggcagatcacttgaggtcaggagttcgagacccacctggccaacatggtgaaaccc

SEQ ID NO: 54781 - DNA, 201 bp, Homo sapiens
ctgggctgggaaaagcatcagtgaggtcgggcaagtcaggatcatgagccaagacccagcgccaacctcggcccccagccacctaatgtccctctgtcccsacacagggataggattgggagcggtctgccccttcgggctccataccacccccattccctggggaactggacggctccgatgaggaggaggcagagggga

SEQ ID NO: 54782 - DNA, 201 bp, Homo sapiens
acccactccccgctctgcccgtcttgagagaatgacccaggccttggcactgcaggcggggtccctggaagatgggggacccccacggggaaggtcagcakggacaagggatagggacagggagaagctggcttgggaagatgagaagggggtggacaaggacttgggaggagagggggcatctcagcaagcatatgctct

SEQ ID NO: 54783 - DNA, 201 bp, Homo sapiens
tttccttgtcctgtttcttctccttgcgaactttcccacgtctctgtttcgctccccacccccttgcctttccccacctccctgttcccccatctctccgrttttctcctcctctgtccctctgtcccctctgtccctctgtccctccgctgcagctgtgggtgggcatgcctgcctggtatgtggccgcctgccgggcca

SEQ ID NO: 54784 - DNA, 201 bp, Homo sapiens
tcccctcttcctactaacgggtcaggagaccaaggagatcagctgggagcaggtagggggcgcggggcggggcgtgagcgcatgaacaggctgtgcacgaygcatggatgcccctcctccgagccctgcccctgccttcaccagaacatgccatcatccccatgggggggcgctgcgccaagcttggctctggactgttcc

SEQ ID NO: 54785 - DNA, 201 bp, Homo sapiens
tcccagctacttgggaggctgaggcaggagaatcgcttgaacccaggaggtagaggttgcactgagccgagattgcaccattgtactccagcctgggtgayagagccagattccatctcataaaaaccaaacaaataaactaacaaaaaaacccaagaggcatgaactcactgtccacggaggaattatgtttgactgtgg

SEQ ID NO: 54786 - DNA, 201 bp, Homo sapiens
gtctctactaaaaaatacaaaaattagccgggcgtggtggctcgtacctgtaatcccagctactcgaaggctgaggcaagagaattgcttgaacctgggayggggaggttgcagtgagacgagatcgtgccaccgcgctccagcctgggtgacatagcagactctttcagaaagagagagagagagagagagagagagaaa

SEQ ID NO: 54787 - DNA, 201 bp, Homo sapiens
aggcaagagaattgcttgaacctgggatggggaggttgcagtgagacgagatcgtgccaccgcgctccagcctgggtgacatagcagactctttcagaaagagagagagagagagagagagagagaaagagagaaagaaagaaatttaaaaataaatataatgtatatttcgaatcacctgagggtcttgtgaaaatgccg

SEQ ID NO: 54788 - DNA, 201 bp, Homo sapiens
ggcaagagaattgcttgaacctgggatggggaggttgcagtgagacgagatcgtgccaccgcgctccagcctgggtgacatagcagactctttcagaaagrgagagagagagagagagagagagaaagagagaaagaaagaaatttaaaaataaatataatgtatatttcgaatcacctgagggtcttgtgaaaatgccga

SEQ ID NO: 54789 - DNA, 201 bp, Homo sapiens
cttaggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggag

SEQ ID NO: 54790 - DNA, 201 bp, Homo sapiens
agagagagagagagagagagagagagaaagagagaaagaaagaaatttaaaaataaatataatgtatatttcgaatcacctgagggtcttgtgaaaatgcmgataccgacttcagtaggtctggagtaaggtctgagattctgcaattccagcaagtccacaggtgatggtgacgctctaggtctcaggacaactgtttga

SEQ ID NO: 54791 - DNA, 201 bp, Homo sapiens
ttaggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagt

SEQ ID NO: 54792 - DNA, 201 bp, Homo sapiens
taggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagtc

SEQ ID NO: 54793 - DNA, 201 bp, Homo sapiens
agttcagatcctgaaatggcttggctagttaaccctggaccccttccaggctggccagtaggaagtgcctattattgaaaatgcctcacctcctgaggggrtcaacagtcaatagaacttatcagctccccaccctttccaagaagagcgcagccagtggggagggacccgtaggagcagcagtctaggggactggaaagc

SEQ ID NO: 54794 - DNA, 201 bp, Homo sapiens
agcctaagggtccctttgggagccaggtggagggcgtggagctggatggggaggagagggggtagggggagaccggagaagcaaattggcaccataaccgwgggggtggagccagcgtggggggcgtggcccgaagagaccaaatggaggtggaggtatgggctaaactgaactctccaggccacgggaggggcacggctg

SEQ ID NO: 54795 - DNA, 201 bp, Homo sapiens
aggcacagacaggcggctggacgaggtgggcgcggcaacagctcagagggctctgctcccagcggctcctcgagaggctgagctgagggggcggggcctgactattaatggtcacggttggaggcggggccaggagaggggcggggttaaaggagaggtgagacccggagaggggtggagtcaaaggaaggggcggagtca

SEQ ID NO: 54796 - DNA, 201 bp, Homo sapiens
gaggcaagagaattgcttgaacctgggatggggaggttgcagtgagacgagatcgtgccaccgcgctccagcctgggtgacatagcagactctttcagaaagagagagagagagagagagagagagaaagagagaaagaaagaaatttaaaaataaatataatgtatatttcgaatcacctgagggtcttgtgaaaatgcc

SEQ ID NO: 54797 - DNA, 201 bp, Homo sapiens
ggcaacagctcagagggctctgctcccagcggctcctcgagaggctgagctgagggggcggggcctgactattaatggtcacggttggaggcggggccagragaggggcggggttaaaggagaggtgagacccggagaggggtggagtcaaaggaaggggcggagtcagacaaggcaggagtccctcaccggctgtccggc

SEQ ID NO: 54798 - DNA, 201 bp, Homo sapiens
tcccagcggctcctcgagaggctgagctgagggggcggggcctgactattaatggtcacggttggaggcggggccaggagaggggcggggttaaaggagargtgagacccggagaggggtggagtcaaaggaaggggcggagtcagacaaggcaggagtccctcaccggctgtccggctcctatacctaggacagcgccaa

SEQ ID NO: 54799 - DNA, 201 bp, Homo sapiens
ctgtggccgtgtccgtgccccgggggtagggggcgcagaatggcgcttccccttctcctctggctccggggtttgcatgggagaatcctctttccacgatkccgctgggcgacgtggcgtgggggcagggggacggtgggggagccctcgcccccgactctcggtcggcctccccgccccaggcgtcactcagtgatcacg

SEQ ID NO: 54800 - DNA, 201 bp, Homo sapiens
aaattagccaggcatggtggcaggcgcccgtagtcccagctactcaggaggctgaggcaggagaatggcatgaacccgggaggcggagcttgcagtgagcygagatagtgccatgcactccagcctgggctacagagcgagactccgtgtcaaaaaaaaaaaaaaaaaaaaaaaaaagtccccaacttattaagaagcccc

SEQ ID NO: 54801 - DNA, 201 bp, Homo sapiens
gaatctcaagacaacacaaggttcccaacctcaaacaccaagaatctcatcctaacatgctaatcaaaaacttcaactccaggctgggcacagtggctcaygcctgtaatcccagcactttgggaggctgaggccagcggatcatgaggtcatgaggtcaggagatagagaccatcctggctaacatggtgaaaacctgtc

SEQ ID NO: 54802 - DNA, 201 bp, Homo sapiens
gacgccaagcagaagctgcagcagacgctgcagaaagcggagaccttgcccgagatagaggcgcagctggcgcagcgcgtggcggcgctcaacaaggtgcsgggaggactcgggtcggggccttgcgtggggaaggggtggggcctagaggaggcggggccgtgaatctggaggggtaggagcgaggtcagaaccccggat

SEQ ID NO: 54803 - DNA, 201 bp, Homo sapiens
gccctgccctgccggagctgactccacagcccttctggctctggaggcctgaaagcctgagtccgtctcctcttacaccatccacaaggaattcttccagyccaacactcactccgctgtccaggcatcccctaggatacactcagaagtcttctatgtgctacctacacatataccccccagccagtactcaccattccc

SEQ ID NO: 54804 - DNA, 201 bp, Homo sapiens
ctcatccactcaccctttcttctctccttccctgcaaccctcttgcctggatgtctcctcctgtggatgtcctgccacctggtgagaacctgagagtaatsatgggacagggaggggtgtgtagaatcccagagtaggtggggttaggtgaggaacaggagccagctgagtcatgggaatcaggggcgggggtggagtcat

SEQ ID NO: 54805 - DNA, 201 bp, Homo sapiens
acctcaagttatctgcccacctcagcctcccaaagtgctgggattgcaggcttgagccaccaggcctggccccttgaccttgacttcaggacccctggccstaggtctgtctctgtgacccttacctctgtgctcttttcctgaccccttggtctctgactgctttcctcatgcccacaggtctctccctggcagtgccct

SEQ ID NO: 54806 - DNA, 201 bp, Homo sapiens
agagtccattgtcctgacttgggggtttagtgacgttggactgcagtgagacagagttaaagcagtgcttccccaaatttaatgtgtagtggggtggcacrcacctgtagtctcagctacttggaagactgaggcaggaggaccgcttgagcccacgaagctgaggtcaacctgggcaacatagtaagaccctgtctctaa

SEQ ID NO: 54807 - DNA, 201 bp, Homo sapiens
atactgtgttctaaaccagggtcaccccacacacaccttagtagacatctcagttaataaggagcccccgacatgactctttgaactcaatccagcatctrtgccctctgtcctcagaatcatgtccctaaggaggaagctggagctccacgaggggaggggccggccatcccaggagacaccccaccacccactccccgc

SEQ ID NO: 54808 - DNA, 201 bp, Homo sapiens
ccttcctccctccctctctttcttctttgtatgttcatttgacatccattcatgtcttcattcatttggtgatttatttagaatttggaaggaacacagcytgccaaggtaggcgggaggaggagggaaaaggaaagggcactctgggacctgcttgggtgactgggtaggtaaaggaatttatttcctttacttattttt

SEQ ID NO: 54809 - DNA, 201 bp, Homo sapiens
gtttgctctgcttagaaccccgctgtgccctgcagacacacagacttagcctcctggcacccagcatctgctccccgagggactcaggcgccatgactccyttcctttgggggacccggaatgtgattctcaatgcagttctctgacttctgttcacactcccacttggggacctaaatgtcttggtcccagtctcctatc

SEQ ID NO: 54810 - DNA, 201 bp, Homo sapiens
agattcacatgtattttttgaccttctgccgtgttttgtacattcataaaaggtgcgtgtgcgtatgtgcatgtgtgtgtgtgtgtgtatgtgtgctgatrggggccatccacagagcagggggtctccatccctgacagcttctatcctggccccttcacccttacaggcatgaactcctggaggaggcctgccgccagg

SEQ ID NO: 54811 - DNA, 201 bp, Homo sapiens
tggcttttacccccctcagcctcccctccactcctaacttggcctgtggtccgtccctgtggtactccaggaggggcccaggccacctccttccctgactstctccctctcctcggcatttgctgtcccactcaaatgtcaccacctctaagaagctttctttgtcagctaaacgagtttccccatcattccggcatatca

SEQ ID NO: 54812 - DNA, 201 bp, Homo sapiens
tgataggggttggggggagaggatttacagattcacatgtattttttgaccttctgccgtgttttgtacattcataaaaggtgcgtgtgcgtatgtgcatrtgtgtgtgtgtgtgtatgtgtgctgatgggggccatccacagagcagggggtctccatccctgacagcttctatcctggccccttcacccttacaggcat

SEQ ID NO: 54813 - DNA, 201 bp, Homo sapiens
tcttattttgttctctcttttgataggggttggggggagaggatttacagattcacatgtattttttgaccttctgccgtgttttgtacattcataaaagstgcgtgtgcgtatgtgcatgtgtgtgtgtgtgtgtatgtgtgctgatgggggccatccacagagcagggggtctccatccctgacagcttctatcctggc

SEQ ID NO: 54814 - DNA, 201 bp, Homo sapiens
tgggaattcaatgctgggaggaggtgtccgtgatcctgaacttgcttgcctggaaacccaggagctcctagagtttttattttttctttctttttttaaawtttttttttgtattttttacatttatattatattttttgtttcttttgtttttcttattttgttctctcttttgataggggttggggggagaggatttac

SEQ ID NO: 54815 - DNA, 201 bp, Homo sapiens
aagctacgcctcgccatccaggagatggtctcgctcacctcgccctcagcccccgcctcctcccgcactgtgagtgtccggcggccaattccagccttcgyttcctcagagccccgcctcttgccctcagtctagccaatcctgggcctgctcactcccctgtcccacgaccctgcttctcattggcttttacccccctca

SEQ ID NO: 54816 - DNA, 201 bp, Homo sapiens
gcctaagggtccctttgggagccaggtggagggcgtggagctggatggggaggagagggggtagggggagaccggagaagcaaattggcaccataaccgtrggggtggagccagcgtggggggcgtggcccgaagagaccaaatggaggtggaggtatgggctaaactgaactctccaggccacgggaggggcacggctga

SEQ ID NO: 54817 - DNA, 201 bp, Homo sapiens
ggcagtgctcgaggaggagctggaactgagcaatcaggaggtgtgggtgtggccaagacagggaatttgaatccaaggggaggggctaaggggctgcccayggggcggagccggttgggtgggttccagagagaatctattggggcaggactagggcagacaagctatggggttggactatggagagaaaccagtggggtt

SEQ ID NO: 54818 - DNA, 201 bp, Homo sapiens
ataaaataaaaaaaataaagctgggctgggaaaagcatcagtgaggtcgggcaagtcaggatcatgagccaagacccagcgccaacctcggcccccagccrcctaatgtccctctgtccccacacagggataggattgggagcggtctgccccttcgggctccataccacccccattccctggggaactggacggctccga

SEQ ID NO: 54819 - DNA, 201 bp, Homo sapiens
attccccaccctgtactgtgtgtagtaaccttctaggttctatgtccagccttgctgtgttttttatttccttctcggtcaatttaaggctctggaacagsctccccaaaacatctgtgttgcatcgtcagagtgggttgctggttttagatatcatgttggggctgggcgcggtggctcatgcctataatctcagcactt

SEQ ID NO: 54820 - DNA, 201 bp, Homo sapiens
aacgttccggactcccccgtcaggatgaaatggataaatcccactcccccttcccagggcgggagtgaactcgcccaatgcgagtttgagtccttggctgyggggaagggagggaaacccatgtggagcccggcgatcgttgtgacatcgggaagggaagtccaaagggaggaatcctggagaggaacagggaggagggtg

SEQ ID NO: 54821 - DNA, 201 bp, Homo sapiens
gtttttattttatttttgagacggagtctcactctgtcacccaggctggagtgcagtggtatgatctcagctcactgcaacctctgcctcccgggttcaarcaattctcctgcctcagcctcccaaatagctgggactacaggcacatgccaccacgcctggctaattttttttgtatttttaatagagacagggttttgc

SEQ ID NO: 54822 - DNA, 201 bp, Homo sapiens
tttctgttgggagacgggtgtcctttacccgcgggaagggggcggggcttccctcccgggccgcatgcggggagaggctgctccctcccctttttcctgcscagtcgcggggcccaagtcttccttcttcgtccgaaaggaggggaggggggactcgctgctacaagcctcgccccctgtgccactcagctccgccccgcc

SEQ ID NO: 54823 - DNA, 201 bp, Homo sapiens
aggggaggggggactcgctgctacaagcctcgccccctgtgccactcagctccgccccgccgcgtccggtcgccggtcccccgggtcatctgcgggcgggktcccctctccctcccccgtgtctcgtgtccccggggcctcaccgccccccgtgctgtggccgtgtccgtgccccgggggtagggggcgcagaatggcgct

SEQ ID NO: 54824 - DNA, 201 bp, Homo sapiens
gctggagtgcaatgctgcgatcttggctcaccacaacctctgcctcccgcgttcaagcgattctcctgcctcagcctcctgagtagctgggattacaggcrcctaccaccatgcccggctaattttttgtatttttagtagagatgggggtttctccatgttggtcagactagtctcgagttcccgacctcaggtgatcac

SEQ ID NO: 54825 - DNA, 201 bp, Homo sapiens
ctgttctgtgttccattttcattccaggcatggtctgagttctaggccagatgccaatttttttttttttttttttgagacggagtttcactcttgttgcycaggctggagtgcaatgctgcgatcttggctcaccacaacctctgcctcccgcgttcaagcgattctcctgcctcagcctcctgagtagctgggattaca

SEQ ID NO: 54826 - DNA, 201 bp, Homo sapiens
tgagacaaggtctctgttgcccaggctggagtgcactggcacaatcacagctcactgcagcctccacctcctaggctcaggtcatcttcccaccttagcckcctgagtagctgggaccacaagcactcaccaccaggcctggctaattaaaaaaaaatttttttggccaggcgcggtggctcatgccggtaatcccagcac

SEQ ID NO: 54827 - DNA, 201 bp, Homo sapiens
ctgcggggaagggagggaaacccatgtggagcccggcgatcgttgtgacatcgggaagggaagtccaaagggaggaatcctggagaggaacagggaggagkgtgctccaggctgaaccgctgctcgctctccctccaggccagacttctgggagttcccgggcagacggcgtttcggtccggacctattcctgctagtgca

SEQ ID NO: 54828 - DNA, 201 bp, Homo sapiens
gattctggccgtgattggttggggatgttctgagttggaagaatgttgactgtgattgattgggacaggatacatagactgggacctgactggttgatagyagaaaaataaaccaggatgggggctaacagtggatggggcagattggatagctggttgtggctgcatacccgttatggagacaggagccccaacgctgcc

SEQ ID NO: 54829 - DNA, 201 bp, Homo sapiens
ggtagaagtgctcaaagctctaaagtctctcttcgagcaccacaaggccctggatgagaaggtatgagaattagaagagcaggggtggagaatggaaaccyatagttgactggggctgttctgagtgggagagattctggccgtgattggttggggatgttctgagttggaagaatgttgactgtgattgattgggacagg

SEQ ID NO: 54830 - DNA, 201 bp, Homo sapiens
tggtgtccaggcacgagaggtcactgcgcatgaccgtggtgaagcgccaggcccagtccccgggtggggtctcctcggaggtagaagtgctcaaagctctraagtctctcttcgagcaccacaaggccctggatgagaaggtatgagaattagaagagcaggggtggagaatggaaacccatagttgactggggctgttct

SEQ ID NO: 54831 - DNA, 201 bp, Homo sapiens
gtctcggtgctcctttatatggctccatcttttcctccatgtgtccgccctacctgtcaccctttttctcacatctgccccttttcccttgcctcttttcmttgaccccatgccgtgtgcttgcagctgctcctggaacacctggagtgcctggtgtccaggcacgagaggtcactgcgcatgaccgtggtgaagcgccag

SEQ ID NO: 54832 - DNA, 201 bp, Homo sapiens
ttgggacaggatacatagactgggacctgactggttgatagcagaaaaataaaccaggatgggggctaacagtggatggggcagattggatagctggttgyggctgcatacccgttatggagacaggagccccaacgctgccctatcggatccgtcccaggggtgttctggaccaggggcaactgtcctaaactggatctt

SEQ ID NO: 54833 - DNA, 201 bp, Homo sapiens
attggttggggatgttctgagttggaagaatgttgactgtgattgattgggacaggatacatagactgggacctgactggttgatagcagaaaaataaacyaggatgggggctaacagtggatggggcagattggatagctggttgtggctgcatacccgttatggagacaggagccccaacgctgccctatcggatccgt

SEQ ID NO: 54834 - DNA, 201 bp, Homo sapiens
gccgtattttggggatgactccaattcatgggcgcttgtctgcctttatcacttcctcgatgtgccctcactcactactccctcagggcctctgcctttcyggcattttcctcatcacctccagcatgaaagattctgcctcccccttgagattttccaaatttcgacccctccctgcctccagctggaacaccctcagat

SEQ ID NO: 54835 - DNA, 201 bp, Homo sapiens
cagctcactgcaagctccgccttctgggttcacaccattttcctgcctcagcctcccaagtagctgggacaacaggcgcccaccaccacgcccggctaatwttttgtatttttggtagagacggggtatcaccgtgttagccaggatggtctctatctgttaacctcgtgatccacctgcctctgcctcccaaagtgttgg

SEQ ID NO: 54836 - DNA, 201 bp, Homo sapiens
aaatgggcaaatgctacaaatcagggattcccttctgcctccccaaggagccggttgttaggcatttaccagcatacaactgccaccttaccaagggcatmccagtgcatccagccgtattttggggatgactccaattcatgggcgcttgtctgcctttatcacttcctcgatgtgccctcactcactactccctcaggg

SEQ ID NO: 54837 - DNA, 201 bp, Homo sapiens
tagtagagatggggtttcaccatgttggccaggctgggctcaatctcttgacctcgtgatccaacagcctcagcctcccaaagtgctgggattacatgagygggccaccttgcccggccgttactgtgttttttttttgaaatggaatctcacactgttgcccaggctggagttcagtggtgctatctcggctcactctaa

SEQ ID NO: 54838 - DNA, 201 bp, Homo sapiens
agggaggagaattgcttgaaccgggacccgggaggtggaggctgcagtgagccgagatcgcatcactgcactccagcctgggtgacagatcactccagctaaaaaaaaaaaaaaaaaaaaaaaagaaagtagggaaaggaaaagaaaagaaaagaaaagaaaaaaattagccaggtatgctggtgtgtgcctgtagtcgca

SEQ ID NO: 54839 - DNA, 201 bp, Homo sapiens
actcttccctcacctgcccatggccccagatcctggcatatggcgacatgaaccacgagtgggtggggaacgactggctgcccagcctggggctgccccartaccgcagctacttcatggagtcgctggtggacgctcgaatgttagatcaccttaacaagaaggagctccggggccaactcaagatggtggacagctttc

SEQ ID NO: 54840 - DNA, 201 bp, Homo sapiens
gtcaggatcatgagccaagacccagcgccaacctcggcccccagccacctaatgtccctctgtccccacacagggataggattgggagcggtctgcccctkcgggctccataccacccccattccctggggaactggacggctccgatgaggaggaggcagaggggatgtttggggccgagctgctgtcccccagtgggca

SEQ ID NO: 54841 - DNA, 201 bp, Homo sapiens
tcttacaggccaccttgaacttgaccttttgtccatagtaatcccttcatgattttccaaaccccttgactatcatcagggccaccctgatacaaaccccratcaccttgatagccctaatcctgcaatgacttcctgagactctcaggaccccttgactctccttgagcctggaaggccttcagaaacccaccaaagtcc

SEQ ID NO: 54842 - DNA, 201 bp, Homo sapiens
agcctcccaaagtgctgggattacaggcgtgagccaccgtgcccggcctacaatattttaaatagctttgtgcatgaaacaaagttttgactgcattttgwttgtgacttgtcacatgaggtcaggtgggggattttcctcttgtggcttcgtgtcagcacgtaagtttagggccaagcactgtggctcacacctgtaatt

SEQ ID NO: 54843 - DNA, 201 bp, Homo sapiens
tctctccctctccctcttcccccacccgccccccgccccccgtttctctccctatttgtctccctcggactctccctcatctcgtccacgtctcttttccytgtcctgtttcttctccttgcgaactttcccacgtctctgtttcgctccccacccccttgcctttccccacctccctgttcccccatctctccggttttc

SEQ ID NO: 54844 - DNA, 201 bp, Homo sapiens
gcggcgagcgggactggccattggagtgctccgctgcggagggaggggaccccgactcgagtaagtttgcgagagcactacgcagtcagtcgggggcagcrgcaagatgcgaagcgagccgtacagatcccgggctctccgaacgcaacttcgccctgcttgagcgaggtagggggcggcgaatggcgggggtcgcgggcg

SEQ ID NO: 54845 - DNA, 201 bp, Homo sapiens
aacgaatttttaagtcgaacgaggcaaacaaaaacttagaaaacatgcatctccgggcgctgaaaatttgcatctctgggctactaaggagcccatctcgrtcagattgttcttgggcacttgtgatttatggagttcagaaaaaaggttaattcccaactgtggaacctacgggtgtaggggcagtgaaaattgcagttg

SEQ ID NO: 54846 - DNA, 201 bp, Homo sapiens
tcgccctctagcgttcgtccggagtagcgccaccccggcttcctggggacacagggttggcaccatggggcccaccagcgtcccgctggtcaaggcccacsgcagctcggtctctgactacgtcaactatgatatcatcgtccggcattacaactacacgggaaagctgaatatcagcgcggacaaggagaacagcattaa

SEQ ID NO: 54847 - DNA, 201 bp, Homo sapiens
tcgcctcgccctctagcgttcgtccggagtagcgccaccccggcttcctggggacacagggttggcaccatggggcccaccagcgtcccgctggtcaaggmccaccgcagctcggtctctgactacgtcaactatgatatcatcgtccggcattacaactacacgggaaagctgaatatcagcgcggacaaggagaacagc

SEQ ID NO: 54848 - DNA, 201 bp, Homo sapiens
gcgctctttacttggtcgctggccaccccagtgtttggaaaaaaatctctgggcttcgactgctgccagggaggagctgctgcaagccagagggaggaagrgggagaatacgaacagcctggtggtgtcgggtgttggtgggtagagttagttcctgtgaacaatgcactgggaagggtggagatcaggtcccggcctgga

SEQ ID NO: 54849 - DNA, 201 bp, Homo sapiens
ctctccagccaaggaaaagctacacaaaaagcctggatcactcatcgaaccacccctgaagccagtgaaggctctctcgcctcgccctctagcgttcgtcyggagtagcgccaccccggcttcctggggacacagggttggcaccatggggcccaccagcgtcccgctggtcaaggcccaccgcagctcggtctctgacta

SEQ ID NO: 54850 - DNA, 201 bp, Homo sapiens
atcactcatcgaaccacccctgaagccagtgaaggctctctcgcctcgccctctagcgttcgtccggagtagcgccaccccggcttcctggggacacaggkttggcaccatggggcccaccagcgtcccgctggtcaaggcccaccgcagctcggtctctgactacgtcaactatgatatcatcgtccggcattacaacta

SEQ ID NO: 54851 - DNA, 201 bp, Homo sapiens
aatggattaacttttgcaaaccaagggagatttcttagcaaatgagtctaacaaatatgacatctgtctttggcacttttgttgatgtttatttcagaatsttgtgtgattcatttcaagcaacaacatggttgtattttgttgtgttaaaagtacttttcttgatttttgaatgtatttgtttcagcagaagtcatttta

SEQ ID NO: 54852 - DNA, 201 bp, Homo sapiens
aacagacaagcaaaacaaagtgaaaaccgaatggattaacttttgcaaaccaagggagatttcttagcaaatgagtctaacaaatatgacatctgtctttsgcacttttgttgatgtttatttcagaatgttgtgtgattcatttcaagcaacaacatggttgtattttgttgtgttaaaagtacttttcttgatttttga

SEQ ID NO: 54853 - DNA, 201 bp, Homo sapiens
tacagatcccgggctctccgaacgcaacttcgccctgcttgagcgaggtagggggcggcgaatggcgggggtcgcgggcgcggggagcccggttgtggtarggcttaggtgtcagaaacgaatttttaagtcgaacgaggcaaacaaaaacttagaaaacatgcatctccgggcgctgaaaatttgcatctctgggctact

SEQ ID NO: 54854 - DNA, 201 bp, Homo sapiens
cgcggcgctgggtgacttcgcgtagcaggcagggaactggccgcggcgagcgggactggccattggagtgctccgctgcggagggaggggaccccgactcsagtaagtttgcgagagcactacgcagtcagtcgggggcagcagcaagatgcgaagcgagccgtacagatcccgggctctccgaacgcaacttcgccctgc

SEQ ID NO: 54855 - DNA, 201 bp, Homo sapiens
aaggcgttaaattttggaaatcctatagacaaagaatatggtgggtggtgtggagcgtgggtaatggcttaaattagtactgcccaggagcagggtataamattagttgggggaaaatgcggagcttcttggcttgagcagcctctgctgttcgcggagttgctgggattgttctcatctctattacctcattttattgca

SEQ ID NO: 54856 - DNA, 201 bp, Homo sapiens
tgcattaccttgaaatatttaagcaacttagaagtagacttctgctgaccagtgccgtcttagaaagtttctttgtaactttctagtcctaggagaggagycaacgtgttgggggactgcagtaaataaaactgcccacgcaaatttagcaatgcaccagggagcagtttaatgtgagtttctgaagagtagttttgcaat

SEQ ID NO: 54857 - DNA, 201 bp, Homo sapiens
ttgagtgaatgtggccatagagtttctccctctctttttcttccccctcttccttttttgaaaaaagaaaaaaaaggaagaaaaaagataatttgattttwaaaaaaaatctctctccctgagctctccccaagtttctttaaaacaaatcaacaacaacacaattggagcagtgccttagctagaatgaattatgccagt

SEQ ID NO: 54858 - DNA, 201 bp, Homo sapiens
tgtagtcccagctactcgggaggctgagaccgaagaattacttgatgaaacatggcagacgacatagaccagcagcaaactaccaacactgtggaggaccycctggatcttaggctcagcccagaggagcgaatttgtgtgaaaatgagaaacgaccgagagcttcgaggcagattacatacttatgatcaacatttaaat

SEQ ID NO: 54859 - DNA, 201 bp, Homo sapiens
tactatagaaattgatgaggaaacatatgaagagacatatgaatcaacaaaacagaatattccagtgttctttctccggggagatggcattttcctggttscccctccactgagagttggctgaaacaaagaatttgtcctgtatggaaaacaggagactttgtacagtggcctctctaaatgtgcaagatattcaaaaga

SEQ ID NO: 54860 - DNA, 201 bp, Homo sapiens
ttcgagtgttcatttttcgtttcgtttcatccgagccccggcttggttcccggccacgccggaggggtctgcgctcccacacacccagacgggaaggggcytctgccctgctgcagaccgaccgccgcatagcgcggcccctgctccccgcggggccctgccctcctggccacaccaaacgaaacttggaaaagttagaga

SEQ ID NO: 54861 - DNA, 201 bp, Homo sapiens
gaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgag

SEQ ID NO: 54862 - DNA, 201 bp, Homo sapiens
gcgtctgtgtataaaagcaggaaatagccaaagctttaatctagcctaatttatttttccccttatatttccctaccctaccctccccccaaaaaaaagcaaaaaaaaaaaaaaaaactaacaaaaaaaattcgagtgttcatttttcgtttcgtttcatccgagccccggcttggttcccggccacgccggaggggtctg

SEQ ID NO: 54863 - DNA, 201 bp, Homo sapiens
cctggggaagcaaagtagaatttcataagaacaaaatggatggagaggagaaaacctatggtggctgtgaaggccctgatgccacgtatgtcaaattgatrtcatctgatggccatgaatttattgtaaaaagagaacatgcattaacatcaggcacgataaaagccatgttgagtggcccaggcgttttatgggtttggc

SEQ ID NO: 54864 - DNA, 201 bp, Homo sapiens
acagaggagacggaagtgagccacacactctgtgtcctcgcctcaccaggaaactactaaagttcctggggaagcaaagtagaatttcataagaacaaaayggatggagaggagaaaacctatggtggctgtgaaggccctgatgccacgtatgtcaaattgatatcatctgatggccatgaatttattgtaaaaagagaa

SEQ ID NO: 54865 - DNA, 201 bp, Homo sapiens
atgttgagtggcccaggcgttttatgggtttggcttttaaatttaggtctttggtcttaagttaatttttgtttatgctgtgaggtcagtttgctgagaaygaaaccaatgaggtcaattttagagagataccttcacatgtgctatcgaaagtatgcatgtattttacctacaaggttcgctacactaacagctccatcg

SEQ ID NO: 54866 - DNA, 201 bp, Homo sapiens
tatcttgtttttttcatagcaatcaaagttgaaatttgtttgctacatcaacaaattaagaacattttcacaaactgagaaataaacaaatatgccaattaaaaaaaaaaaaagaaagaaacagagacagagatatctggcccctgccatccatgtcttgacagtgcctcatgagtctctcctcctgctgccgcctggggg

SEQ ID NO: 54867 - DNA, 201 bp, Homo sapiens; identical to SEQ ID NO: 54463

SEQ ID NO: 54868 - DNA, 201 bp, Homo sapiens; identical to SEQ ID NO: 54465

SEQ ID NO: 54869 - DNA, 201 bp, Homo sapiens; identical to SEQ ID NO: 54468

SEQ ID NO: 54870 - DNA, 201 bp, Homo sapiens; identical to SEQ ID NO: 54469

SEQ ID NO: 54871 - DNA, 201 bp, Homo sapiens
atcttctcatatctactggtggagtgggaaagagtagttcaaacaactcagacagaaaatctcgctggtgcaacagtggagagaagggccaagtacttgtyctgttacttccagtttttctagatatatgagcagcaggactcctctctttataaaaagaactatgagtttcctggctctaatgaagagtgaccaggcatt

SEQ ID NO: 54872 - DNA, 201 bp, Homo sapiens
cctgacgcagcatcccaagtagccgggaccacaggcacatgccaccccccacagctatttttgtttgtttgtttgttttttgttttgttttgtttttgagrcagagtctcactctgtcacccaggctggagtgcagtggcgcgatctcggctcactgcaagctccgcctcctgggttcccgccattctcctgcctcagtct

SEQ ID NO: 54873 - DNA, 201 bp, Homo sapiens
ctactcactggcatatttctgaggtatctgtagaataaccacagcctcagatactggggactttacagtcccacagaaccgtcctcccaggaagctgaatycagcaagaacaatggaggccagcgggaagctcatttgcagacaaaggcaagtccttttttcctttctccttttgggcttatctctggcgggcgcggcgga

SEQ ID NO: 54874 - DNA, 201 bp, Homo sapiens
aagaaggcacaaaccagaaccgcagctgcagctccattaaccggcaaaaagcagcagaacctggaagtccacggggagcttggatgccaaagggaggacgrctgggtcctctggagaggactactcactggcatatttctgaggtatctgtagaataaccacagcctcagatactggggactttacagtcccacagaaccg

SEQ ID NO: 54875 - DNA, 201 bp, Homo sapiens; identical to SEQ ID NO: 54472

SEQ ID NO: 54876 - DNA, 201 bp, Homo sapiens; identical to SEQ ID NO: 54474

SEQ ID NO: 54877 - DNA, 201 bp, Homo sapiens; identical to SEQ ID NO: 54475

SEQ ID NO: 54878 - DNA, 201 bp, Homo sapiens; identical to SEQ ID NO: 54477

SEQ ID NO: 54879 - DNA, 201 bp, Homo sapiens; identical to SEQ ID NO: 54476

SEQ ID NO: 54880 - DNA, 201 bp, Homo sapiens
gcaggataagaaggcacaaaccagaaccgcagctgcagctccattaaccggcaaaaagcagcagaacctggaagtccacggggagcttggatgccaaaggsaggacggctgggtcctctggagaggactactcactggcatatttctgaggtatctgtagaataaccacagcctcagatactggggactttacagtcccac

SEQ ID NO: 54881 - DNA, 201 bp, Homo sapiens; identical to SEQ ID NO: 54478

SEQ ID NO: 54882 - DNA, 201 bp, Homo sapiens; identical to SEQ ID NO: 54479

SEQ ID NO: 54883 - DNA, 201 bp, Homo sapiens; identical to SEQ ID NO: 54480

SEQ ID NO: 54884 - DNA, 201 bp, Homo sapiens
caagttcctgaagccgattatccccaacttccctccccagtgccctgggaaagaaatacaaggaaattctaccttccccaataactttgggttcaatattyagtgaccatagttgacttttacattccataggtattttattttgtggcatttccatgccaatgtttatttcccccaatttgtgtgtatgtaatattgtac

SEQ ID NO: 54885 - DNA, 201 bp, Homo sapiens
ttagtgcagtgcctggcacagagaggccatagttcacgcttatgcaggggatgaagaagaatgagatgccacccacagaggccctgttggttttgctctgsgtgccctgtagcctgagtttgcagtgcatccccctctgatgctgtgggccaggaaggctggccccaaccagctgtggctgggagcagctggtggtgtgag

SEQ ID NO: 54886 - DNA, 201 bp, Homo sapiens
tcagatgagaggatgatagtccaggagacttggggtttccatggcaactgatgtaaacgatgaggaagagcaggtaaggtgcgaggacccccaaaagtgcygtggaatgtggtgattgtaaggccaggagtgggggatgggggaggtgggtcttgccagcagcctgcaggggctctggggcccctgcacactcctgcctct

SEQ ID NO: 54887 - DNA, 201 bp, Homo sapiens
ggcaaggccagcgatgcccttgagtaggggatgtgccccaggagggctggtcttgggcaagagcccagacagcacacccctcttcccaggagggcaggcayggtcgtggactcaaaggcaggagggctgggagatgaggtggtgggaggagggaggttgaaggctctgagtgacaagggggaagagtggggaggcttctgg

SEQ ID NO: 54888 - DNA, 201 bp, Homo sapiens
ggcatgttcttgttctcactcccctttgatctctctcccctcttccttatccctgttcacagaagtggaaactgaggctcagaaaggtgaattggcttggmcagggctatgcagccagggagcagcagggctggggccttgagagaggaaggaggagaagccaggcttggtcagggcccctctgcagagcttcctgcagga

SEQ ID NO: 54889 - DNA, 201 bp, Homo sapiens
cacgctggggcaatgacctattttcacagaagcaaatctgagcctctcatctgagaagtctggtgaaatgcgagagacacggtggggaaataggaccttgmggggcccagaggtggggtgggtaagattcagggggatcctgtgggaacaggtgaagcaaggtgtcaggaaggggcagggctcaccccaaggataaaaaat

SEQ ID NO: 54890 - DNA, 201 bp, Homo sapiens
agtttaattttaatttaaacaactgcatgtggccagtggctactgtggtggacagcaaagctctaagggactgctgagctctggttctggctgaaggtggsggggagggcctaggctggagcgtgtgtgtctgtggtctggcctccatctgccggaagcccctgactgtgggtcatcctgtggggattccctagcttcgtt

SEQ ID NO: 54891 - DNA, 201 bp, Homo sapiens
ctcagccaggctaatcaggtcgcagggtgaaatttaaagggaggaggaggcaccagtccatcagaactcacacttcttcctggcaaagaagtgcccaggaygggagctggggagccagggctgatctaggaggctgggagccaggtgacaggatggccccaaagagagttgtgcagctgtccctgaagatgcctacccatg

SEQ ID NO: 54892 - DNA, 201 bp, Homo sapiens
caaactgcaggataggacagttggcagggaagcattcctctgtgactgctgtatttctcttctccctagagaccaggtggtacatttctgagctgttgacmtaagatttggccggtggagccgcagtgggccgaggcttctgggaagcaagttgcagccacgcaaaaggaaaagctttctaattacctgaactgtcaaagc

SEQ ID NO: 54893 - DNA, 201 bp, Homo sapiens
gaccaggctcagccaggctaatcaggtcgcagggtgaaatttaaagggaggaggaggcaccagtccatcagaactcacacttcttcctggcaaagaagtgyccaggacgggagctggggagccagggctgatctaggaggctgggagccaggtgacaggatggccccaaagagagttgtgcagctgtccctgaagatgcct

SEQ ID NO: 54894 - DNA, 201 bp, Homo sapiens
agggtttcaccatgttggccaggctggtctcaaactcctgactgcaggtgatctgcccaccttggcctcccaaagtgctgggattacaggcgtgagccacsacacccagccctgaattgggccttgaaggaagaaatcagaatgccctggtgggcaaaatgcgaagggcctccagggagggagaacagcacagacaaagtt

SEQ ID NO: 54895 - DNA, 201 bp, Homo sapiens
agcaaagctctaagggactgctgagctctggttctggctgaaggtgggggggagggcctaggctggagcgtgtgtgtctgtggtctggcctccatctgccrgaagcccctgactgtgggtcatcctgtggggattccctagcttcgttccaggctctgctgaaggatcccagcttgtcttcactggagggtcccataggga

SEQ ID NO: 54896 - DNA, 201 bp, Homo sapiens
acaggtggccagataaaaagcatggattttggcaccagccagatccaagtccaaatgtcagtctcatcattctctggctgtatgattatgtgacttaaccygtctgagccacagcttcagagggaggctgtggcatttagtgatgatatatctggcacataaaagatgctcaataaatgctaacaatgatcagggctgcca

SEQ ID NO: 54897 - DNA, 201 bp, Homo sapiens
gtcttggcttctccacgctctacgccccacgtttaaagcgttctttgagcaattccgccccctggtggcagatctgatgatgactcaggcaaggcctgatrcctctcaggcacaaggtgactgcccgccctctccctcctggccaggtccggtgggcggcagatggccagggcagtgcggaacttcctgaaggcacagcag

SEQ ID NO: 54898 - DNA, 201 bp, Homo sapiens
ttggcctcatgagaaaatgttagccattttacagataagaaactgaggcttagagaggttgagtcattgagctaaggccatgcagcttgcacgtggcagarccagagaggaacccaagctgctctaaccacaaagggggctctgtcctggattcctgggcttgcagcccctcacccctgtctcctcgctagcccctgactc

SEQ ID NO: 54899 - DNA, 201 bp, Homo sapiens
agtttgggaccagcctggccaacatggtgaaacctcgtctctgctaaaaatactaaaattagctgggcctgatggtgcacgcccatggtcccagctacttsggaggctgaggtaggagaattgcttgaatccaggaggcagaggttgcgctgagctaagatcaagccactgcactccagcctaggtgacagagcaatactc

SEQ ID NO: 54900 - DNA, 201 bp, Homo sapiens
ttgccgatggtgcctattccaattacacatttcagaacttgttggggtggggcggaaccacacatgggctcaggggctactggacccactgtaagatgaasctgagctgaaactccatggatcacctggcctccatgagcccctgctctgccaggtgggccgcagtgttgtttagggtctcctagaccagttcagggccgg

SEQ ID NO: 54901 - DNA, 201 bp, Homo sapiens
ccaaagtgctgggattacaggcgtgagccaccacacccagccctgaattgggccttgaaggaagaaatcagaatgccctggtgggcaaaatgcgaagggcstccagggagggagaacagcacagacaaagttctggaggtgggaacctgcttggaggactgggagagttgcagacagtgctttgtggctggggtgcagacc

SEQ ID NO: 54902 - DNA, 201 bp, Homo sapiens
agcagaagaaatgaggaggtcaaaggagaatgagtttggggatgggtgatattcacgtctgtgtgctgggtgcaagggaggggagaaggggcaaggccagygatgcccttgagtaggggatgtgccccaggagggctggtcttgggcaagagcccagacagcacacccctcttcccaggagggcaggcacggtcgtggact

SEQ ID NO: 54903 - DNA, 201 bp, Homo sapiens
actggctagagtgggagtgtttacaccacagacattggtcaaggctacaaatcagggcttcattcatcgttttatcaaatgcctagagttcagaaagtgakggagacaggttaacaatgtcaactcaatttaaaagtgtattgcgtctatagccatgacattgtggttagtaccaaaaattgatgaaatgttcctccagga

SEQ ID NO: 54904 - DNA, 201 bp, Homo sapiens
taatttttaagaaggttatgaaccccttgttaaacacagccactatttaaaattaaatatacacacaattaagcaaattatattaaaaacaaaggcagtartactgaaaactcatcactgcttaattattttactgcattttaccattgtccagatatagtggaaatagtgatgtcacgaggtgctattatgcagctcttt

SEQ ID NO: 54905 - DNA, 201 bp, Homo sapiens
gcctggagggatcaggtgacaatgaaccctgtaggtgagtgcacccgccagggccagcgtgctggagggggacccacctgacctgccccgggcttggcctrtaggagccaggggattttttcactgatttctgctctcatctttatcattttcattttctactttctttgtgtttagtttgctgttctttttctggcttga

SEQ ID NO: 54906 - DNA, 201 bp, Homo sapiens
tatcattatttcctctttatggatgaggaaatcaaggctcagggaggttaagtaacttgccccaggccatgcagcaagttaatagtggcaccaagatgcamaactaggggggctgtccccacagccctgcactcagcctcgaggctgcactacccctcgaggtgagtccacagtctctgcctgtttcccggctcccactct

SEQ ID NO: 54907 - DNA, 201 bp, Homo sapiens
gcctctctttaggtgccaaatgttttctgaacacctactacatgccaggcactgtgctacctcctgtgcacaagatggcaacagcagcacccaccgttacktattgagttccaggcactgtctcctagctttccatggcttaccttatgtattccatggggtactcctacagataagtgctatcattatttcctctttatg

SEQ ID NO: 54908 - DNA, 201 bp, Homo sapiens
ttgctataatatgacaattttctcatagatgaaagaaagagtgggagaagtttttttttgttttttgtttttgttttttaatgtacaaaattcctggtagycctggctgttattcaacctcatttccaaccctgaatctttttctcctctgctttcataggccctaactcttgagcaaactccagtcctagagccctttct

SEQ ID NO: 54909 - DNA, 201 bp, Homo sapiens
tccagtcctagagccctttctaggctgtggctatggccaacccattccccagggcctgtctcattctggcaaggaaggggtgccagaagcacagcacttayagccagacagcctccctcttgccttttctcttttgcaggttaacatggtggtcttaggcaagtacctgggcatccccaagccctacgggcccatcatcaa

SEQ ID NO: 54910 - DNA, 201 bp, Homo sapiens
ttaatatgaagagagaacctggagcaagacggctgggacttatgtttgctgtgagatgatggtgatgacgctgattatggtgatgaacagtgatgatggcratgatggcggtgatggtggcaatgatgacatctgagggggcatcagtagcatttgcttctcctgttgacccaaatctttcctgtgctggctgtgtccaga

SEQ ID NO: 54911 - DNA, 201 bp, Homo sapiens
tgggcaccactgcccgcgcttatgcctcaccttgcacctgtcacctgatgtgatctggagactttatccatcttccccatgcgcctatgagcctctcaagrtcatgaactggaacccctgtaccccagaggctgcacagggcccagcacaaactgaaggccactcacacctcagccacagtcagaggccattagcatgctc

SEQ ID NO: 54912 - DNA, 201 bp, Homo sapiens
cacctctgcccttgtctgacctgatgggatgagtcagggcaaagccatctggaaccagctcaaccctgtgccccgagtaagctctggattgggacattttytgggtcagggcaccctgacacgctcatcctcacacttccagggtatttgtgcttggacccaaatcccttatccaatagtcaggaatgatattgataataa

SEQ ID NO: 54913 - DNA, 201 bp, Homo sapiens
agggcctccagggagggagaacagcacagacaaagttctggaggtgggaacctgcttggaggactgggagagttgcagacagtgctttgtggctggggtgyagaccgagtgggagaggggagtcccaagaactgtcaggcccctcctgagtcctgagtctggggtctcctgtgtctaaggggaccctgtccactgagccat

SEQ ID NO: 54914 - DNA, 201 bp, Homo sapiens
aagtgtttcaggcttctgtctctgggtctcagctgcctgctgtgttccccaccacagcccctcgcttgctgctccccagtgggggtcctgtgtcaggcggkgcaggtggggtgggcggtggcctcgctgactctcattaacagggcagctgacaaggagatgagcagatgtgatctcaactgggaagggcctgagcgatgc

SEQ ID NO: 54915 - DNA, 201 bp, Homo sapiens
cctggctgcccatctatcccttcgcccctccaggttgactgtttgagggtcttagtggattccttggagtggaagacccatggccagcttcctccatcacygaggggcttggattcctcgggaccttctgtccactctggaaccacagggattgagacccagcagtccttaggaccacaaggatctagaaacttcactgcc

SEQ ID NO: 54916 - DNA, 201 bp, Homo sapiens
ctagagagaaggtccggagtcccctttgaacaccaagggtcaccccttatgacctcttgccatcaacctgggctgagatttcctctaagaaacccccatascacagcatgggggagaattcccatccccagattagggccccaagccaggtccgcaaccaagggaaggagaggtgcccccagagttaaactcaagtgtccc

SEQ ID NO: 54917 - DNA, 201 bp, Homo sapiens
tgggaggctgaggcaggagaatcgcttgaacccaggaggcagaggttgcagtgagctgagatcatgcctttgcactccagcctgggtgacagagcacgackttgtctcaaaaaataaaaaataaataaaataaaatgcctggtagacacccagggagaaactcagaaagcaagaagtctgagagttctaaccatattgatg

SEQ ID NO: 54918 - DNA, 201 bp, Homo sapiens
aatgggtcaggaaagcctgggaggccacacaggctctggtgacagcctctgagcaggagggatgcaacgggacttctattttaaaaggtccctctggctgstatgttgaagctggactgtggggagagaggggaagcaggtcactggcctatgataaaaatccacatggaagcaactggtggcttggacaggatgtgagct

SEQ ID NO: 54919 - DNA, 201 bp, Homo sapiens
ggttgaggcaggagaatcactcaaacccaggaggcagaggttgcagtgaaccaagatcatgccactgcactccagcctgggtgagtgaaccaagatcatgscactgcactccagcctgggtgacagtgcaagacttcatctcaaaaaaaaaaaaaaagaaaaagaaaaaattggccgggcccagtggctcatgcctataat

SEQ ID NO: 54920 - DNA, 201 bp, Homo sapiens
tgcaggaagccacatttcccccaaggcctgacccctctaggcactgcccactcatctgttactcacaggggagggagacactgagaccaggagcccagcamcccagagagaggtgaacagaggtgtgagctattgagcaagtttggggtggggagggagcagatctagactacaggaagctaggctgggcttggagggtct

SEQ ID NO: 54921 - DNA, 201 bp, Homo sapiens
aactcttgagcaaactccagtcctagagccctttctaggctgtggctatggccaacccattccccagggcctgtctcattctggcaaggaaggggtgccaraagcacagcacttacagccagacagcctccctcttgccttttctcttttgcaggttaacatggtggtcttaggcaagtacctgggcatccccaagcccta

SEQ ID NO: 54922 - DNA, 201 bp, Homo sapiens
tgccaccacgcctggctattttaaaaaattttttgtagagatggggtctccctatgttacccaggctggtctcaagtgatcctcccgccttggcctcccaragtgctgggattatagacatgagccaccatacctgtctggtcattactttttacgaattaataatattccatcttatgaatatattacattttgcatatc

SEQ ID NO: 54923 - DNA, 201 bp, Homo sapiens
ctttctccctcttgggactcagcccctgtacctgctggtctggttaatgtatgtggggcccagggccagctgcccacctggcctctggtgatcctctgctygagaagcccttcctgcttctctgttgggcagtggtctgtgaccccggtggcagggctggggaggaaaaccaggagccatggaaaccaaaccttgactcta

SEQ ID NO: 54924 - DNA, 201 bp, Homo sapiens
atgtatgtggggcccagggccagctgcccacctggcctctggtgatcctctgctcgagaagcccttcctgcttctctgttgggcagtggtctgtgaccccrgtggcagggctggggaggaaaaccaggagccatggaaaccaaaccttgactctaagttgctgctgggagccccgctgtgggggctggttctctcgggtct

SEQ ID NO: 54925 - DNA, 201 bp, Homo sapiens
gccatggaaaccaaaccttgactctaagttgctgctgggagccccgctgtgggggctggttctctcgggtctaggtggccagcagagaccccattgtctcytgccctgttaacataggcttgccagatttagcaaataaaaatacaggatgcctggttaagtttgaatttcagataaaaaacaaaaagcttttttagtata

SEQ ID NO: 54926 - DNA, 201 bp, Homo sapiens
agataaaaaacaaaaagcttttttagtatattgcatgggagatatttctactaaaataatctgctgtttagctgaagctgaagtcttttttttctttttctttttttttttttttttttttgagatggagtctcgctctgtcacccaggctggagtgcagtggcgagatctttgctcactgcaacctccacctcccgggtt

SEQ ID NO: 54927 - DNA, 201 bp, Homo sapiens
agggaatgactgcagcatccaccctccctgtgcccccatcacaaacacaattccccagtctgagaagtgatcttaacttcctgcgtggaatcctggaatcwaagactcggcaacctaggatctcagatttaaaagatcagagaatcttaggagaaaagtcacacgcttgtggcctgcgatcttttggcctacctcatttta

SEQ ID NO: 54928 - DNA, 201 bp, Homo sapiens
aattctgtggaactccctgctcccctgggtcctagctgccacttgccattttgggactggctgggaatctctccccctccctctggccccccaggccctcygctttccgcctccttaccccttcctggcatttcctggatcctagtcttggaatgtctcctcactctgagccttcttctcttcccttctcagctcccatcc

SEQ ID NO: 54929 - DNA, 201 bp, Homo sapiens
gtctgagaagtgatcttaacttcctgcgtggaatcctggaatcaaagactcggcaacctaggatctcagatttaaaagatcagagaatcttaggagaaaastcacacgcttgtggcctgcgatcttttggcctacctcattttatgagcttaatgagtcaccaacataaacagatatcgggagggcctcccataaaaaggc

SEQ ID NO: 54930 - DNA, 201 bp, Homo sapiens
gtctgctcccacaagcctcacgagccagtgagccaagccaggaaccttctctcaagggtgcaggggtctgctctgggaactcccaggcacagagcaaggaycccacatgggaaagtgaggggtctcctgtgtggacgtgtccccattccattggctgttggactgaaaaccaggaatgaggcctttggtggatagatagga

SEQ ID NO: 54931 - DNA, 201 bp, Homo sapiens
cctgagccaccgcgcccggccaatttttttccattttaccttgaggaattccacaatccacagaatgcggacatgctttggggagaggatcggtgactcaygacttggactctaaattcagggccctatctctcagggacattctggtccccagcctctgtttatctcttctgggaagaccagtgagtgaaagctgtccct

SEQ ID NO: 54932 - DNA, 201 bp, Homo sapiens
gacacagccacatcatgtgtgattctagactcctgagaaaatgcctgagcctgctgaggggtctgggacatcagccattgccctccctcaacctccagcarccccagccagccccggggagaggatgcaggggaaagctaaagccagggttgcagccaggggactgggggttggagctgccccctcctactgtctggtgcc

SEQ ID NO: 54933 - DNA, 201 bp, Homo sapiens
ccttttggagagaatgcacccttagtgagcctgcacggctcttgttcttaagagctagggcctctctttaggtgccaaatgttttctgaacacctactacrtgccaggcactgtgctacctcctgtgcacaagatggcaacagcagcacccaccgttacgtattgagttccaggcactgtctcctagctttccatggctta

SEQ ID NO: 54934 - DNA, 201 bp, Homo sapiens
gtttcaacaattgcacacctgacccattttcttggtcagggaggagagtgaagggaggtgccagggtcctattaacgacagggccctgtgtcctcttttgyccgggtctgcccactcctccatgcctttcagatgccctctgtgactgtaatgatcatgatggcagccctggtattttgtttttgtttttgtttttgtttt

SEQ ID NO: 54935 - DNA, 201 bp, Homo sapiens
gccagtgcggagtttgggcaagagaggaaatgatatgcaaatcacatgcaaataggcagcagcctgattgttcctgtgttgggaggggcaggtcagcagcsctcttctggataaggcggctggtcaccaagggggaattggcagtgtggtcagctctggggagaccaaactgccttttggagagaatgcacccttagtgag

SEQ ID NO: 54936 - DNA, 201 bp, Homo sapiens
aacgacagggccctgtgtcctcttttgcccgggtctgcccactcctccatgcctttcagatgccctctgtgactgtaatgatcatgatggcagccctggtwttttgtttttgtttttgtttttgtttttttttgagacggagtcttgctctgtcacccaggctggagtgcagtggcacgatcttggctcactgcaacctcc

SEQ ID NO: 54937 - DNA, 201 bp, Homo sapiens
tgggtcctcctggaggcgcaccagtgaagtctcatctggacctagtcctatagggctcagagaacaggaagagggggcagaaggatacaggaggtgggatrtcagcaaactggggagccagtgcggagtttgggcaagagaggaaatgatatgcaaatcacatgcaaataggcagcagcctgattgttcctgtgttgggag

SEQ ID NO: 54938 - DNA, 201 bp, Homo sapiens
tagcggctggcacctgtggggctcctggcaggccagatcctggccaggcgtgcaggggagccacaggctcagccagcagtgcctgctcttcagccttttcrtccgattctgcctgattctccccctcctgcccccaccactcatccagcacagtgccccagacgacccccaagagcacattggcccccacccccacccact

SEQ ID NO: 54939 - DNA, 201 bp, Homo sapiens
tctcaactgggaagggcctgagcgatgctatcggggtgggcctggcccaagtgcccattaacctcttgggaaaggatgttggggtgttggcagctggcagrgatggtcccccgggatggggatagaccctctttcttcagactgcggtctttagcttgaatccctctcttgggacaagccgagggttggaagtgaatgtcg

SEQ ID NO: 54940 - DNA, 201 bp, Homo sapiens
cccgctgccctgccctgccccaggcctggtggggaccaccctgttctgtaaaccacccgaaaaaggtcaccgtggctttttcatctctcccctcccaggaygagatggagtttggctacatcgaggcccctcacaaatccttccccgtggtctttgactcccccaggaacaggggcctgaaagatttcccctataagagga

SEQ ID NO: 54941 - DNA, 201 bp, Homo sapiens
tctgagaagagtaattgtaaccatggtgacagcatctaacgctgagaagtcatcatctcagggaatccctccaacagtctaggaagtagctcttgggattrtgtccattttacagcggaggaaaatcgaggcagttgagtgacccagttggaggccatgctccacacagaacccacacttcactccatggaagaggtggca

SEQ ID NO: 54942 - DNA, 201 bp, Homo sapiens
gaattcaccccattctgcccataacctctctattgaacctgatgcaactggccctgctgtgggcatgaggttggtgggcattgcagggtgagtaggaggaygctgctctgggcggcgcagacgagatgtgaagtggcccccaggaaggtctgaaccagggccatgggggcacagaggaagcacataaggtttctggctgga

SEQ ID NO: 54943 - DNA, 201 bp, Homo sapiens
agggcctcccataaaaaggcaggtttctggcttctcatgaaaaattggagaagctggggaggtgagatacagtctggcacagagacagaggaatagactcrttgacttctcccattaggaagtcagaatagcttctgtcctaaccatggcttaaaagggtcctgaggtcatgaagttcccagggcaggtggctgcaggtaa

SEQ ID NO: 54944 - DNA, 201 bp, Homo sapiens
atgctgccttatgccataaccagtgggtgaacctgcaccttaccacaggaggcgggcaggggtggagagtagttggttttacactcctcatcccgccctcygcgtctccttttgtgagattctctaagaattcaccccattctgcccataacctctctattgaacctgatgcaactggccctgctgtgggcatgaggttgg

SEQ ID NO: 54945 - DNA, 201 bp, Homo sapiens
ctcatgagttttaatgtgctatcaaaagacagcagatttttatgaatttcacttcaaaatcttgtctaatttccactttgatttcttctttgatccatggmttctttagatgtatactgcttaatttccaaacatttgggggagtttttagttatctttggttattgatttgtctttaatcgcatggttcgcagagcccag

SEQ ID NO: 54946 - DNA, 201 bp, Homo sapiens
gcctgattctccccctcctgcccccaccactcatccagcacagtgccccagacgacccccaagagcacattggcccccacccccacccactcagtttctgyccccaggatctggccatgtccaaactgcaggataggacagttggcagggaagcattcctctgtgactgctgtatttctcttctccctagagaccaggtgg

SEQ ID NO: 54947 - DNA, 201 bp, Homo sapiens
accactcatccagcacagtgccccagacgacccccaagagcacattggcccccacccccacccactcagtttctgtccccaggatctggccatgtccaaastgcaggataggacagttggcagggaagcattcctctgtgactgctgtatttctcttctccctagagaccaggtggtacatttctgagctgttgacctaag

SEQ ID NO: 54948 - DNA, 201 bp, Homo sapiens
ggcagggaagcattcctctgtgactgctgtatttctcttctccctagagaccaggtggtacatttctgagctgttgacctaagatttggccggtggagccscagtgggccgaggcttctgggaagcaagttgcagccacgcaaaaggaaaagctttctaattacctgaactgtcaaagcagagaggggtgtgaggtagtga

SEQ ID NO: 54949 - DNA, 201 bp, Homo sapiens
taataccagccaggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatg

SEQ ID NO: 54950 - DNA, 201 bp, Homo sapiens
ccagccaggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtcca

SEQ ID NO: 54951 - DNA, 201 bp, Homo sapiens
cagccaggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccag

SEQ ID NO: 54952 - DNA, 201 bp, Homo sapiens
gccaggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccagga

SEQ ID NO: 54953 - DNA, 201 bp, Homo sapiens
caggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccaggacg

SEQ ID NO: 54954 - DNA, 201 bp, Homo sapiens
gtttggctacatcgaggcccctcacaaatccttccccgtggtctttgactcccccaggaacaggggcctgaaagatttcccctataagaggatcctggtaygtagcgacaggtagagtgcagaaaccctggttgggtcctcctggaggcgcaccagtgaagtctcatctggacctagtcctatagggctcagagaacagga

SEQ ID NO: 54955 - DNA, 201 bp, Homo sapiens
ggtcaccgtggctttttcatctctcccctcccaggacgagatggagtttggctacatcgaggcccctcacaaatccttccccgtggtctttgactcccccmggaacaggggcctgaaagatttcccctataagaggatcctggtacgtagcgacaggtagagtgcagaaaccctggttgggtcctcctggaggcgcaccag

SEQ ID NO: 54956 - DNA, 201 bp, Homo sapiens
ggacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccaggacgca

SEQ ID NO: 54957 - DNA, 201 bp, Homo sapiens
gacagcttctcactttgctatctgggtgacctgagtaaagttacttaacttctccgagatttcttcatctgtgaagtggggacgtaattcggagtcctcattagggaaaaggagccaggctggtaggagcagggaaaagtaaaaaaagaaaagaaagctgatcagctccaagcctgcctttcttcatggtccaggacgcat

SEQ ID NO: 54958 - DNA, 201 bp, Homo sapiens
cctctgcccctcaccaggtcttagggaagacccgctgccctgccctgccccaggcctggtggggaccaccctgttctgtaaaccacccgaaaaaggtcacygtggctttttcatctctcccctcccaggacgagatggagtttggctacatcgaggcccctcacaaatccttccccgtggtctttgactcccccaggaaca

SEQ ID NO: 54959 - DNA, 201 bp, Homo sapiens
tccacagaatgcggacatgctttggggagaggatcggtgactcacgacttggactctaaattcagggccctatctctcagggacattctggtccccagccyctgtttatctcttctgggaagaccagtgagtgaaagctgtccctcttctccagcctccattcctggctgggcagagctccacttgggagaaagctggttc

SEQ ID NO: 54960 - DNA, 201 bp, Homo sapiens
accaccctgtccacccccgactccagtgggctagctcaccaccctgtccaccacccaccccagtgggctagcccaccaccctgtccacccccgactccagwgggctagctcaccaccctgtccaccccccacaccagagggctagctcaccatcctgatgacccacactccagtgggctagctcaccacactgacccccac

SEQ ID NO: 54961 - DNA, 201 bp, Homo sapiens
ttcatagctgttgtgctctggttggctctgggaggcagaggttgctctgggatcctgagtgagcacacagggcacctccatccaagagcccttcaggaacyttcacctgggtgttggtggtgactatggtcatagctactgagagcctccaaactaggacacagaagttgattctgcagcataaggaagagcttcctgctg

SEQ ID NO: 54962 - DNA, 201 bp, Homo sapiens
gtcaggcagtgctgagaaggtcacagcctcacctggtgaatctggcagcctcagagctctggatcggatgaggcgaggcttcctggcacctacccaggcaygtaactgggtgcccagacaggatgcctggggctgagactggccaggcgagaggcatgtgctcaccctgttggtgactcatgcccagacactactgtgtgg

SEQ ID NO: 54963 - DNA, 201 bp, Homo sapiens
acttgcggtgggttgggcaggagcaggtttgaaaggagtggggaaggagtgggcatggggaagcaggagtttggctttggatgtgtgaaatttaaaatgcytggtagggctgggcgcagtggctcacgcctgtaatcccagcactgtgggaggccgaggttggcagatcacttgaggtcgggagttcaagaccagcctggc

SEQ ID NO: 54964 - DNA, 201 bp, Homo sapiens
gctacatcgaggcccctcacaaatccttccccgtggtctttgactcccccaggaacaggggcctgaaagatttcccctataagaggatcctggtacgtagmgacaggtagagtgcagaaaccctggttgggtcctcctggaggcgcaccagtgaagtctcatctggacctagtcctatagggctcagagaacaggaagagg

SEQ ID NO: 54965 - DNA, 201 bp, Homo sapiens
gaggcgcaccagtgaagtctcatctggacctagtcctatagggctcagagaacaggaagagggggcagaaggatacaggaggtgggatatcagcaaactgrggagccagtgcggagtttgggcaagagaggaaatgatatgcaaatcacatgcaaataggcagcagcctgattgttcctgtgttgggaggggcaggtcagc

SEQ ID NO: 54966 - DNA, 201 bp, Homo sapiens
agagagaataagcagacccctcctcctgcctcttcctggtggttttcaaagctcctgctggggtacctgccgctcttctgtagctgaagctgacctggatrggggtgatgggaaccaagtcttgaaggcagtggggctgggaactagaataggcccctccccatgcctgtgggagtggccctgggcctcagacctgcatag

SEQ ID NO: 54967 - DNA, 201 bp, Homo sapiens
gaggtgggagaatcgcttgaacctgggaggcggaggttgcagtgagcagagactgcaccactgcactccaacctgggtgagagagtgagactctgtctcaagaaaaaaaaaaaaaaagaatcagagcaggggaagggagatgggggatcagtcggggggaaaggtgggcaaggtgcagcattaaatggagtgattgggtgg

SEQ ID NO: 54968 - DNA, 201 bp, Homo sapiens
gctgagaaggtcacagcctcacctggtgaatctggcagcctcagagctctggatcggatgaggcgaggcttcctggcacctacccaggcacgtaactgggwgcccagacaggatgcctggggctgagactggccaggcgagaggcatgtgctcaccctgttggtgactcatgcccagacactactgtgtgggctgttctac

SEQ ID NO: 54969 - DNA, 201 bp, Homo sapiens
aggtgggagaatcgcttgaacctgggaggcggaggttgcagtgagcagagactgcaccactgcactccaacctgggtgagagagtgagactctgtctcaagaaaaaaaaaaaaaaagaatcagagcaggggaagggagatgggggatcagtcggggggaaaggtgggcaaggtgcagcattaaatggagtgattgggtggg

SEQ ID NO: 54970 - DNA, 201 bp, Homo sapiens
cgcaatgactcacatctgtaatcccagtactttgggaggcggatcacctgaggtcaggagtttgagagcagcctggccaacacagtgaaaccctgtctctrttaaaaatacaaaaattaggccgggcacggtggctcacacctgtaatcctagcactttgagaggccgaggagggtggatcacaaggtcaggagatcgaga

SEQ ID NO: 54971 - DNA, 201 bp, Homo sapiens
gctaacatggagaaaacccgtttccactaaaaaatacaaaaaaattagccaggtgtggcggcaggtgcctgtagtcccagctgctccggaggttaaggcargaggtggagcttgcagtgagctgagatcacgccactgcactccagcctgggcgacagagtgagactctgtctaaaaaaaaaaaaaaaaattagctgggtg

SEQ ID NO: 54972 - DNA, 201 bp, Homo sapiens
tgaagtgggaggatcacttgagcccaggaagtcaaggctgcagggagccgtgttcatgccactgcactccagcctgggagacagagtgagaccctgtctcwaataaataaataaataaataaataaataaataaataaataaataaattaccactccttaaccccggactgctcttacttgtttttacaaacagcaacagg

SEQ ID NO: 54973 - DNA, 201 bp, Homo sapiens
atgtggaggggctgaccttccccgatgccgatttcctagggctggtttccctcagtgtcagcctggtggacccgggggtgtgtacagcactggggggtggscaaggaggctgaggggtttgggggcccagtttgcaggctccagggctgggcaggctgggggctgggggggcttgaggcaggctaggggtccctgcagggc

SEQ ID NO: 54974 - DNA, 201 bp, Homo sapiens
atgtgctatcaaaagacagcagatttttatgaatttcacttcaaaatcttgtctaatttccactttgatttcttctttgatccatggattctttagatgtrtactgcttaatttccaaacatttgggggagtttttagttatctttggttattgatttgtctttaatcgcatggttcgcagagcccaggggggatttgtaa

SEQ ID NO: 54975 - DNA, 201 bp, Homo sapiens
atgagccaccatacctgtctggtcattactttttacgaattaataatattccatcttatgaatatattacattttgcatatctatttatccatgggtaatkttcaccttttgtgccaggtgcttctatctctttatttagtttaaagtttatattggcctcatgagaaaatgttagccattttacagataagaaactgagg

SEQ ID NO: 54976 - DNA, 201 bp, Homo sapiens
ggagtttttagttatctttggttattgatttgtctttaatcgcatggttcgcagagcccaggggggatttgtaaaaagtggacagagatcgtttttcaggyactaagagccatggagtgggagacccccagcaactcccctctactccaagaactgcctcgtcctgtcctcactgacctctccttcttggggtgggggtct

SEQ ID NO: 54977 - DNA, 201 bp, Homo sapiens
gtctctattaaaaatacaaaaattaggccgggcacggtggctcacacctgtaatcctagcactttgagaggccgaggagggtggatcacaaggtcaggagrtcgagaacatcctggctaacatggagaaaacccgtttccactaaaaaatacaaaaaaattagccaggtgtggcggcaggtgcctgtagtcccagctgctc

SEQ ID NO: 54978 - DNA, 201 bp, Homo sapiens
gatggaatcagggttggaagtgaatgtcggaatcgggatggaatcagggttggaagtgaaagtcggaatcgggatggaatcagggttggaagtgaatgtcrgaatcggcatggaatcagggttggaagtgaatgtcggaatcaggatgcaggttgcaggaggtggggagggtcagtgtgctttcctgactcctcatgggga

SEQ ID NO: 54979 - DNA, 201 bp, Homo sapiens
tccaatcatatgtatgaatatagtatgaatgcatgaacaaatgcatataactttaattttctgggactcaactccctcacctgtaaaatggggacagtaakagtcccaaccccacagggctgtcataaggattaaatgaggtagcctgggtaaagcatgtgtgtggcacatgtcaataaatgtttgtctcagctttgctga

SEQ ID NO: 54980 - DNA, 201 bp, Homo sapiens
ctttgctgagagtctgctgtttaaacaaagccttgaaggaaaagaggcagttaggccaagcacagtggccctcacttgtagtcccagtgctgtgggaggcsgaggtgggggggtcgcttgaatccaggagtttaagactagcctgggtggcatggcgaaacccacctctacaaaaattacaaaaattagccgtgcgtggtg

SEQ ID NO: 54981 - DNA, 201 bp, Homo sapiens
tctagactacaggaagctaggctgggcttggagggtcttgatagccccagagaaattgtacctgtcatttcttcccccttctttcatcatcatcatcatcrtcatcatcatcatcatcatcattttctaccaagactccaaatagggggctgtgacttagagatgtcaacttttgcccaaagctagggattggctccacag

SEQ ID NO: 54982 - DNA, 201 bp, Homo sapiens
tacctgtcatttcttcccccttctttcatcatcatcatcatcgtcatcatcatcatcatcatcattttctaccaagactccaaatagggggctgtgacttrgagatgtcaacttttgcccaaagctagggattggctccacagagtcctgcttcccttgaaagggctgtgtctggcaccggtggtccctgagtggggtgga

SEQ ID NO: 54983 - DNA, 201 bp, Homo sapiens
tgcaatgagcagatatgtgctctgtcaggtggctgggaggtggccggtgccatgggctggaatgaagctggggttggggaaccagactcatggtgtcattygtgtcacgccatttgcaacaggcaagaagggtacatcagaaaggcctcgtatgctaccctgagagaaggaagtgaggggctgggcggaccgcagggattg

SEQ ID NO: 54984 - DNA, 201 bp, Homo sapiens
tggccgcagcgggggactatgggatctatgggactatcctggggaagggaagagggaacatgagggatgagggacagcagtggggggcgagtagagaggamtcagccttcaaaggtcaagcgtcccagtgggctgaaggtttggttgcactggtgtgttaggagtgagctggaatattgggaagcggtgtccgagtgggtt

SEQ ID NO: 54985 - DNA, 201 bp, Homo sapiens
cagggttggaagtgaatgtcggaatcgggatggaatcagggttggaagtgaaagtcggaatcgggatggaatcagggttggaagtgaatgtcagaatcggsatggaatcagggttggaagtgaatgtcggaatcaggatgcaggttgcaggaggtggggagggtcagtgtgctttcctgactcctcatggggagattccag

SEQ ID NO: 54986 - DNA, 201 bp, Homo sapiens
acaagccttggggtagaggaggctatggtggtcagccccaggtaacacctgaagagtaaggaggaggacagagtgggctcaaggcgtcaccccacaggaastatctggaagctgtcctgggaggggtagaaggtacaatttaaagggaaagactccagagaggcagcctggatcacaaagctttgaggacaaggtgggcag

SEQ ID NO: 54987 - DNA, 201 bp, Homo sapiens
ggagtgggggttctcattcccatcttattgaggaactacccgaggcttagaggagctgagagacttgcctaagtcgatggagccggctgctcctccctcawctgccagctgctcctgctgggagctgccccacctttcccatccctccacctttcccccaccctccttgctcctcacacctgctctgggaaccaaggtggg

SEQ ID NO: 54988 - DNA, 201 bp, Homo sapiens
tttaggcagagccctgaagagggtgagggaaggagacttgtggacatcttggggaggagcagtccatgcagcaggagcgggcagtgccaggacagccttgscatcttcatggcacaacaggaaggccagcgtggctggagctaagtgagcgagggaaagcgtagtagggaggaggcagtcagcaaggtggcaggggcgcat

SEQ ID NO: 54989 - DNA, 201 bp, Homo sapiens
ggagctggggagccagggctgatctaggaggctgggagccaggtgacaggatggccccaaagagagttgtgcagctgtccctgaagatgcctacccatgcygtgtgtgtggtgggagtcgaggcacatgtggacattcacaggtaagagctgggaggcgctctcctggctgcagagagctgggttagagtgtaagtcaatg

SEQ ID NO: 54990 - DNA, 201 bp, Homo sapiens
ctctaagtagggctgtcaggatgtgtccctcatcacctctgcctccgccatctctgaaggtgatggccgtgcaggcttagggctatgttctgcaggtgagrgtctcctactttggggagcaggaagaccaagctctgggccgcagcgtgctttacctcactggcgtcggtaagtagcagctccctggctgcccatctatcc

SEQ ID NO: 54991 - DNA, 201 bp, Homo sapiens
cggtggcagggctggggaggaaaaccaggagccatggaaaccaaaccttgactctaagttgctgctgggagccccgctgtgggggctggttctctcgggtytaggtggccagcagagaccccattgtctcttgccctgttaacataggcttgccagatttagcaaataaaaatacaggatgcctggttaagtttgaatttc

SEQ ID NO: 54992 - DNA, 201 bp, Homo sapiens
atttataataaatttatatatacatatatatgcataagaacccccccactccagagagctggttgttaaacatttgccagcacaccactgcctggagttasggggtaagggggagtgacacagcaaaggcattagaggaaaggccacggagtcagaggagagcaagcagagcccgtgtcccagctgccaagtgggaaagtg

SEQ ID NO: 54993 - DNA, 201 bp, Homo sapiens
gggggaagagtggggaggcttctggagataggagaagataggacatagtcctctaggacactgaaagagaaaagagcctggagcaatgctgtaggagcacragcatgtcacgcatccattgaggtcagcagtcatgagtccaagtgaaccatggtcagccgcgtggtgcaggtgcagagggggtggagagttggatctgat

SEQ ID NO: 54994 - DNA, 201 bp, Homo sapiens
gacccatgagaaagctgctcggtgatccaggcgaggggtgatggtggcttgggccgcagtgatgtcagtggaggtggtgagaggtggtgggttagtggatytctgttgagctggagagtttggaagtgtcagatctggaaaggacttgggtgtgggctgggggtgtccaagggtttaccatctatgccctggcttccagat

SEQ ID NO: 54995 - DNA, 201 bp, Homo sapiens
tcctactttggggagcaggaagaccaagctctgggccgcagcgtgctttacctcactggcgtcggtaagtagcagctccctggctgcccatctatcccttygcccctccaggttgactgtttgagggtcttagtggattccttggagtggaagacccatggccagcttcctccatcactgaggggcttggattcctcggga

SEQ ID NO: 54996 - DNA, 201 bp, Homo sapiens
gcacatacctgttgtccaagctactcaggaggctgaggtgggaggatcacttgagcacgggaggttgaggctgcagtgagccatgcactccagcctctagrctgggcaacagagtgagtgagaccttgtctcaaaaaaaaattaaaaaagagagagagaaagaaagaaaaaaagaaaggaaggaaggaagaggaagaaaga

SEQ ID NO: 54997 - DNA, 201 bp, Homo sapiens
ttcagccagggccagggtcaatgtaacggcagaacccagcccctgcaacctcaggccatgtccccagttctcagagtttggggtcaccagcatatgatttrgaaccccaaagccaccaagagctagcaggtggacatgcacaggcaagcaagtgattcaagagccaaaggcttgggtccctccaactcccagaaccacagg

SEQ ID NO: 54998 - DNA, 201 bp, Homo sapiens
caggcacccgtggagctctactcggactggctctctgtgggccatgtggacgagtttctgacctttgtgcctacctctgaccaaaaggtgcgtcccctccytccctgcctgagccacctctgcccttgtctgacctgatgggatgagtcagggcaaagccatctggaaccagctcaaccctgtgccccgagtaagctctgg

SEQ ID NO: 54999 - DNA, 201 bp, Homo sapiens
gattcaaatccgggttctgggcctctacagtaagccttgcagaggtggcttgggaaggcatggccagggagccagcagcctgggagaggaggcttcccagygaccagtggttacagctctgctagggacagctctgacagtgaaggaggagacatctgaattgggtattttgtttgttttttgtttgtttgtttttcgaga

SEQ ID NO: 55000 - DNA, 201 bp, Homo sapiens
ctaagagccatggagtgggagacccccagcaactcccctctactccaagaactgcctcgtcctgtcctcactgacctctccttcttggggtgggggtctcrctggttcttccatagggtcctgactttggatatgttacccgggagatcccgctccctggtccctccagccttgactccttcggcaacctggacgtcagcc

SEQ ID NO: 55001 - DNA, 201 bp, Homo sapiens
tataatctttgctttggggggttgtgatgagcattagggagcgccaagtaggactcgtgattgttggaattaggactgttgtcaccgcagtcaatggagayagttttttgatggggccaagtgatcatggcagaggttgtggagggggtctggtttctccagagggctgaatatttgggtggttttttaggggtccaggaa

SEQ ID NO: 55002 - DNA, 201 bp, Homo sapiens
gctggggctgggacagtgtgttgtgctgacaagaacatttgcatccagaaactgcctgggttcgaaccccagctttggcacatcctagccttgtgcacttsagcaggttgcctgagcctcagtttcccccggacagcaatggtttctattgcacaaagctgttgtgaggcttgaaggagctagcgggcccagagggctcca

SEQ ID NO: 55003 - DNA, 201 bp, Homo sapiens; identical to SEQ ID NO: 40335

SEQ ID NO: 55004 - DNA, 201 bp, Homo sapiens
gggggatcagtcggggggaaaggtgggcaaggtgcagcattaaatggagtgattgggtgggggcaggagcttgctgagaaggtgacatttaggcagagccytgaagagggtgagggaaggagacttgtggacatcttggggaggagcagtccatgcagcaggagcgggcagtgccaggacagccttgccatcttcatggca

SEQ ID NO: 55005 - DNA, 201 bp, Homo sapiens
tccgggcaccccaaggctgcggggttgaaaggcaaacttggggtggtcccgggtggattgtgccctccctccagaagaatgatggatccccagggtctgtwgtatccaaccatgtagggaacccatctgggacagcaaaattggcatgagtggacattaacctacaccctgtaaccgacatgctgtgtgactgctggaaaa

SEQ ID NO: 55006 - DNA, 201 bp, Homo sapiens
actccatcagtaccaaatatagtcctcaaggaggaggttcaacaacaacgagttccattttatggagaggaaaaccgaggctcagatgcaggaattcactrtggcacaaccatctggggtggagcaggcattccaacccaggtgtcttgggtgcaccaaagctcctccttttaccattgccccacacccgttccctcctct

SEQ ID NO: 55007 - DNA, 201 bp, Homo sapiens
atctatcccttcgcccctccaggttgactgtttgagggtcttagtggattccttggagtggaagacccatggccagcttcctccatcactgaggggcttgrattcctcgggaccttctgtccactctggaaccacagggattgagacccagcagtccttaggaccacaaggatctagaaacttcactgcccagtgaacaac

SEQ ID NO: 55008 - DNA, 201 bp, Homo sapiens
ctgcagggcccaccaagtcctcattttcccctcagaccctgcccgaggtgaccctcttcacagacactgtgggcttccgcatggccccctggatcatgackcccaacactcagcctcctgaggagctgtatgtgtgcaggtgaggctccctccctccagccctcccccaagtctggagtgcagaggtagggacagaagctg

SEQ ID NO: 55009 - DNA, 201 bp, Homo sapiens
gattacaccaccatgcccagctaattttttgtattttaagtagagacagggtttcaccatgttggccaggctggtctcaaactcctgactgcaggtgatcygcccaccttggcctcccaaagtgctgggattacaggcgtgagccaccacacccagccctgaattgggccttgaaggaagaaatcagaatgccctggtggg

SEQ ID NO: 55010 - DNA, 201 bp, Homo sapiens
ggctggtctcaaactcctgactgcaggtgatctgcccaccttggcctcccaaagtgctgggattacaggcgtgagccaccacacccagccctgaattgggycttgaaggaagaaatcagaatgccctggtgggcaaaatgcgaagggcctccagggagggagaacagcacagacaaagttctggaggtgggaacctgcttg

SEQ ID NO: 55011 - DNA, 201 bp, Homo sapiens
ccactctctgtttcttgggtccccaggtcctctgatgggtgggggagttcctgggccacaccccaggagaggaaaggcacaggaagtcatgagtgccccasgtgccggtcaatgccaggcatgttcttgttctcactcccctttgatctctctcccctcttccttatccctgttcacagaagtggaaactgaggctcagaa

SEQ ID NO: 55012 - DNA, 201 bp, Homo sapiens
ttcctgcgtggaatcctggaatcaaagactcggcaacctaggatctcagatttaaaagatcagagaatcttaggagaaaagtcacacgcttgtggcctgcratcttttggcctacctcattttatgagcttaatgagtcaccaacataaacagatatcgggagggcctcccataaaaaggcaggtttctggcttctcatga

SEQ ID NO: 55013 - DNA, 201 bp, Homo sapiens
atgggccccacttagaattgctcccccttcattctgatgcctccctggggaacaaggataatgactttgcatctgcacctggaacggggcctgggggaccwggggtctggtgtgccaggcaccaggctgcctctgctcttggaaaactaggaaaggggatcagaaacatcctctccccgctctaggtttcttctcccaaag

SEQ ID NO: 55014 - DNA, 201 bp, Homo sapiens
ggggagatccactgtggcaccaacgtgcgcaggaagccctttcccttcaaatggtggaacatggtgccctgagcctgcccccacccgccatcctctctgcbctcttgctagggaaccctgccagggtgaaggcaaggaacaaccacctggcctccattctcttgggggagtcttggcactttgcaaacatcctggccacca

SEQ ID NO: 55015 - DNA, 201 bp, Homo sapiens
tgatctaggaggctgggagccaggtgacaggatggccccaaagagagttgtgcagctgtccctgaagatgcctacccatgccgtgtgtgtggtgggagtcraggcacatgtggacattcacaggtaagagctgggaggcgctctcctggctgcagagagctgggttagagtgtaagtcaatggggtgggtgcctggtagac

SEQ ID NO: 55016 - DNA, 201 bp, Homo sapiens
cgggagctggggagccagggctgatctaggaggctgggagccaggtgacaggatggccccaaagagagttgtgcagctgtccctgaagatgcctacccatsccgtgtgtgtggtgggagtcgaggcacatgtggacattcacaggtaagagctgggaggcgctctcctggctgcagagagctgggttagagtgtaagtcaa

SEQ ID NO: 55017 - DNA, 201 bp, Homo sapiens
ggacggtgtgccatttacaaaggtggggaagaaatggggagcaatgggttttgggggagaaatcaatagttctgtctagtgctgatttaactccaaaatckggttcagttatcttttagttagtcttaagtttgggcttagagaattgtggcaagccacttattcaaggattacttattcattcattcccctaatctctaa

SEQ ID NO: 55018 - DNA, 201 bp, Homo sapiens
ccttgtcctctggccccttgggcctggttttcaggggtctctgtagtggccctgcctccatctctagatgcacgtcttgctggtctcctgcacatgctctrtaaaccaacaagagctaccagcaggtgcatgtcaccttgcctttgctcatgttattccactaccaggaatgcccttctcccatatctctgtctatctaaa

SEQ ID NO: 55019 - DNA, 201 bp, Homo sapiens
ttaaggacctagaataagtgtgttgtcctctgaattctttgttgctcacatcattcaacatttttctttctctttttcccacattcctctttttaattgamataaacaactatgtcccacctctttcctaagtgttttaaggtggcccagataacaaaaaataaggagacaggtggattagagttccagcacactttctag

SEQ ID NO: 55020 - DNA, 201 bp, Homo sapiens
gcctctcctagcctggggcctttggtgacctccctttccactcactgccacagctcctgcaagtccccatgctggacagctgcctgtccactgggttctgycttctgctgcctcatcctcctggctcttggctggctcctggcctctggccctgcctgaaactgaggctcagagaagggaagcgaattgtagaaggtcacc

SEQ ID NO: 55021 - DNA, 201 bp, Homo sapiens
tcctctagattatcctgggagaaataaccctcacccatggaaaccagagcctgatagctccctgcctaaatctctccagtggtttccctgtgcctttagamcaaaatgccttagcatcacctccaaggcctggcagattctgactcctactttacctctaacttctcccctccacctccattcatgtgccccatccacttg

SEQ ID NO: 55022 - DNA, 201 bp, Homo sapiens
ctccagtggtttccctgtgcctttagaacaaaatgccttagcatcacctccaaggcctggcagattctgactcctactttacctctaacttctcccctccrcctccattcatgtgccccatccacttgaacattattcccaatgatgcaccaagctctttccctcctcatggtctttgcacatgctgttccctgtgtctga

SEQ ID NO: 55023 - DNA, 201 bp, Homo sapiens
tccacttgaacattattcccaatgatgcaccaagctctttccctcctcatggtctttgcacatgctgttccctgtgtctgacaaggtcttccttgcattcrttacctggctaagtccttattctcctttaggccccagcttaaaagacaaaggtgcaaagaagcctcttctgctctcctaacttaggtatccatcactagt

SEQ ID NO: 55024 - DNA, 201 bp, Homo sapiens
gtctttgcacatgctgttccctgtgtctgacaaggtcttccttgcattcgttacctggctaagtccttattctcctttaggccccagcttaaaagacaaakgtgcaaagaagcctcttctgctctcctaacttaggtatccatcactagtattctcacacacagcatttcactgttggttttttagagcaacatagctagt

SEQ ID NO: 55025 - DNA, 201 bp, Homo sapiens
gtcggagacaagcttctgaagcagaaggtggccatgcccgttatcagcagcaggcaggactgtgattctgccacttctactgtcacagacattctgtgtgmcgccgaggtcaagagcagcaaggggacagaggacaggggccgcatcctaggtgactccaacttgcaagtcagcaagcttctgtcccagttcccactgaag

SEQ ID NO: 55026 - DNA, 201 bp, Homo sapiens
ttccttgcattcgttacctggctaagtccttattctcctttaggccccagcttaaaagacaaaggtgcaaagaagcctcttctgctctcctaacttaggtrtccatcactagtattctcacacacagcatttcactgttggttttttagagcaacatagctagtggttaagagagaggcattggaacgagattgcctcaga

SEQ ID NO: 55027 - DNA, 201 bp, Homo sapiens
tcggagacaagcttctgaagcagaaggtggccatgcccgttatcagcagcaggcaggactgtgattctgccacttctactgtcacagacattctgtgtgcygccgaggtcaagagcagcaaggggacagaggacaggggccgcatcctaggtgactccaacttgcaagtcagcaagcttctgtcccagttcccactgaagt

SEQ ID NO: 55028 - DNA, 201 bp, Homo sapiens
agactgtgaatccctaaggaagttgcgatgctgaaggtgtcctggcctctccctgcctccatcactgacccgctttgcctctcctgtgacttgcagttaaygcacctgtgacggttgctgacaagaacaacccgaagtacacagggaatgttttcactccacactttcctacagccatgacctcagcaaccctgaaccagc

SEQ ID NO: 55029 - DNA, 201 bp, Homo sapiens
ttgatatataacaaaccaccccaaagcttagtggctgaaaactgtgactcatttagctctcatttctacagtttggcaatttgggttgggttcagctgggrggttcttccgctgtgggctgggcttggctgaacttggctcatgctcacccaagcatctgcacttagctaggtctggattggctgacacaacttggagttt

SEQ ID NO: 55030 - DNA, 201 bp, Homo sapiens
ttcgtcgtactcaacaggcaactcaagctcctcctcctccaggaagcattacttgttaactctcgtccacacagattgctcctcttcctggccctctagcrtacatactgtctagatcatgccggtggccgttgatctgatcagaagttctcaacctggaggacctagctgcatgtgtgccaatcagatatgagctgtgtc

SEQ ID NO: 55031 - DNA, 201 bp, Homo sapiens
acatcattatgatttctgaatgatcctccaatatgatttctgaaagagagaaacagaggtggggttaccgctggcatggattgcttatgagggacccacaytgtgtcaggccctgggcacatgatatgaaataggtaaagtctctgctctcttggcacttattttagtgagaagctagtgagacaacccagcccaacttgc

SEQ ID NO: 55032 - DNA, 201 bp, Homo sapiens
atctcctcttctcccttctcctcccttagcccttggatcaggactaggggctctgatttttggattctgcaaaagcttggtatgaagtttggaaaagcaargttctgaccaggtcacagacaaaacagcaagaccagattcatctattggccaacactgacacaaaaatagccctcctcacacatggcacaagctacacac

SEQ ID NO: 55033 - DNA, 201 bp, Homo sapiens
tttcctctgtgtgacatgttaccctgggcttgttcacatggaggttgcaagtcccaagagaaataggaaactaagccctaattcccaaacacttttcaagyctccacgtcttacaaattaggatgagagggaactaccaaagagtatggatacaggaggttgtgataaaatgggggccattactataattagtctaacaca

SEQ ID NO: 55034 - DNA, 201 bp, Homo sapiens
gctttagcaatgattaacatatggccaatcttgtttcatctattactccctctctcttcttttccctcctcctgctggattaattttaaaggcattccccrgcataattttctctgtaaatagtatgtatcgctaagagataaggactctttgttgttgttaggcataaccacaataccattatcacaatttttaaaaatt

SEQ ID NO: 55035 - DNA, 201 bp, Homo sapiens
taattcccaaacacttttcaagtctccacgtcttacaaattaggatgagagggaactaccaaagagtatggatacaggaggttgtgataaaatgggggccrttactataattagtctaacacactaccccactggggctgttggggggattaaaatgagagttttgcttgtaaagtgcttagcacagtgcctggcttgtta

SEQ ID NO: 55036 - DNA, 201 bp, Homo sapiens
taagccacagcagctgagctcccctatgggactccttgattttttcccttgggtcttcatcatcttctccttcagcgctcccatgatagaaggctgagtastttccagaatgcttggtgtgggccacctcatccacttctcataggagccccttgagtaggcacagcagatggttctaggctggtggctcttgtcctcctg

SEQ ID NO: 55037 - DNA, 201 bp, Homo sapiens
ctaccccactggggctgttggggggattaaaatgagagttttgcttgtaaagtgcttagcacagtgcctggcttgttaattagcactaaataaataatgarcccttcttattattttgtgaaaaggacctaaggctttgacatattaggtagcttcctttaggacagccctctccctgacctcccccacccccattaaacg

SEQ ID NO: 55038 - DNA, 201 bp, Homo sapiens
cagcaagtgtgcagcggaggacccagggtccaaggggcaggttgaggccattatttaggttcaggaagatcctggtgaatcagtgcagggatcagtgcagrgatctccccactgctggtgctgtacatgaagggaggcccagtccagaggctgtgatcgggtcagaggccatgccagagtgaacatgagtatccaagaggc

SEQ ID NO: 55039 - DNA, 201 bp, Homo sapiens
tcctttaggacagccctctccctgacctcccccacccccattaaacggtggggatttgaatctagtttccacctccctccagggactgacctcttaactartatgctgtgctgctctacccacatagacacataatggcagaaactcacccaaagccatgaggtcagtctgcagatggaccacaattcaagcccaggtctg

SEQ ID NO: 55040 - DNA, 201 bp, Homo sapiens
ctcacggcaaatgcaagggaaatattaattgtagaggctggcaagagaagaatggatatcctgcggcaacctttcaagggcacgtagcagggctcacagcyggggcgggcccatatgttcttgacacaccaatgccagctttctaagagcctcattgattcctgtggtatgtagaggagaatggcctggaggggttggttc

SEQ ID NO: 55041 - DNA, 201 bp, Homo sapiens
gcaagggaaatattaattgtagaggctggcaagagaagaatggatatcctgcggcaacctttcaagggcacgtagcagggctcacagctggggcgggcccmtatgttcttgacacaccaatgccagctttctaagagcctcattgattcctgtggtatgtagaggagaatggcctggaggggttggttctggaggccatat

SEQ ID NO: 55042 - DNA, 201 bp, Homo sapiens
tctgaccttgacagatgaggaatacaaggtgtagaaggcagctcttgagaggcagagcagggattcacactcagcccctggtagttcctgtctgctagccyggcttcaggttggggagggcaggagtgacctcccaggtgctgagaagggaccatcatggggtgatttttggtacagggatctcagggccctgtggggctt

SEQ ID NO: 55043 - DNA, 201 bp, Homo sapiens
gtaggattgcaatcctctctacacctggagagaagtggcaacgaggagcctaaaagccaggagaccatcaggtgctatcagacaggtgcagaccagcaagkgtgcagcggaggacccagggtccaaggggcaggttgaggccattatttaggttcaggaagatcctggtgaatcagtgcagggatcagtgcagggatctcc

SEQ ID NO: 55044 - DNA, 201 bp, Homo sapiens
tgctttgcacctctatgatactcctagtaatgagaggaggagacagaataccaagatgctgaacaacctgcccagggtcacaccgatgggagttgactggrtcagggtgtaagcttaggctgtccactccaccattctgcagtgaggtgatgggggctgcgctactctcctgggggcttcccagggctcagccccagcacc

SEQ ID NO: 55045 - DNA, 201 bp, Homo sapiens
tgtttctccccagggcctgtacccacagcaggcagcgaggatgccctatcagcaggctttgcacccgcagctgggatgttactcccaacaggtgagtagaygatctctcctcctctgtcctgggtccatgaaggcctttgggtcagagggtgcatctgctccctcctccttttccagctggtgaccagacacctggcccac

SEQ ID NO: 55046 - DNA, 201 bp, Homo sapiens
ctcctggcctggttccagctggcctcagacagcccatgggtctggtcagcaatgtgatgggacaaactcagtcctgtctgggaactgagctgagtagctgmtgccttctggcaggaaaccccttgcctggccatactgagcctctgtttctccccagggcctgtacccacagcaggcagcgaggatgccctatcagcaggc

SEQ ID NO: 55047 - DNA, 201 bp, Homo sapiens
ctgaatcagggacttttaactatatggcgaatctcgatggcagcgaagtgtttgataaaggctcttgggagggaatggagatgtgatgacagtgatggggwtgatttattcccccaaaatgttgatccaggattactgtcaggctgggaggagagtctccggtagtgtccctgaggctctgccccagactctctcctgttc

SEQ ID NO: 55048 - DNA, 201 bp, Homo sapiens
gagctggagttatgtgccaaacactgttctaggtttggaggcctctgtggtgaacaagataaagtccctgcccttgtggagtaaggacacaaaaaggataytattaaattaggtgatggtacaaacgctgtgaagaaaataaacagattgacagaggaaggtgggggagggacacttttaaaaataggcaggaaaggctac

SEQ ID NO: 55049 - DNA, 201 bp, Homo sapiens
atggcagaaactcacccaaagccatgaggtcagtctgcagatggaccacaattcaagcccaggtctgtgcctgaccccagagccctccacttcactctaayccgccaggttgccttgggtactgtgtttgtcattggtctaaaatttcatagctggaagaaaatatttgttttggtatcctcctccagcactaacaatttt

SEQ ID NO: 55050 - DNA, 201 bp, Homo sapiens
gagacaagcttctgaagcagaaggtggccatgcccgttatcagcagcaggcaggactgtgattctgccacttctactgtcacagacattctgtgtgccgcygaggtcaagagcagcaaggggacagaggacaggggccgcatcctaggtgactccaacttgcaagtcagcaagcttctgtcccagttcccactgaagtcca

SEQ ID NO: 55051 - DNA, 201 bp, Homo sapiens
ttctgccacttctactgtcacagacattctgtgtgccgccgaggtcaagagcagcaaggggacagaggacaggggccgcatcctaggtgactccaacttgsaagtcagcaagcttctgtcccagttcccactgaagtccactgagacatccaaggtccctgacaacaagaatgtgctggacaagacaagggtcaccaagga

SEQ ID NO: 55052 - DNA, 201 bp, Homo sapiens
gctgggctagggggccaaaagctggtgggatctggtctattattatcaacaggtaacactgaggcacaggtcctttctggctgcatccagacagatcccgrtgcctgctattgggcagcacagtgcacagccatctggtgggtggccaggtttcccaccactgctgtggaggatcctgtgatggtccccaaagtatgtctg

SEQ ID NO: 55053 - DNA, 201 bp, Homo sapiens
tcctacaggacaacctgttcagtggccctggacccaaggagcccacagggctgagcccatttctgctgctgcctccccgacctcctcctgcacgtcctgasaagctccctgagctccctgctcagaagaggcagctcccagtgtttgccaagatctgttccaagcccaaggctgaccctgctgtggagaggcaccacttga

SEQ ID NO: 55054 - DNA, 201 bp, Homo sapiens
ctttcaagggtcacgtcagcattattaatggtcacttctgaatatagccctgacccagcatgtattatatcctctcaaattgcccaagccaaaacaaaagwtccttgctttagattatttctatattgagattatgttcccgctttcttttcctacaagggttctagtcaaacctcttttcccaaaaggatgccaataagg

SEQ ID NO: 55055 - DNA, 201 bp, Homo sapiens
atccttgctttagattatttctatattgagattatgttcccgctttcttttcctacaagggttctagtcaaacctcttttcccaaaaggatgccaataagrggaaactgaggacccatttctgattttataagcccccacaacatcttgtagaaaggaagaatccaggattctgatcttgaaacaactcaacctaacttca

SEQ ID NO: 55056 - DNA, 201 bp, Homo sapiens
ccatgacctcagcaaccctgaaccagccactctggctcaacctgaactatccacctccaccagtgttcacgaatcactctaccttcttgcagtatcaggtmagtgagctggcctggctctcctgtggacatccacgggggttttggccacagagaaggagtggctggcagggggtctatttcacagagtctttagactcct

SEQ ID NO: 55057 - DNA, 201 bp, Homo sapiens
gcataatttaccttctcccagcttctgtgatctcacaatgctgtccagcttcaacatagctgatcaaggggcctgagataatagcaggcaggttttgaaaycagtagacttgactttaaaggttctgctgcttccaagttaggccttaggctggttagctgctcagagccatggttcctcatttgtgaaatgggttcataa

SEQ ID NO: 55058 - DNA, 201 bp, Homo sapiens
gcacattgaggggtattgagtcttggggcagggatgggggtgtgaggaaaggagcttagaatggaggagcagagggcaccaacacccagcctgccatagcmccaggctggccttgctcctccacacaaatgtggacacccccacactccaactcatacaacctctgcctctcctgtctccccagggagccccaccctccgt

SEQ ID NO: 55059 - DNA, 201 bp, Homo sapiens
tctgggatgagagatgatctgggtcagggaatctcagccccattgcctccaccccttgaacaagaatatcgtccacctggctccagagagaatatttttarataattatgtgtatgtgtatgcatgcatgcatgtgtatgtatttgaaaaaagtaatataaaaacatggtaaaaaattttaaaacttggaggcaatcactg

SEQ ID NO: 55060 - DNA, 201 bp, Homo sapiens
gaaaggaaagggtaccacttagaagactactgcaatagtctgagccaggaaacatgggggcaaaggcagagatggggaccctggaaacatctgcagggcartggagaggcaggagtcaaagacataacagcctacccgcatctagcctaggagagtgtgggtctcagcccagccccaagtgctggctccctgcctgcccct

SEQ ID NO: 55061 - DNA, 201 bp, Homo sapiens
tgggtcagggaatctcagccccattgcctccaccccttgaacaagaatatcgtccacctggctccagagagaatatttttaaataattatgtgtatgtgtrtgcatgcatgcatgtgtatgtatttgaaaaaagtaatataaaaacatggtaaaaaattttaaaacttggaggcaatcactgtttaatggttttttacata

SEQ ID NO: 55062 - DNA, 201 bp, Homo sapiens
atatagcatgtgatggaaataagaagggctcctagctcagcctatgggaaagggcaggtgagaaccagcactttctaggaagaaagcacagagtgggccasctcagggagggaggacacagtgtgtaaatctgcagcactcacagggtaccaaggaagggtgtggggtggaaatagacctctcttctgactcaacagtctc

SEQ ID NO: 55063 - DNA, 201 bp, Homo sapiens
ttggcatacctatcactactggggtctggcagaaaaaccaaagcaggaggaaagccagctgaattctgactttgttgctacctcactggaccactactgcyaccaccatattcttttattctgtcatctaggaccttccttttccctaactttaagtggagatctcataggctgccatttttacattgctaggctctcaat

SEQ ID NO: 55064 - DNA, 201 bp, Homo sapiens
gatgagtcctttaaagaggtagctaagattaaaaaaaagaaaaaagccattagggtgtgtcctaatctaatatgactggtgtcctttaaaggagtgattargacagggacacatatacagggaagaccatgtgaggacatagggagaacacagccaagtgcaagccagcgagagagacttcagagtgaaactaacaatgcc

SEQ ID NO: 55065 - DNA, 201 bp, Homo sapiens
gctgttgagtcataaatttgtgtttgttttaatataataatacatagccattcattcccacccaccaaatcttccactaatatggatgctccaaggggcasgtggtgccctgtcattcctgggaatcccagtctcccgggcacaccctggggaatgggtgcctgggtttgagaaactcactttataggattaaggccaacc

SEQ ID NO: 55066 - DNA, 201 bp, Homo sapiens
agccagcacaaactcaacattctggctgaaaattctactcaaattgtgcatgctgttgagtcataaatttgtgtttgttttaatataataatacatagccwttcattcccacccaccaaatcttccactaatatggatgctccaaggggcacgtggtgccctgtcattcctgggaatcccagtctcccgggcacaccctgg

SEQ ID NO: 55067 - DNA, 201 bp, Homo sapiens
ggcaaattggtgggagccgcccggcccagcctgccttgccgagtcagcgcgctcttgagccgctgggcccttcccggtgcccgcctggcagcgcggcgcgrctggggcaggggtctgctgggggccggggactaagggctgtgggcccatccacacacgcctcatcccttctttccgggggcagcagagcagcagcgggag

SEQ ID NO: 55068 - DNA, 201 bp, Homo sapiens
gcacagcttttgtaagcaaacccagaggccctgatctcaacatactttgagaagagaaataggcgccatgtagtaattggcttaactttggaatcaaacgrgtgtccagagtacattgaaggaagtgtttaccctagctgggttcagggtgaaactacagcatggagatgccaagatgtatagaagagaaatttgattggt

SEQ ID NO: 55069 - DNA, 201 bp, Homo sapiens
cattcatcatctcacttaatcctcactgcggcccggagggtggaggagggctgggggtggggaggccaaagctttctccagccctaagcttagtcccctgmctcctatcaggaaagtcccaggagacagagcttaagggttttccaggtacctttgggacacgggttcacaagccctggtaccgcaactgaatgaatctgc

SEQ ID NO: 55070 - DNA, 201 bp, Homo sapiens
tggaaataataatggccctacctcacagggctttctggagttttaacgacagcatccatgtgaagggccgggcacattttaagcagtcaatgagtgctagmctttgtggattgtttttttttttttagacggagtctcgctctgttgcccaggctggagtgcagtggcacaatcttggctcactgcaacctccacctccta

SEQ ID NO: 55071 - DNA, 201 bp, Homo sapiens
tttgaaggttttagtgtatttgttagagaaaatgcaagagtggtgtgtctaagcatgtctgtgtacacatttgtgcatatgtctgtcatgtatgtacttgwgtatgtgtaactaagtcaaaggaacaacagataggagtgtgtctatgtctgtgtgcccagacctgggacgagggagcttcgtagatgtttaaggcatctg

SEQ ID NO: 55072 - DNA, 201 bp, Homo sapiens
tgtgtgtgcacatgggtgtttgtacatggctgtggtatatttgtgtgcatggctgtggtatgtgggcatggctgtggtacgtgtgtgcatgtgtgaatgtrtgtatgtgtgcatagtgtgtgtgcatgactgtggtgtatggtgcatgggtgtatatgtgcccgagtgtgtgtgtgtgtggcggggggtggctatggtgtg

SEQ ID NO: 55073 - DNA, 201 bp, Homo sapiens
aagccagagctgtgtaaatcacaacagctttttggggataatgaaagccttaaaaataaacaaggagcttttgagatggttattgacagagggaaaagctrggcaaacagggaagagaatggaaataatattgatttgctatttactatatgcctgtctctctacttgtatcacctgactctatccccactaacaacgtag

SEQ ID NO: 55074 - DNA, 201 bp, Homo sapiens
taaattggctcaggctagagcagctctttcctttgctggaatagtgctaggaagacagccttagccccgaagctcagcccccaagccgctgggctaggggrccaaaagctggtgggatctggtctattattatcaacaggtaacactgaggcacaggtcctttctggctgcatccagacagatcccggtgcctgctattgg

SEQ ID NO: 55075 - DNA, 201 bp, Homo sapiens
tggtttcagtagtcagatctgtttgggaaaagctgtgggaaacagagataaacagatttcttaactgttggaattctcagatcatttaatttcctagggtrcacggagaatgttcaagaaggtggtcgatagtattatttaaacatgaaatccacacccttttctttttttattttattattattatttttttgagatgga

SEQ ID NO: 55076 - DNA, 201 bp, Homo sapiens
tacatcacttaagatttttgcagaattttctagaaatctcgtctgtgcactctaaaaacatgctctatctttgttccgtatccctgctgtatttgattttwtttttttttttttgcagtcctttctgatttagcccccgttgcctggtctcctgctgagggggagagggaacaggaagagtgagtgagctggctaacttcc

SEQ ID NO: 55077 - DNA, 201 bp, Homo sapiens
gcttcttcccttcagagaactgagagcagatgaaatgtgggcacaacaatgttagtgccctggcaaagtgaaaaccatcaaagtggcccgaggacagaggyagaatccctgcagcgggggaggttccagtgagcagcactgggaggagggcattccaggcaggaggagcaaggccctcagatgggaaagcaagtggcaagc

SEQ ID NO: 55078 - DNA, 201 bp, Homo sapiens
ctttacctctaacttctcccctccacctccattcatgtgccccatccacttgaacattattcccaatgatgcaccaagctctttccctcctcatggtcttygcacatgctgttccctgtgtctgacaaggtcttccttgcattcgttacctggctaagtccttattctcctttaggccccagcttaaaagacaaaggtgca

SEQ ID NO: 55079 - DNA, 201 bp, Homo sapiens
gtgtctgggagggagggtggtctcaatgtctcctcagtcagctttcgggaaccaccgactgggagctgtgagaccagaaggttgagacttggtctccacaygtctgcagaggtcggaggagtgggtaggcagcccgagaaaggagcagcctgagaagtgagagacagcctggggaaagccagagacagtggaggcaaagag

SEQ ID NO: 55080 - DNA, 201 bp, Homo sapiens
cagctttcgggaaccaccgactgggagctgtgagaccagaaggttgagacttggtctccacacgtctgcagaggtcggaggagtgggtaggcagcccgagraaggagcagcctgagaagtgagagacagcctggggaaagccagagacagtggaggcaaagaggagggtgaggagaaggagcagggtggattggcgttctg

SEQ ID NO: 55081 - DNA, 201 bp, Homo sapiens
aatgtaagggatgcaagcctgagtacccagaggggatgatctgttcattcaaaaaatattgatccagcaccttgtatgtgcctggcactgttgtagacacyagggataatgaagtgaacgaaaaaaaggttttccttctcctaaggagctttcattctagaaggagaaatggacaataaggagataaacaggcaagcatgc

SEQ ID NO: 55082 - DNA, 201 bp, Homo sapiens
atggaacacttttgcaggtttttaggaaggggtgtgacatgaacagattcactaatgtttgaatctctgtccagcttctgtgtggagatggtttgtaagtrtgtgggagaggaagtgggaggcctctgggaagatactgtcagagtccaggggaggcctaatggtggcagtggctgggtaggagtgactgcagtagggatg

SEQ ID NO: 55083 - DNA, 201 bp, Homo sapiens
aacactgacacaaaaatagccctcctcacacatggcacaagctacacacacacacacgaccctcatattcatacttgcttgctcaaccacttatgcatctrtatttagctaacatgagtgatttttgtttttgtttttgttggtaaaatagaagtaagacacttaattttagaaagtttgtattttatgataaaagtatga

SEQ ID NO: 55084 - DNA, 201 bp, Homo sapiens
caagggctgagccttgagacttccagcatgtagaggctgcggagatgtggaggaaccagcaaagattctgtgaataagtaggactatctagtgaggtggggaaaaaaatgggaaagtggagtgcaggaagccaagtgaagaaagtgtttcctgaacaaagtgctggtgttggggtggtgacgcgaggtgctgatggaacaa

SEQ ID NO: 55085 - DNA, 201 bp, Homo sapiens
actgttggaattctcagatcatttaatttcctagggtacacggagaatgttcaagaaggtggtcgatagtattatttaaacatgaaatccacacccttttmtttttttattttattattattatttttttgagatggagtttcacccttgttgtccaggctggagtgcaatggcgtgatctcggctcactgcaatctccgc

SEQ ID NO: 55086 - DNA, 201 bp, Homo sapiens
aacatatggatacccctactccataggcaggggcagttggtgcaacgatgcatttgcctttacccatgtgcttggttacaacaggacatggccagctaatytccttagagctctcacctcccactgtccgcaccctgatctccttgcaaggctaatctccccaacatcccattgactttgtgatgggccctgcggaagagc

SEQ ID NO: 55087 - DNA, 201 bp, Homo sapiens
aagcagcctcagccaccctgttctccatttcttccctctgccacctcatggtgttcatctaccttatcctggggctatttctgggcatgtctctctttttktcttgttatgagctcctgcagggcacagtctagctctgactcacaactgtgtccccagcactcaggtcaaggcctggcactgacaagtgagctgaatcac

SEQ ID NO: 55088 - DNA, 201 bp, Homo sapiens
caatcttccaaggaaatggggtcagagagctccacagaccttgaggggacagagaggagaaatggggaacagtctagcctggtcttttccctgtttagcaytgggaataaagataaggtcccaaatccaatttactcagagctctgtggtaggaggactcagagatgtgaaagacaaagtccccaacaccgaggagcttca

SEQ ID NO: 55089 - DNA, 201 bp, Homo sapiens
tcctaacttaggtatccatcactagtattctcacacacagcatttcactgttggttttttagagcaacatagctagtggttaagagagaggcattggaacragattgcctcagatcactggctttgtcccttagtaagtctgtgaccacaggaaaattacttaacttctctgtcccttggcttcttcattttgaaaattgg

SEQ ID NO: 55090 - DNA, 201 bp, Homo sapiens
ttgttaattagcactaaataaataatgagcccttcttattattttgtgaaaaggacctaaggctttgacatattaggtagcttcctttaggacagccctcyccctgacctcccccacccccattaaacggtggggatttgaatctagtttccacctccctccagggactgacctcttaactaatatgctgtgctgctctac

SEQ ID NO: 55091 - DNA, 201 bp, Homo sapiens
gagaggcaggagtcaaagacataacagcctacccgcatctagcctaggagagtgtgggtctcagcccagccccaagtgctggctccctgcctgcccctctyattctccctgtgagcaacaggcagtcgtgggttgaggtgtctttacaatatcacattgcaaaaaagcccaatgcagtctagtgactagccaagataagcc

SEQ ID NO: 55092 - DNA, 201 bp, Homo sapiens
cctgtttagcactgggaataaagataaggtcccaaatccaatttactcagagctctgtggtaggaggactcagagatgtgaaagacaaagtccccaacacsgaggagcttcagaggctcctgggctacttggcataaaggaactctgctcccaatgaaggagggagggtgcgtgggaagggaccatggcttaagcaaagaa

SEQ ID NO: 55093 - DNA, 201 bp, Homo sapiens
gcccttcttattattttgtgaaaaggacctaaggctttgacatattaggtagcttcctttaggacagccctctccctgacctcccccacccccattaaacrgtggggatttgaatctagtttccacctccctccagggactgacctcttaactaatatgctgtgctgctctacccacatagacacataatggcagaaactc

SEQ ID NO: 55094 - DNA, 201 bp, Homo sapiens
gggagaagatgatgaaaaagaggcagagggaagatgaaagattcccatagggaagctcagctgctgcaacttaggctctgcggtctggaggcatagctctkgtcaccctctaagagggtacgatgagtctcaaaaatggtgacatggaatgctcccagcagagatctttgtgtatgatgccgtgcacacacacaattgcac

SEQ ID NO: 55095 - DNA, 201 bp, Homo sapiens
gcacacacacaattgcacacaaacgatatccatgcatgtttgatgcacacacatagaaacagaaacaggcaggcgcacgactgcctgtagaaagcagagaygagtgctaacagggatcagaggaggcggcgaaacagaggagggacacttagcaacatgcctagtggccttggagctcatggagggctgagaacaggtaag

SEQ ID NO: 55096 - DNA, 201 bp, Homo sapiens
ggaggatcactgcggggagttcagattttattccacatgttatggaacacttttgcaggtttttaggaaggggtgtgacatgaacagattcactaatgttygaatctctgtccagcttctgtgtggagatggtttgtaagtgtgtgggagaggaagtgggaggcctctgggaagatactgtcagagtccaggggaggccta

SEQ ID NO: 55097 - DNA, 201 bp, Homo sapiens
tgttggggagctaacagcatgcttgcttagtcattattctgagaaggggtgccaaccagtcaatagcctttatttttgtatgactctgtataccacaaatkcagaaataatgcacagcatccgagtatggcgctactattggacaactatcatttctggagatgggcaaagcagaggtggcaccgcgtggagctggagccg

SEQ ID NO: 55098 - DNA, 201 bp, Homo sapiens
cttgcttagtcattattctgagaaggggtgccaaccagtcaatagcctttatttttgtatgactctgtataccacaaatgcagaaataatgcacagcatcsgagtatggcgctactattggacaactatcatttctggagatgggcaaagcagaggtggcaccgcgtggagctggagccgcagaactgattctgacttgct

SEQ ID NO: 55099 - DNA, 201 bp, Homo sapiens
cacgcgagttgggggtggggagtgaggttggtggaaggacggtgcaagagttactagtacaatttatccccaaatttaaataatcggatcctacttcttcrtctccccttcctcctcccagccaaggccccaaaccaagagagttcttcccaaggacgtgagctgctccccacctctccccagtagcggctgcctctaggc

SEQ ID NO: 55100 - DNA, 201 bp, Homo sapiens
ctccttcgctgtctacgccaaactctcggcgagagggaagagacgcttcatggggggaggctggaggaaactgggaggggcaaggtccagagaggaggctyctgctggcgcgtgcagtggaaaggcacctgcgatgggcacccccgccccctttgccgacacaccccagagaagctgtgctccgggcttagggcagcctga

SEQ ID NO: 55101 - DNA, 201 bp, Homo sapiens
gcctggtacatggtgaacattcagggaatttttgctggatgaatggataaacagatggatggatggatggatgaatggatggttaagtaggtgctcagtamtgtttgtggaatggacccaaaggtatctcttctagacttcattatttgagttccttaaagaaatgcctccactgagttatgatttaatgttatgctgtct

SEQ ID NO: 55102 - DNA, 201 bp, Homo sapiens
cataaagggcctcgccaggaatccttggcatacctatcactactggggtctggcagaaaaaccaaagcaggaggaaagccagctgaattctgactttgttkctacctcactggaccactactgccaccaccatattcttttattctgtcatctaggaccttccttttccctaactttaagtggagatctcataggctgcca

SEQ ID NO: 55103 - DNA, 201 bp, Homo sapiens
tccctctctacacaaaacacaaaagctgctattcagaaactccaaaggcatgcatttcagtgtaatcaacaagcaaacaactgtataacacgtttatctgycagttgttgttcaagggactttccatgtgttaagcaattggttagtaatagaacatctgtagtaattctacaaagcaagtattcttcattatcatcccat

SEQ ID NO: 55104 - DNA, 201 bp, Homo sapiens
agtggtcaagggctagatcaggcctagagtgctggggtctgagtctcagcttcccttttctcagggggccttggacgcaatcccttatgactttgagattsgctttcctcccgtgtagaacgataataaaaagtggtactaatttcacgagctttaataggattgaatgtgagcccagcgcttggcacagggcaagcgccc

SEQ ID NO: 55105 - DNA, 201 bp, Homo sapiens
gcaagggaggagggaggagatgaagtctgaccttctgggggaatgttctggcccactgttgaggctggtgaaaccctaaaggctgtatattgccccctccrtggtcctttgtccaagctttatagaagagctgaccaaagttctgaagttttgtgggtgaagagtcagattagggctatattccaggctgcctcttcacca

SEQ ID NO: 55106 - DNA, 201 bp, Homo sapiens
gaatttgaaaaacatgtttctgctattgagaaaagagataggaaaccaatgacttagacgaataaacgacatcctaattgtcaaccaaatagaacacaatkagctattcttaaaataaaggcggtgtgctggtggagtcagataactctggtttcagattccatttcagccccatgccatttgaagaatttgttactcttt

SEQ ID NO: 55107 - DNA, 201 bp, Homo sapiens
gagatctttgtgtatgatgccgtgcacacacacaattgcacacaaacgatatccatgcatgtttgatgcacacacatagaaacagaaacaggcaggcgcaygactgcctgtagaaagcagagatgagtgctaacagggatcagaggaggcggcgaaacagaggagggacacttagcaacatgcctagtggccttggagctc

SEQ ID NO: 55108 - DNA, 201 bp, Homo sapiens
ttgtgcactcaggaccttggcaatttgctgccccagcctggcccagcacagcctgaagtgagaaagcaaagaaggaaatacttccaactcggcttgtcctkttgctatgtcccttccccgctctccactcctaggaaccctatgtcattctttccctttcaacacagcacaaaccttatgtcctattgggaaaggggattg

SEQ ID NO: 55109 - DNA, 201 bp, Homo sapiens
tgggcccttccgaatagcccttccacgtctgcttagtaccaggagccatgagtggtgaagaaagatgaatcatgattaacgtcccacttcccatgtccccmtttgtaatttaattttatggtttcgggagctgtgtcgcaggttgtgggagcctgcagagatgggccaccagtggtttggtttaatcccctttttaatatc

SEQ ID NO: 55110 - DNA, 201 bp, Homo sapiens
aggcgccgaaagttgtcacggcggcgtcgcaagggggcagtgccagggactgtggggagagccagccctccccttccagctgttcccagatgtcattctgsccgcccaggcgcctggttcctgagctccgcagcattccactgttcctaagctactggtttttgttgacttttaaatattttcttctaagggagaggggga

SEQ ID NO: 55111 - DNA, 201 bp, Homo sapiens
agtcaaagacataacagcctacccgcatctagcctaggagagtgtgggtctcagcccagccccaagtgctggctccctgcctgcccctctcattctccctrtgagcaacaggcagtcgtgggttgaggtgtctttacaatatcacattgcaaaaaagcccaatgcagtctagtgactagccaagataagcctaatatccag

SEQ ID NO: 55112 - DNA, 201 bp, Homo sapiens
gcgaagtgtttgataaaggctcttgggagggaatggagatgtgatgacagtgatggggatgatttattcccccaaaatgttgatccaggattactgtcagrctgggaggagagtctccggtagtgtccctgaggctctgccccagactctctcctgttcaacatttctatttgtaaattggcggaagactcagaagatgtg

SEQ ID NO: 55113 - DNA, 201 bp, Homo sapiens
tgaggagcacaggggctgagactgggggtgggtggctggggttagagttgggctggggaatggtgacctcacccctctcttctctgtgatgtgcaggtgaygccatacaacccacagcagatgggacagcagatcttccgctcttcctacacccctctgctgagctacatcccttttgtccagcccaattatccctaccct

SEQ ID NO: 55114 - DNA, 201 bp, Homo sapiens
agtgcagtggcatgaccttggctcactgcaacctctgcatcccaggttgaagcgattctcctacctcagcctcccaagtagctgggattactggtatgtgygctaatttttgtatttttagtagagactgggtttcaccatgttggccaggctggtcttgaactccccgcctcatgtgatccacctgcttccacctcccaa

SEQ ID NO: 55115 - DNA, 201 bp, Homo sapiens
tgcagaaataatgcacagcatccgagtatggcgctactattggacaactatcatttctggagatgggcaaagcagaggtggcaccgcgtggagctggagcygcagaactgattctgacttgcttcttttgtcaggagcccaggagctgggttaacctccctgaatgattcgctgtgatagagtctgtgatagattaggtgg

SEQ ID NO: 55116 - DNA, 201 bp, Homo sapiens
catattagtcagtctggtctcggactcctgatctcaggtgatccacctggcttggcctctcaaagtgctgggattataggcgtgagcccttgcacccagcmtttccctctcttgagcttcccaatgctgggtctcagcaccccagtcccattgacactgatgcacccctgttcttgtttgtcaagtgagctagtgctggca

SEQ ID NO: 55117 - DNA, 201 bp, Homo sapiens
cccatctggctgaactgccagaaagctgtttaagggaggaggcagtgatggatgacaaacacactgaacattgagtccttactatgtgcagggcactgttstaagctctttagatgtattaacactttcaccctcacagtgcccctctccgtaagctacagacacaggtatatggatgggcacatagatacacagcaacac

SEQ ID NO: 55118 - DNA, 201 bp, Homo sapiens
atttttgcagaattttctagaaatctcgtctgtgcactctaaaaacatgctctatctttgttccgtatccctgctgtatttgattttatttttttttttttgcagtcctttctgatttagcccccgttgcctggtctcctgctgagggggagagggaacaggaagagtgagtgagctggctaacttccagaatcctggggc

SEQ ID NO: 55119 - DNA, 201 bp, Homo sapiens
ttgtacctagatgcacaataatactgcctgaaaataaagcagcagaaagagaaatgcaaacacacacacacacacacacacacacacacacacatgcagayagaaacacaggtatagttgtacacatgccaccaagctgcaggagcctgtgtgcaggcacagggacacaaatagatacagaagcacattgaggggtattga

SEQ ID NO: 55120 - DNA, 201 bp, Homo sapiens
cacttaagatttttgcagaattttctagaaatctcgtctgtgcactctaaaaacatgctctatctttgttccgtatccctgctgtatttgattttattttwttttttttgcagtcctttctgatttagcccccgttgcctggtctcctgctgagggggagagggaacaggaagagtgagtgagctggctaacttccagaat

SEQ ID NO: 55121 - DNA, 201 bp, Homo sapiens
agcagtatttgtcagtgccattcagagtgcctggtacatggtgaacattcagggaatttttgctggatgaatggataaacagatggatggatggatggatdaatggatggttaagtaggtgctcagtaatgtttgtggaatggacccaaaggtatctcttctagacttcattatttgagttccttaaagaaatgcctccac

SEQ ID NO: 55122 - DNA, 201 bp, Homo sapiens
caagaagctgattgtccactttgtggaccaagggtcagtagcaatttccagtagatggcatcctctttgccaggtcacacagagttaatggagacagactygacttccagtctgcacttggctgaaaattgaactggtgcacctttggccagctgcttaactccatttggcctttacttcctcatttgcaaattgagggtg

SEQ ID NO: 55123 - DNA, 201 bp, Homo sapiens
agtaccatagaccctgtggcttaaaaaacagaaatgtattgcctcacaattctggaggctggaagtccaagatcaagaggtcgacacagttggttccctcygaggcttctctctctggcttgtagatggctgccttcttctccctgtgtcctcacatgtgttcccatggtacatatctgtgtccaaacttctaatcaggac

SEQ ID NO: 55124 - DNA, 201 bp, Homo sapiens
tagcacaggagagatgccaggactggcaaaacttgggggaaaaaggtagattacaggaaatgggggtgagcaggcctaaccgtgaacccagcaaagtggtsgggtgcccacaaaatctttctgtgagccccaaggtgattactcaaggtcaatgcgggttctgtgtggggtctgccatgggaccgccttgcagaatttggg

SEQ ID NO: 55125 - DNA, 201 bp, Homo sapiens
agcccaggagctgggttaacctccctgaatgattcgctgtgatagagtctgtgatagattaggtggtttttcccaaccccaaagagaaagcgaatagcacrggagagatgccaggactggcaaaacttgggggaaaaaggtagattacaggaaatgggggtgagcaggcctaaccgtgaacccagcaaagtggtcgggtgc

SEQ ID NO: 55126 - DNA, 201 bp, Homo sapiens
gactgggtcaagcaggatggttagtgccatctgatcggctcacagggatgccaggccagagatgggatgtgagatgaaaggccagaaaatggaaccaaagycagacaggttgcaaccagctcttagaggtcttggcatgggtaaaggcaagtgaacttgttcagtcctttattcaacacatcccgactgagctggagttat

SEQ ID NO: 55127 - DNA, 201 bp, Homo sapiens
tgctatttctccaagggtgctgaggaatctgtatttgaaaccagcactacaggtgactcatgcatgtgtgtgaaaggttctctgatactttggaagggggycaaagatgacaaaaccttaggcttaaaagataactgtctggtacatctttgagaaggaggtgtttcaaagaaaagtgtggaaggaaggaaggagattgac

SEQ ID NO: 55128 - DNA, 201 bp, Homo sapiens
agacaggttgcaaccagctcttagaggtcttggcatgggtaaaggcaagtgaacttgttcagtcctttattcaacacatcccgactgagctggagttatgygccaaacactgttctaggtttggaggcctctgtggtgaacaagataaagtccctgcccttgtggagtaaggacacaaaaaggatattattaaattaggtg

SEQ ID NO: 55129 - DNA, 201 bp, Homo sapiens
tttcaaatttgaaagagatttttgaagccatcttccgctgctcgaatcccctccttactgtccctgccaagtggtgcacttgtaccacttggtacagtttmtcagatggggagcttaccacttccctttgctgccccttcccttgctatgaaccccctcaaaataccttttgctttctatcactgaaatatgtctctatca

SEQ ID NO: 55130 - DNA, 201 bp, Homo sapiens
acaattgccttcgcagtaccaggctgtatgatgggtcccagggacacagagataagcagaacagaagcctttcctcaaagagctcccagtctagtgggtgrcatgaacacagatacatctgacaacaatgacattcaacaaatattgccaggtgcggtggcttatgcctataatcccagcactttgggaggccgaggtggg

SEQ ID NO: 55131 - DNA, 201 bp, Homo sapiens
tgcccgcctggcagcgcggcgcggctggggcaggggtctgctgggggccggggactaagggctgtgggcccatccacacacgcctcatcccttctttccgkgggcagcagagcagcagcgggagaccgggagcaggaggggtagggcgagagaaaagcaggacctgggccgggggtgggagtcgggccgttgacgctcgct

SEQ ID NO: 55132 - DNA, 201 bp, Homo sapiens
cctgtccactgggttctgtcttctgctgcctcatcctcctggctcttggctggctcctggcctctggccctgcctgaaactgaggctcagagaagggaagygaattgtagaaggtcacccgtcagaaaggacagagctgggttttgaatccaggtctcctgactgcaaagcccttgctctttctccttcttccactcttag

SEQ ID NO: 55133 - DNA, 201 bp, Homo sapiens
tcacatgggcctggggcccaattccaccccaacacttattctctagggtcaatttgagtacatcttttaaccttcctgagcctcaatttcctctttctcarttggaaaggaagatgctctgtatccctcatggttgtggtggggacaagtgccacctgtaaaacccagcacctagcaaactcctcaaaaatactggttcag

SEQ ID NO: 55134 - DNA, 201 bp, Homo sapiens
cagggccctgtggggcttctagaagctactttgagtatgtgcgtgtaatatttgtataaaataaagcagaaagcaaatacagacaaatagaatgactagtrtgtgatgaccctatgtaaccattacctggctttagcaatgattaacatatggccaatcttgtttcatctattactccctctctcttcttttccctcctcc

SEQ ID NO: 55135 - DNA, 201 bp, Homo sapiens
aaaccctgtctctaaaaaaaaaaaatgatgactaagaaaagcttggagtctaatgcaagttcaggaataaaccagagatcagctctatgcatctccacctstaaaggggaaacaactgcataattcatttagtacaagtcgattcactctaaaatgccctcacagagctcaccgtgtaaaactaatttgcaatggtttgct

SEQ ID NO: 55136 - DNA, 201 bp, Homo sapiens
gctaaatctggcaacactactttcatgggtaggtcaggataaatatctgtgggacaataattgaggtttgacctttggcaggctggtactccaatgaccaygctttactacatcttgtacctagatgcacaataatactgcctgaaaataaagcagcagaaagagaaatgcaaacacacacacacacacacacacacacac

SEQ ID NO: 55137 - DNA, 201 bp, Homo sapiens
cagagggcaccaacacccagcctgccatagcaccaggctggccttgctcctccacacaaatgtggacacccccacactccaactcatacaacctctgcctytcctgtctccccagggagccccaccctccgtgcaaaccgcacctctgacctgaaatgtgttagaatgttcgggagggtagggaagagcctgcaggggtag

SEQ ID NO: 55138 - DNA, 201 bp, Homo sapiens
ggggtagggagccttgttacctgggccagcactgatttctcagcagcaggaacccttgcatcctgagatgaatctgggatgagagatgatctgggtcaggkaatctcagccccattgcctccaccccttgaacaagaatatcgtccacctggctccagagagaatatttttaaataattatgtgtatgtgtatgcatgcat

SEQ ID NO: 55139 - DNA, 201 bp, Homo sapiens
cacgcttgtatgcccgcccctcccgacgccgccttgctgggtgccaagaaccaaccgaagcagccagaactcctcagtgaaaggcctgctttatgttccckgggcagtgaggagggggcttctcccttcccattgtccagactcagcccccgaaagagagggctcagccttcccaccagccctggagaggaggaagggact

SEQ ID NO: 55140 - DNA, 201 bp, Homo sapiens
tcctccagagaaaggaactggcagagatgcccaggcctcctgtgcagcccacagctgggcagaagagagtctgggctgctctgtaattctggggctgcagkccaatgggctttctcttaccctcttctcagctccagaactttgctctgtggctgcaacgggcagatgagatttacccccagaactttcccgggcaaaagg

SEQ ID NO: 55141 - DNA, 201 bp, Homo sapiens
gtgaactctaggacctgcctcctccacttcaatcccctcccaggtccaggcacttcctcccccatgaggacaggggtactttctgccatgctgacccatasggtcatgactcccatctgacctgcgaggtgctcttggcatgttctgacctttagctcatcaccttgggatttggtgcctgcgcccagcatcaccaggccc

SEQ ID NO: 55142 - DNA, 201 bp, Homo sapiens
agtccctgcccttgtggagtaaggacacaaaaaggatattattaaattaggtgatggtacaaacgctgtgaagaaaataaacagattgacagaggaaggtkggggagggacacttttaaaaataggcaggaaaggctactttgagactgtgacactggaaccgaggcctgagtgatgaggaggagccagtcaagggacact

SEQ ID NO: 55143 - DNA, 201 bp, Homo sapiens
tatttggagatggctccagagcaggctacaaagctctactttatagtttcatcagatacatggaatcaggggcacatttttttataacactgtgtgaactytaggacctgcctcctccacttcaatcccctcccaggtccaggcacttcctcccccatgaggacaggggtactttctgccatgctgacccatagggtcatg

SEQ ID NO: 55144 - DNA, 201 bp, Homo sapiens
aaaaaggatattattaaattaggtgatggtacaaacgctgtgaagaaaataaacagattgacagaggaaggtgggggagggacacttttaaaaataggcakgaaaggctactttgagactgtgacactggaaccgaggcctgagtgatgaggaggagccagtcaagggacactggggggttgcagggagaagcattccata

SEQ ID NO: 55145 - DNA, 201 bp, Homo sapiens
agaaaataaacagattgacagaggaaggtgggggagggacacttttaaaaataggcaggaaaggctactttgagactgtgacactggaaccgaggcctgartgatgaggaggagccagtcaagggacactggggggttgcagggagaagcattccataggaagtgcaaaggccctcgggctggaatgaacttagcatttca

SEQ ID NO: 55146 - DNA, 201 bp, Homo sapiens
ctattcatttactcacctactcacgatttactcatttctatgtatttatttactcattaatttaagtaattttgaaaaccatttctccctacaagcctacyagaggctgagcattgttctaggtggagggattcaaagatgactaaagtcaggtgtggtggcatgtgcctggagtcccagcctacaccagaggctgagata

SEQ ID NO: 55147 - DNA, 201 bp, Homo sapiens
aggttgtgatgaaaggtgacctaagaaggaagctgaagtggaccagtttcatattagtagtctattgtcatggacctgttcatatcagtagtctattgtcyttacacaggtcttgaaatgtcctgttcattgattcgctgactcctttaccaatatgattctaccctttcatttttgtgtgcctattcactattcatttac

SEQ ID NO: 55148 - DNA, 201 bp, Homo sapiens
aaacttggaggcaatcactgtttaatggttttttacatattttcccggcaatatctatttatataaacatttttaaataaatgcggcattctgggcacacwgttccattgcttttgtcagtgaggattatatttggagatggctccagagcaggctacaaagctctactttatagtttcatcagatacatggaatcagggg

SEQ ID NO: 55149 - DNA, 201 bp, Homo sapiens
tttccagagctctggagctcagcagtggcaaagatgagatctccttgttggtggaacaggagttcctaagcctcaccaaagagcactcgatcctggtcgamgagagttctggggagctggaggtacccggcagctctcccgaggggaccagagagctggctccctgcattcttgcccctcctctagtggcaggcagtaatg

SEQ ID NO: 55150 - DNA, 201 bp, Homo sapiens
ttggtgcctgcgcccagcatcaccaggccccacatctccactggagaacattggggaagaccgggagggaggactcaggtttccaaagaggacacagcatrgagaggctagtgagaaccaaggtataggctccgggcttaccctgctggggttctgaccacaactcagacgctggaaacactgagaaagttgcttcacttc

SEQ ID NO: 55151 - DNA, 201 bp, Homo sapiens
atctcccttttctggggcctatgtccttctgcaaagccacgccttggtgagctggcactaacaccgtctgtctctctgacccatttccagagctctggagytcagcagtggcaaagatgagatctccttgttggtggaacaggagttcctaagcctcaccaaagagcactcgatcctggtcgaagagagttctggggagct

SEQ ID NO: 55152 - DNA, 201 bp, Homo sapiens
tgaccttgtgatccacccacctcgtcctcccaaagtgctcggttacaggcgtgagccaacgcacccagccccctttgtggatttttttttttagataaggktgtatggggtgagagagggctgtcagagtgcctgattcctgagcacttggaccccagacttgctattaaagtggaaatccagaagtttcttcaaattcta

SEQ ID NO: 55153 - DNA, 201 bp, Homo sapiens
ccgttatcagcagcaggcaggactgtgattctgccacttctactgtcacagacattctgtgtgccgccgaggtcaagagcagcaaggggacagaggacagrggccgcatcctaggtgactccaacttgcaagtcagcaagcttctgtcccagttcccactgaagtccactgagacatccaaggtccctgacaacaagaatg

SEQ ID NO: 55154 - DNA, 201 bp, Homo sapiens
tggggagatagtggtcaacaagatggatgaggtctctgacttgtcgcggcaagatggtgggagccccagttctaggtcggagttcatcacgggcaatctcrgaagcaccactgaattcctgtatttccctagagtttgtgctcaaccccattgcctttttttgcccttcctcctagactcacactgtctactatggcagcc

SEQ ID NO: 55155 - DNA, 201 bp, Homo sapiens
acaggctccaggagagcagggaccatgccatttttgcccacccttatgcttcttcagtgcccagcaactcatcgggcacagaggaggggttgcatcagtamtgggggaattatgaatggggatgggagaagttcagaaagttcttaaggtcacacagctcggaaatgagtgtcaggattcaacccagccctgcatttatag

SEQ ID NO: 55156 - DNA, 201 bp, Homo sapiens
ggcttctctgaggagatgtgattatctgggctgagacctgggttctaagaaggagccagtcaagggaagttctggaaagaacatttgggcaaaatggagarcaagggccaggcatggtggctaaagcctgcaatcccaacactttgggaggctgaggtgggcagaacgcttgagcccaggagttcaagaccagcctgggca

SEQ ID NO: 55157 - DNA, 201 bp, Homo sapiens
gctctgcttcacgcacgagttcacttgacaaacaaggatgggggcatgcatcactatcaatgtgactggggtgttgagaccgaacactggcaaactcaagrtggggagtgtagggcctcagagcaaaggattccaacctgtggcccatggggtctctgaagtaattccccaaatgctgagagctgggaggatgtctttccg

SEQ ID NO: 55158 - DNA, 201 bp, Homo sapiens
gggagggacacttttaaaaataggcaggaaaggctactttgagactgtgacactggaaccgaggcctgagtgatgaggaggagccagtcaagggacactgrggggttgcagggagaagcattccataggaagtgcaaaggccctcgggctggaatgaacttagcatttcaaggggtagataaaagcccaacatgactggaa

SEQ ID NO: 55159 - DNA, 201 bp, Homo sapiens
aggagccagtcaagggacactggggggttgcagggagaagcattccataggaagtgcaaaggccctcgggctggaatgaacttagcatttcaaggggtagmtaaaagcccaacatgactggaagagggaggagatggggccaatttgtgtagggcatcataaaggagtttggattttatcctgtgtgtagtgagaatccac

SEQ ID NO: 55160 - DNA, 201 bp, Homo sapiens
cagagtaagactctgtttcaaataaatgaaactataaaataattataccagaaataccaacatagaggccggcccaggcaaaccaggacatatgttcgtcstactcaacaggcaactcaagctcctcctcctccaggaagcattacttgttaactctcgtccacacagattgctcctcttcctggccctctagcatacata

SEQ ID NO: 55161 - DNA, 201 bp, Homo sapiens
acatgcttcttcccttcagagaactgagagcagatgaaatgtgggcacaacaatgttagtgccctggcaaagtgaaaaccatcaaagtggcccgaggacaraggcagaatccctgcagcgggggaggttccagtgagcagcactgggaggagggcattccaggcaggaggagcaaggccctcagatgggaaagcaagtggc

SEQ ID NO: 55162 - DNA, 201 bp, Homo sapiens
gggacgaaaccagcaatattcctgagtgcattcagattggggaacaacgcctggccagggatcagggagaccttgctggataacaatctcctgaaaggaarcccaggctgggggtggggaggaattagtggaggcagctggacccagccaagtccctacatcagcttcttccctctgtggcaaggcccttagcctttcagg

SEQ ID NO: 55163 - DNA, 201 bp, Homo sapiens
gctttctaagagcctcattgattcctgtggtatgtagaggagaatggcctggaggggttggttctggaggccatatcccctgaaacccaccgtgagttcaraatggagacaaggaggtggttgcagctgggggggacatgagtgtttccttaaacaccacaaaggctgcagtgtgggaatgaatggggaagatgctttctt

SEQ ID NO: 55164 - DNA, 201 bp, Homo sapiens
ggggccataggctgccaagctgtggtttctaggagactctgaggacagagggtcaaatccatgagtttgtggatggcctgatgatccccagcggagaccaygttaactagtacattgatgctgttgtgtgccatgtgctgctcagatagggttttctgggcatcaaggtgaaggtcatgctgccctgggaccccgctggta

SEQ ID NO: 55165 - DNA, 201 bp, Homo sapiens
gtacaaactcctaggagggcttactgtgcggagggcctgcgatggtgggctgtggttcatcatgaataggggggccataggctgccaagctgtggtttctrggagactctgaggacagagggtcaaatccatgagtttgtggatggcctgatgatccccagcggagaccacgttaactagtacattgatgctgttgtgtgc

SEQ ID NO: 55166 - DNA, 201 bp, Homo sapiens
gagaggcacaatctgctttccttttgatggtgtgcagcagcatgatggccgcgcgaatttccaagaagaggatgttggtcgctgatggcatcttcaaagcygaacggaatcagtttcttactccggagctggctaaagacgcttctctgaagctcaggttcaagttacacccatcacgacagtaacaaatatcttagccaa

SEQ ID NO: 55167 - DNA, 201 bp, Homo sapiens
aggctgggtaatatataaagaaaagagatttattttggctcacagttctgcaagctgtacaagaagcatagcaccggcatctgcttctggtgaaggcctcrggaagcttccgctcatggcacaaggtgaagtgggagcaggcacatcacatggcaagaatggaagcaagggatggagggagggggccacactccttcaaac

SEQ ID NO: 55168 - DNA, 201 bp, Homo sapiens
atttgatgtgtgttggtccgtttcatattgctataaagaaatacttgaggctgggtaatatataaagaaaagagatttattttggctcacagttctgcaasctgtacaagaagcatagcaccggcatctgcttctggtgaaggcctcaggaagcttccgctcatggcacaaggtgaagtgggagcaggcacatcacatggc

SEQ ID NO: 55169 - DNA, 201 bp, Homo sapiens
ttgatgctctcaagagcatcaacaatgctgagaagaggagtaaatgccaggttcttattaggccgttctccaaagtcatcatccagtttctaactgtgatratgaagcatggctacattggtgatttgaaaccattgatgatcacagagctgagaaaatagtgaacctcacaggcaggttaaacaagtgtggagtgatcag

SEQ ID NO: 55170 - DNA, 201 bp, Homo sapiens
cctcaggaagcttccgctcatggcacaaggtgaagtgggagcaggcacatcacatggcaagaatggaagcaagggatggagggagggggccacactccttyaaacaatcccatctcgatgaactctcagagccagaactcactccttatggcaaggagggcaccaagccattcttaagtcatctgcccccatgactcaaac

SEQ ID NO: 55171 - DNA, 201 bp, Homo sapiens
tctcagcccgggaggctcctcgagcagcgcccgccgcgtccctcggccttctgtggccacgctttggcgggggtggggggggcggggctggtctttggggrcatcgttccgtctctggggatgcggaggaactgggaggtcgcttctgggctgtagttactcagggccccaaaactgcagtgccccccgtccccgggagag

SEQ ID NO: 55172 - DNA, 201 bp, Homo sapiens
ggtgagcgccaccaagcccagctaattttttgtatttttagtagagacagggttttccatgtaggccagtctggtctcgaactcttaacctcaactgatcygcctgcctcggtctcccaaagtgctgggatgacaggtgtgagccactgggcccggccttcccagataatttaaggagagtttggcctgtgccggagcata

SEQ ID NO: 55173 - DNA, 201 bp, Homo sapiens
ggaaccctgggctcgggccccctgtcgctgtggttctggggtctgggtgctggtgccgtctgctggagagtggtctggagctgcagctctgtggagtctgraaaggggctgcccagtgattctcaccagctagtcagtggtggagaagttgcctgggtgtggaccacagagctggggatggaaccaggggccagggctggt

SEQ ID NO: 55174 - DNA, 201 bp, Homo sapiens
tggccaggctggtcttgaactcctgacctcaggtgatccacccgcctcagcctcccaaagtgttgggattacaggagtgagccactgtgcctggccttcarctgcttcctaagagtctaagttcttgttccaccctttaaggccagtgaaggacccgaacactgtgtgtgccggtgtcacgcagccagcagggctctgctc

SEQ ID NO: 55175 - DNA, 201 bp, Homo sapiens
ccctggagcaccaggtcctctgcactgctgagtgtgtgcttgtcctgcccattgccctgctcgggtttctgtgactgcgtaactggctgccccatgcaggrtgttttccaaagtaccgctgtctgtggtctgtgtgctccgtcatccagcagggcctgaggtggcaaggccggccgggctggtggggcggtcctcagagtt

SEQ ID NO: 55176 - DNA, 201 bp, Homo sapiens
gggcgtggggactacctggccgtggtgctggccacccaaggccacacccaggtgctgattcaccagctgagccgtcgccgcagccagagtccgttccgccrcagccacggacaggtgcagcgagtggccttccaccctgcccggcccttcctgttggtggcgtcccagcgcagcgtccgcctctaccacctgctgcgccag

SEQ ID NO: 55177 - DNA, 201 bp, Homo sapiens
tgctgaggcctgtgccaggctggagctgctcagagatttcggggtggtgggcttcctgggatccccccaaggtcaaagggtaccctgtatcccctgaagtraccattttctctctctctctgcaggccagcactccttgcccgaggacagagatggcgagcgcccggattggggatgagtatgcggaggacagctctgatg

SEQ ID NO: 55178 - DNA, 201 bp, Homo sapiens
cgggggcgtgcccgccttcgctctggggttcctgcgcccgagcactttactgcccccacgggtgagaggtgggcctgttttccccatcagccttggttccrccagtaaacccgatccggttggagccatcctcacctccgcagtcgagggcagaatctgttttccaggttgggatgtgaattctcagtggcgcccactctg

SEQ ID NO: 55179 - DNA, 201 bp, Homo sapiens
tggggccccaccttgggctgggggttcgctcagctggtttggactttgaggaggaggagactaagcaggacctggctttctcccctctggccccggcgccrgggcccagcacccctgctggaaccttcagtagggtgagatgcagcaggtgagcctcccgccctggccttgccctgagcacttcaacagataaaaccctga

SEQ ID NO: 55180 - DNA, 201 bp, Homo sapiens
agcaccaggtcctctgcactgctgagtgtgtgcttgtcctgcccattgccctgctcgggtttctgtgactgcgtaactggctgccccatgcagggtgtttyccaaagtaccgctgtctgtggtctgtgtgctccgtcatccagcagggcctgaggtggcaaggccggccgggctggtggggcggtcctcagagttccccac

SEQ ID NO: 55181 - DNA, 201 bp, Homo sapiens
cctttcagctccgaggcctccaggtcgttgttccctgttcactttcttctagcctcgttagacaccccaaactctgaccccagtccacgggggctctgacrtctctttcccctgcactccctcttgaccctgcccagacctccccatgctggcccgcaccttcccacctgctcctgtctggcctcctgcattcccgctctg

SEQ ID NO: 55182 - DNA, 201 bp, Homo sapiens
ccctgccctgccgtggcgcccatgcacctgcccgcgtgtcctgtgctttagctgaggggccgaggccctgccctgccgtggcgcccatgcacctgcccgcrtgtcctgtgctttagctgaggggctgaggccctgccctgccatggcgcccgtgcatctgcccgcgtgtcctgtgctttagctgaggggcaccttgggccc

SEQ ID NO: 55183 - DNA, 201 bp, Homo sapiens
ggacagggcccaagaagatggggtgggtgctgtacctccctcttccttccctggggtatctgtgggccacggcagggcccacagctgttgctagtagcctscttggggccagtgggtttgatttatttttgtgtttgtgtggtttgagggcaggcatcccttccccaccctttgcgtccctgctacagtgacccctctttc

SEQ ID NO: 55184 - DNA, 201 bp, Homo sapiens
gccgggctggtggggcggtcctcagagttccccacgctgctggctgcccaagtccctgcctgaggccctgccctgttgtggcgctcatgcacctgcccgcrtgtcctgtgctttagctgaggggccgaggccctgccctgccatggcgcccgtgcatctgcccgcgtgtcctgtgctttagctgggaggccgaggccctgc

SEQ ID NO: 55185 - DNA, 201 bp, Homo sapiens
ccgccgacgccccgcacctgcccgctcaggccagcagcccctgatgtccctgccctggagactttcactatcttccatcccatttgtccccaacgttgacyggccactgaggttgggggttcatgtggaggtttgcaacccccactaggcccaggtctggaaatgggaggcctggaggtgaggggtaggtgggctatggac

SEQ ID NO: 55186 - DNA, 201 bp, Homo sapiens
tcatcacgcccggctaatgtctgtatttttaggagagacgggtttcaccatgttggctgagctggtctcgaactcctgacctcaggtaatccacctgtctkggcctcctgaagtgctgggatgacaggcgtgagccgccgcacctggccatcaatgcatttaattgtgaaggtgcttggagcgtccctccgctaggcggtg

SEQ ID NO: 55187 - DNA, 201 bp, Homo sapiens
tcttctgccacgtgcttctgcctgtccccccactccctcctgtcgctgtttcctccacagtggttggcaagacgtggcccctgtggcctctgcctcgtgcrtctgaaggacatcccagccacagcatcacatcagactggaacagtggcgggatggggctgggcatcaggcagcatgcatgtgtcatgtcacggacacctc

SEQ ID NO: 55188 - DNA, 201 bp, Homo sapiens
tgaaagtgagagaaggccaaagacctggtattaaactgagggaaggccgaagacctggtattaaagtgagagaaggccaaagacctggtatgaaagtgagrgaaggccgaagacctggtattaaactgagggaaggcctaagacctggtattaaactgagagaaggccgaagacctggtattaaagtgagagaaggcctaa

SEQ ID NO: 55189 - DNA, 201 bp, Homo sapiens
cgcggtccttgctctgcagaggggagggaggagtgtcaggccccggcagagcccagcgccagtctgcgcctctctggcctccctgctgggtgccatctcargtggccagcgccaaggcacctccttcccggctctccccagcttccctcaagcgttttggggaggggagcatactgctgcacagccgaaattgtaaaatta

SEQ ID NO: 55190 - DNA, 201 bp, Homo sapiens
gcccggggcgtcctgcggagagccccacagtgggaggcccttgtagcggggagcccggtgactgctgggggtcagctgctggcggcccctgtggagacctsgcgacctgccaagggctccggacctgcctgggtggacccagggtgggcgtgcttctggctgcagggccgggccacaggcttccctctggctttctgccct

SEQ ID NO: 55191 - DNA, 201 bp, Homo sapiens
cttcgggcgctgggcctggctgagcgctgtcgccccctggtggactctgtgccccacagctgtcccacggggatgctgcgcccctgggaacccagcacctycgaaggccacctctgccccctgcccagagcctgcctgtgccgtggcctgtccacatccagcacaggggccacggggcacagagcgctgggtgacaagtct

SEQ ID NO: 55192 - DNA, 201 bp, Homo sapiens
tgggtgggcccctttggccatccctagctcttacccctcatgcagctccctgcaggggactccacactccactgggagccgagtgtcctagggacgccctsgagaggagccccaggagaaggccccagcccccggcaggcctgtgttacaggtgtgcctgcctgtgccctgttggggagccctgcccgtgtggcctcgcct

SEQ ID NO: 55193 - DNA, 201 bp, Homo sapiens
gcctcaacagctccagtgggtgggcagttgcaggcttttgctcttacagttgacctgacagtaacatgctgtttctcacatgtgcacaccattcttggggmaaattccaagagaatttctaggtcaaaggataaatgcttttttttgtttgagacagggtctcactctgtcactcaggctggagggcagtggtgcgatgtt

SEQ ID NO: 55194 - DNA, 201 bp, Homo sapiens
cttccccccgaccatgctgcccccgtcccaggcggggctcggcaggagcgccatgtggggcccctgggaggagtcctgtggctttgacatgaatgggggtrcgggtggttggcggtgggtcttggtcctcagctggcggctttgctcctgactgccccagtggcttccgtgtctagcctgacacccgtgtcagcccaggga

SEQ ID NO: 55195 - DNA, 201 bp, Homo sapiens
tggtcctcagctggcggctttgctcctgactgccccagtggcttccgtgtctagcctgacacccgtgtcagcccagggacagaggccccgggaggctgcartccagccctcacagaggacagggccgtgggcaggacctgcggcgccgggtgccagccacagcccccagaggcccccttagagctgggtgttctcggcctt

SEQ ID NO: 55196 - DNA, 201 bp, Homo sapiens
cagagcgctgggtgacaagtcttttgtcacctgccaggaccctgggactgcggcccatgagcagcgaggctgggactccagcgtgcggtgcttcagcccckgccactgtgagggttcgggagcccagcccggtacccgtccgcagaggccaggcgggggcagccgaccgcagccgggtgtggaactgcccttgtgcgcgtc

SEQ ID NO: 55197 - DNA, 201 bp, Homo sapiens
acctggccatcaatgcatttaattgtgaaggtgcttggagcgtccctccgctaggcggtgatgccatgcactactgcagccgcccctcagctgctttcccrccaccagcctccctcatggtgttgctgcttcatcttttcctcttgtttagtgatgtttttctttcattaagaatgaggctcgcacagctgggcttaactg

SEQ ID NO: 55198 - DNA, 201 bp, Homo sapiens
acaagtcttttgtcacctgccaggaccctgggactgcggcccatgagcagcgaggctgggactccagcgtgcggtgcttcagccccggccactgtgagggktcgggagcccagcccggtacccgtccgcagaggccaggcgggggcagccgaccgcagccgggtgtggaactgcccttgtgcgcgtctggggcttggggcc

SEQ ID NO: 55199 - DNA, 201 bp, Homo sapiens
aaagtgttgggattacaggagtgagccactgtgcctggccttcaactgcttcctaagagtctaagttcttgttccaccctttaaggccagtgaaggacccraacactgtgtgtgccggtgtcacgcagccagcagggctctgctcagaggcagctgtggtcctgctcagagagaggagtgggtgggttggtgcgtggttgc

SEQ ID NO: 55200 - DNA, 201 bp, Homo sapiens
cttccaggggccaagtggcactggtgcatgaggagatgcccctctctccagtcaaggctcgtggaggcaggacacccactgccctcgctggggctgggagccccccctccgctgggcagcacagctcgctccactccttgtggccacctgcagcgccctcctcaccctcagggcccccgggtgcccgacaggcccgagtcg

SEQ ID NO: 55201 - DNA, 201 bp, Homo sapiens
tctctgctagctcagccctgtcttggttgtggggatcatcaaattgggtggtggaggggatggacagccagcccctcacagccccctcggccgcggccgckctgggttgttgaaactgccccattgctttgtgaagcgaattcaactcatcctggctcccatgggctgaatggcccgcaggccactctaggcgccaggttc

SEQ ID NO: 55202 - DNA, 201 bp, Homo sapiens
gccgccaagatggccccgtcatgcccagttagtggcctcaggttaggcctgtttctgtgtcatcccgaaggcagtccagggctccttacgcctgtatctcygccacctcccactcgcatcgtgggtccacggggccgggccaccaggggctctgccagacaccctcgcccgccacagccatctggaggattctgcccccga

SEQ ID NO: 55203 - DNA, 201 bp, Homo sapiens
ggttctggggtctgggtgctggtgccgtctgctggagagtggtctggagctgcagctctgtggagtctggaaaggggctgcccagtgattctcaccagctrgtcagtggtggagaagttgcctgggtgtggaccacagagctggggatggaaccaggggccagggctggtggtaaactccgctcttgcctctgcctgtggc

SEQ ID NO: 55204 - DNA, 201 bp, Homo sapiens
ccatcggcacagagctcttggatagcagcctgtctctgtgctgggcaccctgcggctagcgtgggcagggccctagggagccttggccgtgctgaggtgcygggtgtggggtctgtggtgcagcgctgggttgtcttggtgtccttggcaccccgacagcgatgttctggctctggtctctgggcaagttaggactgcttc

SEQ ID NO: 55205 - DNA, 201 bp, Homo sapiens
ctcccttcagcccgagcctgccttcaacctggttccctccccccagacaccacaagaaggctctgcgggctgtggccttccacccgcggtacccactcttygcgtcaggctcggacgacggcagtgtcatcgtctgccatggcatggtgtacaagtgagtgctgaccctgcctggccccctccccagggcagtggtgtctg

SEQ ID NO: 55206 - DNA, 201 bp, Homo sapiens
gcgaagggggatgcgtgctgctgggctgggctccaccagcgtggagaggctggcaccgggctgggctccgccagcgtggagaggctggcaccgggctgggytccgccagcgtggagaggctggcaccgggctgggttccgccggcgtggagaggctggcactgggctgtgtccaagagcagatttggctgcggggggctgc

SEQ ID NO: 55207 - DNA, 201 bp, Homo sapiens
tgcctgtaatcccagctactcgggaggctgaggcgttagaatcacttgaacctgggaggcggaggttgcagtgagccgagatctcaccactgcactccagyctgggtgacagagtgaggctctgcctcaaaaaccaaaacaatgttttcgcataataacatatccaagtacttgaaaggtactagaggtgtctgcggagtc

SEQ ID NO: 55208 - DNA, 201 bp, Homo sapiens
ggtgggcgtgcttctggctgcagggccgggccacaggcttccctctggctttctgccctcaggcctttagcattgacatgcacacgaccctgcctcctttmtaaggactgtgtagaattacgtggcattcagtgagcagctgcacgtggtgttctagggcacctttggatgctcaggtgctcctgaggggtgtgccaggga

SEQ ID NO: 55209 - DNA, 201 bp, Homo sapiens
cagacagacacgggaggaggcgggcagcgggccagccccatacctgcagttccaatctgtggtcctgacagctgcagccactttggggagggggagggaarggggctcatcgagagcggaaaaatcccagccgacacatcagccggttgcggcctgtgtccggtgcagtctgggctgggggcctgtccttggggctgggcg

SEQ ID NO: 55210 - DNA, 201 bp, Homo sapiens
cctcactgccgccgcctcctcaggtctacaggggccacagtgaccttgtccggtgcctcagtgtctctcctgggggccagtggctggtttcaggtgggtcygagctgggggcagccttgagctggggggcaggtgggatggccaggtgttgagagctgtctctgccgcatccaggctctgacgacggctccctgcggctct

SEQ ID NO: 55211 - DNA, 201 bp, Homo sapiens
aatttctaggtcaaaggataaatgcttttttttgtttgagacagggtctcactctgtcactcaggctggagggcagtggtgcgatgttggctcaccaaaayctcaacttcctgggctcaagggatcctcctacctcagcctccctggtagctgggactacagggtccccgccaccatgcctggctagttttgttttgtttt

SEQ ID NO: 55212 - DNA, 201 bp, Homo sapiens
gttgtcaccaacccagtgtttccttgcagccccccctcctctgcacctctcctctcagccacagcaccggcagcgattctggcgtctccgacagcgaggaragtgtgttctcaggcctggaagattccggcagtgacagcagtgaggatgatgacgaaggcgacgaggagggagaggacggagcccttgatgacgagggcc

SEQ ID NO: 55213 - DNA, 201 bp, Homo sapiens
agaaaaaagcactagtaagagaaggcctaagacctagtattaaagtaagagaaggcctaagacctggtatgaaagtgagagaaggccaaagacctggtatkaaactgagggaaggccgaagacctggtattaaagtgagagaaggccaaagacctggtatgaaagtgagggaaggccgaagacctggtattaaactgaggg

SEQ ID NO: 55214 - DNA, 201 bp, Homo sapiens
gaggcctcagaggaggagcgccaagtgggcctgcggctgcgcatctgccacgggaaggtacgtggggcgccttgggggtgaggctgcagcgggaggggccyggctcagccactcagccagccttgctctcctgcagccagtgacgcaggtgacctggcacgggcgtggggactacctggccgtggtgctggccacccaagg

SEQ ID NO: 55215 - DNA, 201 bp, Homo sapiens
agtggaggccctgggggctggggagccaggggtggcactgtgcttaggggccgtgtctgggcctggctcacagggaggactcggtgctgctgctgaacccrgctctgggggaccggctggtggcgggcagcacagatcagctgttgagcgccttcgtcccgcctgaggagccccccttgcagccggcccgctggctggagg

SEQ ID NO: 55216 - DNA, 201 bp, Homo sapiens
catcatggaagagagaattacatcttaaatggattacttcagcagcttcagttaatttatacaaaaatcaaccaactcattaagcctctctattggttaaygattctagcagccagttgaaatggaagaagagaatgaattctagtttaaagtgaagtcttagattgtggcatgattaaaacaaaacagggccaggtgtgg

SEQ ID NO: 55217 - DNA, 201 bp, Homo sapiens
tttctccttttgtctctagttcatcctctaaccaccagccatgaattcagtgaactcttttctcattctctttgttttgtggcactttcacaatgtagagkaaaaaaccaaatgaccgcactgtgatgtgaatggcaccgaagtcagatgagtatccctgtaggtcacctgcagcctgcgttgccacttgtcttaactctg

SEQ ID NO: 55218 - DNA, 201 bp, Homo sapiens
cctatggcctttctccttttgtctctagttcatcctctaaccaccagccatgaattcagtgaactcttttctcattctctttgttttgtggcactttcacratgtagaggaaaaaaccaaatgaccgcactgtgatgtgaatggcaccgaagtcagatgagtatccctgtaggtcacctgcagcctgcgttgccacttgtc

SEQ ID NO: 55219 - DNA, 201 bp, Homo sapiens
cctgattgaaaggtggtgtgggtgcatttggttaaccgggacgcgctttgtgctttgttttctaggctatagaaagcgcaattggtggtaacgcttatcarcacagcaaagtgaaccagtggaccacaaatgtagtagaacaaactttaagccaactcaccaagctgggaaaaccatttaaatacatcggtaatggagtct

SEQ ID NO: 55220 - DNA, 201 bp, Homo sapiens
gaaactcaggttcctggtttccagcacagcaagttaggggtagagaataaagttgctgagatgcaagcacactggcatccatgtgaaaggggagctgacartgaaaaactcagaaaatcatacaatggcaatatcataatgataagcttagcaagagcagcgacaatgagcttgcattgtcagataacccccaaagaatac

SEQ ID NO: 55221 - DNA, 201 bp, Homo sapiens
aagatattgcaaattgttcttcactcagtgagttggttttgtttccaagtccgacttctgagtacagcaagtgaggtggcttcgggcagtcagctcctgamcccccctaaaaagaaagggcagggcctgcagtggacagcagccagacagggaggaagactcactgccaagtcagggttctctgccttgattccctcagga

SEQ ID NO: 55222 - DNA, 201 bp, Homo sapiens
aacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaacatga

SEQ ID NO: 55223 - DNA, 201 bp, Homo sapiens
acagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaacatgac

SEQ ID NO: 55224 - DNA, 201 bp, Homo sapiens
gtgagtataagaaaattgaacaatcaatttccagttattctggacctagtgatccagtttggggcctatttgcttacttttcttacattcctaaatttcayactttattgtgttgttgatcatgaagaggaagagagacagaagggatgtttgttactcattcagaaagtacacactgagggagcgtgcagggcatagacc

SEQ ID NO: 55225 - DNA, 201 bp, Homo sapiens
cagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaacatgaca

SEQ ID NO: 55226 - DNA, 201 bp, Homo sapiens
gtgttgttgatcatgaagaggaagagagacagaagggatgtttgttactcattcagaaagtacacactgagggagcgtgcagggcatagacccttctggartttacagctgaggggcaggcagggcagacacatcaaacagtcctgctggaaggtgtcagcctgcatttgctgtgtggtaagtgccactagtggtggtgct

SEQ ID NO: 55227 - DNA, 201 bp, Homo sapiens
ctgctttccactaaaaattctttaaaatgtccctcaacctttttcgtactgtaaccatatgggaggtgatacagtgcctttcctttgtgattaaggtcackgtagtcacttggaaggatcctttaagcttccagaaatgacttaatctctaagatattgcaaattgttcttcactcagtgagttggttttgtttccaagtc

SEQ ID NO: 55228 - DNA, 201 bp, Homo sapiens
cacttgagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaag

SEQ ID NO: 55229 - DNA, 201 bp, Homo sapiens
aggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcact

SEQ ID NO: 55230 - DNA, 201 bp, Homo sapiens
gagcccaggagggaagctgaggtgggaggattgcttgagcccaggaggtcaaggctgcagtgagccaagattccatcactgctctccagcctgggcaacakgacaccctgcctcagaaaagtaaaaataaaaaaatctcatcataaacctaaaataagttttggaatataaagggcttttagttatctgaaaaatgcactt

SEQ ID NO: 55231 - DNA, 201 bp, Homo sapiens
tgggcatgggcgaggcaggcgcgagaggagaggggcgtggcaggtccggggcggggcctgagtgcgcctgcgcagtccgcgccactcagggagccggaggsgacgcgccggaggaaagatggaagactaccaggctgcggaggaggtaaccgccgggtcggcgacggaagggtggaggcctagagccctggccgcggaagg

SEQ ID NO: 55232 - DNA, 201 bp, Homo sapiens
cacaaatgtagtagaacaaactttaagccaactcaccaagctgggaaaaccatttaaatacatcggtaatggagtcttgtttcttttatatttgcgggatkgttttttaacactgatcagaggggcatccagtaccagaaacaacagctaacgtggctcaactcaaggaaggctcctggtgggagtcggtcgtgtgtgtag

SEQ ID NO: 55233 - DNA, 201 bp, Homo sapiens
gcactgtgatgtgaatggcaccgaagtcagatgagtatccctgtaggtcacctgcagcctgcgttgccacttgtcttaactctgaatatttcatttcaaasgtgctaaaatctgaaatctgctagtgtgaaacttgctctactctctgaaatgattcaaatacactaattttccatactttatacttttgttagaataaat

SEQ ID NO: 55234 - DNA, 201 bp, Homo sapiens
tttgtgtagcatagagatgggtacttgaatgttggccttattgtgagtaaaacgtcgtcccccagctttccctgccgtaaatgctgctctcttccctcccscagggagctgcactgtgcgatgggagaataagaccatgtactgcatcgtcagtgccttcggactgtctatttgacctgcagtccagcctatggcctttct

SEQ ID NO: 55235 - DNA, 201 bp, Homo sapiens
acttgagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaaga

SEQ ID NO: 55236 - DNA, 201 bp, Homo sapiens
cttgagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagat

SEQ ID NO: 55237 - DNA, 201 bp, Homo sapiens
gagcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattcc

SEQ ID NO: 55238 - DNA, 201 bp, Homo sapiens
agcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattcca

SEQ ID NO: 55239 - DNA, 201 bp, Homo sapiens
gcccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccat

SEQ ID NO: 55240 - DNA, 201 bp, Homo sapiens
cccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatc

SEQ ID NO: 55241 - DNA, 201 bp, Homo sapiens
aacactgatcagaggggcatccagtaccagaaacaacagctaacgtggctcaactcaaggaaggctcctggtgggagtcggtcgtgtgtgtagtatacgtkagcgtacgcttgaccatttggctgctggtacaattgcagatcgtatgtgaagcgggatcttacaggaggtcccatcagatgcttttagaacaagtgaagc

SEQ ID NO: 55242 - DNA, 201 bp, Homo sapiens
ccaggcatttgagagcagcctgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatca

SEQ ID NO: 55243 - DNA, 201 bp, Homo sapiens
tgggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaa

SEQ ID NO: 55244 - DNA, 201 bp, Homo sapiens
gggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaac

SEQ ID NO: 55245 - DNA, 201 bp, Homo sapiens
tatttgcaaaggcaccctcatgattaaaaataaacttttcataaatcacttcttggggtgccgtcagttcctgattgaaaggtggtgtgggtgcatttggktaaccgggacgcgctttgtgctttgttttctaggctatagaaagcgcaattggtggtaacgcttatcaacacagcaaagtgaaccagtggaccacaaatg

SEQ ID NO: 55246 - DNA, 201 bp, Homo sapiens
ggcaacagagcaagaccccatctctacaaaaaactagccaggcgtggtggcacatgcctgcagtcccagctactggacaagctgaggtgggaggattgcttgagcccaggagggaagctgaggtgggaggattgcttgagcccaggaggtcaaggctgcagtgagccaagattccatcactgctctccagcctgggcaaca

SEQ ID NO: 55247 - DNA, 201 bp, Homo sapiens
tgggtacttgaatgttggccttattgtgagtaaaacgtcgtcccccagctttccctgccgtaaatgctgctctcttccctcccgcagggagctgcactgtscgatgggagaataagaccatgtactgcatcgtcagtgccttcggactgtctatttgacctgcagtccagcctatggcctttctccttttgtctctagttc

SEQ ID NO: 55248 - DNA, 201 bp, Homo sapiens
cgcttgtgctcatgtgaagagcacattggcaggcaagtgcctgactaatgttattttcaggatgaccttttacccattcagatctaccatgtgtaaaaggmaaactatactcctggcactagattcctgcaggcagcccacctcctgagtcatccagacactgacagagaacagccatgctggcagctggtggttagtcct

SEQ ID NO: 55249 - DNA, 201 bp, Homo sapiens
ctgcgtcaggatgagctccaggttttctttgggccgatgcttcgtgtcctccaccagcttatagacgcgatgtcgccggtgcaggcgcggcttccggcccyccccggccagcggtaccttccaccagcgctccacgatgaccgtgccctggcggccaggaaagcgacggtaagctagtctccacaaggaacaccctctccc

SEQ ID NO: 55250 - DNA, 201 bp, Homo sapiens
gaggccgaggctggcagatcactcgcggttaggagctggagaccagcccggccaacacagcgaaaccccgtctccaccaaaatacgaaaaccagtcaggcrtggcggcacgcgcctgcaatcccaggcactcagcaggctgaggcaggagaatcaggcagggaggttgcagtgagccgagatggcagcagtacagtccagc

SEQ ID NO: 55251 - DNA, 201 bp, Homo sapiens
ctgcctcagctggattgtttgatataaaggagaactccacaataggcataggctattagttcctgggactaagggatattattgcatctttaagatcttgrctccaattctcccaggctctccccatcaatgcccaccttgcttcaacggacacaccccaatctgcctgaggtctgatttgaagactagaggagcattttt

SEQ ID NO: 55252 - DNA, 201 bp, Homo sapiens
tctcagacagggcggacgggcagagatgctcctcacctcccagatggggtcgcggctgggcagagacactcctcagttcccagacagggtcgtggccgggyagaggcgctccccacatcccagacgatgggcggctgggcggagacgctcctcacttcctagacgggatgacggccgggcagaggcgctcctcacatccca

SEQ ID NO: 55253 - DNA, 201 bp, Homo sapiens
gcgcctcggcccgggccttactctccaccgactgcgtcaggatgagctccaggttttctttgggccgatgcttcgtgtcctccaccagcttatagacgcgrtgtcgccggtgcaggcgcggcttccggccctccccggccagcggtaccttccaccagcgctccacgatgaccgtgccctggcggccaggaaagcgacggt

SEQ ID NO: 55254 - DNA, 201 bp, Homo sapiens
aactatagcctcttgcctcaaggagctcaaactctgttggatataagggatggtgaataaccattcataagtgatagatactatttcagagcttactatgycatcattgtattagtatataggtagacctcactaatctctagtgttaagcacttcatgaacatctcatttcatcttaaattctgtgaggaggaaggttct

SEQ ID NO: 55255 - DNA, 201 bp, Homo sapiens
ggcgctccccacatcccagacgatgggcggctgggcggagacgctcctcacttcctagacgggatgacggccgggcagaggcgctcctcacatcccagacratgggcggccaggcagagacgctcctcacttcccagacggggtggtggccgggcagaggctgcaatctcggcactttgggaggccaaggcaggcggctgg

SEQ ID NO: 55256 - DNA, 201 bp, Homo sapiens
aaatatgcagaggtctcaaagtggcagtcccagaaccaaattttgcttacaatgttgtttttttatcaacaattttttagtagttgattttttttttttttgagttggagtctcgctatgttgcccaggctggagtgcagtggcacgatctcagctcactgcaagctccgcctcctgggttcacgccattctcctgcctca

SEQ ID NO: 55257 - DNA, 201 bp, Homo sapiens
ttgaaagaatttcccaaatggcaagaaataacaacagaatagggggtggaaagctggcatggaactttagaatttttccatctggttgggcccaggaacayagaaacaggctggacaacagaaaatacagaagatcatgccagagcctggtactgtgtatcttcccacctcagattccaagataaactaatttgggtctct

SEQ ID NO: 55258 - DNA, 201 bp, Homo sapiens
tgtttgtgaacttccagaatgatcggaacgacagaggtggggatctgctgttcttccttgcttttcgcgctgaggcagctggataactccttttcctttayaggagaccctcttcccctgtctttaaaaatgcaccctcaggcatttcagggattcttttcttcccacctaccacgaaggtgggaagttgtaacttgttcc

SEQ ID NO: 55259 - DNA, 201 bp, Homo sapiens
accatttataagccaatgactcccaaatttctagttccatcctagacatctcccaaactcgtctcaaatattcaactgtttattcgtcattttcctcttaygtatccaaaggacacctcaaagttaactgtcccaaactaatttatttattcccccctcgcccccaaaactgccccatctgcagcctttttcctctcagtt

SEQ ID NO: 55260 - DNA, 201 bp, Homo sapiens
ttcctgggactaagggatattattgcatctttaagatcttggctccaattctcccaggctctccccatcaatgcccaccttgcttcaacggacacaccccmatctgcctgaggtctgatttgaagactagaggagcatttttactccttttccaggctgggaacttgacggtgctggctactgaccccctgctccaccagg

SEQ ID NO: 55261 - DNA, 201 bp, Homo sapiens
atggtgtttggtaggtgtattatatgcattttcaacttatgatactttcaacatacgatgggtttatcaggacataaccctattttaagtcaaggagcacwtgtatttccagaatccagccacttgtcaccacctccaatgctctaccttggaataagacactactttctcctggattactgcaatagtcccctaaaagat

SEQ ID NO: 55262 - DNA, 201 bp, Homo sapiens
acgccactgcactccagcctgggcaacactgagcactgagtgaacgaggctccgtctgcaatcccggcacctcaggaggccgaggctggcagatcactcgrggttaggagctggagaccagcccggccaacacagcgaaaccccgtctccaccaaaatacgaaaaccagtcaggcatggcggcacgcgcctgcaatcccag

SEQ ID NO: 55263 - DNA, 201 bp, Homo sapiens
cggtacggctgagcgaaagtatggggagcgggccggggaacagatggcaccgcggcttgcctatttttgctttttggcagaggtgacggacgcctagaatyactgactgataatggaatgagtgttaggtggactgacgccggaaaagacgctcttcctcttgaaagtgtgggctttgctgtagctccagttgctgggcta

SEQ ID NO: 55264 - DNA, 201 bp, Homo sapiens
aactctgccagctccaggaggagcctgacccttaatcattatactgcagtatttaagctaataaaggagaattctaaatcacaagctatgtaaaccgtagraaaaaaagcaactatggtaaggccgcgacagttccctctggggagggtctcagtactggacagaagaccataaaaactggatgaaagaaggtccatttgg

SEQ ID NO: 55265 - DNA, 201 bp, Homo sapiens
taagcacttcatgaacatctcatttcatcttaaattctgtgaggaggaaggttctatgatttataaatggaaaattctatagatggaaactgaagttctgmaggactaactcacagaacaagtgttaaaaccagagttagagcctaggtctgttggactaaagcacatcctatatgcctgcactacactgcttcccagggc

SEQ ID NO: 55266 - DNA, 201 bp, Homo sapiens
taaccattcataagtgatagatactatttcagagcttactatgccatcattgtattagtatataggtagacctcactaatctctagtgttaagcacttcakgaacatctcatttcatcttaaattctgtgaggaggaaggttctatgatttataaatggaaaattctatagatggaaactgaagttctgcaggactaactc

SEQ ID NO: 55267 - DNA, 201 bp, Homo sapiens
cacgccactgcactccagcctgggcaacactgagcactgagtgaacgaggctccgtctgcaatcccggcacctcaggaggccgaggctggcagatcactcrcggttaggagctggagaccagcccggccaacacagcgaaaccccgtctccaccaaaatacgaaaaccagtcaggcatggcggcacgcgcctgcaatccca

SEQ ID NO: 55268 - DNA, 201 bp, Homo sapiens
aatgtgaaagggtcagacataaggccaagggaacggggacatatttaaccggatgcctggagcatatgttacagaaactatagcctcttgcctcaaggagytcaaactctgttggatataagggatggtgaataaccattcataagtgatagatactatttcagagcttactatgccatcattgtattagtatataggtag

SEQ ID NO: 55269 - DNA, 201 bp, Homo sapiens
tcccacctaccacgaaggtgggaagttgtaacttgttccatcaagttacaactggactctgaggaagcccctgcaggtggtgttaggggccagactgaagragcactggtgaaattacacagaatccattcaagggatgtggccagcaggacaaaatggatctcaaacatatggagcacctacaatgtgaaagggtcagac

SEQ ID NO: 55270 - DNA, 201 bp, Homo sapiens
gaaaaccagtcaggcatggcggcacgcgcctgcaatcccaggcactcagcaggctgaggcaggagaatcaggcagggaggttgcagtgagccgagatggcrgcagtacagtccagcttcggctttcacaactttggtggcatcagagggagaccgtggagggagagggagagggagagggagagggagcggccaaacattt

SEQ ID NO: 55271 - DNA, 201 bp, Homo sapiens
cctgctccaccaggacccagtacagttagactttcacttccgccttacctcccagacctctgcccattggcacggccttctctgtgaccgtcgactcttcytggatatcccatatcaggccttggatcaaggcaaccgggaaaggtgactgagcctggatgggagaatggggagggaataggtaggggatttcacccttct

SEQ ID NO: 55272 - DNA, 201 bp, Homo sapiens
gggagagggtgttccttgtggagactagcttaccgtcgctttcctggccgccagggcacggtcatcgtggagcgctggtggaaggtaccgctggccggggrgggccggaagccgcgcctgcaccggcgacatcgcgtctataagctggtggaggacacgaagcatcggcccaaagaaaacctggagctcatcctgacgcag

SEQ ID NO: 55273 - DNA, 201 bp, Homo sapiens
cagtcatgaaaacagagttcatttgagctgagatttttttttttttttttttttttgcagcttggtgttgtggttgccccacatacattaaagttaccagmagagcctatcacacggtggggcgagtattggtgtgaggtgacggtgagtgttttgcatactttcttttttcttttctttctccttttcccccactttttc

SEQ ID NO: 55274 - DNA, 201 bp, Homo sapiens
aaaaatgctcctctagtcttcaaatcagacctcaggcagattggggtgtgtccgttgaagcaaggtgggcattgatggggagagcctgggagaattggagycaagatcttaaagatgcaataatatcccttagtcccaggaactaatagcctatgcctattgtggagttctcctttatatcaaacaatccagctgaggcag

SEQ ID NO: 55275 - DNA, 201 bp, Homo sapiens
accgtcgctttcctggccgccagggcacggtcatcgtggagcgctggtggaaggtaccgctggccggggagggccggaagccgcgcctgcaccggcgacaycgcgtctataagctggtggaggacacgaagcatcggcccaaagaaaacctggagctcatcctgacgcagtcggtggagagtaaggcccgggccgaggcgc

SEQ ID NO: 55276 - DNA, 201 bp, Homo sapiens
tgaggcaggagaatggcgtgaacccaggaggcggagcttgcagtgagctgagatcgtgccactgcactccagcctgggcaacatagcgagactccaactcaaaaaaaaaaaaaatcaactactaaaaaattgttgataaaaaaacaacattgtaagcaaaatttggttctgggactgccactttgagacctctgcatattt

SEQ ID NO: 55277 - DNA, 201 bp, Homo sapiens
aagctggtggaggacacgaagcatcggcccaaagaaaacctggagctcatcctgacgcagtcggtggagagtaaggcccgggccgaggcgcttcctctcaggctggtccggtttggcatcagctttttctagcccgtccccctcaactatttgccttgctttttctttgtggaaacaatccaactctatatgtgagaagag

SEQ ID NO: 55278 - DNA, 201 bp, Homo sapiens
agtggcacgatctcagctcactgcaacctccacctcccaggttcaagcgatccttctgcctcagtccccctagtagctgggattacaggcacacgccaccrtgcctggctaatttttgtattttagtagagacagggtttccccatgttggccaggctggtctcaaactcctgacctcaggtgatccacctgcctcagcct

SEQ ID NO: 55279 - DNA, 201 bp, Homo sapiens
agagacccaaattagtttatcttggaatctgaggtgggaagatacacagtaccaggctctggcatgatcttctgtattttctgttgtccagcctgtttctrtgttcctgggcccaaccagatggaaaaattctaaagttccatgccagctttccaccccctattctgttgttatttcttgccatttgggaaattctttcaa

SEQ ID NO: 55280 - DNA, 201 bp, Homo sapiens
ccttccctttgacatttaacttaacttgaaaatgaaataggaactagaagaacaggaatgcagaagcccagccaatgtccaacataggaatagtttgatgstatttaacatgggctcatttttcttttactgcttttcatctttaactttcttttctagctgagacaagaaggaaaattagagaagatccagaccaaggca

SEQ ID NO: 55281 - DNA, 201 bp, Homo sapiens
gcatcccctgaaaacaagaagctgtttgaagaggagaaattggtgagctcaaaggaaggacagagagacttggggagataaaacttcttttctcttgcagyttccttccctttgacatttaacttaacttgaaaatgaaataggaactagaagaacaggaatgcagaagcccagccaatgtccaacataggaatagtttga

SEQ ID NO: 55282 - DNA, 201 bp, Homo sapiens
taactgttgtatttttggtagagacagggtttcgccatgttggccaggctggtttcaaactcctgggctgaagtgacccactttgggagacccaccttggyctcccaaagtgctgggattacaggcatgagccatcttgcttggcttgcataccctgtgaccctgacatgtttcctctcctttgactcaaactcataattc

SEQ ID NO: 55283 - DNA, 201 bp, Homo sapiens
aactgagaggaaaaaggctgcagatggggcagttttgggggcgaggggggaataaataaattagtttgggacagttaactttgaggtgtcctttggatacrtaagaggaaaatgacgaataaacagttgaatatttgagacgagtttgggagatgtctaggatggaactagaaatttgggagtcattggcttataaatggt

SEQ ID NO: 55284 - DNA, 201 bp, Homo sapiens
tgggtgaagtgccttaaagtaccaagggaggtcccaatctgggaatcagggaacccatggaatagtctgagatgagggctctgccttcaaggatatttacrtacaagttggagagaacatggacacatgagaagataatcagtacaggcacccgccaccatgcccggctaactgttgtatttttggtagagacagggtttc

SEQ ID NO: 55285 - DNA, 201 bp, Homo sapiens
acatggacacatgagaagataatcagtacaggcacccgccaccatgcccggctaactgttgtatttttggtagagacagggtttcgccatgttggccaggstggtttcaaactcctgggctgaagtgacccactttgggagacccaccttggcctcccaaagtgctgggattacaggcatgagccatcttgcttggcttgc

SEQ ID NO: 55286 - DNA, 201 bp, Homo sapiens
ctcttgggagatccctgatgtgttgggtgaagtgccttaaagtaccaagggaggtcccaatctgggaatcagggaacccatggaatagtctgagatgaggrctctgccttcaaggatatttacgtacaagttggagagaacatggacacatgagaagataatcagtacaggcacccgccaccatgcccggctaactgttgt

SEQ ID NO: 55287 - DNA, 201 bp, Homo sapiens
aaatgggagctgaaccctgaaatagttgcccgccacttctttaagaatgtgagtgagtgttcccaaaaaccactctacccctgaggtggaagctgcctctsgaaaggaggcctgggattgatccctttgttaggaaggggtgtgatcatccagttgtagttaaggaaagtattcttggttagtttgcaggaatatgggaag

SEQ ID NO: 55288 - DNA, 201 bp, Homo sapiens
cctggtggagcagggggtcagtagccagcaccgtcaagttcccagcctggaaaaggagtaaaaatgctcctctagtcttcaaatcagacctcaggcagatkggggtgtgtccgttgaagcaaggtgggcattgatggggagagcctgggagaattggagccaagatcttaaagatgcaataatatcccttagtcccaggaa

SEQ ID NO: 55289 - DNA, 201 bp, Homo sapiens
atcttttaggggactattgcagtaatccaggagaaagtagtgtcttattccaaggtagagcattggaggtggtgacaagtggctggattctggaaatacawgtgctccttgacttaaaatagggttatgtcctgataaacccatcgtatgttgaaagtatcataagttgaaaatgcatataatacacctaccaaacaccat

SEQ ID NO: 55290 - DNA, 201 bp, Homo sapiens
tagcccagcaactggagctacagcaaagcccacactttcaagaggaagagcgtcttttccggcgtcagtccacctaacactcattccattatcagtcagtrattctaggcgtccgtcacctctgccaaaaagcaaaaataggcaagccgcggtgccatctgttccccggcccgctccccatactttcgctcagccgtaccg

SEQ ID NO: 55291 - DNA, 201 bp, Homo sapiens
ccaaatggaccttctttcatccagtttttatggtcttctgtccagtactgagaccctccccagagggaactgtcgcggccttaccatagttgctttttttyctacggtttacatagcttgtgatttagaattctcctttattagcttaaatactgcagtataatgattaagggtcaggctcctcctggagctggcagagtt

SEQ ID NO: 55292 - DNA, 201 bp, Homo sapiens
attacaggcataagccactgtgcccagccctagctctcctttttctgactgggagaaaagtcagggtgaaaagctgggattaggtggtgctaaatcttacytacctgactgatctctgagaattcccattgttttgtgtgcaggtaaatgggcttgatactgtgagagtgcctatgtctgtcgtgaactttgagaagccca

SEQ ID NO: 55293 - DNA, 201 bp, Homo sapiens; identical to SEQ ID NO: 16007

SEQ ID NO: 55294 - DNA, 201 bp, Homo sapiens; identical to SEQ ID NO: 16011

SEQ ID NO: 55295 - DNA, 201 bp, Homo sapiens; identical to SEQ ID NO: 16013

SEQ ID NO: 55296 - DNA, 201 bp, Homo sapiens
acactcaattggtgctaaggccattttgtcaaatgaacagctttctcagcatgtggtccagtcaccactcaatcagaataccccaaatgtgaagcaaaggkatctgcattttagcaagttttccaggtgatacaccctaatgagacactgggaatgaatgggtgagtgagctgcaggtagcagtgccacagacaggaggag

SEQ ID NO: 55297 - DNA, 201 bp, Homo sapiens; identical to SEQ ID NO: 16014

SEQ ID NO: 55298 - DNA, 201 bp, Homo sapiens; identical to SEQ ID NO: 16016

SEQ ID NO: 55299 - DNA, 201 bp, Homo sapiens
tggtcagcgaggagacctatcgtggggggatggccatcaaccgcttccgccttgagaatgtaacccctgagggagactggcagagggagtggatgggggayggggaaggccattttgagggggctgttggaagtaccatggccccagaggagagaagtgggggctcagggtggtgggaagaagcaaggaggaactggttct

SEQ ID NO: 55300 - DNA, 201 bp, Homo sapiens; identical to SEQ ID NO: 16032

SEQ ID NO: 55301 - DNA, 201 bp, Homo sapiens
gagaaatgaggacaccaaggcttagagcacagccccgaggcgccgtctaccaggccccgtcccctcccccggctcctgtcggtcagcactgaaaccccgtycctgctccaggcctccttctctggggtccaaggtcccatacaggcctctgcctcggccgcaggcccttcagtcaccgtcgcctcgtctccctgactgtcc

SEQ ID NO: 55302 - DNA, 201 bp, Homo sapiens; identical to SEQ ID NO: 16021

SEQ ID NO: 55303 - DNA, 201 bp, Homo sapiens; identical to SEQ ID NO: 16023

SEQ ID NO: 55304 - DNA, 201 bp, Homo sapiens
tcaccataggccttaccagttgaaccctttctgccaccccctctggggatactgtacttagggacactttttcccaaactggcccatactctcctccccartaaaaagatctcactgttcttctgggctccttccccaggcaagttgctccctgagctgctccaaccttatacagaacgtgtggaacatctgagtgaattc

SEQ ID NO: 55305 - DNA, 201 bp, Homo sapiens; identical to SEQ ID NO: 16025

SEQ ID NO: 55306 - DNA, 201 bp, Homo sapiens; identical to SEQ ID NO: 16035

SEQ ID NO: 55307 - DNA, 201 bp, Homo sapiens
agatgagcgggcagcagcttgtggaacagagccacgtggtgctcagcaccttgtgggagccgcatatcacccaacgccaggttggtgcccagggcaaggcygggttgtggggaaggagtctccagtgggtactgcctgaccctgccctctcttcctcccaacatcctggcctgtctgaaggtggagaaagcctgggccctc

SEQ ID NO: 55308 - DNA, 201 bp, Homo sapiens
tcatcatcctttcatctattttagatacacctactaaatgtttaatatatacttttggagaagtacaacataagggagtctttaatctgtgttttccttgkctgggttaatgactgtttatttaaagagtgctgtaaaattggatgtgtggtgtttaaaatggccatgtcctgaggaaacttaagtaacaaagtactaaat

SEQ ID NO: 55309 - DNA, 201 bp, Homo sapiens
tactaaatgtttaatatatacttttggagaagtacaacataagggagtctttaatctgtgttttccttgtctgggttaatgactgtttatttaaagagtgytgtaaaattggatgtgtggtgtttaaaatggccatgtcctgaggaaacttaagtaacaaagtactaaatgctaagtaggcttttgcatattgtaactaaa

SEQ ID NO: 55310 - DNA, 201 bp, Homo sapiens
atttgcagggttcagtttggcaaagacttggtgcagatgtgacagcagttgaatttttaggtcatgtaggtggagttggaattgatatggagatatctaaraactttcaacgcatccttcaaaaacaggggtttaaatttaaattgaatacaaaggttactggtgctaccaagaagtcagatggaaaaattgatgtttcgt

SEQ ID NO: 55311 - DNA, 201 bp, Homo sapiens
ccagagtttgggcagaaggaagtctgccccttctgtgcctcctgttttttgggggtttcccctttatgttccagctgttgtggttgccccatattctgccytctgatccttaaccaataaaacttggcttttgtttccccctcaagtgagaacccgttaaaaatgagacattgagccagtgctgttcactttttaagtgcc

SEQ ID NO: 55312 - DNA, 201 bp, Homo sapiens
aagctgaagttatcacttgtgatgtactcttggtttgcattggccgacgaccctttactaagaatttgggactagaagagctgggaattgaactagatccyagaggtagaattccagtcaataccagatttcaaactaaaattccaaagtaagttggataattgtctgcattttcagtaattttaaaattgatttcaaaca

SEQ ID NO: 55313 - DNA, 201 bp, Homo sapiens
gtcagtcattcagatatgattcaaatgtctataaaccgaactgatgtaagtaaatggtctctcacttgttttatttaacctctaaattctttcattttagkggtagcatttgtgttgaagaggttttaaagcttccattgttgtctgcaactctgaagggtaattatatagttacccaaattaagagagtctatttacgga

SEQ ID NO: 55314 - DNA, 201 bp, Homo sapiens
taggaacatactagcgaaagaagaaaatgttttacaataaattattaagatgatttcgtaaacatttgctatagaaacttttatgattattgggttttttwaatttatttgcagggttcagtttggcaaagacttggtgcagatgtgacagcagttgaatttttaggtcatgtaggtggagttggaattgatatggagata

SEQ ID NO: 55315 - DNA, 201 bp, Homo sapiens
aagacattaaaaattcagcaaagaaacctgttttgtagcttgtatttacattactctgaaattaaaaattagaacccatttaagggatgttgtgtagatcrtcatttggttcaagatttgaaaataaaaatacattttattagatacttaattctgaaccgaaatcagtgaaccaagcagggtggctaaaaagcacagatg

SEQ ID NO: 55316 - DNA, 201 bp, Homo sapiens
gatgtatcatccctgtctctttaagcaaaacactcaagtttcaaaatcagtttagcaaatatagggttttttctaacttaaggtcattttattacttaatrtaactcagttgcttatcaaattattgcattagcacattgaaatttatgattaggttaatgctagaaagagaatccaatattctcattgttgtgccttctt

SEQ ID NO: 55317 - DNA, 201 bp, Homo sapiens
ttcatgtcaatggatatggaaagataactggcaaaaatcaagtcactgctacgaaagctgatggcggcactcaggttattgatacaaagaacattcttatwgccacgggttcagaagttactccttttcctggaatcacggtatttatgcttcataatttacaaccattacaacttttctttagaaatacgttttataagt

SEQ ID NO: 55318 - DNA, 201 bp, Homo sapiens
gttgaaattttccagttggtgagtgaaaaacactgcatattgcttcaagaatttagctaagaactaaagattaattgaacaaattacagtgtccgaagttygcttgaatttagacaagatgatggagcagaagagtactgcagtaaaagctttaacaggtggaattgcccacttattcaaacagaataaggtcagtgttta

SEQ ID NO: 55319 - DNA, 201 bp, Homo sapiens
atatcttttagaataattcacttttgggtcagcccaaaagtgtttattattattcaaatgataaattataaaggactatatattttagtctgtgaaaacayagcccgaatagcttgttttgtagaagaattaagacatatatttggaattttagtgatctgaaacattgaggttatgtgcagttaaataatgttttctttg

SEQ ID NO: 55320 - DNA, 201 bp, Homo sapiens
attgttacatatcagtgattaaaagtatatgctcaaaaatacatatacttaaaatctaaaatatttaattcagttttattgtcattaaaagggtttttggrgaattatagcagtaatatatgttataaatatatatgctcatgtaagagtgagaaaagaatataaaatatggcaaaaattgaattttataaaaactttcct

SEQ ID NO: 55321 - DNA, 201 bp, Homo sapiens
agagatgatgtatatgcactaaagcaaatagaatatcatactagttgaaaaatggaatgacgtaaagaaagaagagctaggggtagtcaggagacctgcaytgtaggcaaggcttttacatcctagctctgtgaccttgggtaaatcagaaatctctcagagtctctttttccttatctctaatatatgtgttggttatat

SEQ ID NO: 55322 - DNA, 201 bp, Homo sapiens
gtatacttttcatgcttaatgatattaccagactgcttgacttggctcttctgtctaaagacttaaatgtgtctaacgtacgcataatagatgtttagtgraggaagagtaaaataaataatctaaaaaatgtggagagatttacttaaaaaagaaggcctaaatccagatttctcccagccaagtataaccaagcctaac

SEQ ID NO: 55323 - DNA, 201 bp, Homo sapiens
attcttccatttttacatctgctctttgggctgaattctccatattatgcaagttcccctttcttaggcttccctttaattgttagtatttttgtttttctttttttttttttttgagtccgagtcttgctgtgtcgcccaggctggagtgcagtggcgcgatctcggctcactgcaacttctgcctcccgggttcaagtg

SEQ ID NO: 55324 - DNA, 201 bp, Homo sapiens
atatacacacacacagacacagcatgtgcagacacacccctccaagagcctaaagtagtgtttgtaatgtgaaatgcctgctgttagtgtttatttctagrtagatggaacagatcgtacataggtagaccagcataattctatgcatgtaggctaagagtagtaattcaccgttactgaagcttaaactgcatggtattg

SEQ ID NO: 55325 - DNA, 201 bp, Homo sapiens
tcaattttttatctttatttgaaaaatggccacaatagttaattgaatattctggttagcctattatcttaaggtatgtaaaaattatcaatatgcaagtwcaaaacatatttgttaaatattacatagaagctgttttttccctcatatttcagaagttaaggacctgaaaaaggtaataggtcttaaatttattggaaa

SEQ ID NO: 55326 - DNA, 201 bp, Homo sapiens
accagcataattctatgcatgtaggctaagagtagtaattcaccgttactgaagcttaaactgcatggtattggtgagtaaacagaacgtggtaggagatraggctggagaaatagttactgaaggaatttggatgctgtacttaggaacatgggctttatctaacaagacactggagaaccaacagagcgtaacaacaga

SEQ ID NO: 55327 - DNA, 201 bp, Homo sapiens
atagaaatgtaatgaggcttacataagacagtacacgtgactggctcactaactggcacattttaagctacccaagtggtaggtattattgtagactgactttttttttttttttttttttgaaacttggtctcactctatcatgcaagctggggtgcaatggtgcgatcttggttcactgcaacttccacctcccgggtt

SEQ ID NO: 55328 - DNA, 201 bp, Homo sapiens
ttcctaaggaattatgttgatagctaaaaaggttgagagtaactctcgttacaggttggaccttttactgtaattcttttttttatttagactgtaagaartagggctatgtcatttatatatacacacacacagacacagcatgtgcagacacacccctccaagagcctaaagtagtgtttgtaatgtgaaatgcctgct

SEQ ID NO: 55329 - DNA, 201 bp, Homo sapiens
ttattttccttataatgatctaatatgtaacacttgtaggaatttgtagagtacttttcttgacttttttctttgagttaattttaataacattaattgcsttgtttaagtcagtcacctcttattgtactccagtatttttaaagtatcaacctgatactttaaacctggtaggagcacacatttcagaatctaaaggac

SEQ ID NO: 55330 - DNA, 201 bp, Homo sapiens
caaatttttgaccaggatgaaacatcgaaagccatctgacagtacagtctttcaccagttataaacacctttgatgtttattcatcttcgtttctccatckcatctacaaggatatcatgagattttcttaaaattttttttaacaccttgctgatatcaaaatatactacattcaccagtccagaaacccttcagaaagt

SEQ ID NO: 55331 - DNA, 201 bp, Homo sapiens
agttgggaaattcccatttgctgctaacagcagagctaagacaaatgctgacacagatggcatggtgaagatccttgggcagaaatcgacagacagagtaytgggagcacatattcttggaccagtgagtattgtaaaaccagagaaatcccattaagatttctagaaagcattgctgtttattaattataaaccacctgg

SEQ ID NO: 55332 - DNA, 201 bp, Homo sapiens
ggcaaaaattgaattttataaaaactttcctagaagaaggattgggaggacctataaacagttctctctgggctgtatggcaatgtggatgggttgttttytttttaattttgctttagtgtatttaaatttattcagtaaacctaaatttttaatcagaaaagacattaaaaattcagcaaagaaacctgttttgtagct

SEQ ID NO: 55333 - DNA, 201 bp, Homo sapiens
aaataaataatctaaaaaatgtggagagatttacttaaaaaagaaggcctaaatccagatttctcccagccaagtataaccaagcctaaccctgcaaatcsagatttctaccattatatcttctgttcctttgccaactttttcctgaggtttgcctttatgtgtttttgaagagtcagttttcatttcctaaaatctgga

SEQ ID NO: 55334 - DNA, 201 bp, Homo sapiens
ttattcaaacagaataaggtcagtgtttaatattcagatttctgctttactttgaatacaaattaaactttgcattatagagtgatgatatttgaacttgrttacaggggaatatttatttaatttaaaatagcttgctaacctgaaatagatttccctgacatatatcacagatttttttgctgcaccatggtgtagcat

SEQ ID NO: 55335 - DNA, 201 bp, Homo sapiens
aagcattttgttttagataaattatttacagagtaatttttcctttgaatgatttatcaaacaaattactttaaactttgtgaatttataaagattatttygtaaaggttgttcatgtcaatggatatggaaagataactggcaaaaatcaagtcactgctacgaaagctgatggcggcactcaggttattgatacaaaga

SEQ ID NO: 55336 - DNA, 201 bp, Homo sapiens
ctagtggttgtgtagtagtaactcactgtggggtttttttttctatttttattttttaaattgctatgtaatagatgtacttttttcaaggtacatgtgawaatttgatatattcatataattaaatcagggtaattaggctatccatcacctcgaacattttttttaatgctaggaatattgaattattctcttctagct

SEQ ID NO: 55337 - DNA, 201 bp, Homo sapiens
attgatggttgcctaaattttcttctgacccacaaatatttggattttaattttaaatttcttcccttgcagaccttatcagaagcttttagagaagcaamtcttgctgcgtcatttggcaaatcaatcaacttttgaattagaagattatatatatttttttctgaaatttcctgggagcttttgtagaagtcacattcc

SEQ ID NO: 55338 - DNA, 201 bp, Homo sapiens
cgggcgcctgggccgcaccacccctggccccgcctctgcactggctcagcccggccctgggctccgaggtggccgctcatcctgcagcaggcgagggacgrggctgggcccaggctgtggcgagtcctttcgggttgtgtgacggccggcggtcacacatgccacacccccaagcctgggccgagggccatcccggtcaca

SEQ ID NO: 55339 - DNA, 201 bp, Homo sapiens
gtggacatttcatataaatgaaatcatacaatattattttgtgtgtgctctctttacatagcataatgttcttatggttcatccaagttgtagcatgtatstatacttcatttctttatctggctaaatatctcattctatggatatggcacattttgtttatccattcatcatgggtggacatttgggttgtttctactt

SEQ ID NO: 55340 - DNA, 201 bp, Homo sapiens
tggacaaaatggaatactcttatatctatattttacataaatttagtattttgtttcagtgcactaatgtgtaagacaaaaagctacttattgtagcatcmtggaatatctccgtcaactcatattttcatgctgttcatgaaagattcaatgcccctgaatttaaatagcttttttctctgatacagaaaagttgaattt

SEQ ID NO: 55341 - DNA, 201 bp, Homo sapiens
aatttcttcccttgcagaccttatcagaagcttttagagaagcaaatcttgctgcgtcatttggcaaatcaatcaacttttgaattagaagattatatatdtttttttctgaaatttcctgggagcttttgtagaagtcacattcctgaacaggatattctcacagctccaagaatttctaggactgaattatgaaacttt

SEQ ID NO: 55342 - DNA, 201 bp, Homo sapiens
cacagtgatcaagttatttttaatttggttttcacattggaaacaagtcagtcattcagatatgattcaaatgtctataaaccgaactgatgtaagtaaayggtctctcacttgttttatttaacctctaaattctttcattttaggggtagcatttgtgttgaagaggttttaaagcttccattgttgtctgcaactctg

SEQ ID NO: 55343 - DNA, 201 bp, Homo sapiens
cttgcagaccttatcagaagcttttagagaagcaaatcttgctgcgtcatttggcaaatcaatcaacttttgaattagaagattatatatatttttttctkaaatttcctgggagcttttgtagaagtcacattcctgaacaggatattctcacagctccaagaatttctaggactgaattatgaaacttttggaaggtat

SEQ ID NO: 55344 - DNA, 201 bp, Homo sapiens
ttatgaaacttttggaaggtatttaataggtttggacaaaatggaatactcttatatctatattttacataaatttagtattttgtttcagtgcactaatrtgtaagacaaaaagctacttattgtagcatcctggaatatctccgtcaactcatattttcatgctgttcatgaaagattcaatgcccctgaatttaaata

SEQ ID NO: 55345 - DNA, 201 bp, Homo sapiens
gaagaattaagacatatatttggaattttagtgatctgaaacattgaggttatgtgcagttaaataatgttttctttggttgtagacagtctgcattgagraaaatgaaacacttggtggaacatgcttgaatgttggttgtattccttctaaggtgagcatgtgttttgtacagcacagagattgtttttggctagcaac

SEQ ID NO: 55346 - DNA, 201 bp, Homo sapiens
tagcatgtagtttttgccttggaagcaaatttacttggcttgttattttaaagggtgctggagaaatggtaaatgaagctgctcttgctttggaatatggmgcatcctgtgaagatatagctagagtctgtcatgcacatccggtaattattaacaacatatagaattgatggttgcctaaattttcttctgacccacaaa

SEQ ID NO: 55347 - DNA, 201 bp, Homo sapiens
gttattttaaagggtgctggagaaatggtaaatgaagctgctcttgctttggaatatggagcatcctgtgaagatatagctagagtctgtcatgcacatcyggtaattattaacaacatatagaattgatggttgcctaaattttcttctgacccacaaatatttggattttaattttaaatttcttcccttgcagacctt

SEQ ID NO: 55348 - DNA, 201 bp, Homo sapiens
ggttttcacattggaaacaagtcagtcattcagatatgattcaaatgtctataaaccgaactgatgtaagtaaatggtctctcacttgttttatttaaccyctaaattctttcattttaggggtagcatttgtgttgaagaggttttaaagcttccattgttgtctgcaactctgaagggtaattatatagttacccaaat

SEQ ID NO: 55349 - DNA, 201 bp, Homo sapiens
aacatatagaattgatggttgcctaaattttcttctgacccacaaatatttggattttaattttaaatttcttcccttgcagaccttatcagaagcttttrgagaagcaaatcttgctgcgtcatttggcaaatcaatcaacttttgaattagaagattatatatatttttttctgaaatttcctgggagcttttgtagaa

SEQ ID NO: 55350 - DNA, 201 bp, Homo sapiens
aaaaatgtctttttcattcttgtttgttgaatgtttttcacatcattattgtttgtctttgattaataagagaaactgaattggtgtagtgccatatactrttccatgtagagaatgccatgtcttttttttaacttctttttaaatttttattgtaaattgacaaattacaattgtatatatttatggcatacaaagtgg

SEQ ID NO: 55351 - DNA, 201 bp, Homo sapiens
catagatctacttttttgcaatcttccctttccaatcttgactgcgttcctgatcagcttagatgccatagtccatcactttaaccacactcttacagatrtccttgagttgcttgtctcactgttctgtcatatctgcttggcaaaactctagttcggtttgaatgcagcagtctgccttttttatgctatttccaggct

SEQ ID NO: 55352 - DNA, 201 bp, Homo sapiens
tggtggtaaagctgaagttatcacttgtgatgtactcttggtttgcattggccgacgaccctttactaagaatttgggactagaagagctgggaattgaastagatcccagaggtagaattccagtcaataccagatttcaaactaaaattccaaagtaagttggataattgtctgcattttcagtaattttaaaattgat

SEQ ID NO: 55353 - DNA, 201 bp, Homo sapiens
gtttgaagcacagtgatcaagttatttttaatttggttttcacattggaaacaagtcagtcattcagatatgattcaaatgtctataaaccgaactgatgyaagtaaatggtctctcacttgttttatttaacctctaaattctttcattttaggggtagcatttgtgttgaagaggttttaaagcttccattgttgtctg

SEQ ID NO: 55354 - DNA, 201 bp, Homo sapiens
accattatatcttctgttcctttgccaactttttcctgaggtttgcctttatgtgtttttgaagagtcagttttcatttcctaaaatctggaaatcactgrgaaggctggattcctgagtactatggggagatagaggaaggaaggaaggcccacttaagctgttgatagtagaaaaattagaggagagaaagagtgaggc

SEQ ID NO: 55355 - DNA, 201 bp, Homo sapiens
ctaccactgagcctaaagtatgtatctttcttgtagatatctcttgtatctgatgtaacaataatgagaatagaatatttgagtgctgtgtcactttagtrtacattttgttatttttacatcagctttttgaaataggtgctgttatttttgaggtgaagaaactgaatgaagcacaaagaaccaatgaatggttaaggt

SEQ ID NO: 55356 - DNA, 201 bp, Homo sapiens
gaaggtatttaataggtttggacaaaatggaatactcttatatctatattttacataaatttagtattttgtttcagtgcactaatgtgtaagacaaaaarctacttattgtagcatcctggaatatctccgtcaactcatattttcatgctgttcatgaaagattcaatgcccctgaatttaaatagcttttttctctga

SEQ ID NO: 55357 - DNA, 201 bp, Homo sapiens
aaggtatttaataggtttggacaaaatggaatactcttatatctatattttacataaatttagtattttgtttcagtgcactaatgtgtaagacaaaaagrtacttattgtagcatcctggaatatctccgtcaactcatattttcatgctgttcatgaaagattcaatgcccctgaatttaaatagcttttttctctgat

SEQ ID NO: 55358 - DNA, 201 bp, Homo sapiens
cattgactacaattgtgtgccatcagtgatttacacacaccctgaagttgcttgggttggcaaatcagaagagcagttgaaagaagaggtaagtctgaacrtgggtggttttaagccaatgtgtgagttgtgccaatgacattggtggttgagaaacagcattttatcattatgctaatatatttaacagctgtgaaatat

SEQ ID NO: 55359 - DNA, 201 bp, Homo sapiens
ccagtgcctttagttttttctaaaatatatttgttcagagtttgcagttgctatcagcaggagggttggtctgatatctgtgtgctactttgccattattrgaagtgaactctgcatctttttaaaaatttgaaatcccggtatcatgtgaagtgctgtttatgtaaatctcaacatatcccttactcagggaaaaaaaag

SEQ ID NO: 55360 - DNA, 201 bp, Homo sapiens
atgacatctcttttcctgttcgttttttctttttaaaaatctggttttgtttttgtttgtttttttttttgagacaaagtctcgctcttgtcccctaggcwggagtgcagtggcgtgatcttggctcactgcaactccacctcccgggttcaagtgattctcctgcctcagcctcccgagtagctgggattacaggtgcct

SEQ ID NO: 55361 - DNA, 201 bp, Homo sapiens
catgccacacccccaagcctgggccgagggccatcccggtcacacataggcctctaccttggaggaagtgtaagccacccatgtcccgtatagtctggctytttataccatttgcctttttctcatcctaattctgatccctgagtggcctaagtttatgcagtgggcaggtaaccctggggtcacttcttgaatggttta

SEQ ID NO: 55362 - DNA, 201 bp, Homo sapiens
tgtttcttttgatttctgtggtagtatctatgccattggtgatgtagttgctggtccaatgctggctcacaaagcagaggatgaaggcattatctgtgttraaggaatggctggtggtgctgtgcacattgactacaattgtgtgccatcagtgatttacacacaccctgaagttgcttgggttggcaaatcagaagagca

SEQ ID NO: 55363 - DNA, 201 bp, Homo sapiens
ctgtatatacacgctagcttagagttaggaaacaaaaattacaggtaaaaagattatcatgtatagattattcaagtatttaagttagaactttcagagcwttatttatttatttatttatttatttattttgagacggagtctcactctgacatccaggctagagtgcaatggcactatctcagctgactgcaacttccg

SEQ ID NO: 55364 - DNA, 201 bp, Homo sapiens
gatacagtgtcaggaaaggcctttctgaggagatgatgtctgggcagggtcctgagtgaagtgggggagtgaggttacttcaggcagagggaaacaacacygagaaaggcctgaggtgggacttagcttgtgaagtttaaggagtaataagaaggctggtatgactggagcagaaacccatgcaatgtaaagtcggagagg

SEQ ID NO: 55365 - DNA, 201 bp, Homo sapiens
tgccaggcagaccctgagccagaacttagattttagtggaatgaggctgagtgttccataatcagtttggtgatcccttgacattgagtaaatcataaatsacttagtacccatgtgtgtaaagtgtgtaaaagctttgagtggatgcagtaacaagcattttacacacatacttgtattttatctgaggtacatgcttac

SEQ ID NO: 55366 - DNA, 201 bp, Homo sapiens
ttgagacggagtctcactctgacatccaggctagagtgcaatggcactatctcagctgactgcaacttccgcctcccgggttcaagtgattctcctgcctyggcctcccgagtagctgggattacaggcacccaccactacacccggctaattttcttgtatttttagtagagtcggggcttcactatgttggccaggctg

SEQ ID NO: 55367 - DNA, 201 bp, Homo sapiens
atattcatttactggttatcatgagtacgtgttgagatggtcatagttttttttatgactacttctagtgtatattctaatttcttttctaggcctgaatktatctttattttcatgttataggacaatattaaggcattttaaaggtcatcatcctttcatctattttagatacacctactaaatgtttaatatatactt

SEQ ID NO: 55368 - DNA, 201 bp, Homo sapiens
ccacaattatgggacctaatgacagcccatatcaaagcggtgtattctttttggcaattcattttcctacagactgctccttcaaaccacctaaggttgcrtgtacaacaaggatttgtcatccaaatattaacagtaatggcagcatttgtctcgatattctaagatcacagtggttgcctgctttaaaactatttctaa

SEQ ID NO: 55369 - DNA, 201 bp, Homo sapiens
accaagagcttgtgtctggcagagccggtatgagatgagacaatgctgtcccacctccgggataaccaggagttttggccagacttttgagcacataccgrgagagtgaggagccagatgacaagcacatactatggcactaagacagattaataaggaacttagtgatttggcccatgaccctccagcacaatgttctgc

SEQ ID NO: 55370 - DNA, 201 bp, Homo sapiens
atgcaaacagggaggcttatgacatctaatgtgttttccagagtgaagtgcctggctccattccaaactcctggaagtggactgtggaacacattgtctawaaagccttgcgctcacacattctgcctcctaaacatttcacagaagatggaaatatcctgcagcttgctaacctgcctgatctatacaaagtctttgaga

SEQ ID NO: 55371 - DNA, 201 bp, Homo sapiens
tctcttgtcctcactcttcctttttgctggtgatatttttacttatttcatgaaaaaaaagataacatatacacacacatagatatatgcacaagtatatrtatatatgtgtgcataacacacataaacatatacattggtaaatttaaaaacatatttatgaaatatatgtagcatctacagaaaaacatgaacacttgt

SEQ ID NO: 55372 - DNA, 201 bp, Homo sapiens
tattttgaggtattgaatttctttggaccaggtgaattgggacgaagaaaaggaatgttttgaaagcctcagtaaagaatgcgctatgttctattccatcyggaagcagtacatatctgaggagtcgaccctctcaggccagcaggtacagtggtgatgcacactggcaccccaggactaggacaggacctcatacaatct

SEQ ID NO: 55373 - DNA, 201 bp, Homo sapiens
ttgagttttgagtattttcaaaagcttcagaatctcttttctaatagagaactgatagaaattggatgtgaggataaaaccctagccttcaaaatgaatgrttacatatccaatgcaaactactcagtgaagaagtgcatcttcttactcttcatcaaccgtaagttaaaaagaaccacatgggaaatccactcacaggaa

SEQ ID NO: 55374 - DNA, 201 bp, Homo sapiens
gcttcttcctaggagccagcaccgctctttgaccttgccatgcttgccttagatagtccagagagtggctggacagaggaagatggtcccaaagaaggacwtgctgaatacattgttgagtttctgaagaagaaggctgagatgcttgcagactatttctctttggaaattgatgaggtgtgacagccattcttatacttc

SEQ ID NO: 55375 - DNA, 201 bp, Homo sapiens
ttagaaatcagtccccagaatgtggatgttaatgtgcaccccacaaagcatgaagttcacttcctgcacgaggagagcatcctggagcgggtgcagcagcmcatcgagagcaagctcctgggctccaattcctccaggatgtacttcacccaggtcagggcgcttctcatccagctacttctctggggcctttgaaatgtg

SEQ ID NO: 55376 - DNA, 201 bp, Homo sapiens
atctagacgtttccttggctcttctggcgccaaaatgtcgttcgtggcaggggttattcggcggctggacgagacagtggtgaaccgcatcgcggcggggkaagttatccagcggccagctaatgctatcaaagagatgattgagaactggtacggagggagtcgagccgggctcacttaagggctacgacttaacgggcc

SEQ ID NO: 55377 - DNA, 201 bp, Homo sapiens
gttcagataacctttccctttggtgaggtgacagtgggtgacccagcagtgagtttttctttcagtctattttcttttcttccttaggctttggccagcakaagccatgtggctcatgttactattacaacgaaaacagctgatggaaagtgtgcatacaggtatagtgctgacttcttttactcatatatattcattctg

SEQ ID NO: 55378 - DNA, 201 bp, Homo sapiens
gctatattttaatctattgttgatatgattttctcttttccccttgggattagtatctatctctctactggatattaatttgttatattttctcattagascaagttactcagatggaaaactgaaagcccctcctaaaccatgtgctggcaatcaagggacccagatcacggtaagaatggtacatgggagagtaaattg

SEQ ID NO: 55379 - DNA, 201 bp, Homo sapiens
agcttcatccatgtccctgcaaaggacatgaactcatcattttttgtggctgcatagtattccatggtgtatatgtgccaccttttcttaatccagtctaycattgttggacatttgggttggttccaagtctttgctattgcgaatagtgctgcagtaaacatacgtgtgcatgtgtctttatagcagcatgatttataa

SEQ ID NO: 55380 - DNA, 201 bp, Homo sapiens
attgttgatatgattttctcttttccccttgggattagtatctatctctctactggatattaatttgttatattttctcattagagcaagttactcagatkgaaaactgaaagcccctcctaaaccatgtgctggcaatcaagggacccagatcacggtaagaatggtacatgggagagtaaattgttgaagctttgtttg

SEQ ID NO: 55381 - DNA, 201 bp, Homo sapiens
atctatctctctactggatattaatttgttatattttctcattagagcaagttactcagatggaaaactgaaagcccctcctaaaccatgtgctggcaatyaagggacccagatcacggtaagaatggtacatgggagagtaaattgttgaagctttgtttgtataaatattggaataaaaaataaaattgcttctaagtt

SEQ ID NO: 55382 - DNA, 201 bp, Homo sapiens
taacagaagacgataacaggactatgggagttatgagctgggaaccttggacaaaaatatatacatattaaataaatattaagtgtatatatatacttacrtatattaagtgtatgtgtgtgtgtgtatatatatatttttttaatttactggttggttttgggaagcagaaattaccataactactcttaaaaatctttt

SEQ ID NO: 55383 - DNA, 201 bp, Homo sapiens
ttctgttcaggtggaggaccttttttacaacatagccacgaggagaaaagctttaaaaaatccaagtgaagaatatgggaaaattttggaagttgttggcrggtacagtccaaaatctgggagtgggtctctgagatttgtcatcaaagtaatgtgttctagtgctcatacattgaacagttgctgagctagatggtgaaa

SEQ ID NO: 55384 - DNA, 201 bp, Homo sapiens
agaatgacttgaacccgggaggcggaggttgcagtgagccgagatcgcgccattgcactccagcctgggcaacaagagcgaaactccgtctcaaaacaaaygaacaaacaaaaaccccaaaaatccctgaagtacgtgagctagtggtgaaagaaagctggagaaaaggagcaggaataataataataataataataataa

SEQ ID NO: 55385 - DNA, 201 bp, Homo sapiens
cttccgttgagcatctagacgtttccttggctcttctggcgccaaaatgtcgttcgtggcaggggttattcggcggctggacgagacagtggtgaaccgcwtcgcggcgggggaagttatccagcggccagctaatgctatcaaagagatgattgagaactggtacggagggagtcgagccgggctcacttaagggctacg

SEQ ID NO: 55386 - DNA, 201 bp, Homo sapiens
ctgacatctagtgtgtgtttttggcaactcttttcttactcttttgtttttcttttccaggtattcagtacacaatgcaggcattagtttctcagttaaawaagtaagttcttggtttatgggggatggttttgttttatgaaaagaaaaaaggggatttttaatagtttgctggtggagataaggttatgatgtttcagt

SEQ ID NO: 55387 - DNA, 201 bp, Homo sapiens
gttctctcttattttcctgacagtttagaaatcagtccccagaatgtggatgttaatgtgcaccccacaaagcatgaagttcacttcctgcacgaggagakcatcctggagcgggtgcagcagcacatcgagagcaagctcctgggctccaattcctccaggatgtacttcacccaggtcagggcgcttctcatccagcta

SEQ ID NO: 55388 - DNA, 201 bp, Homo sapiens
tttttaatagtttgctggtggagataaggttatgatgtttcagtctcagccatgagacaataaatccttgtgtcttctgctgtttgtttatcagcaaggasagacagtagctgatgttaggacactacccaatgcctcaaccgtggacaatattcgctccatctttggaaatgctgttagtcggtatgtcgataacctata

SEQ ID NO: 55389 - DNA, 201 bp, Homo sapiens
gaattttttccagccgggtacattggcctgtaatcccagcacttcgagaggccaaggtggaagggtcacttgagtctaggagttacacacaacacacacacacacacacacacacacactagccaggcatggtggcaaatgcctgtagtctcagctactccggaggctcaggtggaaggatcacttgagcccaggaggttg

SEQ ID NO: 55390 - DNA, 201 bp, Homo sapiens
cttgctggcccctctggggagatggttaaatccacaacaagtctgacctcgtcttctacttctggaagtagtgataaggtctatgcccaccagatggttcstacagattcccgggaacagaagcttgatgcatttctgcagcctctgagcaaacccctgtccagtcagccccaggccattgtcacagaggataagacagat

SEQ ID NO: 55391 - DNA, 201 bp, Homo sapiens
gtttgtttatcagcaaggagagacagtagctgatgttaggacactacccaatgcctcaaccgtggacaatattcgctccatctttggaaatgctgttagtyggtatgtcgataacctatataaaaaaatcttttacatttattatcttggtttatcattccatcacattattttggaacctttcaagatattatgtgtgtt

SEQ ID NO: 55392 - DNA, 201 bp, Homo sapiens
gatagtgattcttctgatggatctgagccaagtaaattgaaaacctctggaaagaattcatcattttagatgtcctgagaaacattcgagattcctgggargaagtcaaaatatcaacattaacaggagtttggaagaaattgcatccagccctcatggataactttgaggggttcaagacttcagtggaggaagtagctg

SEQ ID NO: 55393 - DNA, 201 bp, Homo sapiens
tctttcctgaggtgatttcatgactttgtgtgaatgtacacctgtgacctcacccctcaggacagttttgaactggttgctttctttttattgtttagatygtctggtagaatcaacttccttgagaaaagccatagaaacagtgtatgcagcctatttgcccaaaaacacacacccattcctgtacctcaggtaatgtag

SEQ ID NO: 55394 - DNA, 201 bp, Homo sapiens
accatttcccatttatttgactgtagacaagttacattcctaaactatgtctcagatttctcatctgtaagttgtggtattactagttaacatgcaggggttttgtttgtttgtttgtttgtttgtttgtgagggtaagaaataacccaagaagcctagtccttggtagttgctcagtgccctataaatgttgtgaaccag

SEQ ID NO: 55395 - DNA, 201 bp, Homo sapiens
ctttcctgaggtgatttcatgactttgtgtgaatgtacacctgtgacctcacccctcaggacagttttgaactggttgctttctttttattgtttagatcrtctggtagaatcaacttccttgagaaaagccatagaaacagtgtatgcagcctatttgcccaaaaacacacacccattcctgtacctcaggtaatgtagc

SEQ ID NO: 55396 - DNA, 201 bp, Homo sapiens
aggtcaaggcagccagatcatttgagatcaggagttcgagaccagcatggccagcatagtgaagccccatctctactaaaaatacaagaaaaaattaaccragcatggtggcgcatacctgtaatcccagccactctggaggctgagacatgaaaattgcttgaacccgggaggcggaggttgcagtgagctgagatctcg

SEQ ID NO: 55397 - DNA, 201 bp, Homo sapiens
atttgttaggaattctactcgccttgctttttcttttccagcatgtttaagggaatgacctccaaggccccaaatcacagttgtattcatgttctttcatytcacagatacaatccaggccagtcccagatttgcagctgttaataaatgtgaatggttttccagtaagggggtagaaaaacatagggagagaaccgggtt

SEQ ID NO: 55398 - DNA, 201 bp, Homo sapiens
aggacaccagtgtatgttgggatgcaaacagggaggcttatgacatctaatgtgttttccagagtgaagtgcctggctccattccaaactcctggaagtgractgtggaacacattgtctataaagccttgcgctcacacattctgcctcctaaacatttcacagaagatggaaatatcctgcagcttgctaacctgcctg

SEQ ID NO: 55399 - DNA, 201 bp, Homo sapiens
ctttcagtctattttcttttcttccttaggctttggccagcataagccatgtggctcatgttactattacaacgaaaacagctgatggaaagtgtgcatasaggtatagtgctgacttcttttactcatatatattcattctgaaatgtattttttgcctaggtctcagagtaatcctgtctcaacaccagtgttatcttt

SEQ ID NO: 55400 - DNA, 201 bp, Homo sapiens
aattggatgtgaggataaaaccctagccttcaaaatgaatggttacatatccaatgcaaactactcagtgaagaagtgcatcttcttactcttcatcaacygtaagttaaaaagaaccacatgggaaatccactcacaggaaacacccacagggaattttatgggaccatggaaaaatttctgatccataggtttgattaa

SEQ ID NO: 55401 - DNA, 201 bp, Homo sapiens
aatgtttaaattcgtacctattttgaggtattgaatttctttggaccaggtgaattgggacgaagaaaaggaatgttttgaaagcctcagtaaagaatgcrctatgttctattccatccggaagcagtacatatctgaggagtcgaccctctcaggccagcaggtacagtggtgatgcacactggcaccccaggactagga

SEQ ID NO: 55402 - DNA, 201 bp, Homo sapiens
cttcatgttcttgcttcttcctaggagccagcaccgctctttgaccttgccatgcttgccttagatagtccagagagtggctggacagaggaagatggtcscaaagaaggacttgctgaatacattgttgagtttctgaagaagaaggctgagatgcttgcagactatttctctttggaaattgatgaggtgtgacagcca

SEQ ID NO: 55403 - DNA, 201 bp, Homo sapiens
tatgtattcagaactcattccatttaggcttggaaacccgtttggtgcaactctgttcaagttccattgtctgctttgagaatgcttgggcttgtatagtragctgtcactttttaatttgttaggaattctactcgccttgctttttcttttccagcatgtttaagggaatgacctccaaggccccaaatcacagttgta

SEQ ID NO: 55404 - DNA, 201 bp, Homo sapiens
ggtgatttcatgactttgtgtgaatgtacacctgtgacctcacccctcaggacagttttgaactggttgctttctttttattgtttagatcgtctggtagratcaacttccttgagaaaagccatagaaacagtgtatgcagcctatttgcccaaaaacacacacccattcctgtacctcaggtaatgtagcaccaaactc

SEQ ID NO: 55405 - DNA, 201 bp, Homo sapiens
tttccttggctcttctggcgccaaaatgtcgttcgtggcaggggttattcggcggctggacgagacagtggtgaaccgcatcgcggcgggggaagttatcyagcggccagctaatgctatcaaagagatgattgagaactggtacggagggagtcgagccgggctcacttaagggctacgacttaacgggccgcgtcactc

SEQ ID NO: 55406 - DNA, 201 bp, Homo sapiens
tttctaagcctcccaagtagctgagattacaggcatgcaccaccagctaatttttgtatttttagtagagatggggtttcactgtgttggccaggctggtytcaaactcctgacctcaggtgatccacctgccttggcctcccagagtgctgggattacaggtgtgagccactgtggctggcctgtttcacatttcttaag

SEQ ID NO: 55407 - DNA, 201 bp, Homo sapiens
gatttcatgactttgtgtgaatgtacacctgtgacctcacccctcaggacagttttgaactggttgctttctttttattgtttagatcgtctggtagaatsaacttccttgagaaaagccatagaaacagtgtatgcagcctatttgcccaaaaacacacacccattcctgtacctcaggtaatgtagcaccaaactcctc

SEQ ID NO: 55408 - DNA, 201 bp, Homo sapiens
ggggtattgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttca

SEQ ID NO: 55409 - DNA, 201 bp, Homo sapiens
tgtttagatcgtctggtagaatcaacttccttgagaaaagccatagaaacagtgtatgcagcctatttgcccaaaaacacacacccattcctgtacctcasgtaatgtagcaccaaactcctcaaccaagactcacaaggaacagatgttctatcaggctctcctctttgaaagagatgagcatgctaatagtacaatcag

SEQ ID NO: 55410 - DNA, 201 bp, Homo sapiens
gtattgaaacttccaactataattatgatttgtctgttctctttgcagttctcttagtttttgccttcatatatatatacatatatatgtatatatatatwtatttttttttttttgagatggagtcttgctctgttgcccaggctggagtgcagtggtgtgatcttggctcactgcaagctccgcctcccaggttcacgc

SEQ ID NO: 55411 - DNA, 201 bp, Homo sapiens
ggcctcaaatcttctggccaccacatacaccatatgtgggctttttctccccctcccactatctaaggtaattgttctctcttattttcctgacagtttakaaatcagtccccagaatgtggatgttaatgtgcaccccacaaagcatgaagttcacttcctgcacgaggagagcatcctggagcgggtgcagcagcacat

SEQ ID NO: 55412 - DNA, 201 bp, Homo sapiens
attgaaacttccaactataattatgatttgtctgttctctttgcagttctcttagtttttgccttcatatatatatacatatatatgtatatatatatatatttttttttttttgagatggagtcttgctctgttgcccaggctggagtgcagtggtgtgatcttggctcactgcaagctccgcctcccaggttcacgcca

SEQ ID NO: 55413 - DNA, 201 bp, Homo sapiens
tctggccaccacatacaccatatgtgggctttttctccccctcccactatctaaggtaattgttctctcttattttcctgacagtttagaaatcagtcccyagaatgtggatgttaatgtgcaccccacaaagcatgaagttcacttcctgcacgaggagagcatcctggagcgggtgcagcagcacatcgagagcaagct

SEQ ID NO: 55414 - DNA, 201 bp, Homo sapiens
gcttgctcctccaaaatgcaacccacaaaatttggctaagtttaaaaacaagaataataatgatctgcacttccttttcttcattgcagaaagagacatcrggaagattctgatgtggaaatggtggaagatgattcccgaaaggaaatgactgcagcttgtaccccccggagaaggatcattaacctcactagtgttttg

SEQ ID NO: 55415 - DNA, 201 bp, Homo sapiens
tttgatctggaatgataaagatgataagggtgggatagctgaaggcctgctctcatccccactaatattcattcccagcaatattcagcagtcccatttayagttttaacgcctaaagtatcacatttcgttttttagctttaagtagtctgtgatctccgtttagaatgagaatgtttaaattcgtacctattttgaggt

SEQ ID NO: 55416 - DNA, 201 bp, Homo sapiens
ttttgttttgcagttctccgggagatgttgcataaccactccttcgtgggctgtgtgaatcctcagtgggccttggcacagcatcaaaccaagttataccytctcaacaccaccaagcttaggtaaatcagctgagtgtgtgaacaagcagagctactacaacaatggtccagggagcacaggcacaaaagctaaggagag

SEQ ID NO: 55417 - DNA, 201 bp, Homo sapiens
tttgcagttctccgggagatgttgcataaccactccttcgtgggctgtgtgaatcctcagtgggccttggcacagcatcaaaccaagttataccttctcamcaccaccaagcttaggtaaatcagctgagtgtgtgaacaagcagagctactacaacaatggtccagggagcacaggcacaaaagctaaggagagcagcat

SEQ ID NO: 55418 - DNA, 201 bp, Homo sapiens
atgtttcagggattacttctcccattttgtcccaactggttgtatctcaagcatgaattcagcttttccttaaagtcacttcatttttattttcagtgaakaactgttctaccagatactcatttatgattttgccaattttggtgttctcaggttatcggtaagtttagatccttttcacttctgaaatttcaactgatc

SEQ ID NO: 55419 - DNA, 201 bp, Homo sapiens
ttacttctcccattttgtcccaactggttgtatctcaagcatgaattcagcttttccttaaagtcacttcatttttattttcagtgaagaactgttctacyagatactcatttatgattttgccaattttggtgttctcaggttatcggtaagtttagatccttttcacttctgaaatttcaactgatcgtttctgaaaat

SEQ ID NO: 55420 - DNA, 201 bp, Homo sapiens
tcatgttcttgcttcttcctaggagccagcaccgctctttgaccttgccatgcttgccttagatagtccagagagtggctggacagaggaagatggtcccwaagaaggacttgctgaatacattgttgagtttctgaagaagaaggctgagatgcttgcagactatttctctttggaaattgatgaggtgtgacagccatt

SEQ ID NO: 55421 - DNA, 201 bp, Homo sapiens
aacacattgtctataaagccttgcgctcacacattctgcctcctaaacatttcacagaagatggaaatatcctgcagcttgctaacctgcctgatctatasaaagtctttgagaggtgttaaatatggttatttatgcactgtgggatgtgttcttctttctctgtattccgatacaaagtgttgtatcaaagtgtgatat

SEQ ID NO: 55422 - DNA, 201 bp, Homo sapiens
gctaagtttaaaaacaagaataataatgatctgcacttccttttcttcattgcagaaagagacatcgggaagattctgatgtggaaatggtggaagatgawtcccgaaaggaaatgactgcagcttgtaccccccggagaaggatcattaacctcactagtgttttgagtctccaggaagaaattaatgagcagggacatg

SEQ ID NO: 55423 - DNA, 201 bp, Homo sapiens
acttgctggcccctctggggagatggttaaatccacaacaagtctgacctcgtcttctacttctggaagtagtgataaggtctatgcccaccagatggttygtacagattcccgggaacagaagcttgatgcatttctgcagcctctgagcaaacccctgtccagtcagccccaggccattgtcacagaggataagacaga

SEQ ID NO: 55424 - DNA, 201 bp, Homo sapiens
ggaagtagtgataaggtctatgcccaccagatggttcgtacagattcccgggaacagaagcttgatgcatttctgcagcctctgagcaaacccctgtccartcagccccaggccattgtcacagaggataagacagatatttctagtggcagggctaggcagcaagatgaggagatgcttgaactcccagcccctgctgaa

SEQ ID NO: 55425 - DNA, 201 bp, Homo sapiens
gcttgatgcatttctgcagcctctgagcaaacccctgtccagtcagccccaggccattgtcacagaggataagacagatatttctagtggcagggctaggyagcaagatgaggagatgcttgaactcccagcccctgctgaagtggctgccaaaaatcagagcttggagggggatacaacaaaggggacttcagaaatgtc

SEQ ID NO: 55426 - DNA, 201 bp, Homo sapiens
attctattacttacctgttttttggttttattttttgttttgcagttctccgggagatgttgcataaccactccttcgtgggctgtgtgaatcctcagtgrgccttggcacagcatcaaaccaagttataccttctcaacaccaccaagcttaggtaaatcagctgagtgtgtgaacaagcagagctactacaacaatggt

SEQ ID NO: 55427 - DNA, 201 bp, Homo sapiens
agactgctaaccagctgtaaatgtttcaaaatatgcatgttttacagcagttgttcaaagcaatacaggaacagtaaggacagagccagtcattttacaamcacattctgttaaactgatgtctattagcagggtttttcctattttattaggaaggacttacacctgatatataacaaagcttgttttaatcaaggctca

SEQ ID NO: 55428 - DNA, 201 bp, Homo sapiens
gtttaaactatgacagcattatttcttgttcccttgtcctttttcctgcaagcaggaagggaacctgattggattaccccttctgattgacaactatgtgycccctttggagggactgcctatcttcattcttcgactagccactgaggtcagtgatcaagcagatactaagcatttcggtacatgcatgtgtgctggagg

SEQ ID NO: 55429 - DNA, 201 bp, Homo sapiens
ctagattattccaagaagggacaatttccaagacttggtttacactgagacggctcctgattttaaggataccttagatcaaactctaggaaggcagtttsattttggccttgcagttccctgggtcattttccaagcccatggcctcctggagtcttcgcctagctgtaggttatctttgtggctattatttcactgtaa

SEQ ID NO: 55430 - DNA, 201 bp, Homo sapiens
cctcgcttttgccaggacatcttgggttttattttcaagtacttctatgaatttacaagaaaaatcaatcttctgttcaggtggaggaccttttttacaayatagccacgaggagaaaagctttaaaaaatccaagtgaagaatatgggaaaattttggaagttgttggcaggtacagtccaaaatctgggagtgggtctc

SEQ ID NO: 55431 - DNA, 201 bp, Homo sapiens
agaacactagcctcatgaggcattttgggaaaaaagagtttgctggttcagtgtgtatgggcagtgccacaagccgtaccctccgttgaagacactcattycacacattactgcataaaaagcttccaccagccattcggcaaacttattgagtgtctgctatttcctgggtattgtgctatatggtagggttatagtagt

SEQ ID NO: 55432 - DNA, 201 bp, Homo sapiens
tgagtattttcaaaagcttcagaatctcttttctaatagagaactgatagaaattggatgtgaggataaaaccctagccttcaaaatgaatggttacatayccaatgcaaactactcagtgaagaagtgcatcttcttactcttcatcaaccgtaagttaaaaagaaccacatgggaaatccactcacaggaaacacccac

SEQ ID NO: 55433 - DNA, 201 bp, Homo sapiens
catcgggaagattctgatgtggaaatggtggaagatgattcccgaaaggaaatgactgcagcttgtaccccccggagaaggatcattaacctcactagtgytttgagtctccaggaagaaattaatgagcagggacatgagggtacgtaaacgctgtggcctgcctgggatgcatagggcctcaactgccaaggttttgga

SEQ ID NO: 55434 - DNA, 201 bp, Homo sapiens
ataataatgatctgcacttccttttcttcattgcagaaagagacatcgggaagattctgatgtggaaatggtggaagatgattcccgaaaggaaatgactrcagcttgtaccccccggagaaggatcattaacctcactagtgttttgagtctccaggaagaaattaatgagcagggacatgagggtacgtaaacgctgtg

SEQ ID NO: 55435 - DNA, 201 bp, Homo sapiens
caccagtgtatgttgggatgcaaacagggaggcttatgacatctaatgtgttttccagagtgaagtgcctggctccattccaaactcctggaagtggactrtggaacacattgtctataaagccttgcgctcacacattctgcctcctaaacatttcacagaagatggaaatatcctgcagcttgctaacctgcctgatct

SEQ ID NO: 55436 - DNA, 201 bp, Homo sapiens
aagagatttggaaaaatgagtaacatgattatttactcatctttttggtatctaacagaaagaagatctggatattgtatgtgaaaggttcactactagtraactgcagtcctttgaggatttagccagtatttctacctatggctttcgaggtgaggtaagctaaagattcaagaaatgtgtaaaatatcctcctgtgat

SEQ ID NO: 55437 - DNA, 201 bp, Homo sapiens
agcatgaattcagcttttccttaaagtcacttcatttttattttcagtgaagaactgttctaccagatactcatttatgattttgccaattttggtgttcycaggttatcggtaagtttagatccttttcacttctgaaatttcaactgatcgtttctgaaaatagtagctctccactaatatcttatttgtagtatgtta

SEQ ID NO: 55438 - DNA, 201 bp, Homo sapiens
atcacttgaacccaggaggcggaggttgcagtgagccaagaatgcaccactgcactccagcctgggcaacacacacacacacgaaaaacgaagtggtaagratggaaatccttctcttcttcctgatctaagggggaaaggggaaagttacaaaacattcagtatgctgttagccatataggtttttttgtagatgcccat

SEQ ID NO: 55439 - DNA, 201 bp, Homo sapiens
gtttctcacctgccattctgatagtggattcttgggaattcaggcttcatttggatgctccgttaaagcttgctccttcatgttcttgcttcttcctaggrgccagcaccgctctttgaccttgccatgcttgccttagatagtccagagagtggctggacagaggaagatggtcccaaagaaggacttgctgaatacatt

SEQ ID NO: 55440 - DNA, 201 bp, Homo sapiens
gcagaactatttctgtctcatccatgtttcagggattacttctcccattttgtcccaactggttgtatctcaagcatgaattcagcttttccttaaagtcrcttcatttttattttcagtgaagaactgttctaccagatactcatttatgattttgccaattttggtgttctcaggttatcggtaagtttagatcctttt

SEQ ID NO: 55441 - DNA, 201 bp, Homo sapiens
gccattctgatagtggattcttgggaattcaggcttcatttggatgctccgttaaagcttgctccttcatgttcttgcttcttcctaggagccagcaccgstctttgaccttgccatgcttgccttagatagtccagagagtggctggacagaggaagatggtcccaaagaaggacttgctgaatacattgttgagtttct

SEQ ID NO: 55442 - DNA, 201 bp, Homo sapiens
tgtcctttttcctgcaagcaggaagggaacctgattggattaccccttctgattgacaactatgtgccccctttggagggactgcctatcttcattcttcsactagccactgaggtcagtgatcaagcagatactaagcatttcggtacatgcatgtgtgctggagggaaagggcaaatgaccaccctttgatctggaatg

SEQ ID NO: 55443 - DNA, 201 bp, Homo sapiens
tggtagttgctcagtgccctataaatgttgtgaaccaggtggtgagggtttggtgctgctagagaattctggtatctgctctgtgcaacagagtactgtargtgatgcaagagaaagaagacctgatgccttctttcctcccagctttgagaatggagcaaaggcctaccccagccaccaagtgagccagtgggcttgatc

SEQ ID NO: 55444 - DNA, 201 bp, Homo sapiens
ttgtcctttttcctgcaagcaggaagggaacctgattggattaccccttctgattgacaactatgtgccccctttggagggactgcctatcttcattcttygactagccactgaggtcagtgatcaagcagatactaagcatttcggtacatgcatgtgtgctggagggaaagggcaaatgaccaccctttgatctggaat

SEQ ID NO: 55445 - DNA, 201 bp, Homo sapiens
ggtaattgttctctcttattttcctgacagtttagaaatcagtccccagaatgtggatgttaatgtgcaccccacaaagcatgaagttcacttcctgcackaggagagcatcctggagcgggtgcagcagcacatcgagagcaagctcctgggctccaattcctccaggatgtacttcacccaggtcagggcgcttctcat

SEQ ID NO: 55446 - DNA, 201 bp, Homo sapiens
tggcatacagtggccactggaagacaaccagcaggggatgggggcgtttacccttgcaagtgagcattaggaactagaggactgattgccctttcttcagstttggtttcccttgctgcagaaaaagatgctgagactcatggcctcggttatgaactcagatatgtggtttggctttgaagcacagatggattttgtccg

SEQ ID NO: 55447 - DNA, 201 bp, Homo sapiens
cgccaaaatgtcgttcgtggcaggggttattcggcggctggacgagacagtggtgaaccgcatcgcggcgggggaagttatccagcggccagctaatgctrtcaaagagatgattgagaactggtacggagggagtcgagccgggctcacttaagggctacgacttaacgggccgcgtcactcaatggcgcggacacgcct

SEQ ID NO: 55448 - DNA, 201 bp, Homo sapiens
ttcctgcaagcaggaagggaacctgattggattaccccttctgattgacaactatgtgccccctttggagggactgcctatcttcattcttcgactagccmctgaggtcagtgatcaagcagatactaagcatttcggtacatgcatgtgtgctggagggaaagggcaaatgaccaccctttgatctggaatgataaagat

SEQ ID NO: 55449 - DNA, 201 bp, Homo sapiens
gggatcatgtctgtggagctcaccacctcgtcctcggtgctgagcagagtgcctggcatgtgtactcagtagatatttgctaagggagcgagtcagtgatkgagaggagcagcctgggaggtaaagccctagaatctttattttaaagggatatcaaagttgaacattcagttagacagttctcttgagtccagggattta

SEQ ID NO: 55450 - DNA, 201 bp, Homo sapiens
aattgggacgaagaaaaggaatgttttgaaagcctcagtaaagaatgcgctatgttctattccatccggaagcagtacatatctgaggagtcgaccctctsaggccagcaggtacagtggtgatgcacactggcaccccaggactaggacaggacctcatacaatctttaggagatgaaacttgcccatctctaaaatttc

SEQ ID NO: 55451 - DNA, 201 bp, Homo sapiens
ttggagtcttactgaggctaaaatgataaatctaaatgatttaaaattgtgtattcctacacagtatctcacttaattatgtaatagtcttgtgagtgagrcagagcagatgccgttttctctattttaaagatgaggaaaatggaatggaaaatggaaaggacagactaattgcaacatcctcgcaatcaaaaacaggcc

SEQ ID NO: 55452 - DNA, 201 bp, Homo sapiens
cacattgtctataaagccttgcgctcacacattctgcctcctaaacatttcacagaagatggaaatatcctgcagcttgctaacctgcctgatctatacaragtctttgagaggtgttaaatatggttatttatgcactgtgggatgtgttcttctttctctgtattccgatacaaagtgttgtatcaaagtgtgatatac

SEQ ID NO: 55453 - DNA, 201 bp, Homo sapiens
aataactttctgaatagtatcaaactgttttcagtgcagtgtattaacaaaactaacctgcctcaagtttggtcagctttggagtcttactgaggctaaamtgataaatctaaatgatttaaaattgtgtattcctacacagtatctcacttaattatgtaatagtcttgtgagtgaggcagagcagatgccgttttctct

SEQ ID NO: 55454 - DNA, 201 bp, Homo sapiens
taaagccttgcgctcacacattctgcctcctaaacatttcacagaagatggaaatatcctgcagcttgctaacctgcctgatctatacaaagtctttgagwggtgttaaatatggttatttatgcactgtgggatgtgttcttctttctctgtattccgatacaaagtgttgtatcaaagtgtgatatacaaagtgtacca

SEQ ID NO: 55455 - DNA, 201 bp, Homo sapiens
tggagtgcagtggcgtgatcataggtcactgaagctttgaactcctaggctcaagtagctaggaatacaagtgtgtaccactacacctggctaattttttwaaaaaaatttttttcgtagaaacgggagtcttgtgttaccaaggctaatctcaaactcatggcctcaagtgatactcttgcctcagcctcccagagtgct

SEQ ID NO: 55456 - DNA, 201 bp, Homo sapiens
ctctagggaatttctcactccagtggagaaggcaacacacttaccaaactgtgtggaaactatctcatttgattagaaattttacctcaagaagaggaagracagttgagaaagaacattttcttacacatgagacagctaaggcttacaagaaggagaggaataatgaggcaaaataatcctcattaatattttcattcc

SEQ ID NO: 55457 - DNA, 201 bp, Homo sapiens
ggaaggacttacacctgatatataacaaagcttgttttaatcaaggctcagaaaatgtttttcattagtttttttcctaaccatgaagaataactgctttrtaacacacatgctggctataaagcagacaaaaaattcactgtaggtgctgcctgactggcctctgtccgtgtttctgttggggctgcttaccacagcctc

SEQ ID NO: 55458 - DNA, 201 bp, Homo sapiens
tttctttcagtctattttcttttcttccttaggctttggccagcataagccatgtggctcatgttactattacaacgaaaacagctgatggaaagtgtgcrtacaggtatagtgctgacttcttttactcatatatattcattctgaaatgtattttttgcctaggtctcagagtaatcctgtctcaacaccagtgttatc

SEQ ID NO: 55459 - DNA, 201 bp, Homo sapiens
tagcaaagaaaggtcaagctcttacgcatgccattcatttatctacactgtgcaggcgcactcaggtggcagggacaaagaccactcctttggcgcatctsaagttcagaattctcagtagaggggctccagctgtccttttgtcaggtgcccatgcctgctccaggcctgtgtggtcaggacacgtgttacagagtacag

SEQ ID NO: 55460 - DNA, 201 bp, Homo sapiens
ttgcagttccctgggtcattttccaagcccatggcctcctggagtcttcgcctagctgtaggttatctttgtggctattatttcactgtaattatacaggwagatttattgagggatttctgtgtaccagccgtggttctcagcactttgtatactttgtattaactctgactcctgacagtaactctacagaggttctgc

SEQ ID NO: 55461 - DNA, 201 bp, Homo sapiens
atctttgtgatcggggtttcttgataccatttctgtgccattttcgggactggttgtgtgtggtgtggttcttggacttcgccatgtctacaccttaagcygcggctcccgaagcacctagaaccggaagagttggctcactatttagcacacacacacgtctataatagtgctggccacttggggttggaattagtttat

SEQ ID NO: 55462 - DNA, 201 bp, Homo sapiens
tgattggctgaaggcacttccgttgagcatctagacgtttccttggctcttctggcgccaaaatgtcgttcgtggcaggggttattcggcggctggacgaracagtggtgaaccgcatcgcggcgggggaagttatccagcggccagctaatgctatcaaagagatgattgagaactggtacggagggagtcgagccgggc

SEQ ID NO: 55463 - DNA, 201 bp, Homo sapiens
tccctggttgaagggattctcctccctcagcctcccgagtacctgggattacaggcatgcgccaccacgcccagctaatttttgtatttttagtagagacrtggtttcatcatgttggccaggatggtctcgatctcctgaccttgtgatccacccgcctcggcctccccaaatgctgggattacaggcgtgagccaccac

SEQ ID NO: 55464 - DNA, 201 bp, Homo sapiens
catgcgccaccacgcccagctaatttttgtatttttagtagagacgtggtttcatcatgttggccaggatggtctcgatctcctgaccttgtgatccaccygcctcggcctccccaaatgctgggattacaggcgtgagccaccacgcccggccacttggcatgaatttaattcccgccataaacctgtgagataggtaat

SEQ ID NO: 55465 - DNA, 201 bp, Homo sapiens
cctgacagtttagaaatcagtccccagaatgtggatgttaatgtgcaccccacaaagcatgaagttcacttcctgcacgaggagagcatcctggagcgggygcagcagcacatcgagagcaagctcctgggctccaattcctccaggatgtacttcacccaggtcagggcgcttctcatccagctacttctctggggcctt

SEQ ID NO: 55466 - DNA, 201 bp, Homo sapiens
gtcagataagcagtctaccagagaacagactgatcttgttggccttctgccagcacaggggttcattcacagctctgtagaaccagcacagagaagttgcytgctcctccaaaatgcaacccacaaaatttggctaagtttaaaaacaagaataataatgatctgcacttccttttcttcattgcagaaagagacatcggg

SEQ ID NO: 55467 - DNA, 201 bp, Homo sapiens
tcttgttggccttctgccagcacaggggttcattcacagctctgtagaaccagcacagagaagttgcttgctcctccaaaatgcaacccacaaaatttggytaagtttaaaaacaagaataataatgatctgcacttccttttcttcattgcagaaagagacatcgggaagattctgatgtggaaatggtggaagatgatt

SEQ ID NO: 55468 - DNA, 201 bp, Homo sapiens
ttgtcagatttttaccagtttggtgattgtgaaacagtgtctgatggtagtttttatttgcattttcttggttgaaataaagttgtgtatttcagccaggygcgttggctcatgcctataatcccagcactttaggaggccaaggtgggcagatcacttgaggccaggagttcaagaccagcccagccaacgtggcaaaac

SEQ ID NO: 55469 - DNA, 201 bp, Homo sapiens
tttttatttgcattttcttggttgaaataaagttgtgtatttcagccaggtgcgttggctcatgcctataatcccagcactttaggaggccaaggtgggcrgatcacttgaggccaggagttcaagaccagcccagccaacgtggcaaaaccccatctctactaaaaatacaaaaattagatgggtatggtgtcacatgcc

SEQ ID NO: 55470 - DNA, 201 bp, Homo sapiens
ggaggcagaggctgcagtgagctgagatcacaccacagcactccagcctggaagacatagtgagactctctctcaaaaaaaaaaaaaaaaaaaaaggaagkaagcattgtgagggcaggtaccttctctgttttgttcattgctggatgtagttagtatacagcagtatctgatggatggatagatggaggaatgaatgaa

SEQ ID NO: 55471 - DNA, 201 bp, Homo sapiens
gtcagttccagagtggacagcagctggtctcctccaatttaattccaacactgtctacttggagatagcattagatcccacaggttgagggtgcagtcccmtagactgcccccagtctcctgcttcagacaccagtcacaagtccaggactctagaagttctgaccagtttcaagttggggttcccacaaccccccacttt

SEQ ID NO: 55472 - DNA, 201 bp, Homo sapiens
tgtatgttgggatgcaaacagggaggcttatgacatctaatgtgttttccagagtgaagtgcctggctccattccaaactcctggaagtggactgtggaayacattgtctataaagccttgcgctcacacattctgcctcctaaacatttcacagaagatggaaatatcctgcagcttgctaacctgcctgatctatacaa

SEQ ID NO: 55473 - DNA, 201 bp, Homo sapiens
atgtacttcacccaggtcagggcgcttctcatccagctacttctctggggcctttgaaatgtgcccggccagacgtgagagcccagatttttgcctgttayttaggaactttctttgcaagtattacctggatagttttaacattttcttctttgaacctagttataaaggtattgtgctgttgttcctaggcttagagtc

SEQ ID NO: 55474 - DNA, 201 bp, Homo sapiens
gaaagatgatgtaacttacgcaaagctacacagctcttaagtagcagtgccaatatttgaacacactcagactcgatcctgaggttttgaccactgtgtcrtctggcctcaaatcttctggccaccacatacaccatatgtgggctttttctccccctcccactatctaaggtaattgttctctcttattttcctgacagt

SEQ ID NO: 55475 - DNA, 201 bp, Homo sapiens
cgccattctcctgcctcagcctcccgagtagctgggactacaggcgcctgtcaccacacccagctaattttttgtattttttagtagagacggggtttcaycgtgttagccaggatgatctcgatctccagacctcgtgatccacccacctcggcctcccaaagtgctgggattacaggcgtgagccaccgtgcccagcca

SEQ ID NO: 55476 - DNA, 201 bp, Homo sapiens
taaatccttgtgtcttctgctgtttgtttatcagcaaggagagacagtagctgatgttaggacactacccaatgcctcaaccgtggacaatattcgctccrtctttggaaatgctgttagtcggtatgtcgataacctatataaaaaaatcttttacatttattatcttggtttatcattccatcacattattttggaacc

SEQ ID NO: 55477 - DNA, 201 bp, Homo sapiens
ggacttgctggcccctctggggagatggttaaatccacaacaagtctgacctcgtcttctacttctggaagtagtgataaggtctatgcccaccagatggwtcgtacagattcccgggaacagaagcttgatgcatttctgcagcctctgagcaaacccctgtccagtcagccccaggccattgtcacagaggataagaca

SEQ ID NO: 55478 - DNA, 201 bp, Homo sapiens
ccttgccatgcttgccttagatagtccagagagtggctggacagaggaagatggtcccaaagaaggacttgctgaatacattgttgagtttctgaagaagwaggctgagatgcttgcagactatttctctttggaaattgatgaggtgtgacagccattcttatacttctgttgtattcttcaaataaaatttccagccgg

SEQ ID NO: 55479 - DNA, 201 bp, Homo sapiens
caatcaagggacccagatcacggtaagaatggtacatgggagagtaaattgttgaagctttgtttgtataaatattggaataaaaaataaaattgcttctragttttcagggtaataataaaatgaatttgcactagttaatggaggtcccaagatatcctctaagcaagataaatgactattggcttttgtggcatggca

SEQ ID NO: 55480 - DNA, 201 bp, Homo sapiens
tgtaatttctgcccctttgcccttcagttggggtattgctttggaccgattagagggctgtggctgggatgctaaaggttcatgtttccttagctggctcytgagccaccagctcccaccacctgtgtatacctgtgctagtttgccttcccacaagtagctgctggctatctgttatgctggtacagttttcagaaactg

SEQ ID NO: 55481 - DNA, 201 bp, Homo sapiens
agattaaacccagttagggcagccccaccagccttggaacccacacatctggagattgttgatgcagagagaaaggttcctactggtgagacctgaaaggkatatgtggcaggtgggaggaagaagttctgtctggaaaccaacccttgttcctccgttattgattgactcctggtaccaacatgagccctaggtcttata

SEQ ID NO: 55482 - DNA, 201 bp, Homo sapiens
cagaaaacttaaaattcccaagcagatgaatgcttctcggaaggacactgacagttacctacctggaaagaatctagatggaggtggcatgggcactaagyggtgagattaaacccagttagggcagccccaccagccttggaacccacacatctggagattgttgatgcagagagaaaggttcctactggtgagacctga

SEQ ID NO: 55483 - DNA, 201 bp, Homo sapiens
ggaacagtaaggacagagccagtcattttacaaccacattctgttaaactgatgtctattagcagggtttttcctattttattaggaaggacttacacctratatataacaaagcttgttttaatcaaggctcagaaaatgtttttcattagtttttttcctaaccatgaagaataactgctttgtaacacacatgctggc

SEQ ID NO: 55484 - DNA, 201 bp, Homo sapiens
agcttttgccttactctttatccgaccactgccctgccaggaaaacaaggctctataactcctcttacaggtcagcttgacacaaaaagggtgcctggatkcctaatgtttcattgtcacttttcccagtcagatgataatgcttttcaaatcaacatatattttgggggaggttggaagggagagttgaaatattctaag

SEQ ID NO: 55485 - DNA, 201 bp, Homo sapiens
aggcaacacacttaccaaactgtgtggaaactatctcatttgattagaaattttacctcaagaagaggaaggacagttgagaaagaacattttcttacacrtgagacagctaaggcttacaagaaggagaggaataatgaggcaaaataatcctcattaatattttcattcctcccctggggattagaactactttcagac

SEQ ID NO: 55486 - DNA, 201 bp, Homo sapiens
tggtcacccagagtggcagataggagcacaaggcctgggaaagcactggagaaatgggatttgtttaaactatgacagcattatttcttgttcccttgtcstttttcctgcaagcaggaagggaacctgattggattaccccttctgattgacaactatgtgccccctttggagggactgcctatcttcattcttcgacta

SEQ ID NO: 55487 - DNA, 201 bp, Homo sapiens
gccccaggccattgtcacagaggataagacagatatttctagtggcagggctaggcagcaagatgaggagatgcttgaactcccagcccctgctgaagtgrctgccaaaaatcagagcttggagggggatacaacaaaggggacttcagaaatgtcagagaagagaggacctacttccagcaaccccaggtatggcctttt

SEQ ID NO: 55488 - DNA, 201 bp, Homo sapiens
cccacccagccttatattttttaatgatgcacattagctcaattacataaaccagggaaatccagctaggacctggtgatttctgagcctgacccatgtgmctttcaatgaactgaacttgccacagctgtatttactgtctactgagatgctgtcacacagaccccgtcatagcacagttcctgagttacatctttacat

SEQ ID NO: 55489 - DNA, 201 bp, Homo sapiens
gagccaccgcgccctgcagttttttgtatttttaatagagacagggtttcaccatgttagccaggatggtctcgatttcctgacctcaggtgatctgcccrctttggcctcccaaagtgctgggattacaagcatgagccaccgcgcccggctcaagtggagatttttatatggagtccagttatactctttttaatatat

SEQ ID NO: 55490 - DNA, 201 bp, Homo sapiens
gtctcagccatgagacaataaatccttgtgtcttctgctgtttgtttatcagcaaggagagacagtagctgatgttaggacactacccaatgcctcaaccrtggacaatattcgctccatctttggaaatgctgttagtcggtatgtcgataacctatataaaaaaatcttttacatttattatcttggtttatcattcca

SEQ ID NO: 55491 - DNA, 201 bp, Homo sapiens
gccctgcagctctacgggatgaagctatactccagagtcctgctacattggctgtgtggccagctgctgggatctgagggttgtcagataagcagtctacyagagaacagactgatcttgttggccttctgccagcacaggggttcattcacagctctgtagaaccagcacagagaagttgcttgctcctccaaaatgcaa

SEQ ID NO: 55492 - DNA, 201 bp, Homo sapiens
cagcaaaggcactggcatacagtggccactggaagacaaccagcaggggatgggggcgtttacccttgcaagtgagcattaggaactagaggactgattgycctttcttcagctttggtttcccttgctgcagaaaaagatgctgagactcatggcctcggttatgaactcagatatgtggtttggctttgaagcacagat

SEQ ID NO: 55493 - DNA, 201 bp, Homo sapiens
tgttttccagagtgaagtgcctggctccattccaaactcctggaagtggactgtggaacacattgtctataaagccttgcgctcacacattctgcctcctwaacatttcacagaagatggaaatatcctgcagcttgctaacctgcctgatctatacaaagtctttgagaggtgttaaatatggttatttatgcactgtgg

SEQ ID NO: 55494 - DNA, 201 bp, Homo sapiens
aagaacaccatggtgttgtatgggaattgtttaggtagaatgaaagaaatcctctaatagagatatgaggccagttcagcagaaagccagggtgagatctyctgagagggatggaagggtgtcttgatcatctctggtagcagcaaaggcactggcatacagtggccactggaagacaaccagcaggggatgggggcgttt

SEQ ID NO: 55495 - DNA, 201 bp, Homo sapiens
tgggattacaggcgtgagccaccatgcctggccatttttcagtatttcttttttttttttttttttttttttttttgagacagagtttcactcttgttgcmcaggctggagtacaatggtgtgatctcggctcaccgcaacctctacttcccaggttcaagcaattcgcctgcctcagccttctcaagtagctgggattac

SEQ ID NO: 55496 - DNA, 201 bp, Homo sapiens
gttagattacattttttttccagtggaactctgcttaagtcctgaccagtatgttttcagaaggatcagagggcctgcccttgtccattggtgcatgacaycagcttggtgggttccttgctgctccctgttttcatagggttatcagaataccttctctccctgccaccagcaggtcacactggctcctgactttttggc

SEQ ID NO: 55497 - DNA, 201 bp, Homo sapiens
atcatatttcccactgtgcccagaaagagcacagttagtccacatgagctaatgggggcaaagggaagtgaggagggagaatgtactgccttatcatgttktctattacttggctgaagtaaaacagtcccaagccgatagtaagatagtgggctggaaagtggcgacaggtaaaggtgcacctttcttcctggggatgtg

SEQ ID NO: 55498 - DNA, 201 bp, Homo sapiens
atatggttatttatgcactgtgggatgtgttcttctttctctgtattccgatacaaagtgttgtatcaaagtgtgatatacaaagtgtaccaacataagtkttggtagcacttaagacttatacttgccttctgatagtattcctttatacacagtggattgattataaataaatagatgtgtcttaacataatttcttat

SEQ ID NO: 55499 - DNA, 201 bp, Homo sapiens
acgtttccttggctcttctggcgccaaaatgtcgttcgtggcaggggttattcggcggctggacgagacagtggtgaaccgcatcgcggcgggggaagttwtccagcggccagctaatgctatcaaagagatgattgagaactggtacggagggagtcgagccgggctcacttaagggctacgacttaacgggccgcgtca

SEQ ID NO: 55500 - DNA, 201 bp, Homo sapiens
tacctgttttttggttttattttttgttttgcagttctccgggagatgttgcataaccactccttcgtgggctgtgtgaatcctcagtgggccttggcacwgcatcaaaccaagttataccttctcaacaccaccaagcttaggtaaatcagctgagtgtgtgaacaagcagagctactacaacaatggtccagggagcac

SEQ ID NO: 55501 - DNA, 201 bp, Homo sapiens
cttgccatgcttgccttagatagtccagagagtggctggacagaggaagatggtcccaaagaaggacttgctgaatacattgttgagtttctgaagaagamggctgagatgcttgcagactatttctctttggaaattgatgaggtgtgacagccattcttatacttctgttgtattcttcaaataaaatttccagccggg

SEQ ID NO: 55502 - DNA, 201 bp, Homo sapiens
ccaagaagcctcacaatgcccaatgaagaaaagccctgtgcttggtgctgccgcctcccttccccgtcctgctggcagggctgcgcttcagtagctctggrtgcgtcagagcagtccatgaacattctgtgtggaaaatctctgactgttttagtggattacactgctctccctttcctccagtgcctcgttattcagtat

SEQ ID NO: 55503 - DNA, 201 bp, Homo sapiens
gcacttcgaagataccagattttatgggtcatccttggattttgaagcttataactgtgacaaaaaatgtgaagggaagagatttgaaacatgtggaaggraaagtgagtgcagactataaacttccaaaaagacaagcccaaaatacacctaaacgttatgtcagattattttgttaaaatcagttgttagtgacgtccg

SEQ ID NO: 55504 - DNA, 201 bp, Homo sapiens
catctaatgtgttttccagagtgaagtgcctggctccattccaaactcctggaagtggactgtggaacacattgtctataaagccttgcgctcacacattstgcctcctaaacatttcacagaagatggaaatatcctgcagcttgctaacctgcctgatctatacaaagtctttgagaggtgttaaatatggttatttat

SEQ ID NO: 55505 - DNA, 201 bp, Homo sapiens
tatgttgggatgcaaacagggaggcttatgacatctaatgtgttttccagagtgaagtgcctggctccattccaaactcctggaagtggactgtggaacayattgtctataaagccttgcgctcacacattctgcctcctaaacatttcacagaagatggaaatatcctgcagcttgctaacctgcctgatctatacaaag

SEQ ID NO: 55506 - DNA, 201 bp, Homo sapiens
gacccagtgcacatcccatcagccaggacaccagtgtatgttgggatgcaaacagggaggcttatgacatctaatgtgttttccagagtgaagtgcctggytccattccaaactcctggaagtggactgtggaacacattgtctataaagccttgcgctcacacattctgcctcctaaacatttcacagaagatggaaata

SEQ ID NO: 55507 - DNA, 201 bp, Homo sapiens
gtttcttgataccatttctgtgccattttcgggactggttgtgtgtggtgtggttcttggacttcgccatgtctacaccttaagccgcggctcccgaagcrcctagaaccggaagagttggctcactatttagcacacacacacgtctataatagtgctggccacttggggttggaattagtttatttatcagcatgttgt

SEQ ID NO: 55508 - DNA, 201 bp, Homo sapiens
tgagttcattgaaaaattagaatttttttttttttcccttttttagaggcaaggtctcactctgtcgcccacactggagtgcagtagtgtaagcatagctmactgtaaccttgaactcctgggctcaagcaattctgtcatctcagccagctgaagtagtaactgtaggttcacaccaccatgcctatttttgtttttgta

SEQ ID NO: 55509 - DNA, 201 bp, Homo sapiens
acagctgaaggaagaacgtgagcacgaggcactgaggtgattggctgaaggcacttccgttgagcatctagacgtttccttggctcttctggcgccaaaakgtcgttcgtggcaggggttattcggcggctggacgagacagtggtgaaccgcatcgcggcgggggaagttatccagcggccagctaatgctatcaaagag

SEQ ID NO: 55510 - DNA, 201 bp, Homo sapiens
attatttcttgttcccttgtcctttttcctgcaagcaggaagggaacctgattggattaccccttctgattgacaactatgtgccccctttggagggactkcctatcttcattcttcgactagccactgaggtcagtgatcaagcagatactaagcatttcggtacatgcatgtgtgctggagggaaagggcaaatgacca

SEQ ID NO: 55511 - DNA, 201 bp, Homo sapiens
caaggcctgggaaagcactggagaaatgggatttgtttaaactatgacagcattatttcttgttcccttgtcctttttcctgcaagcaggaagggaacctrattggattaccccttctgattgacaactatgtgccccctttggagggactgcctatcttcattcttcgactagccactgaggtcagtgatcaagcagata

SEQ ID NO: 55512 - DNA, 201 bp, Homo sapiens
gtacaaatagcacaggaggaccagccccatgcagatggtagcccaggggcgggggtagggggtcacaccagtccttctgtcctcatgttggcagagatatmtactctgaagcctttgtaggggcctgggcacctttgggagcctgagctggaactgaaggtggagctgcagcctgggccttggtttgatccttggccttgg

SEQ ID NO: 55513 - DNA, 201 bp, Homo sapiens
ttttgattatttaggaagactccctgcccttcctatacatttcacataatttttaataagttgtaaaaaagtgatttataggattctttgtaagtgggggaagttaagcagacaaaaagtttttaaatcttactgcagagtgtcaggaaccttttatagcaccagacaggtagggacagaacatgagtggcagcaagccag

SEQ ID NO: 55514 - DNA, 201 bp, Homo sapiens
agtttaaaaacaagaataataatgatctgcacttccttttcttcattgcagaaagagacatcgggaagattctgatgtggaaatggtggaagatgattccygaaaggaaatgactgcagcttgtaccccccggagaaggatcattaacctcactagtgttttgagtctccaggaagaaattaatgagcagggacatgaggg

SEQ ID NO: 55515 - DNA, 201 bp, Homo sapiens
tttcatttttggggctctccatcttgatgtgttctttggatcgtgaacagatccaaagaaaaggttgttctgccgtgctgtttgtcaggatgaaaaactcttttttaagtgtttaggtctgcccccagtgcccagcccaatcaagtaacgtggtcacccagagtggcagataggagcacaaggcctgggaaagcactggag

SEQ ID NO: 55516 - DNA, 201 bp, Homo sapiens
ttaggaacctgaggctgaataaagttcaggtaaaagtaaaattagttgagaagagacatctgccaaaagaaatctatttttaacttcacttgctgtctttsctagaggaacagaaatagtgctgaatgtcctattagaaatgatggttgctctgcccgtctcttccctctctctcacacaatatgtaaactcatacagtgt

SEQ ID NO: 55517 - DNA, 201 bp, Homo sapiens
tacagctgaaggaagaacgtgagcacgaggcactgaggtgattggctgaaggcacttccgttgagcatctagacgtttccttggctcttctggcgccaaawtgtcgttcgtggcaggggttattcggcggctggacgagacagtggtgaaccgcatcgcggcgggggaagttatccagcggccagctaatgctatcaaaga

SEQ ID NO: 55518 - DNA, 201 bp, Homo sapiens
gctgaaggaagaacgtgagcacgaggcactgaggtgattggctgaaggcacttccgttgagcatctagacgtttccttggctcttctggcgccaaaatgtmgttcgtggcaggggttattcggcggctggacgagacagtggtgaaccgcatcgcggcgggggaagttatccagcggccagctaatgctatcaaagagatg

SEQ ID NO: 55519 - DNA, 201 bp, Homo sapiens
tcgttcgtggcaggggttattcggcggctggacgagacagtggtgaaccgcatcgcggcgggggaagttatccagcggccagctaatgctatcaaagagakgattgagaactggtacggagggagtcgagccgggctcacttaagggctacgacttaacgggccgcgtcactcaatggcgcggacacgcctctttgcccgg

SEQ ID NO: 55520 - DNA, 201 bp, Homo sapiens
gcaggggttattcggcggctggacgagacagtggtgaaccgcatcgcggcgggggaagttatccagcggccagctaatgctatcaaagagatgattgagarctggtacggagggagtcgagccgggctcacttaagggctacgacttaacgggccgcgtcactcaatggcgcggacacgcctctttgcccgggcagaggca

SEQ ID NO: 55521 - DNA, 201 bp, Homo sapiens
gtttgttatcattgcttggctcatattaaaatatgtacattagagtagttgcagactgataaattattttctgtttgatttgccagtttagatgcaaaatycacaagtattcaagtgattgttaaagagggaggcctgaagttgattcagatccaagacaatggcaccgggatcagggtaagtaaaacctcaaagtagcag

SEQ ID NO: 55522 - DNA, 201 bp, Homo sapiens
aaattattttctgtttgatttgccagtttagatgcaaaatccacaagtattcaagtgattgttaaagagggaggcctgaagttgattcagatccaagacartggcaccgggatcagggtaagtaaaacctcaaagtagcaggatgtttgtgcgcttcatggaagagtcaggacctttctctgttctggaaactaggctttt

SEQ ID NO: 55523 - DNA, 201 bp, Homo sapiens
ttctgtttgatttgccagtttagatgcaaaatccacaagtattcaagtgattgttaaagagggaggcctgaagttgattcagatccaagacaatggcacckggatcagggtaagtaaaacctcaaagtagcaggatgtttgtgcgcttcatggaagagtcaggacctttctctgttctggaaactaggcttttgcagatgg

SEQ ID NO: 55524 - DNA, 201 bp, Homo sapiens
gtttgatttgccagtttagatgcaaaatccacaagtattcaagtgattgttaaagagggaggcctgaagttgattcagatccaagacaatggcaccgggawcagggtaagtaaaacctcaaagtagcaggatgtttgtgcgcttcatggaagagtcaggacctttctctgttctggaaactaggcttttgcagatgggatt

SEQ ID NO: 55525 - DNA, 201 bp, Homo sapiens
tatctaacagaaagaagatctggatattgtatgtgaaaggttcactactagtaaactgcagtcctttgaggatttagccagtatttctacctatggctttygaggtgaggtaagctaaagattcaagaaatgtgtaaaatatcctcctgtgatgacattgtctgtcatttgttagtatgtatttctcaacatagataaata

SEQ ID NO: 55526 - DNA, 201 bp, Homo sapiens
acagaaagaagatctggatattgtatgtgaaaggttcactactagtaaactgcagtcctttgaggatttagccagtatttctacctatggctttcgaggtraggtaagctaaagattcaagaaatgtgtaaaatatcctcctgtgatgacattgtctgtcatttgttagtatgtatttctcaacatagataaataaggttt

SEQ ID NO: 55527 - DNA, 201 bp, Homo sapiens; identical to SEQ ID NO: 24199

SEQ ID NO: 55528 - DNA, 201 bp, Homo sapiens; identical to SEQ ID NO: 24214

SEQ ID NO: 55529 - DNA, 201 bp, Homo sapiens; identical to SEQ ID NO: 24217

SEQ ID NO: 55530 - DNA, 201 bp, Homo sapiens; identical to SEQ ID NO: 24174

SEQ ID NO: 55531 - DNA, 201 bp, Homo sapiens
tgggggtgtccccgggctaccagacctttgtttcttgccagcagcagcaggtacccttccgtgtgcctccacacctactacttcaagcccacaccacctcrgaccctaaaccctcagctcctcagacctgtctaggggcctctccccagctggcctctcacgctctccgggaagcctccttaaccctgtccccccacagct

SEQ ID NO: 55532 - DNA, 201 bp, Homo sapiens
ggtgtgagccaccgtgcccggcctctcccagggttcttgaaaggagtgggagaacccacagctgcttcttgccagcagtgggcaccaggcggtggccagcscacatttgaggccattcttgtcctcagggagaacgtgctggccctggacatcttctttgaggccctcaactatgagaccgtggagcagaagaaggcctat

SEQ ID NO: 55533 - DNA, 201 bp, Homo sapiens; identical to SEQ ID NO: 24208

SEQ ID NO: 55534 - DNA, 201 bp, Homo sapiens
agggcccacccctgaagcctagaccaccatcccgccccagctgaggagaaacaggcaggagggtgtgcagtgacctcgactggtccctgggaggaggaccrctccccacctctgaccctctcgtcctcacacagcttcaggaagggctgggcagccatcgaacccaagttccccacctcagcctgggccccaggtaacaca

SEQ ID NO: 55535 - DNA, 201 bp, Homo sapiens; identical to SEQ ID NO: 24191

SEQ ID NO: 55536 - DNA, 201 bp, Homo sapiens
tcagaggcctgagtgtggggaggtaggctttgactccctagggagagagggacacttaggaaacagacgggccctggaagtgggacatgaagagtgccctrgccatccagtgtaggctgagatgctaggggcacagaaagaagagatctgctgatgccagccttccaaccatttcccagcttggccaagagccagctctgg

SEQ ID NO: 55537 - DNA, 201 bp, Homo sapiens; identical to SEQ ID NO: 24197

SEQ ID NO: 55538 - DNA, 201 bp, Homo sapiens; identical to SEQ ID NO: 24198

SEQ ID NO: 55539 - DNA, 201 bp, Homo sapiens
cgcacctgctaccttgtcacacagctctagacctgctgtctgtgtcctcggagccccgccctgacatcctggacatgcctagcctgcacgtagcttttccrtcttcaccccaaataaagtcctaatgcatcagcctcagctgtttctcttacagggcagagactagccaagccaaggtcagcccaacttaggcattggaag

SEQ ID NO: 55540 - DNA, 201 bp, Homo sapiens; identical to SEQ ID NO: 27967

SEQ ID NO: 55541 - DNA, 201 bp, Homo sapiens; identical to SEQ ID NO: 17013

SEQ ID NO: 55542 - DNA, 201 bp, Homo sapiens
aatgaaatcttttgagtttttagccaaaaattggcatttttaaaatacgaaaatttccttggaattataatgtactgtacctcttcttttttaaataaagrcattttactatatggaaaataactcactaaagcataaattacattatacaaatcatgatcactaatgatgtagtctgtcattcactttgtattaatctta

SEQ ID NO: 55543 - DNA, 201 bp, Homo sapiens
tatgaacagtatttcagccttaattgtgaatttccttgttattcaagtattaaatgaaatcttttgagtttttagccaaaaattggcatttttaaaatacraaaatttccttggaattataatgtactgtacctcttcttttttaaataaaggcattttactatatggaaaataactcactaaagcataaattacattata

SEQ ID NO: 55544 - DNA, 201 bp, Homo sapiens
ccaaactcattactatatccagcattattttaatgttactttcttgatggttctcataattataatatgaaatgtaagttcattgattcacttttcagtcrgtcctacaaagacattaatctcaatatatgtatagagaattagcagcagctcactgcttatgcaaatcagctttgtactggctacaaaacaactaatcca

SEQ ID NO: 55545 - DNA, 201 bp, Homo sapiens
ttggggtaacatttctgtagattttccctgccacctgcccgccatctctaacccagcccgggcactccttccgaagctgcttaagatgccggtggttagtytctagagacggcgagaagcgcgggcacaggcgcacgagctcgcaccaggctgagtgcggagatggggactccatctctctgcaacctctgccaaaagaaa

SEQ ID NO: 55546 - DNA, 201 bp, Homo sapiens
agctgggcgtggtggcgcacgccagtagagtcccagctactctggaggctgaggcaggagaatcgcttgggaggcagacgttgcggtgagctgagattgcrccactgcactccagcctgagcaacaagagtgaaattccgtctcaaaaaaaaagagctaaaaaaaggtgtctttctgatcacctaagactcagaattctaa

SEQ ID NO: 55547 - DNA, 201 bp, Homo sapiens
aatgtctttgtcaagccctctaggtcattttgatccactaaatttgaaagtcacttccctatatataggaaagcaccctttatgtcatattttttttcccytaataaaactataggccgggtgcggtggctcacgcctgtaatcccagcactttgggaggccgagacgggtggattacctaaggtcaggagttccatacca

SEQ ID NO: 55548 - DNA, 201 bp, Homo sapiens
cattccgaaaagaaaacctttagcccaggctccaattataatgaccaagtattaaatatttatgtatgtggctataacaacatactttactagtcttgacsaaaatgtacagtgtgttacaaaacacattgagatatgtatgctgtcagaatagactgatgattagaaattgcctagtcaacacaacagtccgtgattctt

SEQ ID NO: 55549 - DNA, 201 bp, Homo sapiens
aaacaactaatccataaagaaaactaagattgaggtaactaataatttggaaattggtcaatggaaagtggaaaagatcaaggcgctaaagtagtttgcamctgctcataagagagacatgggattaaaatcacgaaaagaacctgaattagaaaccattctatctcaactagagttggtcagttaagaacttggctttta

SEQ ID NO: 55550 - DNA, 201 bp, Homo sapiens
tttcacatcccaatactattttgaaattctaaacaattaaaccaaaattccaataaatataaggttatgccttcaatatattcctatacaattctgtaacmatggtttaaaatacacaagcttaaaataacatgcttagaaatacacaataatatgaacagtatttcagccttaattgtgaatttccttgttattcaagta

SEQ ID NO: 55551 - DNA, 201 bp, Homo sapiens
tgagaggctgaggcaggagaatagcttgaacccgggaggctgaggttgcagtaggccacgatcgtgccactgcaccacagcctgggcaacagacaagactkcatctcaaaaacaaacagaaaagaatatatgagatactcccttagatcacaacctttcttcacctattttaattagccttataataccagtgtattcttt

SEQ ID NO: 55552 - DNA, 201 bp, Homo sapiens
catttctgcattctagccgactttcatgagcttgcgattaaacgtgcatgttacttctaggatttctttacatctttcaaaagttttattttctgacacayaggattgcagaatgagtttccaaaattttcgctggttattaaggaactcactttggttttcagtactagtgaagttaaatgaagttctggttatatgaat

SEQ ID NO: 55553 - DNA, 201 bp, Homo sapiens
ttctgagactcagaatggtttactctaacaaaacactgtgctgtctatcccttgtacttgcctactgtaatatggatttcacttctgaacagtttacagcmcaatatttattttaaagtgaataaaatgtccacaagcagtgttgtcatgtagtcaatggcagattattaaatttctttatttttttcattatcctgttgt

SEQ ID NO: 55554 - DNA, 201 bp, Homo sapiens
tcccaggttcaagtgattctcctgcctcagcctcccaagtagctggggttacaggcatgcgccagcacgcccggctaattttgtatttttagtagagtagyttctacatgttggtcaggccggtctcgaactcccgacctcaggtgatttcgcccacctcagcctcccaaaatggtgggattacaagtgtgagcctccgcg

SEQ ID NO: 55555 - DNA, 201 bp, Homo sapiens
atcattgaaagtcatgataatttctgtcccactgtgtctcattatagagttctcagccattggacctcttctaaaggatggtataaaatgactctcaaccmctttgtgaatacatatgtgtatataagaggttattgataaacttctgaggcagacatttgtctcgctttttttcatttttgttgtgtcttataaactgac

SEQ ID NO: 55556 - DNA, 201 bp, Homo sapiens
tttgttttgtttgagacagagttttcctcttattgctcaggctggagtgcaatggcgcaatcttggctcactgcaacctctgcctcccaggttcaagtgaytctcctgcctcagcctcccaagtagctggggttacaggcatgcgccagcacgcccggctaattttgtatttttagtagagtagtttctacatgttggtca

SEQ ID NO: 55557 - DNA, 201 bp, Homo sapiens
agaattgcagtagtatgtgatagtattatctaggtatgagagattaaactcttggttgtggggtgagttgctggcagtgaaaaagtagaggaagagtctaragctgaaaaatatccaggaaagaactgatgggacttacctgtagaagagaaaaagagatagaagagccgaaaataactacatttagagctagccttacta

SEQ ID NO: 55558 - DNA, 201 bp, Homo sapiens
aataataattacccttttctctacatccaaccctgtcactcccttactttagattctcttcatctctcacctgggttactgtaactcctaacttgactctyttcctctagatttgtccctgctattccttcttccttgccactgctgaagtaatacttaaaaatatcatcacagcacatctttgcctaaatcctataaaat

SEQ ID NO: 55559 - DNA, 201 bp, Homo sapiens
agagattaaactcttggttgtggggtgagttgctggcagtgaaaaagtagaggaagagtctaaagctgaaaaatatccaggaaagaactgatgggacttayctgtagaagagaaaaagagatagaagagccgaaaataactacatttagagctagccttactaaaaattagttatgttattcagagaaacaaggaataaag

SEQ ID NO: 55560 - DNA, 201 bp, Homo sapiens
atagcaggtgtatatatttatggagtacatgagatattttacatatactcttttgttgttgttgttgtttttgagacagagtttcactctttcccctaagytggagtgctgtggtgcaatcttggctcactgtggcgcaatcttggctcactgcaacctccatctcctgggttcaagtggttcttgtgccttggcctcctg

SEQ ID NO: 55561 - DNA, 201 bp, Homo sapiens
gctactcaggaggctaaggtggcaggatcatttgagctcgggaggcggaggaggttgcagtgagccaagatcacaacacagcactccagccagggtaacasagtgagactccatctcaaaaaataattaagaaaatgaggccgggcacagtggctcacgcctgtattcccagcactttgggaggccaaggtgggcggatca

SEQ ID NO: 55562 - DNA, 201 bp, Homo sapiens
atataaaagtcgtgctagcatatagctgtagtcccagctacacagcaggctgaagtaggaggatcacttgagcccaggaattcaaggttgcactcaacctrggtaaaaagagtgagaccctatctcaaaattaattaattaaataataggtttaatctgccagtcgagaaaaattgaattttttaaagctacagatgataa

SEQ ID NO: 55563 - DNA, 201 bp, Homo sapiens
aaataccccttagccttgctcaaagatacccatttctgatttatgacattgtagattagttttgtctcttttttggattccacatgaatggaatcatatastgtataatatttctgtacctgaactctgactcagtgtaacacttttttttggtggtgttttgtttagttgattttttttctattgatacatagtatttgt

SEQ ID NO: 55564 - DNA, 201 bp, Homo sapiens
gtatccaccatatatttattggaaacccatatactgtctaatttttataaatcattcattcatttataatcggtgcactcactttttaaattcaggtctasattcatttctttgccagtcaatacccatttaaccaccagatcctaattttttaacctctttaataataattacccttttctctacatccaaccctgtcac

SEQ ID NO: 55565 - DNA, 201 bp, Homo sapiens
gcccttttaaccacttctctacactgcctccccattttaatatattgtcttccattttcatctgcctactgggcatagccatatatacatttttaataatytcacactcatcatttttttctctttcatactgacccttttcttgccttctcctgtgttctacccaattgaccaattagaaacctaagtcttttttcttac

SEQ ID NO: 55566 - DNA, 201 bp, Homo sapiens
gataacaatttttaaatgtatatgtgactttttaaataaatgattgtttataaataagtctgtaggtaccccatgctttctcattatcttagcccatgccsttttcttcctcctaaaatgccctaattgcctcttatccatccttcaaggcaatgacttctttcaagatgaaacaggagaggcagcatggtaaaatgggaa

SEQ ID NO: 55567 - DNA, 201 bp, Homo sapiens
cagcgatgacatccctttccgagtcaactggcccggcaccgagttctctctggtcagtgccctcactaaccccgcagccacccctcctcctgacactaagkgttcggcctcttccctcggttttctttgctttttctccccaagaccttctctgcagactcttaccttccccaagccaaagctgcttttatgcagcgttca

SEQ ID NO: 55568 - DNA, 201 bp, Homo sapiens
cttaaattaagaaaatgaattagccgggagtggtgccgcatgcctggaatcctagctactcaggaggctaaggtggcaggatcatttgagctcgggaggcrgaggaggttgcagtgagccaagatcacaacacagcactccagccagggtaacagagtgagactccatctcaaaaaataattaagaaaatgaggccgggca

SEQ ID NO: 55569 - DNA, 201 bp, Homo sapiens
tgcagtttaaaaataataacttaagccataactgaaaaaagaaattaagtttggcatggaaacccttaaacgtgtgtgtttaattttaggaagatttgcartcaactaaagaagagagatttccagcgatccacaagtcgattgctattggctctcagccagtgctcactgttgggacaacccacatatccaaattgacag

SEQ ID NO: 55570 - DNA, 201 bp, Homo sapiens
cctcctaaaatgccctaattgcctcttatccatccttcaaggcaatgacttctttcaagatgaaacaggagaggcagcatggtaaaatgggaaggacaccrgcctaggagccaggaggctgaggtataggctatagctagctgtggaaccttgaacaaatttgaaactgacttcctccactcaataaatttattaagccaa

SEQ ID NO: 55571 - DNA, 201 bp, Homo sapiens
ggacaacccacatatccaaattgacagatgaccaactcataaaagagtttcttagtggttcttactgctttcgtggggtgagaagtaaatcttcagtttamatatttattttacaactttacctgccaggtatggtcagtgggcatcagcagcactgaaaagaatttttctctagagaaatgacaggatcctttcatcccc

SEQ ID NO: 55572 - DNA, 201 bp, Homo sapiens
gagacaccatgcccggccgcaaccaattattaacgttttgaatgaaaatctaactccacacttgctttctttatagaaattagggttttaaaacaagataacaatttttaaatgtatatgtgactttttaaataaatgattgtttataaataagtctgtaggtaccccatgctttctcattatcttagcccatgccctttt

SEQ ID NO: 55573 - DNA, 201 bp, Homo sapiens
gcataattataagtgtcatttaatgaaagcttactctgaaatcttaggggaagtctcagctgcttcaaatatcagaaagtaattcagctgagttatgtggsttttgtgcattgaaatatatccatcttttttagattgagtcttattggacttacgaagtatgtcatggaaaacacattcggcagtaccatgaagagaaag

SEQ ID NO: 55574 - DNA, 201 bp, Homo sapiens
gggcgtggtggcagacgcctgtagtcccagctacttgggaggctgaggcaggagcatggcatgaacacaggaggcggagcttgcagtgagccgagatggcrccactgcactccagcctgggcaacagagtgagactccatttcaaaataaaataaaatactgaaatgggcttctgaactgtcccttacaaaactttcaaag

SEQ ID NO: 55575 - DNA, 201 bp, Homo sapiens
cccctcaagcatttgtcctttgtgttacaaacaatccaatgagactcttttagtattattgactatagtcaccctgttgttctatcaagtagtaggtcttrttcattctaagaggttttttttgtacccattaaccatccccacctccttcacaacctcccactacccttcccagcctatagtaaccatccttctactctc

SEQ ID NO: 55576 - DNA, 201 bp, Homo sapiens
ttgccatgttggccaagctggtctcgaactcctggtctcaagtgatctgcccaccttggcctcccaaagtgctgggattacaggcgtaagccagtacaccsggccgagtatataatagaattttaatttaaattgctaattgttattttttaagctatgtagaaaattgtccctaagccaggtaattattacagaccccaa

SEQ ID NO: 55577 - DNA, 201 bp, Homo sapiens
ggatcacctgagtccaggaggtcaggctgcagtgagctgtgatcatgtcactgcactcagcctgggttagtgaaagaccctgtctcaaaaaaaaaaaaaaagttattgttaaattgagaatagaacaaaggtccttaataagaagaggttctccttgccaggaatagccaaatagtaccatagttgcacagtaccataaga

SEQ ID NO: 55578 - DNA, 201 bp, Homo sapiens
acttgagcccaggaattcaaggttgcactcaacctgggtaaaaagagtgagaccctatctcaaaattaattaattaaataataggtttaatctgccagtcragaaaaattgaattttttaaagctacagatgataatgctttaaaaatatttagcataggccaggcacatggcccacgcctataattccagcactttggga

SEQ ID NO: 55579 - DNA, 201 bp, Homo sapiens
tggacatttgtatctaactaatatgcagctgtatgaaataggataaggtcctttgtctgtttactaactgaaattggaagagactggattagaagatctgmattttttaagctttaaaattgtctgctttaaattgtcttcccattcagatatatcaaaacaatatataattatttacaatcttgctttcagatttgctta

SEQ ID NO: 55580 - DNA, 201 bp, Homo sapiens
actatgatgtcaaaacaagatgtgtcaagttaatggatgttattaccacatagctttctatttgcaagtgttaggggttttttggtttggtttggtttggkttgggtttttctgtttttgtttgttttttgagacagggtctcagtctgttgcccattctgaagtgcagtggtacggtcaccactggctgcagcctcgacc

SEQ ID NO: 55581 - DNA, 201 bp, Homo sapiens
taaaaattctgaaataggtttataagaattgttcaggaaactgatacttaaaaaccttttttccctccattcttgccttgtgaaaagcaaaaatacatttwaaaaaaacctttttttaagaaagcatgaactctgtgaagattattttacggctccatattttatacttcagttatttgaaagcaatggcgtaccgtaggg

SEQ ID NO: 55582 - DNA, 201 bp, Homo sapiens
ttttcaatgtagaaaataaatattcacgagtactaccttgggaatatgttggccaagaaccttctatttgaaaaaggttggtgtctacccagtgatttgasagtaatgctggaatttggtttaaaatatatgttcaaaatggaatttacgagattttttttttggacattgtgtgaattttaaaatactgaaataggctgg

SEQ ID NO: 55583 - DNA, 201 bp, Homo sapiens
ataagtgtcatttaatgaaagcttactctgaaatcttaggggaagtctcagctgcttcaaatatcagaaagtaattcagctgagttatgtggcttttgtgyattgaaatatatccatcttttttagattgagtcttattggacttacgaagtatgtcatggaaaacacattcggcagtaccatgaagagaaagaaactggt

SEQ ID NO: 55584 - DNA, 201 bp, Homo sapiens
aattatattaaatcatacagggtccacttgagtgggatttttaagagtacagttattaacagtgatcttactttaaatgatttggacagtaccttaaagtkctctctgttttaggtgcaaagaatcagattcacctcatgctgttactgtatatatgctagagcctcactcctgtcaatatattcttggggtaagttaaaa

SEQ ID NO: 55585 - DNA, 201 bp, Homo sapiens
acactgtgctgtctatcccttgtacttgcctactgtaatatggatttcacttctgaacagtttacagcacaatatttattttaaagtgaataaaatgtccmcaagcagtgttgtcatgtagtcaatggcagattattaaatttctttatttttttcattatcctgttgtacacattttaaacatacatatctgaacaagaa

SEQ ID NO: 55586 - DNA, 201 bp, Homo sapiens
cttgttttgaggattaatgagttaatgaatgtaaaacacttaaaacagtactgtcctagaactaatacagctagtacttactgctttgttttgttttttttgtcttagggaaaatgctgtaatttgcttttgtgtttaggattacagtggtgccaagtagtactggttttattatagttaaacagttgttaggccagggca

SEQ ID NO: 55587 - DNA, 201 bp, Homo sapiens
gaagaaagaaggaaggatttccacatataagacagtatatagttagtgtttaaaaaataataaaagcagaatgggaaaaggggtttctggacagacagttscaatagagaaataagtatggtaccaaatgaatagtgtaaagatcagtataacattgcgtaggatgaagtcaggctgcagtggaagagatagaggccaaag

SEQ ID NO: 55588 - DNA, 201 bp, Homo sapiens
atacacactcaaagacgagaacaataaacactggagattccaaaagacaggagagagggaggggtgacaaactacctatgaagtattaggatactatgttsaatacttgggtgacagggatattagaagctcagacttcatcatcatgcaatatatccatgtaacaaacctgcacatgtaccccccgaatctaaaattttt

SEQ ID NO: 55589 - DNA, 201 bp, Homo sapiens
attgtcttcccttttttgctgtggttccaaacaagcagtttctttttacatttgaagcattttggagaccattttgaaaggaattacaaatgttatgtctyatagcaaatcgttggcacaattgaataaatgtttctaagaaattctttatcataagtttagctttgcaactgttactttcaaatctctttgattccctca

SEQ ID NO: 55590 - DNA, 201 bp, Homo sapiens
gaccaactcataaaagagtttcttagtggttcttactgctttcgtggggtgagaagtaaatcttcagtttaaatatttattttacaactttacctgccagrtatggtcagtgggcatcagcagcactgaaaagaatttttctctagagaaatgacaggatcctttcatccccaaagaacattttctttttgcagtctcata

SEQ ID NO: 55591 - DNA, 201 bp, Homo sapiens
acccttaaacgtgtgtgtttaattttaggaagatttgcaatcaactaaagaagagagatttccagcgatccacaagtcgattgctattggctctcagccastgctcactgttgggacaacccacatatccaaattgacagatgaccaactcataaaagagtttcttagtggttcttactgctttcgtggggtgagaagtaa

SEQ ID NO: 55592 - DNA, 201 bp, Homo sapiens
gtatttccattactgtcatgtggcattattgagaaaggcccagttcttaacttgatctaatatgttttctttttttttagggtgtcggttggtggaaataygaattctgctatggcaaacatgtacatcaataccatgaggtatagaatagcatttatatatcattctaccactagatggtttaaagtttaagaatctgtt

SEQ ID NO: 55593 - DNA, 201 bp, Homo sapiens
ttcctctagatttgtccctgctattccttcttccttgccactgctgaagtaatacttaaaaatatcatcacagcacatctttgcctaaatcctataaaatratgtccaaacctctcagcatttagttttctaccatatagcacctgcttctctctttagatttaaatatcatacccccacatctttggttttacctcttcc

SEQ ID NO: 55594 - DNA, 201 bp, Homo sapiens
acagaaccggcccagatcaagtactgtgatgtacatatgtcatcctgaatctaagcatgaaattctttcagtagctgaagttacaacttgtgaatatgaarttgtcattttgacaccactcttgtgcagtcatcctaaatataggtaggatgtgcatttaatattttaaacataaaatgcacacatgctttaaagtgttct

SEQ ID NO: 55595 - DNA, 201 bp, Homo sapiens
atgctaagtgctgcaaagtccattatcttaaagtgtattaaaagcaagtggacaatttatttttcaaattttctgcagtttaaaaataataacttaagccrtaactgaaaaaagaaattaagtttggcatggaaacccttaaacgtgtgtgtttaattttaggaagatttgcaatcaactaaagaagagagatttccagcg

SEQ ID NO: 55596 - DNA, 201 bp, Homo sapiens
ttcaaattgaagtcccggaaaaagcaaaatttttttaaactttttattccaattaccttcaagcattcaacttgcaatactttattatattctttcattaycatttcattgaaacagtaagtgacactatgatgtcaaaacaagatgtgtcaagttaatggatgttattaccacatagctttctatttgcaagtgttaggg

SEQ ID NO: 55597 - DNA, 201 bp, Homo sapiens
agaaattaagtttggcatggaaacccttaaacgtgtgtgtttaattttaggaagatttgcaatcaactaaagaagagagatttccagcgatccacaagtcrattgctattggctctcagccagtgctcactgttgggacaacccacatatccaaattgacagatgaccaactcataaaagagtttcttagtggttcttact

SEQ ID NO: 55598 - DNA, 201 bp, Homo sapiens
gtattaatgccacaaaatattgatacattgaaatacctatgtaaaattttgttatgaatcagatataactttagcaggcttggaagagaatactttaatayctgttgttgtatccaaagagcacacttggagtgaatatggcagatgtttgaagaattatgtcattaaaattttttactcttggcacctgtgtttttttta

SEQ ID NO: 55599 - DNA, 201 bp, Homo sapiens
tgtattaatgccacaaaatattgatacattgaaatacctatgtaaaattttgttatgaatcagatataactttagcaggcttggaagagaatactttaatmcctgttgttgtatccaaagagcacacttggagtgaatatggcagatgtttgaagaattatgtcattaaaattttttactcttggcacctgtgtttttttt

SEQ ID NO: 55600 - DNA, 201 bp, Homo sapiens
ctttgtgaagtcttcatatttcagttcttggtcaaagcctatttgagccacctcttcctctgtgagtctactgtcctctgtgcccttactgccttttttttctttgagacagagtctcactctgtcacccaagctggagtgtagtggcgtgatctcagctcactgcaacctccacctcccaggttcaagagattatcatgc

SEQ ID NO: 55601 - DNA, 201 bp, Homo sapiens
catttcttttcattgattttaatccttttccttattctagtactactcaaactattttaatattctcttatattcataatttcataatattttaaagtttsacatcctactcattataatttaatttttaggtatttgtcccagctaaccctcttgaaaaatagactaaaaccctatctctgtctcctgatacattattaa

SEQ ID NO: 55602 - DNA, 201 bp, Homo sapiens
ctttcttaggaagaagaaaaggattataaaggccctaatccaagagagcttttggagccactatttaaacaaagcagttgttcctacagagtatgtatttyatgtttacttgatgactagaaaatagattaccaacagccaacagacctttgaaaataccgtttcttctttattatgttgtgtcaggtttttttttttaac

SEQ ID NO: 55603 - DNA, 201 bp, Homo sapiens
tgagatccctgcctccaaagagcttgtttggagatattattaacagtgcctttttaaagttcttagagtggatttttcttgtgtttatgtagagaaaagtrtaggagctaacttcttagtgatctttgtcttctcaggttctatcctttattccttcattccatgaaaaatttttaatttgtcttttgctggccttgagta

SEQ ID NO: 55604 - DNA, 201 bp, Homo sapiens
cggggtttcactatgttagccagaatggtctcgatcttctgccctcacgatccgcccgtctcggcctcccagagtgctgggattacaggcatgagccatcrtgcccagcctccacttggttcttttttatctctactgaaatttcctatctggtcatacatgttttcttcatcatgtttagtataattattataacatttg

SEQ ID NO: 55605 - DNA, 201 bp, Homo sapiens
aggcaggaggatcacaaggtcgggagattgagaccatcctggctaacacggtgaaaccccgtctctattaaaaatacaaaaattagccgggcgtggtggcrgacgcctgtagtcccagctacttgggaggctgaggcaggagcatggcatgaacacaggaggcggagcttgcagtgagccgagatggcaccactgcactcc

SEQ ID NO: 55606 - DNA, 201 bp, Homo sapiens
ccattgaatgaatttatcactgatgtattttttatctcttaacatttccacttggttctttttgttgttgttgttttttatttacttatttttttttttttgagacagagtctcgctctgtcacccaggctggagtgcagtagcgcaatcttggctcattgcaacctccacctcccgggttcaagttattctcctgcctca

SEQ ID NO: 55607 - DNA, 201 bp, Homo sapiens
aatccctgtttagtttttttcaagggatatcttttaggttagttttcttttcttagggaagcaacacagtgtaatagttcagagcacagtccctggagtcrgactacctggattcaaatgctggctcatcacttcctaccttggagaaattacatcatcttttttatctctcacttttgttgtgtaatggtatttgcctca

SEQ ID NO: 55608 - DNA, 201 bp, Homo sapiens
gactccatctcaaaaaaaaaaaaaagaataatgagacaaagtatatgaaatggaaattaacccttcatgtttaggatggtcgtaactgatagatggaactracatttgtctggagctttctctatgctaagtgctgcaaagtccattatcttaaagtgtattaaaagcaagtggacaatttatttttcaaattttctgcag

SEQ ID NO: 55609 - DNA, 201 bp, Homo sapiens
tcccgagtagctggtattacaggcatatatggtaccacgtccggctaatttttgtatttttagtagagacagtgtttcaccttgttggctagcctagtctygaactcctgacctcaagtaatctgcccgcctcggcctcccaaattgctgggattataggtgtgagccacccgcacccagccccattttcttattaatgtc

SEQ ID NO: 55610 - DNA, 201 bp, Homo sapiens
tttcttctttattatgttgtgtcaggtttttttttttaactattattttaggtttagggttacctgtgcaggattgttatataggtaaactgcatgtcacyggggtttggtgtacagattatttagtcacctagataatgaatatagtacctgatgggttggtttttttttttttttttcttttaatcctctccctcctcc

SEQ ID NO: 55611 - DNA, 201 bp, Homo sapiens; identical to SEQ ID NO: 28485

SEQ ID NO: 55612 - DNA, 201 bp, Homo sapiens; identical to SEQ ID NO: 28554

SEQ ID NO: 55613 - DNA, 201 bp, Homo sapiens
tacttcactcctatgggtttaggttggggcctgcctggaggcaggggactgaatctgtagccctgtccactaagctgcccagggagtctcctcatggctcrtttccctgatttggtgggaacctgggaaacccctgctctggagttaacagttaacattctggagttaactcaacgttcattcagcccatctggagtaacc

SEQ ID NO: 55614 - DNA, 201 bp, Homo sapiens
tgcagcagtttttttttttttttttaattgagacggagtctcactctgttgcccgggctgaagtgcagtggcacaatctcagctcatgcagcagttttttwaaaaatgaggcactgaatgttcatgtctccattgatgagaaaaatgtcctctctaacccttttcttatgctattcccctttcctattctctctgatatca

SEQ ID NO: 55615 - DNA, 201 bp, Homo sapiens
cactcacagtttactaaggacttaaaggtaggccatgtttgtgatcactgccatgaaaacattgagcaacagatcctcggtcaggagactaacctgctatyacaacgttgttcctgtggggaaatctgcttctgtcttttcaataaacattagccgtcccgagactgtagcacacagtctgagaaagtgaggaatgaggat

SEQ ID NO: 55616 - DNA, 201 bp, Homo sapiens
gcaggctgtttctctggcatttgaattccttctatagcattcctgacaaagggtatgtaacgtcttcttgacaacctccaatggcagctcactaccttccraggcaggccacttggcctctgactgtcaatattcaacagaacatttctctgaacccggtttttgtccccatatagcttttatcccttgatccaagttcta

SEQ ID NO: 55617 - DNA, 201 bp, Homo sapiens
ggagcaatgaggtagagggtgttctgggaggagtctgatatctggactctcgaggggttctttctgtcattgtaactccaacaaaggggcattccgacgamgtcccatatgatgtggccccaggccatctctctgtactcttgtccttcccctctctctcccttgtttggatccagcccctctggcctccactctcttctt

SEQ ID NO: 55618 - DNA, 201 bp, Homo sapiens
ctcagcaaccatggagaactgtccttgaccccaacccctctgaatccaacccacctcatgcctagtcctgcagcattcagagccccatatagattgtggargtgaggcccctgatgctgtctgaggagcctttccaagcaacaggggcaatgacttggccaggcaggcagggtcagacacagaagggcagtgcatcagtca

SEQ ID NO: 55619 - DNA, 201 bp, Homo sapiens
gcagcattcagagccccatatagattgtggaggtgaggcccctgatgctgtctgaggagcctttccaagcaacaggggcaatgacttggccaggcaggcakggtcagacacagaagggcagtgcatcagtcattccaaagttgctggcttcatagatacggtgattgtatctattggctttgtcttcagtgcaaatccaga

SEQ ID NO: 55620 - DNA, 201 bp, Homo sapiens
atcagtcattccaaagttgctggcttcatagatacggtgattgtatctattggctttgtcttcagtgcaaatccagaagcaaacccttctttcctgttacytcccagctcacagccaccctcatctcttgcctggattacggcagcagtgtcctgactgatttccctgcttcctctctctcaccttcagttcattctcagc

SEQ ID NO: 55621 - DNA, 201 bp, Homo sapiens
cttgaccctattgagctgggtcaagctcgcccagcacagcttccactctgagctctagagcccagagcagctggaagccctgggagaagcatgctgacacraggggttaacttgcatctccccatatcttccccactgggtgttccagggctaagagaccccctgggtccctctccctctttcccattaacccctgacctg

SEQ ID NO: 55622 - DNA, 201 bp, Homo sapiens
ctgctatgctccccagcaggggtgggcatagggacaatcacggtatctatgaagccagcaactttggaatgactgatgcactgcccttctgtgtctgaccmtgcctgcctggccaagtcactgcccctgttgcttggaaaggctcctcagacagcatcaggggcctcacttccacaatctatatggggctctgaatgctgc

SEQ ID NO: 55623 - DNA, 201 bp, Homo sapiens
gattagctaaggaaagaagaagaggaaaagcaccttcttctgggcctgcgaaacatcagaaagggattgcaggggcctggagggggctgcctgcagggctstccagatacgcgtggacaagccctgtctggaggatggggatgctggctccgggaccgctgcagggtcgccgacccaggaagggtcacaaaggagagtagg

SEQ ID NO: 55624 - DNA, 201 bp, Homo sapiens
ggtgggcatagggacaatcacggtatctatgaagccagcaactttggaatgactgatgcactgcccttctgtgtctgaccatgcctgcctggccaagtcaytgcccctgttgcttggaaaggctcctcagacagcatcaggggcctcacttccacaatctatatggggctctgaatgctgcaggactaggcatgaggtggg

SEQ ID NO: 55625 - DNA, 201 bp, Homo sapiens
atttctgaagtgtgatctaaaagggggagaggcagctacgggtgaatgcaccgttgtctccttgcctatggaggagagccagagctgcctttctgtagtayaggccagggcagcagccttcttgccttggtgtaggggtgatattgtctgtgcttgtggcttcctggggtaatcaggtagggaatagaccgacaggcatcc

SEQ ID NO: 55626 - DNA, 201 bp, Homo sapiens
agggctctccagatacgcgtggacaagccctgtctggaggatggggatgctggctccgggaccgctgcagggtcgccgacccaggaagggtcacaaaggasagtaggtcgaggccgagggagagagacgagggcaggtggagggaggcgcgggagacaagaggttgccaagagcccccggctctgcccaggccgtgcccac

SEQ ID NO: 55627 - DNA, 201 bp, Homo sapiens
cttcccaagatcaagttccttacactagtgccccaggccatccatgtcacctctctgacctaattgatcactcttcttcctggctctctcccctgagcatsactggctcttcattgtttcttgaacaccttagggtccttgttctggctgttctctttgcccagaatggctctcctctggatttcccaatggcttaattct

SEQ ID NO: 55628 - DNA, 201 bp, Homo sapiens
tgactgatgcactgcccttctgtgtctgaccatgcctgcctggccaagtcactgcccctgttgcttggaaaggctcctcagacagcatcaggggcctcacytccacaatctatatggggctctgaatgctgcaggactaggcatgaggtgggttggattcagaggggttggggtcaaggacagttctccatggttgctgag

SEQ ID NO: 55629 - DNA, 201 bp, Homo sapiens
gacctcttcattttctctctggttagacagagtttaaatggctttacctgactttggaagactcctgaggagtctaagcaggtccagccagtgggtacagscttgaagaccaacagggtgggctggcagatgagacagtatcagcatctcagtccaggcgtcccagccaggaccaccctaaccaccaccaggaggatggaa

SEQ ID NO: 55630 - DNA, 201 bp, Homo sapiens
ccacaccttgtccataaactgcccctcagctaccttcagacccaggatacaggtaggcattttagtccatcttcagaattcccatctgtatttctgaagtrtgatctaaaagggggagaggcagctacgggtgaatgcaccgttgtctccttgcctatggaggagagccagagctgcctttctgtagtacaggccagggca

SEQ ID NO: 55631 - DNA, 201 bp, Homo sapiens
cttctcacctgcagctccagcccacactgtgaagagccttgtgcccacagctgtgcacatcctgggcttcctccacaccttgtccataaactgcccctcarctaccttcagacccaggatacaggtaggcattttagtccatcttcagaattcccatctgtatttctgaagtgtgatctaaaagggggagaggcagctacg

SEQ ID NO: 55632 - DNA, 201 bp, Homo sapiens; identical to SEQ ID NO: 46665

SEQ ID NO: 55633 - DNA, 201 bp, Homo sapiens
tgtgaggcaccgcacccggcctgtgtgctcctctttgagtaactattaccatgtatgctgctcaattacatttcagctactcaaggcccagtcagactgcrgtgactctggggaggggttaataataataattattattattttgcctctctgggaacaaggaagttttgggaattacccaatcatgatccttccagagtt

SEQ ID NO: 55634 - DNA, 201 bp, Homo sapiens
agaatggctctcctctggatttcccaatggcttaattctcacgtccttcaaatctttgctcagttttctccctcttagtgatgtctaccacggccacctcrtttaagattgcagcacccacctgcctgcgctcctcatcgcccttatccccccctcctacactgcttttttccctttaatctgtagcacttatcctcttcc

SEQ ID NO: 55635 - DNA, 201 bp, Homo sapiens
aggcatgtgccaccatgcctggctaattttgtatttttagtagagatggggtttctccaggttggtcaggctggtcttgaactcctgacctcaggtaatcracctgcctcggcctcccaaagtgctggggttacaggcgtgagccaccacgcccagccaaaactaactctttctgtatttccaggtttggtaaatggtacc

SEQ ID NO: 55636 - DNA, 201 bp, Homo sapiens
ccagatgcttacacaggcagagatctttctggaagggctttcatggatgctcattcccagcatggcagctcctccactctgctttgctgactcctcctctycccactggcctcagcttgactctccttcctcagggaggcccttccctctgtactcccgccagctatattttgatcccttgttattctggctcttggtttt

SEQ ID NO: 55637 - DNA, 201 bp, Homo sapiens
tgtctccattgatgagaaaaatgtcctctctaacccttttcttatgctattcccctttcctattctctctgatatcatgtttcatgagccctttgccctakcagctcttgtatttgtcttttgtacaggagaacagatgcaaaaactattgctcaaggaaaataaagtgaaaacgaggaaaagcaaaagaagatctggaga

SEQ ID NO: 55638 - DNA, 201 bp, Homo sapiens
gtgatgtggatctggaggccagctgtgctgatcctttgtccaaggtgaagtgattgcccaggaactggggagaagagggaaggtccttggacagggctgayatcctaggtggggagattgaagccaccctgggaaaatagtacttcaaacccacccctgtttcttcaatacctctttcctcgctgttatcaagactggatt

SEQ ID NO: 55639 - DNA, 201 bp, Homo sapiens
agccaggccagccctttctcctgcattccacactcacatacctgcttagatgtttaacagatgtctcaaatgtagcatgtcccacatactgcctctacccyacctattgtcttccctgtctcagctgatggggactccgtccttgtttaactcctttttctctctcaccactctcccaccacatccactgggtcacgaggc

SEQ ID NO: 55640 - DNA, 201 bp, Homo sapiens
tctcatccagagctgctttgatctgaggtggggccctggagatgaacgaaagaaaggtggggagtgctgtgtattttttccccacaaatccaccagggctsattgtcagatcctgggctttcctttccacatcatttttagggactgaggccagttttgcatgattcagtgaccaggcatgtggcctgactgtaggtggca

SEQ ID NO: 55641 - DNA, 201 bp, Homo sapiens
gagaccacttgaggaaaaggcttctgagaggaggagtgcctggggctgagcctggaagtgatggctggagaccaagatggataaagaaggatattctcagytgggaggcagagggggaagcctggttaaaggggcagagtacatgagtatgtcaggtgcaagggacagagaagagccgagtctgtctggaatcgagggtgc

SEQ ID NO: 55642 - DNA, 201 bp, Homo sapiens
accgaaggcttgggggagagggagggaggaggaggctgagtgtcctagagcggctgaggccggaggcctggtgtccccagcctaagcagagggccccgggrgccgggtgggtgggggtctgtctggacgaattgttctgtgtgtgaggtctgagctctgaggcagcagtgttagcacaataaagaaacattgagacgtgag

SEQ ID NO: 55643 - DNA, 201 bp, Homo sapiens
gggccggggagggttgcttctgtcgctcgcctcgaccacgccccctctcctccctcctgcttagatccctggcagtcagagctggaaggggccatccaggrcaactcctctgaacaacatacaaagtgcagataaaaggaaaacaaagacaaaaagaattagctcagaatatctacgaccgtaaaataaactgaggaaccg

SEQ ID NO: 55644 - DNA, 201 bp, Homo sapiens
ttcctgtgctgagaaagattaaacttaaaaaaaaacagttaggtccatcctaaatgcccaagatttaagaaggaacctcatagttcaactgggtatttgawgaatgtgaatgattttgtatttgatgagctgatgaggacagtatagtgatgcagagggtaggtgcttgtacatctgaattgtctgggctgtttcttattt

SEQ ID NO: 55645 - DNA, 201 bp, Homo sapiens
aaaaacagttaggtccatcctaaatgcccaagatttaagaaggaacctcatagttcaactgggtatttgatgaatgtgaatgattttgtatttgatgagcygatgaggacagtatagtgatgcagagggtaggtgcttgtacatctgaattgtctgggctgtttcttattttatatgtaatttatttgtatttaaagagtt

SEQ ID NO: 55646 - DNA, 201 bp, Homo sapiens
gctgggaaaggccttggctggatttataatgagctgtgtttactgagcattatgaagtaaagttcaatatgattactctgaagtctgacctaaaaaaaatsctactccttcactatacagatagggaaactgaggcccctcaggctggactttaaatccccaatcttacttttccattttattctagaaggtcagttgaga

SEQ ID NO: 55647 - DNA, 201 bp, Homo sapiens
ggactttgtgtttcatttgtttggcctgccttgattttatttggtcatccttcttgattctttcatattatttgtttacacttaactctggaatattttgrtggttgttttcaatgtactgtaggtctttaaattggtttataatgaattattgaggagaatagcaagttgttgacattatatctgtctgtagtaacatta

SEQ ID NO: 55648 - DNA, 201 bp, Homo sapiens
attctcccaggccccctgtccttgggaagggatgtgcactctgcaggtattagtgattttatatagctgcatgagttgctgggaaaggccttggctggatytataatgagctgtgtttactgagcattatgaagtaaagttcaatatgattactctgaagtctgacctaaaaaaaatcctactccttcactatacagatag

SEQ ID NO: 55649 - DNA, 201 bp, Homo sapiens
ctctatttttctagagagatgcaaacagcacaaagttatgctacttctattaaatactacataaattgtcttcatcctacttcctagttccgccttttccrtctctcccccgccttgctggagctgaattctggttcctcaggtcactgaagaattattgagagaatttgtatccccttggttccaggttactcttttgat

SEQ ID NO: 55650 - DNA, 201 bp, Homo sapiens
gtctgtgcttgtggcttcctggggtaatcaggtagggaatagaccgacaggcatcctgttaggcttgtcctttctagacgcagcctccagaagaataaatrctccattagcagctggctggagctggctgaggctctggctggtgactctggcctctggtgtagacttccctcaggtgagtgcatggatgagagctctacc

SEQ ID NO: 55651 - DNA, 201 bp, Homo sapiens
tcctgcacaagggggttctctgtctctggacccactctgtcagcatggacatcctttttctttttccctggtaaggacatcagaaagaaagttacccctcyagtgtttggagtcttggaatccttggcctgcctgcaggcctctgaatcctcagtgtgttagcccaaggtcaccttaggtaaaggaacatttctcctggtc

SEQ ID NO: 55652 - DNA, 201 bp, Homo sapiens
ctttcttgagaactcagaatgcctctctgcgctgacctgtcttaaaattaatgtggcggacaaagtttgtattagagactgctccctcagcttagggaggmgtctaatgacaacagctaatgcctgtggttacctccaggacatgaggtggaaaatgccacgtgtgttctcccagatccttctcagaggtgcatgtgaaca

SEQ ID NO: 55653 - DNA, 201 bp, Homo sapiens
ccagatccttctcagaggtgcatgtgaacattgccctccccaagcgcgctcatcacctggtgagcagagtcagccagggcctggggaacagcctcacaggwgctctgggcctcccaggcatagggcgtgggccatgtcaggctcagctctgcaggataggtcacagtttaacagactctgttgaaagctctttcctgtccc

SEQ ID NO: 55654 - DNA, 201 bp, Homo sapiens
catgcaggcttctcactcacagtttactaaggacttaaaggtaggccatgtttgtgatcactgccatgaaaacattgagcaacagatcctcggtcaggagmctaacctgctattacaacgttgttcctgtggggaaatctgcttctgtcttttcaataaacattagccgtcccgagactgtagcacacagtctgagaaagt

SEQ ID NO: 55655 - DNA, 201 bp, Homo sapiens
accctgggtgtctgtggattgttagggattttctgggactgttaggctgtcaggttgttatcaatgaggggcaggagggatcccagggtatttctgagcakcgaagagagaggtccaggctaccaactggttgtgtcttctttgctggggggtgggagcgggggtagtggctccctggtctgggagcaggactgcagtgag

SEQ ID NO: 55656 - DNA, 201 bp, Homo sapiens
ggttttttcctaggattcctgcaataacttcattttcctgccttcactctcggcaccttcaatccattctccatgcagctgccagcgtgatcttttaaaaygtgagtctgatcatgtcatttcctgtcttaaagctcttcagtggtctgcttttacatttataattaacttttaaattctccatgtcctatcagaccctgc

SEQ ID NO: 55657 - DNA, 201 bp, Homo sapiens
gcctggaagaggaggtgcagatgtggaatctcttggcctgagagttttgccttcctcagtggaggagatatctggagaatgcccattttgtctagctgcaygttccccaccctctgagttaaccacttcgttaaaaagtgtgttttggcgatgtgcttactgagtgtcaccagtaggactgtgtgttaaacctgatccttc

SEQ ID NO: 55658 - DNA, 201 bp, Homo sapiens
ccacttgaggaaaaggcttctgagaggaggagtgcctggggctgagcctggaagtgatggctggagaccaagatggataaagaaggatattctcagctggsaggcagagggggaagcctggttaaaggggcagagtacatgagtatgtcaggtgcaagggacagagaagagccgagtctgtctggaatcgagggtgctgag

SEQ ID NO: 55659 - DNA, 201 bp, Homo sapiens
attctcttctagctcctaaatatgcactgaagccatccacttgtctccctctctctccccaccttcattccaagctatgatggttttttcctaggattcckgcaataacttcattttcctgccttcactctcggcaccttcaatccattctccatgcagctgccagcgtgatcttttaaaatgtgagtctgatcatgtcat

SEQ ID NO: 55660 - DNA, 201 bp, Homo sapiens
tcctggcactcaggcccctgatggtctccctctgagcccagggctcactgtggtgccctctgtagccctgactttgacaacccctcccaggtggagggtcsctcctgaagggttgccacacagctttcccagagctgaggagggaccttcctggcaggtgtgtgggtgggagggcacatagattttcttcaccgtttttgg

SEQ ID NO: 55661 - DNA, 201 bp, Homo sapiens
gataacaggaagcacctgaaacacaagctcgacagggtcccagagtcagtctggggataagctgccagaatcctcagggtggcccacctgggccagggtgygttctcccgtgccgtttcccatctgcctgacctcagttcctggcactcaggcccctgatggtctccctctgagcccagggctcactgtggtgccctctgt

SEQ ID NO: 55662 - DNA, 201 bp, Homo sapiens
tataatcttccctattccaggaacaagggagccatgatcagacttggcctctatttggggggtgggaccagtgaggctctggcaagaaaggctcactaaaragcagcaagagagattttatagagactctgagaacagcttcctgttagggtgagtcaacagggaaggtagagatttcctaaatccaatgctgagatcaca

SEQ ID NO: 55663 - DNA, 201 bp, Homo sapiens
atgatacagatacaatggaggaagtaaataactttaagagcttaggtaatagtgaactgtagtaaagtcatcaggaagtggtgagttttgagtacttatcrcctttgttttaatatcatttaattataaatgtatgtaatttactttttaataatggctgcatttaacaactggcttgggaaagttaggtggaccatgtca

SEQ ID NO: 55664 - DNA, 201 bp, Homo sapiens
atctgggggaagaggcaaggagtccagaaagccaccagtagagaaggaggagaaccaggacttgcctctgagtcctggaatccacatgcaggtgtgaatawtgacaagaatcctcactagtaataataatcctaatgataacaggaagcacctgaaacacaagctcgacagggtcccagagtcagtctggggataagctgc

SEQ ID NO: 55665 - DNA, 201 bp, Homo sapiens
attcagcccatctggagtaaccattttatttattcctggtgtatggaaacaaaactgattccattcagttctttgcagttaggttgggaagaatgtgcagyagaggggtgtgtggaggacatgggaacttgcagacaaggtggggatagtggctactttggggaatctggaggagctgggcgtggtcattgtgcctgccgg

SEQ ID NO: 55666 - DNA, 201 bp, Homo sapiens
tactgaatgaatggatgggtgcatttcctgttctacagatacctgttcaaactttgttttgtactttattttgttaacccagttaatgcttctgacaagawgttctacagctcctccccaccccatcaaagaggagggcccttggcctcaaataggccaatcaggctctgttggtggggagttgaatcttcagtgagcaac

SEQ ID NO: 55667 - DNA, 201 bp, Homo sapiens
catgtatttttgtttagtaaaatgtctaatatttagagctcaaatagtagctactattcataatttatataagttttagtgcttttggaactcaattcatwagaaaatagatacagtgcaaacaaaatgttacttttttaaaaggaattttcaagctattatacagttgtcccttggtaaacacagaggagggttggttcc

SEQ ID NO: 55668 - DNA, 201 bp, Homo sapiens
ttagtaaaatgtctaatatttagagctcaaatagtagctactattcataatttatataagttttagtgcttttggaactcaattcattagaaaatagatayagtgcaaacaaaatgttacttttttaaaaggaattttcaagctattatacagttgtcccttggtaaacacagaggagggttggttccaggacctcctgtg

SEQ ID NO: 55669 - DNA, 201 bp, Homo sapiens
gtaattaacattttaaattgctttttaaataccttgaggtggcaaaaaattttgatagcagaaaagaaaagaaaaaattatggccaggtgcagtggttcaygcctgtaatcccaacacttcgggaggccggggcaagatgatcacctgagcctaggagtgggcaacaaagtgagaccccatctctacaaaaaaattttaaa

SEQ ID NO: 55670 - DNA, 201 bp, Homo sapiens
attccttcatctgttgcactggtagtaaaaagcagatagtacaatctgtgtatgaaacaagaattgaaggagagaggtagactaaagcaggagaggagagygagaaaagaaataaaggatgaaatcaggatgacagagaaaatgagatttgattaaggtaaagacacagttgtttcaggaaacagcatggttagtgcaagt

SEQ ID NO: 55671 - DNA, 201 bp, Homo sapiens
ctaaagagcgtcgtgtggcagagtgagtgcggtggggtaggggttgagagagggaaggccgggaggctgccgtgccgggcctcgttttgcagccccaaccyagcggtctgttgaggagccgccgcgagcacttgttgctttgggacctgtgtgaggacttcttcctgctttcctgccctgccttattccttgccagcacca

SEQ ID NO: 55672 - DNA, 201 bp, Homo sapiens
ctatgtgtcatatactttcctgagtgttttacataaatttattcatttaatcctcacaatagccatagtaatagattgtacttctccattttgaagatcargaaatcaaagaggttaagtaccttgcctcaaatcacacagctaatgaattgttaaggtttgttttgctctgttctctgtgtttggattctagcattttat

SEQ ID NO: 55673 - DNA, 201 bp, Homo sapiens
tatgatatctgtatcatatataaatacatatgatatctgtatatataaatacatatgatatctatctgtatatataaatacatatgatatctatctgtatmatatataaatacatatatctatctgtataatatataaatacatgatatctatctatatataatatataaatacatatgatatatatctatataatatata

SEQ ID NO: 55674 - DNA, 201 bp, Homo sapiens
tgctctacatataggagatttaaagcttgtggtttaaatttcagactagcaaatagcttctgttactgaatttcggagcctaaatttggtacaatttacgracggtttttcatcagtttaaagaacgcttagaggaaatgtctttatagtcacatagggaatacagtgttacagttaatgtttttcattaaatcaccaaca

SEQ ID NO: 55675 - DNA, 201 bp, Homo sapiens
aatcgatacatagaatccaatataatcatgatggaatactgtataggagataaaatgaataaatccgatatgtgtgtcaatgtcaatgtagataaatctcaaacacacacacacacacacacatacatatgaaacagaaatgactggagggagaatacacatgaaattaattataatggttgccttggtttgaggcagggg

SEQ ID NO: 55676 - DNA, 201 bp, Homo sapiens
cgatacatagaatccaatataatcatgatggaatactgtataggagataaaatgaataaatccgatatgtgtgtcaatgtcaatgtagataaatctcaaacacacacacacacacacacatacatatgaaacagaaatgactggagggagaatacacatgaaattaattataatggttgccttggtttgaggcaggggtat

SEQ ID NO: 55677 - DNA, 201 bp, Homo sapiens
ttttaaaaagctactatactcccttctttctgaatcaaaaacattcagagataagaattagatggaagtaaagctccctgtggtttgtgctccatcacaawtttttttttttttttttttttttttagtagaggcagggtttccccatgttggccaggctagtcttgaactcctgacctcaggtgatccccctgcctcggc

SEQ ID NO: 55678 - DNA, 201 bp, Homo sapiens
tagtagaggcagggtttccccatgttggccaggctagtcttgaactcctgacctcaggtgatccccctgcctcggcctcccaaagtgctgggattgcaggkgtgaaccaccacgcccagccttcatcacaattttttatggaaacagaatacaaagcagcaggaagctctaagtgtccagattcaagttttcatgttggtg

SEQ ID NO: 55679 - DNA, 201 bp, Homo sapiens
gaggcagggtttccccatgttggccaggctagtcttgaactcctgacctcaggtgatccccctgcctcggcctcccaaagtgctgggattgcaggtgtgarccaccacgcccagccttcatcacaattttttatggaaacagaatacaaagcagcaggaagctctaagtgtccagattcaagttttcatgttggtgccttc

SEQ ID NO: 55680 - DNA, 201 bp, Homo sapiens
ccacaccctgctaagtttttgtatttttttttagagacagggtttcaccttgttagccaggctggttttgaactcctgacctcaagtgatccgcccacctyggcctccgaaagtgctaaaattacaggcgtgagccactgcacctggccgatattcctgttcttaatggaaatttgataattgtactgtgggttattagca

SEQ ID NO: 55681 - DNA, 201 bp, Homo sapiens
ttcctgataacataaacaatagaataacacatattttttatattgtttttactatattctaacaaagtaagctagagaaaagaaaatgttattaagaaaaycaaaaggaagagaaaatatacttactattaaatagaagtggattattatgaaggtcttcattcttgtcattttcaagttgagtaggcagaggtggaggaa

SEQ ID NO: 55682 - DNA, 201 bp, Homo sapiens
tcttacttaactttcaaagtaatagtgaaggtgaattttaaagtttgtttaaaatctttattttatttctgtaactttttatttttggaaagttctaacayggaggtagagaatgaactcctacgtacccattgcctagtttcaatagttaacaacatttttgtctgtcctgcttcattaaaatttttttattttatttta

SEQ ID NO: 55683 - DNA, 201 bp, Homo sapiens
atctaagcttcttcataacttctctatatgtataacctagatttatctgaatccagcttaaagtttctatatctttgtcttgaatagcctaacagagtcayatttatcaaccttacaagaaattcagcactagattgactagtggatgttattctacatgtttctttaaagtaatagttacttactagtagatttaagagc

SEQ ID NO: 55684 - DNA, 201 bp, Homo sapiens
ttggttccaggacctcctgtgtataccaaaatccacacatactcaagacctgcatcagcccaacagaacctacatatctggaaagtcagcccttcatacaygcaggtttcacatcctgcaaatactgtattttctatctgttatttagttgaaaaaactctgagtataagtgcatccacgcagttcaaacccaagttatta

SEQ ID NO: 55685 - DNA, 201 bp, Homo sapiens
aacactatcagaataatcttaacatttttgtcatgttgcaccctagtcaaccaatgatttttgtgtgtgttaaaatacttgaaacatttagaaagataaakagaatatgaacttgaagaacttctgggtatttttctcatgttatttttcattactgtcaaactcaacacaaattcaacaattcaatgcttccatcccatt

SEQ ID NO: 55686 - DNA, 201 bp, Homo sapiens
tcaagttttataatacttttattttaatagacatatgttctgatatgattataaataaattttagcattaaagcacaaaatactgttcagtggagttatgygaccacactcagattttttaaaataggcatctccactcttagttttaagtcaaatacaatatagtatttactggtaaattaaatatcttcgttaggaaac

SEQ ID NO: 55687 - DNA, 201 bp, Homo sapiens
ttatactggtattttgattgtaagagctttattgcctccaacatgcatctcctgcttgtcacacctgtgttgatgagtgtgttgtccaggtcaaagaaaayggcctgcacgtggctcagccccatagcacctgtgccttgctgcaacctgccacgtcgctgcctgcacatgcgcaaggtgggcggcccaattttgtttttt

SEQ ID NO: 55688 - DNA, 201 bp, Homo sapiens
tatttagaatctcactctttcccatcttttttttttttttttgagacagaggctctctctgtagcacaggctggagtgcagtggcatgacctcggctcacrgcaacctctgcctcccaggttcaagcaactttcctgcctcagcctcccatctgggattacaggcgcctgccatccgcccagctaatttttgtatttttag

SEQ ID NO: 55689 - DNA, 201 bp, Homo sapiens
tgtgtataattttaaactcgccaaaaacttaactaccaatagcctgctgttgagtggaagccttcctgataacataaacaatagaataacacatatttttwatattgtttttactatattctaacaaagtaagctagagaaaagaaaatgttattaagaaaatcaaaaggaagagaaaatatacttactattaaatagaag

SEQ ID NO: 55690 - DNA, 201 bp, Homo sapiens
tttgtcatgttgcaccctagtcaaccaatgatttttgtgtgtgttaaaatacttgaaacatttagaaagataaatagaatatgaacttgaagaacttctgsgtatttttctcatgttatttttcattactgtcaaactcaacacaaattcaacaattcaatgcttccatcccatttatgctgtctgttgattgcctcctgt

SEQ ID NO: 55691 - DNA, 201 bp, Homo sapiens
ggtctaattgactcacagatctacatggctgggaaggccttaggaaacttacagtcatggcagaaagcaaaggggaagccaggcaccttcttcacaaagcyacaggagggagaagtacaagcagggcacatgccagacacttgtaaaaccatcagatctcatgagaactcacttactattatgagaacagcatggggaaaa

SEQ ID NO: 55692 - DNA, 201 bp, Homo sapiens
tatattcagtttatattcagttctgtagttcgatttagcagtgggtttcgtggaatacttggtgttatttgtcctctaaaaccttactataggtctgagaratatcccatatatctaagcttcttcataacttctctatatgtataacctagatttatctgaatccagcttaaagtttctatatctttgtcttgaatagcc

SEQ ID NO: 55693 - DNA, 201 bp, Homo sapiens
acttgagtatcaatcactttcctgtttcacctattaatgttttattgtgctagacatggtggatgatacattgcagaggttctagatgatgctgtctctayacagaatgttgagttttgttctggcaggcagttaagttgctgaggaataatcgtgattctgttgtaacttcatgttagacaatgttatggtaaatttatt

SEQ ID NO: 55694 - DNA, 201 bp, Homo sapiens
caatgaatggagtaatacactatggctcttttcatttagcataatgcatttgagattcattcatgctgcatgcaagagtagtttcattactttttattgcygagtagtattccatcatatggatgtaccacaagttgtttatcaatttaccagtttcagaacattttagtttttccagttgttggcaattatgaataaagc

SEQ ID NO: 55695 - DNA, 201 bp, Homo sapiens; identical to SEQ ID NO: 32725

SEQ ID NO: 55696 - DNA, 201 bp, Homo sapiens
ctttttaaataccttgaggtggcaaaaaattttgatagcagaaaagaaaagaaaaaattatggccaggtgcagtggttcacgcctgtaatcccaacacttygggaggccggggcaagatgatcacctgagcctaggagtgggcaacaaagtgagaccccatctctacaaaaaaattttaaaattaaccatgtttggtgaca

SEQ ID NO: 55697 - DNA, 201 bp, Homo sapiens
cctcccgcggagcccgtgcgtgccctcggccgcgctccccactcttctccgctcccgtccgcgctccaccagttggggatgtctctccatccgagacaatycgggcgctgtttattccgcccccatctccaccccacactggagtttgcaaggactgtttattctgcttattcgtgttagtatcaacccgtgcttttcaaa

SEQ ID NO: 55698 - DNA, 201 bp, Homo sapiens; identical to SEQ ID NO: 32727

SEQ ID NO: 55699 - DNA, 201 bp, Homo sapiens; identical to SEQ ID NO: 32730

SEQ ID NO: 55700 - DNA, 201 bp, Homo sapiens
tgaactcctacgtacccattgcctagtttcaatagttaacaacatttttgtctgtcctgcttcattaaaatttttttattttattttattttttgagacakagtctcactctgccatgcaggctggagtgcagttgcgccatctcagctcactgcagtctccgcctcccaggctcaagtgattgttttgcctcagcgggat

SEQ ID NO: 55701 - DNA, 201 bp, Homo sapiens
gagactgggtaatttataaagaaaagaggtttaattgactcacagttccacatggctggggaggcctcaggaaacttaacaatcatggcagaagccaccaygtcacagggagaatgagtgccaagcaaaggggtaagccccttataaaaccatcagattttgtgtgaacgcactatcacaagaatagcatggggcaaaccg

SEQ ID NO: 55702 - DNA, 201 bp, Homo sapiens
gacattgtttttattatctgtcattctgtgacttccttttttttaaacaactgacattgactcaacatttttcatgttgcttcacaatctcgtaattaacwttttaaattgctttttaaataccttgaggtggcaaaaaattttgatagcagaaaagaaaagaaaaaattatggccaggtgcagtggttcacgcctgtaat

SEQ ID NO: 55703 - DNA, 201 bp, Homo sapiens
aattggccataacagaggggcttacaggccccatgcaggtccaaaatccaatagggcagtcattaaatcttaaagttccaaaaggatctcctttgactccrtgtctcacatctgggtcatgttgatgcaaaaggtgggttcccatggccctaggcagctctgcccctgtggctttgcaggatatagcccctctcccagctg

SEQ ID NO: 55704 - DNA, 201 bp, Homo sapiens
tctgagcctgacccacgaaaccattttttcctccttggcctctggacctgtgatgggaggggctaccacgaaggtctctgacatgccctggagacattttccccgttgttttggtgattaacatttggctccttgtttcttatgcagatttcagcagccagcttgaatttctcccccgaaaatgggtttttctatcatatc

SEQ ID NO: 55705 - DNA, 201 bp, Homo sapiens
ttatgaagaaatacctgagactgggtaatttataaagagattcagttgactcacagttccatatggctgcagaggcctcaggaaacttatagtcatggtgraaggcacctcttcacagggtggcaggggagagaaagaatgccgagtgaaggaggaagccccttataagaccatcggatctcatgagaactcactcactat

SEQ ID NO: 55706 - DNA, 201 bp, Homo sapiens
tttatctcagccgcattttataattttcattttagtggtattgcacattttttctttatttctaggtatttgattttttggtgttataaatggtatttttwaaattccattttactttattagtatataaaatgtgattgatttttgtatatttaccttggatctggtgaccttgctaaatttattttttaattctagtac

SEQ ID NO: 55707 - DNA, 201 bp, Homo sapiens
aatctgtgaataaagaaaatttagtgtcttcctttctaaattaatcttccagaggtgtccaaaggagagaatacagtcatgggttcttagtttctgtttcrgctagtaaagtcccttccttatccctcttttccacttatcactagagacagaaactaaaaaccatggcttcaggctgcaaaaagcctaaaacaaaacaga

SEQ ID NO: 55708 - DNA, 201 bp, Homo sapiens
atcagattaaggatgttcccttctattcttagtttaccaacaggtttttatgtgtttctgttttttgtttttttcttttttcttttttttaagagacaggktcttgttctgtcacccaggctggagtgcagtggtgcagtctcaactcactgcagcctcaacctcttgggctcaaacgatcctcccacctcaggcccccaa

SEQ ID NO: 55709 - DNA, 201 bp, Homo sapiens
ctggagttaccttggtgttcccattgttccccaagtaagaagtcttatgttgtgtatatactttatatgtatgtgtatgtatggttgtatgtattaactgttttttttttttatgtggacagtcttcttaagttcactctatagattttgaataagtaagcaattaaagattttgttctcttttccatatgtaatttgggc

SEQ ID NO: 55710 - DNA, 201 bp, Homo sapiens
ccatgtgcccacttgttaatactacttgtactaccatgccgtaaagcagtggtctccatacttttcagttcatgcacacctaaccataaaaaaaatgtgarcatgaacctatttacttataagttaagcattactgtaataaaaaatatataatctatgtatacagtatatttatatacatacatatatcataaaatctaa

SEQ ID NO: 55711 - DNA, 201 bp, Homo sapiens
agaagattgcatgaataagttcaagcttaatatagaaaagctctgcaaaactgaacaggtatgtgcagagtcagaaatgcctctgttcataacaaatttcmaggataaactttgtaagttaaaacctaactttttgcttgatacagtggttggtttttacagaatcacagactctctcttatcaggggagccacctaggca

SEQ ID NO: 55712 - DNA, 201 bp, Homo sapiens
gttatttttttcagaaagaaaaacccaaaaaaataaaagcaagatgttattttgttacaaacactcagtagacttttattattacccacatatttatacawtctggtactgtttatttcttactgctcttcagtttttccagctgggttagattgaattctcccagctttctttttgtctgagggcatcttcgttttgcaa

SEQ ID NO: 55713 - DNA, 201 bp, Homo sapiens
tgtttcatgtattttacttcaatgtatgttataaactcaagatgttatttttttcagaaagaaaaacccaaaaaaataaaagcaagatgttattttgttayaaacactcagtagacttttattattacccacatatttatacaatctggtactgtttatttcttactgctcttcagtttttccagctgggttagattgaat

SEQ ID NO: 55714 - DNA, 201 bp, Homo sapiens
ctttcttttgttagtgtttacatagtatatcttttcccatcctttactttcaactacctgtgtcttgatatttaaaatgtgcttcttaaaaagagcttgtrgttgaattttgtttttttatccagcccaaaaatcttttaattagaatgcttgtttagttcatatatatttcatgtaattattgatatagttaaatttata

SEQ ID NO: 55715 - DNA, 201 bp, Homo sapiens
tgtacttgaaaggaatataaattctgtatgtgtcagttaaatcaagatggttaatcatgttcaaatcttctatttcttttctgatttttttttacctgctmtgtcagttactagaagtggtatattaaaaactctgatcatgactgtgaattagtttgtttttctttagtcctttcaacttttgaagttatattaactgat

SEQ ID NO: 55716 - DNA, 201 bp, Homo sapiens
gaggttgcagtgagccaagatagtgccactgcacttcagcctggagaaaagagtgagactccatgtaaaaaaaaataaaataaaattcactgcatatgttwttaatatttcaaagaaccaacatttgtctttgttgattttcactcttgcatgttttatctttaattagctgatttttactcagttttatttccttccttc

SEQ ID NO: 55717 - DNA, 201 bp, Homo sapiens
ttattttggtagcaattgtgtgattgtgcactcatatttttacctatttaaggaactacggaagaaaatttggacaggttgatccagaatgtaaagatagraaatgagagtgacatgattcgtaactggagttaccttggtgttcccattgttccccaagtaagaagtcttatgttgtgtatatactttatatgtatgtgt

SEQ ID NO: 55718 - DNA, 201 bp, Homo sapiens
tagtgcgattttggctcactgcagcctcctcctcctgggttcaaacaatcctcccatctcagtctccgaagtagctgggactacaggcacacactagcacrcccagctaatttgtatattttcttggatagaaacagggtttcaccatgttgcccaggatggtctcaaactcctgggttcaagtaatccacttgccttggc

SEQ ID NO: 55719 - DNA, 201 bp, Homo sapiens
ttgtctcattcccagctttatgggaaatgagttcaatatttcatcattaagtattatgttagttttaggtagttttcttttatcagattaaggatgttccyttctattcttagtttaccaacaggtttttatgtgtttctgttttttgtttttttcttttttcttttttttaagagacaggttcttgttctgtcacccagg

SEQ ID NO: 55720 - DNA, 201 bp, Homo sapiens
gaacatatttattgattataaatcaagactgaatattggtatccaaatgctgtgatatgtattgttgaaaagcataatgtagtaaatcagtatgaaaaatktttatgcagatttgatcatcagatataatttagcaatgggcaacttaaggatgttcccgtgggttttttgttttcatcttgttttacttgggatttaagt

SEQ ID NO: 55721 - DNA, 201 bp, Homo sapiens
ttaaattactgtagccataactattagatttaacattcttttctctgaatcttctgtcagtttttttccctcagccgagacattaatagacctctaaccargcctaacttaattgctttgttgaggttgttctttaaatgttttactcatatatacatatatatatataaaacaattttgtatattgatacacaagcttta

SEQ ID NO: 55722 - DNA, 201 bp, Homo sapiens
tgttttactcatatatacatatatatatataaaacaattttgtatattgatacacaagctttacttcagtattttgatttagtttatggtttcatatatcrctttaaaatggatatcaagatttatgtcataaaatcagctgttgtacatgtttacaaatgcataatgctgacttcgtaaatttatctttattaccagaaa

SEQ ID NO: 55723 - DNA, 201 bp, Homo sapiens
tcaagcctgtatggcttccatcctctactgatcaagctgagtgtgggttaggggttgcattccaaaataggcagttcttaagtctccctcctttttttaattttttttttttttttaaatagaggcaaggcctctctctgttgcccacactggagtgcaggagtgcagtggcatgatcgtagcttactataaactcaaacg

SEQ ID NO: 55724 - DNA, 201 bp, Homo sapiens
tttgatagatgtgtatttttcagtgaatggagaagtggcactttctgttattaataaagagatttcagaatattttcagagcctgagccctaaatcatatytatcacagtattttcagtgttttaacaaatacattattcaccaaacaaaataatatgtatagcatgactgtaagacactccattttgaacattaaacaat

SEQ ID NO: 55725 - DNA, 201 bp, Homo sapiens
tgggaggccgaggcgggcagatcacttgaggtcaggagttcgagaccagcctgatcaacatagtgaaaccccatctctactaaaaatacaaaaattagccrggcatggtggcacactcctgtaatcccagctattcaggaggctgaggcaggagaatcgcttgaacctgggaggtggaggttgcagtgagccaagatcatg

SEQ ID NO: 55726 - DNA, 201 bp, Homo sapiens
gttggctgctagtgggttttaatgacattttatatcttatctgtaatataattccataagagaaaaattcatgattggaaaaaaaaatgcaacttaaaagyaccatttttcacctagcaaattggcagagggatttaaaatatatatatatgggtatgtatgtgtgtgtgcattctggctattctggttatcagtggataa

SEQ ID NO: 55727 - DNA, 201 bp, Homo sapiens
cagcctgatcaacatagtgaaaccccatctctactaaaaatacaaaaattagccgggcatggtggcacactcctgtaatcccagctattcaggaggctgargcaggagaatcgcttgaacctgggaggtggaggttgcagtgagccaagatcatgccactgcactccagcctaggtgacagagcaagactccacctcaaat

SEQ ID NO: 55728 - DNA, 201 bp, Homo sapiens
cagtttattcagaggggatattatttacctctgttaccctgtaggtctctaaacttttaagtagacttattttttaaaaagctactatactcccttctttytgaatcaaaaacattcagagataagaattagatggaagtaaagctccctgtggtttgtgctccatcacaattttttttttttttttttttttttttagta

SEQ ID NO: 55729 - DNA, 201 bp, Homo sapiens
ttgaacctgggaggtggaggttgcagtgagccaagatcatgccactgcactccagcctaggtgacagagcaagactccacctcaaattaattaattaattwatttatttatttgtacctgattggctgcccatcctaagttgagaccacacctagcaaagctgcaggattttgtactcgcctcactgccccaccttgaatc

SEQ ID NO: 55730 - DNA, 201 bp, Homo sapiens
tttgttatcaagaaccttaaaaaatgttttatattttagagtttattgttaggaaataaataaatggtttagctaagtttctagtagtaaataaatctaawtaaattttagcattaataaataatagaccatatgatgatatctgaatgaaatatatgaataaaatgataaataaatgaaaacccatgtggccattaaaaa

SEQ ID NO: 55731 - DNA, 201 bp, Homo sapiens
ctgaagtgtatcctttgatgcgggtctgttggtggtagtcttttttattttttatttttttccaagacagagtcttgctctgtcatccaggccgcagtgcrgtggcacgatctcggctcactacaacctgtgcctcccggactcaagcagtcctcgtgtctcagcctcctgactagctgggattacagatgtgcaccacca

SEQ ID NO: 55732 - DNA, 201 bp, Homo sapiens
tcatttatgtttcctgaatctgaggatttacatctttcataaattcttcaaatattgccacttctgtagtcttggttttgttagaacatcttattctgtcataatgtctcttaatttcttaaacttttttgtttcttctgctggtgtttcattctagaaatttttcttcagatttagttttcagttctttaggtctctctt

SEQ ID NO: 55733 - DNA, 201 bp, Homo sapiens
catttatgtttcctgaatctgaggatttacatctttcataaattcttcaaatattgccacttctgtagtcttggttttgttagaacatcttattctgtcataatgtctcttaatttcttaaacttttttgtttcttctgctggtgtttcattctagaaatttttcttcagatttagttttcagttctttaggtctctctta

SEQ ID NO: 55734 - DNA, 201 bp, Homo sapiens
atttatgtttcctgaatctgaggatttacatctttcataaattcttcaaatattgccacttctgtagtcttggttttgttagaacatcttattctgtcataatgtctcttaatttcttaaacttttttgtttcttctgctggtgtttcattctagaaatttttcttcagatttagttttcagttctttaggtctctcttac

SEQ ID NO: 55735 - DNA, 201 bp, Homo sapiens
attatttgggtaacttttggactagtggaagattaatttagagattaggtagaagccagtcagtggaggatgttaaatagtagagtttagattttattctrtaagcaagagtgagcatttgagggaatttcgaggtgtgtattaatataaacaaagggttgtatttcaggaaggtgactctgacagctgtgtgaaaaatgg

SEQ ID NO: 55736 - DNA, 201 bp, Homo sapiens
aacttttggactagtggaagattaatttagagattaggtagaagccagtcagtggaggatgttaaatagtagagtttagattttattctataagcaagagygagcatttgagggaatttcgaggtgtgtattaatataaacaaagggttgtatttcaggaaggtgactctgacagctgtgtgaaaaatggattgaaatagc

SEQ ID NO: 55737 - DNA, 201 bp, Homo sapiens
aagatagtgaaaatatttccataagaggcaaagactataacaaagctacaagctcactgtgcaaaggtgtgaaaatgtcatggtaaaaagcaccacatgcyaatttttttttttttttttttttttgagacggagtctcattccatcgtccaggctggagtgcagtggtgcaatctcgtttcactgcaacctccaccaggt

SEQ ID NO: 55738 - DNA, 201 bp, Homo sapiens
tatttgttgatatgatttcctttgactcctctctaaacatacctacctgtgactgtgtcactttttatgggtgcccttactatctccataaaactagttckttcttttagacaataacactgactctgtaggtatcttcagattctttttattttttcgtctggcagacacaggtagatccaagtatcttcagattccaag

SEQ ID NO: 55739 - DNA, 201 bp, Homo sapiens
aaccttagtgagtacagagagtctggtacagttagtagagaggatactagaagggatctggtagagatagaaacaagctagctatagattagcatgaagartagatggaagacaggatctgtatttaaggagctgattataggtttataaagatgaaaaaagcatgtggcagtagtcttaaaaaacttttaatgatggtga

SEQ ID NO: 55740 - DNA, 201 bp, Homo sapiens
aggaaccccccagatctcagtgcattactacaacaaaggtttatttctcatttgtgttgtccattgttgtttggctggggctttgctctacatcctctacmttctagtactgaggccgaagggctagtctgggacatagccgagggaaaagagaaaatagtggagccacacaatagcttttaaagcttctgctgggaagtg

SEQ ID NO: 55741 - DNA, 201 bp, Homo sapiens
aaaagcaagatacaaaattgtatattcctcattcttgcagtcacctaccaagctttggatctttctaatcacttgatagtttaagcttctcactcactgtstctcacttcaacacttctccagtcataagtcttggtggttcgttatccatgtagatgatacttatagtatgttggtttctagttccttaatctgttatat

SEQ ID NO: 55742 - DNA, 201 bp, Homo sapiens
acttcaacacttctccagtcataagtcttggtggttcgttatccatgtagatgatacttatagtatgttggtttctagttccttaatctgttatattccartagtcttgtcttctatgttgtttcagttttcctagacctcttcattgccaataagagcatcctgttcatacatattaccttactctttttttttttttcc

SEQ ID NO: 55743 - DNA, 201 bp, Homo sapiens
ggctgaggatctcataagctcaggaggtcaaggctgcagtgggccaaaatcacaccactgtactccagcacaaagtgagactctgtctcaaaaaaaaaaamaaaaaaaaaaggctcaaagtcaaattttgaagagctctatttagaatctcactctttcccatcttttttttttttttttgagacagaggctctctctgta

SEQ ID NO: 55744 - DNA, 201 bp, Homo sapiens
atttccatttgatttttttaaatttccatttctgactgttgagattccctgttgttaacttgttaccatatttttctttttaattcttttgatcatatttrtaattgcttggaagtccctaacatctgagtctactcagggttaattcctactgaatgtttttttttcccccaagtatgagtcacacattcctgtttcttt

SEQ ID NO: 55745 - DNA, 201 bp, Homo sapiens
catgattttgcaagtaaatcggagaacaagtataaagcagcatatatttacttcactgactgtaagtcttttaaaaagttattgcttcattgttcaaaatsccattggttttaaactgtcgactttttaaaaatcagcccaaaatgtcattaaagtatctactttttataatattatttcagtcctggtgattttctattt

SEQ ID NO: 55746 - DNA, 201 bp, Homo sapiens
atgaatgtgaaccctcttttaacttaaggaatcttaaggctaaagaatatcatgttaaaagatactaggagccagtggttgatattccaacctagatctartggaatgataaactctttgatgaaaggggaaaaacactggctctgagttccagaacttagtattatagagtcttagaattttctaatgttagaaagctgc

SEQ ID NO: 55747 - DNA, 201 bp, Homo sapiens
tactgcctaggctgtcttccagggtttttatagttttgggttttacctttaagtctttaatccatctcgagttgatttttgtatatggtgtatggaagggrtccagtttcagtcttctgcatgtagctggccagttatcccagcaccatttattgattagggagtcctttccacattgttcttgtcagctttgtcgaatat

SEQ ID NO: 55748 - DNA, 201 bp, Homo sapiens
gaatcgatacatagaatccaatataatcatgatggaatactgtataggagataaaatgaataaatccgatatgtgtgtcaatgtcaatgtagataaatctmaaacacacacacacacacacacatacatatgaaacagaaatgactggagggagaatacacatgaaattaattataatggttgccttggtttgaggcaggg

SEQ ID NO: 55749 - DNA, 201 bp, Homo sapiens
caggctggagtgcagtggtgcaatctcgtttcactgcaacctccaccaggttcaagcatttttcttgcctcagcctccagagtagctgggattacagacaygtacccccacgcggggctaatgtttgtacttttagtagaaatgagatttcaccatgttgaccaggctggtctcaaactcctgacctcccaaagtgctggg

SEQ ID NO: 55750 - DNA, 201 bp, Homo sapiens
cagttatctctacctggtcctgcccttgacatgtggagattattacagttcaaggtgagatttgggtagggaaacagagccaaaccgtatcattctgcccytggtacctcccatatctcatgtcctcacatttcaaaacacaatcatgcccttccaacagtcccctacagtcttaactcattccagcattaacccaaaagt

SEQ ID NO: 55751 - DNA, 201 bp, Homo sapiens
tgtacgtaggaggctcctggttctaccaaaaataatgacagaaaattagctggtgcagaaaactgtggaactggtcgtaaagtccttaatgaaaagtagartcctagaagtcaggagatcattgcagagagattggtaaagtcagatatgatagtgcttcaaagaaataaagttggacatcagcacatttagaaattacat

SEQ ID NO: 55752 - DNA, 201 bp, Homo sapiens
gctggtgcagaaaactgtggaactggtcgtaaagtccttaatgaaaagtagaatcctagaagtcaggagatcattgcagagagattggtaaagtcagataygatagtgcttcaaagaaataaagttggacatcagcacatttagaaattacatggagaggaagaagattaactcactcatggtgattccatgagtcaaagg

SEQ ID NO: 55753 - DNA, 201 bp, Homo sapiens
ctgctaagtttttgtatttttttttagagacagggtttcaccttgttagccaggctggttttgaactcctgacctcaagtgatccgcccacctcggcctcygaaagtgctaaaattacaggcgtgagccactgcacctggccgatattcctgttcttaatggaaatttgataattgtactgtgggttattagcacatcaaa

SEQ ID NO: 55754 - DNA, 201 bp, Homo sapiens
aggctagtcttgaactcctgacctcaggtgatccccctgcctcggcctcccaaagtgctgggattgcaggtgtgaaccaccacgcccagccttcatcacarttttttatggaaacagaatacaaagcagcaggaagctctaagtgtccagattcaagttttcatgttggtgccttctttaaatttactttttttttttttt

SEQ ID NO: 55755 - DNA, 201 bp, Homo sapiens
taagcttttccctttttcacattttccttctgatcctcatacagataaagacattgtttttattatctgtcattctgtgacttccttttttttaaacaactgacattgactcaacatttttcatgttgcttcacaatctcgtaattaacattttaaattgctttttaaataccttgaggtggcaaaaaattttgatagcag

SEQ ID NO: 55756 - DNA, 201 bp, Homo sapiens
atattatttcagtcctggtgattttctatttatcatttgttctaattaggctagaaagaatctaaaaatgtaagattatatctatcctaattcatattaasgtgatagaaaattaaaagaaactattcccaactgctttcaaaagacagtcattttgctgggatgctgggatgtgagggatgggtggagagggctagccct

SEQ ID NO: 55757 - DNA, 201 bp, Homo sapiens
atcttggtttctgagtttttctctgtattatctgtattaatgttagataacatagctatttttctaatataaaagttattttaagcagtttattcagaggrgatattatttacctctgttaccctgtaggtctctaaacttttaagtagacttattttttaaaaagctactatactcccttctttctgaatcaaaaacatt

SEQ ID NO: 55758 - DNA, 201 bp, Homo sapiens
catttgcagacggaagagatgctatcactcaggagattccaaggtctttaggggctctgtgctaggaacagggggtaaaaaccaaatattttttattgtaycacagtaactgttattatttataccctctgatagaagagccgtcagtttttaacatgacttgttaccaaaaacttgttgataaatttcccaaaagcatta

SEQ ID NO: 55759 - DNA, 201 bp, Homo sapiens
gttttagtgcctctgtctacttgtagatataaaacagatggaaaagaaaaggaggccatccttgaagaagaagatgacctctgggttagaattcgacatcracatattgcggttgtgttagagtatgtgaactcattttaatttttgttccataatttttagacactatgtgatagtacattttgtaaccttaaaatagtt

SEQ ID NO: 55760 - DNA, 201 bp, Homo sapiens
caaaagcattaacttaaatataaattaggaaatagaaaagcttaagttaatgaaataaccatctcattaataagatttaatgaaaaataggttactataayttatattttaattatattttatgtattactatgtattactaccgattttaaaatcaattgaacattaataaaacatagtgtgggaaattgttttattaag

SEQ ID NO: 55761 - DNA, 201 bp, Homo sapiens
cctacctcatttttgctgaagaactgctcacttaatatcctgggagtgatcttgttgaaatttgccaccatcatgttgaagcaatgaaccttcacccgtartataatgaatgtgacactgcttatatctatcctgtaggacagctaaaaggacaagacctcagcatcacatgccaaccagtctgttagagcaatcacacac

SEQ ID NO: 55762 - DNA, 201 bp, Homo sapiens
cactttttatgggtgcccttactatctccataaaactagttcgttcttttagacaataacactgactctgtaggtatcttcagattctttttattttttcstctggcagacacaggtagatccaagtatcttcagattccaagacagttctatcattagaaatttaaagcacatatgtaattttaaattttctagtagtca

SEQ ID NO: 55763 - DNA, 201 bp, Homo sapiens
tccaagtgaactgaagcagatatttatgaaatgatgatatatttccaaaaatacgaaaaacagataaggcagatggtaactctaataagagtcactgaagkattataatggcactctggaaatggctcatagcaaaacccaacttttttttttgagacagagtttcactcttgttacccaggctggggtgcagtggcgcga

SEQ ID NO: 55764 - DNA, 201 bp, Homo sapiens
tttacattcctttttttgtgctaaggttttttgaagtctcatatgtattctgtacttacaggatatctcagttcagactagccacatttcaggtgctcaayagccagatatggctggtttccaccatctaggacaatgcagttctaaggtttcaaagactgtaatgagatgacttctgcttggggagcttttctccaatct

SEQ ID NO: 55765 - DNA, 201 bp, Homo sapiens
tgccaagcaaaggggtaagccccttataaaaccatcagattttgtgtgaacgcactatcacaagaatagcatggggcaaaccgcccccatgattcagttayctctacctggtcctgcccttgacatgtggagattattacagttcaaggtgagatttgggtagggaaacagagccaaaccgtatcattctgcccctggtac

SEQ ID NO: 55766 - DNA, 201 bp, Homo sapiens
tttcaccataattctcatataacactataatcctcctagcaaacaatatataattatctcaattgatatttcataacacttccaaatcttctcaatcacartacaaccttccagatcacaattctaaaaatgactataaataactgaattgcttttactaacaacatttctgacaccaaatatgtgttttattcccccctc

SEQ ID NO: 55767 - DNA, 201 bp, Homo sapiens
ccacagctaaattttcatctatgttcaggctgctgctgttggtgctgggttatgtccagagaaatgaataactgtgtgtaaaaggaaatgcgagaagtttrttcataattcattacttaacctataatgtttattacttgcctactttcacttacaataaattttcatagtttaagagaaattatcattgtttagaaaaca

SEQ ID NO: 55768 - DNA, 201 bp, Homo sapiens
gcctcctgttgtattagtctgttctcacattgctgtaaggaaatacccaggactgggtaatttataaaggaaagcggtctaattgactcacagatctacawggctgggaaggccttaggaaacttacagtcatggcagaaagcaaaggggaagccaggcaccttcttcacaaagctacaggagggagaagtacaagcaggg

SEQ ID NO: 55769 - DNA, 201 bp, Homo sapiens
tacctgtggtcctagctacgtgggaggctgaaattgaggatcgcttgagcccaggacctcaaggcttcagtcagccataaccatgccactgcactccagcmtgggtgacagagtgagtccccatcttaaaaaacaaagacaaaaacaaacctacacatgaccatggctaaacctggtatcagtgagtgggagggagaagcc

SEQ ID NO: 55770 - DNA, 201 bp, Homo sapiens
aaggcttcagtcagccataaccatgccactgcactccagcctgggtgacagagtgagtccccatcttaaaaaacaaagacaaaaacaaacctacacatgaycatggctaaacctggtatcagtgagtgggagggagaagccttgggcggccgtgcgataaatgtttttaatcgaataatgttatctcctgctgtgggatat

SEQ ID NO: 55771 - DNA, 201 bp, Homo sapiens
aatttaggctatctcaaaactggcattattacaaacagtatgcagtgagcattcttgtacttttacgtatatctggatagggtgcttcccttggactgagkacttttctttacttttgttttattttttccttttctacaaaaggtttggaggttatgttatctatttttattcttgtagcagtttattactaagcatatt

SEQ ID NO: 55772 - DNA, 201 bp, Homo sapiens
tgttttattttttccttttctacaaaaggtttggaggttatgttatctatttttattcttgtagcagtttattactaagcatatttgactcaacaaagtckaagattaattagtatctctgccctcctcttgaacaatacaagaaccttagaccaactggatgtaaaccatgcaccccttaaatgttataatacttcattt

SEQ ID NO: 55773 - DNA, 201 bp, Homo sapiens
tattaaatataccctcttactctaattacaaaagtaattagattttagttatatagtcttcatttttcctctcttgggctactcagatttttctttgtttyattataacttcacattcttaagacaattaaccatttgttttgttctgttgtatgtttttggtggggaaaagggacagaacttaggaaaagggtgctttgt

SEQ ID NO: 55774 - DNA, 201 bp, Homo sapiens
taaaataatttttcattttgtaaacattttttaaatttcagtttaattttagaattaaacttcatgatattataaagtatacactgaaagaaagataattstttgatccttttttccatttctagtaaacctctagataatgccagtaagcttgcacagcttgttgaaaaaaagcttgaagactactacaagattgatgaa

SEQ ID NO: 55775 - DNA, 201 bp, Homo sapiens
ttacaattttattgatggaattaactctttccttccttaggatgctattgataatagattagattcaaaagaatggccatattgttcccagtgtccagcartatggaatggttcaggagctgtaaggtaaattctacaagtgaaaatcaatgaaattttcattctacggactaataatttaaaatggtacacagatactca

SEQ ID NO: 55776 - DNA, 201 bp, Homo sapiens
gtttaaattttttcttctagcttcctgagttggagttttagaacattgatttccaacctttcttctgttctattgtatatattttatagttatttacatctcaaacttagctgcatcccaggagttttggaataacttattttcatttagttcaaaacattttctaacccttattatgatttcttctttgacccatgtgtt

SEQ ID NO: 55777 - DNA, 201 bp, Homo sapiens
agtggtattgcacattttttctttatttctaggtatttgattttttggtgttataaatggtattttttaaattccattttactttattagtatataaaatktgattgatttttgtatatttaccttggatctggtgaccttgctaaatttattttttaattctagtactttgtttatagattggcttttttgtttttaaga

SEQ ID NO: 55778 - DNA, 201 bp, Homo sapiens
tctttgttttattataacttcacattcttaagacaattaaccatttgttttgttctgttgtatgtttttggtggggaaaagggacagaacttaggaaaagkgtgctttgtattctaagatattaaaactatgttcacactaagaaattgaagctgcttaagatgattttatcttgttattctagggtaaaactcattcaca

SEQ ID NO: 55779 - DNA, 201 bp, Homo sapiens
atatgtaaataaatagaaaatgtttgtataatgatctgtagttatctgttattgctttgaatactaatccaaagaatttattactttttaaaatgaaatakgaaagatactgacattaacaataaatgtttccagcactgttattcactgtttagtgattagtgatgtttgcgaattaatgataacaaggctttcattgtg

SEQ ID NO: 55780 - DNA, 201 bp, Homo sapiens
gtcctttccactctttctgcctggaaaattaatcatccttcaaatacttgatacctttcctttattcagggacacctgataaagtgataaagtgtcacctyatttttgaagccttccttgactcttcaggccaagtgttgcttcctcccacatgctatcataagccctaagcctgctatagaatttatattgcactttttc

SEQ ID NO: 55781 - DNA, 201 bp, Homo sapiens
tattttttaaaaagctactatactcccttctttctgaatcaaaaacattcagagataagaattagatggaagtaaagctccctgtggtttgtgctccatcmcaattttttttttttttttttttttttttagtagaggcagggtttccccatgttggccaggctagtcttgaactcctgacctcaggtgatccccctgcct

SEQ ID NO: 55782 - DNA, 201 bp, Homo sapiens
atgaaagctctttatttcatcactccgacatcaaaggtgagtattttgagaccttaaaaagcaggttcatcaatatttcaccattgttatggtttactaasagaaaattcaaagtaataaagtacactttagtagaaaaatattgccataaactagtttgcttaggaaagtttttttctgtgttagaagattatttgcatt

SEQ ID NO: 55783 - DNA, 201 bp, Homo sapiens
ctggatacctgttacaatgtcaaagtatctatagtatctaatctgcctattctaaataaattttggggttttcttaaggggtaaaatttaactttagtacwatataccttgacttatatacttctttttaaaaatgaagtttactataaagtgcctaaattgtctatacagtaagtcctcacttaaaatgttgttgatagg

SEQ ID NO: 55784 - DNA, 201 bp, Homo sapiens
gtattttctattgtatttttatttgcattctggtcaaatcttggtttctgagtttttctctgtattatctgtattaatgttagataacatagctatttttytaatataaaagttattttaagcagtttattcagaggggatattatttacctctgttaccctgtaggtctctaaacttttaagtagacttattttttaaaa

SEQ ID NO: 55785 - DNA, 201 bp, Homo sapiens
ctgtcacatttatcttactctgccatatgatcacatagaaaactggtaactaaagaatcacagagaagtccaaagacacatacaattctgtcttatgttayatgttatataatatacttcaaaataaaaatatcatatctaagttaagtcttggtctctgctgttagagattcctcactttaagtaagtagtatatcattt

SEQ ID NO: 55786 - DNA, 201 bp, Homo sapiens
gtgctaattacattctggactcagtggagctaagtggtttggctcctgttaagggtttagtaactgttgaagcttctactgttggtgattggttacgttcrgggaaatgagtaaatatagccaatttataattttatcactcacataagggctagttttgagttatgctaataaataatctgtaatcctgtcttttaaaat

SEQ ID NO: 55787 - DNA, 201 bp, Homo sapiens
ccaggttctacacatgttttaacacccaaaaagctgttggatgatataaagatgctgaataaacccaaggataaagtctccttaattaaagatgaatagcrtttctttttggagggtttagagattcttactaatatgttgaactaaaatagaaagaaaatgttgctgtcatgtaatttaaacaatgtaaatattttatgg

SEQ ID NO: 55788 - DNA, 201 bp, Homo sapiens
gttgataggttcttgttaactgacaaaaccaattttaccataggctaattgatataaacaagaattaagttccttggttatgtaatgtcaccaaacttctrcataaagacctgaaacacttcgaatattaaacattgaaagaaatgtgactatatgtacatttaagaaagattaataaaaacaggatcatttttttgccca

SEQ ID NO: 55789 - DNA, 201 bp, Homo sapiens
tgttatgctggtgaagagcctttttctttctctctctcttttttcttaaataatttttgtggatacatagtaggtgtatatatttatggggtacgtgacayattttgatacagacatacaatgcataatagtcacatcagggtaaacgggatatctatcacctcaagcatttatcctttctttgtgataaaaacaatccaa

SEQ ID NO: 55790 - DNA, 201 bp, Homo sapiens
atagtatgttctgtacgtttgtttaaccattaaatagtttttgaggcacaaatacatttctacttcaaaaatattttgaattttttgtggatatggacatkacattggcaaggcctgtgtggaattaagttttaagaatttcaggccaggctagtggctcaggcctgtaattccagcactttgggaggccaaagcagaagg

SEQ ID NO: 55791 - DNA, 201 bp, Homo sapiens
tgctcgccagaaacccagagctaattatttagaagaccgaaaaaatgggtcaaagctgattgtttttgtaattggagggatcacatactctgaagtgcgtkgtgcttatgaagtttctcaggcacataaatcctgtgaagttattattggtaagactttcattttcttcttttctgtttttttttttttttttgagactaa

SEQ ID NO: 55792 - DNA, 201 bp, Homo sapiens
ggaaatatgtctcttattttaaggacatgaagagtataagctaaagaacggaagacatgtatcaactatgggagatttttgggttactctctaatgggttmaggtttataatttatgtctgagatataggccgattttggtaatgttgtgtttctctgtgctaggagttagatttttattttagtctatctcagattcctt

SEQ ID NO: 55793 - DNA, 201 bp, Homo sapiens
gctttatcacaggtgaattcagcctcctgtttatactggtattttgattgtaagagctttattgcctccaacatgcatctcctgcttgtcacacctgtgtygatgagtgtgttgtccaggtcaaagaaaatggcctgcacgtggctcagccccatagcacctgtgccttgctgcaacctgccacgtcgctgcctgcacatg

SEQ ID NO: 55794 - DNA, 201 bp, Homo sapiens
ctatttttatccattacttgaaagctattgttttatttatttgtccaatcttatttatttatgaagggagagtaatgttgatatcagctacgttattgtgrgtgaaactggaagcctcctaaattcttctttcaaaaaaattgtcaaatattcagtaaattaactagatttgataatttgtaaaactctaggatttcaaag

SEQ ID NO: 55795 - DNA, 201 bp, Homo sapiens
taggactaggctcaactaattaaaagaaaactctggactttcagtggattacacaacacggaaatttatttcttcctaatacacaagaaatcaggaatagkctatataagggtgataatgctggctctatgaaattgtcaggggtctagtctcctaggcatggcccttatgatctaagatgattgtaaatttttttttttt

SEQ ID NO: 55796 - DNA, 201 bp, Homo sapiens
aaaggaattttcaagctattatacagttgtcccttggtaaacacagaggagggttggttccaggacctcctgtgtataccaaaatccacacatactcaagwcctgcatcagcccaacagaacctacatatctggaaagtcagcccttcatacacgcaggtttcacatcctgcaaatactgtattttctatctgttatttag

SEQ ID NO: 55797 - DNA, 201 bp, Homo sapiens
tggaaagtcagcccttcatacacgcaggtttcacatcctgcaaatactgtattttctatctgttatttagttgaaaaaactctgagtataagtgcatccaygcagttcaaacccaagttattaaatataccctcttactctaattacaaaagtaattagattttagttatatagtcttcatttttcctctcttgggctact

SEQ ID NO: 55798 - DNA, 201 bp, Homo sapiens
tgttgaccttgtaaattaaagtgtaatttgattgctttggagcatttttggtgtgtttgcttccttaactgtgtgtacagtagagctacatttaaacacakggaatttggcccttttgcttttaaaagtaaataccaggctcactatcatatttattgaaggagaaaccatattcaaaattgttaggctataattgttctg

SEQ ID NO: 55799 - DNA, 201 bp, Homo sapiens
gagaattgttttcatttttagctcccggaagcaagtgagaacatgcgaaatgttctttcagtgcctggcttatttcgcttaacatggtgaccgccagttcyatccatgttgttgtaaatgtcaagatccattcttttttatggctgaaacatttgtttcagtatttgtaatagtgtaataagaatgactcatatgtccatc

SEQ ID NO: 55800 - DNA, 201 bp, Homo sapiens
gtatcctccaaatcctctaacccagttctttgtacataagtaaattattttgttaattgaatgaatgaatgtatctgtgaggttttgctgtacatacgtayagtaagatttatattatgtctagcacaatgccatgtcttttggggaaatatgtctcttattttaaggacatgaagagtataagctaaagaacggaagaca

SEQ ID NO: 55801 - DNA, 201 bp, Homo sapiens
atcgatacatagaatccaatataatcatgatggaatactgtataggagataaaatgaataaatccgatatgtgtgtcaatgtcaatgtagataaatctcamacacacacacacacacacacatacatatgaaacagaaatgactggagggagaatacacatgaaattaattataatggttgccttggtttgaggcaggggt

SEQ ID NO: 55802 - DNA, 201 bp, Homo sapiens
tcataagcttttccctttttcacattttccttctgatcctcatacagataaagacattgtttttattatctgtcattctgtgacttccttttttttaaacaactgacattgactcaacatttttcatgttgcttcacaatctcgtaattaacattttaaattgctttttaaataccttgaggtggcaaaaaattttgatag

SEQ ID NO: 55803 - DNA, 201 bp, Homo sapiens
cataagcttttccctttttcacattttccttctgatcctcatacagataaagacattgtttttattatctgtcattctgtgacttccttttttttaaacaactgacattgactcaacatttttcatgttgcttcacaatctcgtaattaacattttaaattgctttttaaataccttgaggtggcaaaaaattttgatagc

SEQ ID NO: 55804 - DNA, 201 bp, Homo sapiens
ataagcttttccctttttcacattttccttctgatcctcatacagataaagacattgtttttattatctgtcattctgtgacttccttttttttaaacaactgacattgactcaacatttttcatgttgcttcacaatctcgtaattaacattttaaattgctttttaaataccttgaggtggcaaaaaattttgatagca

SEQ ID NO: 55805 - DNA, 201 bp, Homo sapiens
ccaggctggtctcaaactcctgacctttgatctacgcacctcggcctcccaaagtgctgggattacaggtgtgcgccactacgcctggccagcggtggtartctttacagttttatccgtttcttcatttggtcgttgttcttagccagctatgaatttctaagagctgagttatgttcagtcaacacttgtagaaaatat

SEQ ID NO: 55806 - DNA, 201 bp, Homo sapiens
gggaggctgaggcaggaggatcccttcagcccaggaggctgaggctgcagtggacattgattgtgccaccgcactccagcctgggtgacagagcaagaccytgagtctaaataaataaataaatagctagcgtaagcccgggcacagtggctcacgcctgtaattacagcactttgggaggccaaagcaggtggattgctt

SEQ ID NO: 55807 - DNA, 201 bp, Homo sapiens
agtcaacacttgtagaaaatattctgctgtttccagggttctactttagctcttgggaaggtggagggggttgtgttttctgtcagtcttgtacctttgtraataattaaccttttttctctggttgttttttgtcctcggttctgtatattctctgtgctatgtgtatctgaggatttatttttatttctttctttggaa

SEQ ID NO: 55808 - DNA, 201 bp, Homo sapiens
ggaattcctacaacctcccttccctttcaggttcattaatttgctggaatggctcacagaacttcagaaaacgcttaacttactattaccagtttattacaaaagatacaaatgaacagccaggttggagaggtacatagggtaaggtcaaaaaaggtcctaagcataggtgcttctatccacatggagttgggtgtctca

SEQ ID NO: 55809 - DNA, 201 bp, Homo sapiens
atggaaaatgtttttaaatcagtgaactaatttttaaaacatatttagataattttgaaagtcattgtaaggaacatatttattgattataaatcaagactgaatattggtatccaaatgctgtgatatgtattgttgaaaagcataatgtagtaaatcagtatgaaaaatgtttatgcagatttgatcatcagatataat

SEQ ID NO: 55810 - DNA, 201 bp, Homo sapiens
tggaaaatgtttttaaatcagtgaactaatttttaaaacatatttagataattttgaaagtcattgtaaggaacatatttattgattataaatcaagactgaatattggtatccaaatgctgtgatatgtattgttgaaaagcataatgtagtaaatcagtatgaaaaatgtttatgcagatttgatcatcagatataatt

SEQ ID NO: 55811 - DNA, 201 bp, Homo sapiens
ggagcttatttttttaaattactgtagccataactattagatttaacattcttttctctgaatcttctgtcagtttttttccctcagccgagacattaatwgacctctaaccaagcctaacttaattgctttgttgaggttgttctttaaatgttttactcatatatacatatatatatataaaacaattttgtatattga

SEQ ID NO: 55812 - DNA, 201 bp, Homo sapiens
tcagtttttttccctcagccgagacattaatagacctctaaccaagcctaacttaattgctttgttgaggttgttctttaaatgttttactcatatatacwtatatatatataaaacaattttgtatattgatacacaagctttacttcagtattttgatttagtttatggtttcatatatcgctttaaaatggatatcaa

SEQ ID NO: 55813 - DNA, 201 bp, Homo sapiens
tttatttctgcagactcatagttacttatttcagtatgtgtcttgtaattttgaatgctgagtttatttcagtagccagcattgagaacgcatcccttcargcaggttttgcatgtgcttttgccagattagaggttttttcttttttgtattaatgtctcagtttggggttcctcagaccatgaaggtagtatgattaat

SEQ ID NO: 55814 - DNA, 201 bp, Homo sapiens
tgttactcctaacttaatgaagttcaaaagtatacccagtattctcaagaaagtctgaccatataatatttatgttttgatgtttacacataaaataatctttttttttttttttttgagacaggatctcactctgtcacccaggctggagtgcagtagtgcgattttggctcactgcagcctcctcctcctgggttcaaa

SEQ ID NO: 55815 - DNA, 201 bp, Homo sapiens
ctcccaaagtgctgggatcacaggcatgagccactgcgtctggccctaactttttttgttaacttttaggtttggagtacatttgccagtttgttataggkaaactcatgtcaagggggtttgttacacagattatttcatcacccaggtactaagcctagtacccaatagttattttttctattcctttccctcctccca

SEQ ID NO: 55816 - DNA, 201 bp, Homo sapiens
ccaaagtgctgggattgcaggtgtgaaccaccacgcccagccttcatcacaattttttatggaaacagaatacaaagcagcaggaagctctaagtgtccarattcaagttttcatgttggtgccttctttaaatttacttttttttttttttttctttttttgagacagagtcttactctgtcacccaggctggagtgcag

SEQ ID NO: 55817 - DNA, 201 bp, Homo sapiens
tctaacaaagtaagctagagaaaagaaaatgttattaagaaaatcaaaaggaagagaaaatatacttactattaaatagaagtggattattatgaaggtcktcattcttgtcattttcaagttgagtaggcagaggtggaggaagcggagggattgatcttgctgtctcatggggtggcagaggcagaggaggtggcaggg

SEQ ID NO: 55818 - DNA, 201 bp, Homo sapiens
catctccccttgcctttgaggttgtcctgaccttatgcagggtgtcagctcccaatctgtaccttgcacagtacccagggctcggccccttgtttgctaasatcagaaaatactccacaaggcagaccaagcctcaactcagtttaccattctagtatttagcttcctttttaccaatagccctggagatttctctgactt

SEQ ID NO: 55819 - DNA, 201 bp, Homo sapiens
ttctcatgtttcttttttaaacatgcttggactttttgttatttcttattttgtcatactctctatcctcctttattgtctattgtcattttaaacatacytaatttgtagtctatatctaataaattcactaatttatactctttgggttcaattctgttgccttttatttctgcagactcatagttacttatttcagta

SEQ ID NO: 55820 - DNA, 201 bp, Homo sapiens
catgtaatattttatttcctttatattaaaaaatctgaagcagatatgataaggtttttccttgtaaattccaaatatatcgatataagattatttgatayattatctgaacttttacatgtttataaaataatttttcattttgtaaacattttttaaatttcagtttaattttagaattaaacttcatgatattataaa

SEQ ID NO: 55821 - DNA, 201 bp, Homo sapiens
actgtgtaataagtggaatgagagaagaatatacagagtataatgggaatatagtcccgggcttatcttctaaactggagtgttggaaggcatcccaagargaagaggccctttagcttgaagaatgaagtaacatgataaagagggagttcattgcatggaaaacaggattcttcaggtagaggcaatagagaaaaaggc

SEQ ID NO: 55822 - DNA, 201 bp, Homo sapiens
tgtggctaagtatggatgaagaactgaatttcttatttcatttaatttcaactaatttaaatttaaatagcctcatgtggctagtggctactatatgggaytctggggatctagagcaatctggaggaggaatggtaaaagtaatgactactatttattgagtacttacccaacaccagattctgtacttagtgtgttctg

SEQ ID NO: 55823 - DNA, 201 bp, Homo sapiens
tctgttatattccaatagtcttgtcttctatgttgtttcagttttcctagacctcttcattgccaataagagcatcctgttcatacatattaccttactctttttttttttttccaaaaccaaaaatggttaatattaccttactctttttaccttactaccttattagctatcactggctggagaacatagcatcttaaa

SEQ ID NO: 55824 - DNA, 201 bp, Homo sapiens
ttggctcactgcaacctccatctcccaagttcaagcgattctcctgcctcagcctcccaagtagttgagattacaggcatgcgtcaccacacctggctaatttttttgtatttttagaagagatggggtttctccatgttggtcaggctggtctcgaactgctgacctcaggtgatccagtatcctcggccttcccaagtg

SEQ ID NO: 55825 - DNA, 201 bp, Homo sapiens
atagcaaaacccaacttttttttttgagacagagtttcactcttgttacccaggctggggtgcagtggcgcgatctcagctcactgcaacctccacttccygagttcaagcgattctcctgcctcagcctcccgagtagctgggattacaggcatgtgctaccatgcccagctaattttgtattttttttttttagtagag

SEQ ID NO: 55826 - DNA, 201 bp, Homo sapiens
tacccaggctggggtgcagtggcgcgatctcagctcactgcaacctccacttcccgagttcaagcgattctcctgcctcagcctcccgagtagctgggatyacaggcatgtgctaccatgcccagctaattttgtattttttttttttagtagagatggggtttctccatgttgttcagggtggtcttgaactcccgacct

SEQ ID NO: 55827 - DNA, 201 bp, Homo sapiens
actgcaacctccacttcccgagttcaagcgattctcctgcctcagcctcccgagtagctgggattacaggcatgtgctaccatgcccagctaattttgtattttttttttttagtagagatggggtttctccatgttgttcagggtggtcttgaactcccgacctcaagtgatctgcccacctcagcctcccaaagtgctg

SEQ ID NO: 55828 - DNA, 201 bp, Homo sapiens
ttgctaaggataatgacctctagctccatccatgttcctgctaaagacataatctcattcttttttatggctgcttagtattctatggtacatatatatakagagagagataccacattttttttaatccagtctcccactgatgggcatttaggttgattccatgtctttgctattgtgaatagtgctgcagtgaacata

SEQ ID NO: 55829 - DNA, 201 bp, Homo sapiens
ccatttttcatatgcttgtgggtcacctgtatgtcttttgaaaagtgttgatatcctttgcccactttttaatggttttttttcttgtaaatttaagttcyttatagatgctgaatattagacctttgtcagatgcatagtttgcaaatactttctcccattgtataggttgtctgtttactctgttgatagttccttttg

SEQ ID NO: 55830 - DNA, 201 bp, Homo sapiens
tagtgaaaatatttccataagaggcaaagactataacaaagctacaagctcactgtgcaaaggtgtgaaaatgtcatggtaaaaagcaccacatgctaatttttttttttttttttttttttgagacggagtctcattccatcgtccaggctggagtgcagtggtgcaatctcgtttcactgcaacctccaccaggttcaa

SEQ ID NO: 55831 - DNA, 201 bp, Homo sapiens
gaggcaaagactataacaaagctacaagctcactgtgcaaaggtgtgaaaatgtcatggtaaaaagcaccacatgctaatttttttttttttttttttttytgagacggagtctcattccatcgtccaggctggagtgcagtggtgcaatctcgtttcactgcaacctccaccaggttcaagcatttttcttgcctcagcc

SEQ ID NO: 55832 - DNA, 201 bp, Homo sapiens
acaagctcactgtgcaaaggtgtgaaaatgtcatggtaaaaagcaccacatgctaatttttttttttttttttttttttgagacggagtctcattccatcrtccaggctggagtgcagtggtgcaatctcgtttcactgcaacctccaccaggttcaagcatttttcttgcctcagcctccagagtagctgggattacaga

SEQ ID NO: 55833 - DNA, 201 bp, Homo sapiens
tagagaaaagaaaatgttattaagaaaatcaaaaggaagagaaaatatacttactattaaatagaagtggattattatgaaggtcttcattcttgtcattktcaagttgagtaggcagaggtggaggaagcggagggattgatcttgctgtctcatggggtggcagaggcagaggaggtggcaggggaggcaggcacactc

SEQ ID NO: 55834 - DNA, 201 bp, Homo sapiens
ggattttacttttcagtttcttgagttgtgtcttgaaattattgtttgtaaaaatgtttcttttgattttggagggaaaaaaatcaaaaagttttagtgcytctgtctacttgtagatataaaacagatggaaaagaaaaggaggccatccttgaagaagaagatgacctctgggttagaattcgacatcgacatattgcg

SEQ ID NO: 55835 - DNA, 201 bp, Homo sapiens
cattccttcttgagtttaacttgagctttatcacaggtgaattcagcctcctgtttatactggtattttgattgtaagagctttattgcctccaacatgcmtctcctgcttgtcacacctgtgttgatgagtgtgttgtccaggtcaaagaaaatggcctgcacgtggctcagccccatagcacctgtgccttgctgcaac

SEQ ID NO: 55836 - DNA, 201 bp, Homo sapiens
atgtctttatactttttctacatatgtttgtatcctaaacagtgtcttgagttatatcttgcaggatttcctcttgatctttggctttcagcctttaactrtgttgtgtctaggtatagttctctttgtgtttattctacctgaggattgttgagtttcttaaatctgcaagttaataattttcatcaaatttgggaagtt

SEQ ID NO: 55837 - DNA, 201 bp, Homo sapiens
gatctgtccgccttggcctaccaaagtgctggggttacagttacaagccaccgtgcctagctgattttaatagcttttttttaactggagaaatctatttrttatgtacacaccacagaaaaattgcccccgcccctgaaaaaaaaaaggtcatgcaagaaaatcagattcctaatataaaaatgtatatatctaaagtag

SEQ ID NO: 55838 - DNA, 201 bp, Homo sapiens
attattttcccttattttctgtcctgaatttggtgtttattgcctgtatgtctttatactttttctacatatgtttgtatcctaaacagtgtcttgagttrtatcttgcaggatttcctcttgatctttggctttcagcctttaactgtgttgtgtctaggtatagttctctttgtgtttattctacctgaggattgttga

SEQ ID NO: 55839 - DNA, 201 bp, Homo sapiens
gtactttattataaaaaatattttcatgaaacaagaagtatttccttccccacctcctcttccttcacatagcagagaccttaatcctttttgataattayttttgtgttgaggtactttaaacatttaaaaagatacagagaatgttacaatgcatacccttatgcccagtgcccagcttattaactaaatcattataat

SEQ ID NO: 55840 - DNA, 201 bp, Homo sapiens
ccaaatgaagaaagggagtcatgcagcaaatattggtgtaataagtaaatgatttcactgatttttgaaggaaataaggtttgtgagtttcaaagaaaagrctaatcttatactaaatatttatgtctaaggttcctcaattgcaaatgcaagttttgacctttatgccaaacaaagtcctgcaatttacaattttattga

SEQ ID NO: 55841 - DNA, 201 bp, Homo sapiens
ataaaaaaaatgtgagcatgaacctatttacttataagttaagcattactgtaataaaaaatatataatctatgtatacagtatatttatatacatacatrtatcataaaatctaacattgaaaaaagggaaaattttaaagaataaaatgaaaaggaaaacttcccatatcccattgaattgtcttgagtacccctaggc

SEQ ID NO: 55842 - DNA, 201 bp, Homo sapiens
atttgaactggggaagcaaaggttgcagtgagccgagatggcaccactgcactccagcctgggcaacagagcgagactccatctccaaaaaaaaaagaggktctacttaataaatctaactgttttggagaaattacattgaaaatattttggatttttgattgtttgcaagtgaaaatgtaaatgaaatactactaggtg

SEQ ID NO: 55843 - DNA, 201 bp, Homo sapiens
tttattccccttttcctttgacttaaaccccagtttatactttctttggggagctaatttggtacagtgcataactatgatttctctgttttgcttggctwattttatgttattcacacatgcttaaacatatatgaaaaatctaaagaatttagactttgttttctctaacataagaattttttttcctttctcacaggg

SEQ ID NO: 55844 - DNA, 201 bp, Homo sapiens
ttatgagcttaataaaatcatgacactgattcttcggtcatgatcatatagtttttattccccttttcctttgacttaaaccccagtttatactttctttkgggagctaatttggtacagtgcataactatgatttctctgttttgcttggctaattttatgttattcacacatgcttaaacatatatgaaaaatctaaag

SEQ ID NO: 55845 - DNA, 201 bp, Homo sapiens
atttgggcaagttagttcatttcagaccgcaatgccctcatggtcaactggagataataatgcctgtctcacaggattactaaaagaattaaatgaaatartccatgtatttttgtttagtaaaatgtctaatatttagagctcaaatagtagctactattcataatttatataagttttagtgcttttggaactcaattc

SEQ ID NO: 55846 - DNA, 201 bp, Homo sapiens
tgcccacgcctcggcatgtggcccgtgacgccactgtgtgcacacccacgcagcacccgagtcaaagcgacacagaacctggcactgggacctgggacccyacggctgctccagggagggtctgtgtggagcagccagccggctctgccttcacgccctccacagggaatcacagttatctcactccctgcctcaaagggg

SEQ ID NO: 55847 - DNA, 201 bp, Homo sapiens
gggattaacacaattaccatcccatgcagcccctgggggacaggccgctcctcctgcctctctggctgcctgccaaggctgctggtgctgagtggagacgmcaccgtcctctggccccacagccccgaccccgccctcaggccccctgtgctcctcaccggcgggtcgcaggccaatctccaggctgcctctctggaattc

SEQ ID NO: 55848 - DNA, 201 bp, Homo sapiens
cagccccgaccccgccctcaggccccctgtgctcctcaccggcgggtcgcaggccaatctccaggctgcctctctggaattcacagcggctctgatgctcsggcataacgaggtggcggctgcggtggacgctggatatgagggtgggaaggttgccgtcctggctgcagaacgagaccgggaaaagctgaccccgtgggc

SEQ ID NO: 55849 - DNA, 201 bp, Homo sapiens
taggaggcgggaccggggaccccttccgtccaggagccctaggaggcgggacggggaccccttccgtccaggagccctaggaggcgggaccggggaccccytccgtccaggagccctaggaggcgggaccggggaccccttccgtccaggagccctaggaggcgggaccagtcatgcgtgcgctgcgggagtgcgtgcgtt

SEQ ID NO: 55850 - DNA, 201 bp, Homo sapiens
tcttcagcatccaactgaaccagagctgccaggttcactcctcgtccctcctacacgcccttccctgttcctccactctgcagacatcccctcgccttagrgctcctacacacccttcagggccccactcacacatcagcattctcacctccttgtgggtctctaggagggtgggaagggggaggtgacagcctcattttt

SEQ ID NO: 55851 - DNA, 201 bp, Homo sapiens
gagggtctgtgtggagcagccagccggctctgccttcacgccctccacagggaatcacagttatctcactccctgcctcaaagggggtcgaggggcccacygggcgcccgggaagaggccgatctgctcaggggcagtcctgcaggacaggccccaggagagaatgtgccacatgtgaaccatcccctgacccccgatttc

SEQ ID NO: 55852 - DNA, 201 bp, Homo sapiens
ggtgcccacaggcccagcatccatgactcttcagcatccaactgaaccagagctgccaggttcactcctcgtccctcctacacgcccttccctgttcctcyactctgcagacatcccctcgccttagagctcctacacacccttcagggccccactcacacatcagcattctcacctccttgtgggtctctaggagggtgg

SEQ ID NO: 55853 - DNA, 201 bp, Homo sapiens
gggctgcaggcaggaggagccgttactggagcggggtcggggggaccgcggctgggtttccctacaggcctcgctgacaaatgtattctgtagtgtcccawgtaaaaggctcataaaatgtcatcagtgttcatgacagttcataaaaatgatcaggtgagctggcaaccccaaaatgaggtagaaataagtttaaagatg

SEQ ID NO: 55854 - DNA, 201 bp, Homo sapiens
tggggcaggaggcgcaggaaggagaaggggagggggaggccagagcctggcaggtgtgaccccagctgcccacgcatgggcctcccgccaccgcccctcaktgatgaccacacggcctagcccttgcccattttcccaccagctcaggggcccaggagagaggggccaagcccccgcctgcaaacaatggctcgaggagca

SEQ ID NO: 55855 - DNA, 201 bp, Homo sapiens
acggcctggggctccgctggctccaaaaggcaggtggtcactgcagagccagccagacagggcgaaggggatggaaggacagacggacagatgggtggagrccactggacgggagcaaatgaacacacagatggaggtggcctggcagtgtgttctgtgggagcctgcagaggcagaaggacccagggacaggctgaaaca

SEQ ID NO: 55856 - DNA, 201 bp, Homo sapiens
tgtggagcagccagccggctctgccttcacgccctccacagggaatcacagttatctcactccctgcctcaaagggggtcgaggggcccaccgggcgcccrggaagaggccgatctgctcaggggcagtcctgcaggacaggccccaggagagaatgtgccacatgtgaaccatcccctgacccccgatttctgcacacga

SEQ ID NO: 55857 - DNA, 201 bp, Homo sapiens
tgactccacgccctgggggtctcccaggccagccagtgcctccgactctggcccttcctcatcctcatgagggctctagctgggtggagtgaggggccacycccctgtgacccaagacctccatgaggcctaggcagtggggctcccaagcccgtccccccacaagccctgccgtcagctccaggcctaattcctttttct

SEQ ID NO: 55858 - DNA, 201 bp, Homo sapiens
tcctgaggcagaggaggacggcctggggctccgctggctccaaaaggcaggtggtcactgcagagccagccagacagggcgaaggggatggaaggacagayggacagatgggtggagaccactggacgggagcaaatgaacacacagatggaggtggcctggcagtgtgttctgtgggagcctgcagaggcagaaggaccc

SEQ ID NO: 55859 - DNA, 201 bp, Homo sapiens
agcttcagccccaaacacagcccagcaggtggcagaggggaggcccaggccaggcccagctcactctcctgaggtcctcccttgggtcctgccgaccgcamccattccagaccacaccatccatgtacccatctccgacccaccccgagctcctccgaagcccctgactccacgccctgggggtctcccaggccagccagt

SEQ ID NO: 55860 - DNA, 201 bp, Homo sapiens
aggccccgtagagcctgtgagcccggaagtgcacgaacacgtcctgactccatgggtgagagctgccgggcaacccccatcacgtgcaccccacaggaccscagacacagacatgccggcacacgcacacgcgtgtacctgaggaggtctccctgtgtgaaggcacaggggagggcctgctggctcagaatatctcaatca

SEQ ID NO: 55861 - DNA, 201 bp, Homo sapiens
cacccgagtcaaagcgacacagaacctggcactgggacctgggaccccacggctgctccagggagggtctgtgtggagcagccagccggctctgccttcaygccctccacagggaatcacagttatctcactccctgcctcaaagggggtcgaggggcccaccgggcgcccgggaagaggccgatctgctcaggggcagtc

SEQ ID NO: 55862 - DNA, 201 bp, Homo sapiens
cgtgacgccactgtgtgcacacccacgcagcacccgagtcaaagcgacacagaacctggcactgggacctgggaccccacggctgctccagggagggtctrtgtggagcagccagccggctctgccttcacgccctccacagggaatcacagttatctcactccctgcctcaaagggggtcgaggggcccaccgggcgccc

SEQ ID NO: 55863 - DNA, 201 bp, Homo sapiens
gaagcaaatcagtgatgcagcgaaatcgtcagcatcagttaaatccactgtcatcacaaagaaaagggctggaccaattgatgatatggaaaaattacttkttatgtggatggaagaccagatacagaagcgtataccacttagcctactgatgatccaggctaaggcaagaagtctttttaatatgctaaaagaccgtgc

SEQ ID NO: 55864 - DNA, 201 bp, Homo sapiens
gacttgaactcgggaggcggaggttgcagtgagccgatatcgctccattgctctccagcctgggcgacagagtgagacttcgtctcagaaaaaaaaaaaaagaaagaaaaaatttcccccctttttcacacaaagagattaactagagaggtattaatccttactgacataccccaggcaccatactagactctgggaata

SEQ ID NO: 55865 - DNA, 201 bp, Homo sapiens
ttgccttttttctggatgaccattaagtgtatagtcaaaatgtttctctgataagcctatacctctgtaagttgttactgccggatagtgataactgtttkcctttcctttaagatgccctccaaatccttggttatggaatatttggctcatcccagtacactcggcttggctgttggagttgcttgtggcatgtgcctg

SEQ ID NO: 55866 - DNA, 201 bp, Homo sapiens
tgctgtttcagcctacaagcagattcaaagaagaaatcctgaaatgctcaaacaatgggaatactgtggccagcccaaggtggtggtcaaagctcctgatkaagaaaccctgattgcattattggcccatgcaaaaatgctgggactgactgtaagtttaattcaagatgctggacgtactcagattgcaccaggctctca

SEQ ID NO: 55867 - DNA, 201 bp, Homo sapiens
gcattagattctcatgcgagtgtgaaccctgttatgaactgcccatgcgagggatctgtgttgtgtacttcttatgagaatctaatgtctgatgatctgtyactgcctcccatctcacccccgatgggactgtcaaacacctttttataacatttaccagtcttgcaattatttgtcttcactacttatctatgaacagct

SEQ ID NO: 55868 - DNA, 201 bp, Homo sapiens
gcctaccttaaaggtgctcagaacacttaatttattagcgtacaatagggcaaaatcatctaacataaggcctacaagtgttgaatatctcatgtaattckttgaatactgtactgaaggtgaaaaacagaatgtttgtatgggtaaagtttctactgaatatgtgttgcttttgaaccattgtaaagccaaaaagcttaa

SEQ ID NO: 55869 - DNA, 201 bp, Homo sapiens
ctgtgctttcagctgtgtaaattaatggtgagtacccatacaaccattgttttccacttacagtattcaataaattacaggagatattcaacactattatmaaagagcctcgtgttagatgatttttgtccaactgtaggctaatgtaagtgttctgagcacatttaaggtaggctaggctaagtcatgatattctgtagg

SEQ ID NO: 55870 - DNA, 201 bp, Homo sapiens
gagccctctgttcctgttctgcgaaccgtcctttggaggaaaggaacaggctgctggggaggggaagactcagaatttctagttcccagcaaagcctccakgcaggcagtatcgatgcgctctctccgaaattgataaaatagcgagcaggcctcataccctcagctgggcacttatgaatatccccagcgtttcgagctg

SEQ ID NO: 55871 - DNA, 201 bp, Homo sapiens
tttagcctagcctaccttaaaggtgctcagaacacttaatttattagcgtacaatagggcaaaatcatctaacataaggcctacaagtgttgaatatctcrtgtaattcgttgaatactgtactgaaggtgaaaaacagaatgtttgtatgggtaaagtttctactgaatatgtgttgcttttgaaccattgtaaagccaa

SEQ ID NO: 55872 - DNA, 201 bp, Homo sapiens
tcattttctcctttataaactgtcttccgcccaggggccgctgagccctctgttcctgttctgcgaaccgtcctttggaggaaaggaacaggctgctgggkaggggaagactcagaatttctagttcccagcaaagcctccaggcaggcagtatcgatgcgctctctccgaaattgataaaatagcgagcaggcctcatac

SEQ ID NO: 55873 - DNA, 201 bp, Homo sapiens
tcaaaatgacctaaactgtttcatgtggatgcttgaatcttttctagtacactggtggtgggcaagagggtgttggaaacagggtgcaggcataagatcaraggtgtgttttgccttttttctggatgaccattaagtgtatagtcaaaatgtttctctgataagcctatacctctgtaagttgttactgccggatagtga

SEQ ID NO: 55874 - DNA, 201 bp, Homo sapiens
agaattgcttgaacccggaggcagaggttgcagtgagctgagatggcgccactgcactccagcctgggtgacaaagtgagatgccgtcttaagaaaaaaaraagaattctctgtctttgtctcttttagggggtgggggctgtaaaggcactagaaccataaatactatgtctgtgcagccctgtcaccgtatttaggcac

SEQ ID NO: 55875 - DNA, 201 bp, Homo sapiens
ttgaacccggaggcagaggttgcagtgagctgagatggcgccactgcactccagcctgggtgacaaagtgagatgccgtcttaagaaaaaaaaaagaattmtctgtctttgtctcttttagggggtgggggctgtaaaggcactagaaccataaatactatgtctgtgcagccctgtcaccgtatttaggcacttgagtgg

SEQ ID NO: 55876 - DNA, 201 bp, Homo sapiens
aatacaaacaattagctcggtgtagtggcgggtgtctgtaatcccagctatttgggaggctgaggcaggagaatcacttgaacccaggaggcagaggttgmagtgagccgagattgtgccattgcactccagcatgggagacaagaacaagactctgtctcaaaaagaaaaaagaacaagggctctggattaagacgacca

SEQ ID NO: 55877 - DNA, 201 bp, Homo sapiens
aggaagtgattagtagttttagtcttttggcttctaagtactactggagaaaatcacaaatagtatgttgccattaaaaagtcatcattaatcttaaccakgctttcaatattcctctgcaatcctgccatattttgccacaccttttatttccgcctttctcttctctactccattttaacttctgtctgagctccttcc

SEQ ID NO: 55878 - DNA, 201 bp, Homo sapiens
tcctacatatacacaaatgtttaaagcaagtcatggatggttccagcgcttcaaaaggcgtcataattttcacaatgtaaagatcactggtgaggcagcaygtgctggtaatgaaggtgccatagcttttaaggaacagctgcataggataattatggctaaagatctttgcaataaggagctgattgcactggaggaaga

SEQ ID NO: 55879 - DNA, 201 bp, Homo sapiens
atactttcctgccttcaaatccgtggacctacttgatttaaaactgaaattgggaaaggtgtcccttttcctttccaaaaccacatccctttataaagtckttctctatcttgagcatttacctgcctttcttctggcttcatcctattaacatttaaatatgcttatcctttcttcttaggagaaaaaaaaaattgcttt

SEQ ID NO: 55880 - DNA, 201 bp, Homo sapiens
aagaaaaaatttcccccctttttcacacaaagagattaactagagaggtattaatccttactgacataccccaggcaccatactagactctgggaatatgytatacagggaaagtggggcagtggcttaagggtcagagaagatttgggaaaggtttgtttgtttttttcggttgtaaactgcagacccggcgcggtggct

SEQ ID NO: 55881 - DNA, 201 bp, Homo sapiens
ttgaggccaggagttccagaccagcctgggcaacatagcaagaccaagtccatacaaaaataaaaaatttttaaaaaatcaggagggtgtggtggcatgcrcctgtagtcccatctacttggaaggctgaggtaggagaattgcttaagcccaggagtttgaggctgtagcgagctatgatcatgccactgaactctagcc

SEQ ID NO: 55882 - DNA, 201 bp, Homo sapiens
agtggcctacacgttagaagaaatggacgtcaattacgagagattcgccacagttgacaggcgcagatacaggatgctcttgcttgctacagagaaatatrtagtgaaaagaagaaacaagctgtacggtcaaaacttggtatcttcctgaagaacaacactatgcttgctaaaccatcaactagtgttgatgtcccaatg

SEQ ID NO: 55883 - DNA, 201 bp, Homo sapiens; identical to SEQ ID NO: 22826

SEQ ID NO: 55884 - DNA, 201 bp, Homo sapiens; identical to SEQ ID NO: 22746

SEQ ID NO: 55885 - DNA, 201 bp, Homo sapiens
atagtttggctgttaagtgtacttgtgacttactagaaatttacttttctttcaggatatcttatttggtttattgaagaagctatttcaggagaagtctsctaataggaaggagcatttaaaagtggtggtaatgtcagcaactatggaattagccaagctctctgcattctttggaaattgtccaatatttgatatacc

SEQ ID NO: 55886 - DNA, 201 bp, Homo sapiens
tgacactgctgtttgaacattaggagacagcaatcaaatatatgactgatggatgtttactgaaacatattctgggagacccaaatcttaccaaattcagwgtcattattttggatgaagcccatgaaagaactctaactacagtgagtattttaatttattattatttttttattagcaagtagtttgtttgggtagctt

SEQ ID NO: 55887 - DNA, 201 bp, Homo sapiens
agtgaaattatctatgtcagatgactattgcttagtaggcatttattatataacattgattctcttgtttcctcctcaaacctttactgaaaatgaccttrtagaattttgcttctatataggtagcctagattaaaaaatgattggatatttgttattgcatatataagtaaagaaatccatttacaaattattttttaa

SEQ ID NO: 55888 - DNA, 201 bp, Homo sapiens
tatttgtccctttttctgtatagacagcatgttttgtaacttaccatcattttgtatacataagttagactatttttatgtacccttttgtttagtcagaktggtttgatcacttaatgtttgtacctcttgaggaaaaatttagttgggaaaatagtggtgaattcctgtgacactgctgtttgaacattaggagacagc

SEQ ID NO: 55889 - DNA, 201 bp, Homo sapiens
tgatattgacttcaaggtattttgaatttcagtgaaattatctatgtcagatgactattgcttagtaggcatttattatataacattgattctcttgtttyctcctcaaacctttactgaaaatgaccttgtagaattttgcttctatataggtagcctagattaaaaaatgattggatatttgttattgcatatataagt

SEQ ID NO: 55890 - DNA, 201 bp, Homo sapiens
aagatgatattgacttcaaggtattttgaatttcagtgaaattatctatgtcagatgactattgcttagtaggcatttattatataacattgattctcttstttcctcctcaaacctttactgaaaatgaccttgtagaattttgcttctatataggtagcctagattaaaaaatgattggatatttgttattgcatatat

SEQ ID NO: 55891 - DNA, 201 bp, Homo sapiens
ggaggatttaatgactttgcaactttagctgtcatctttgaacaatgcaaatcaaggtatgtaaggtagtcctttgtcctgaaaaatgtcaatttgatgtrtagttccaatacgtacttatgatgtggcttgtgacactaacgttcagtgaagatgatattgacttcaaggtattttgaatttcagtgaaattatctatgt

SEQ ID NO: 55892 - DNA, 201 bp, Homo sapiens
catttttttttctgtaagcatggattactcttataacaaaactaatttaaaaagtaaattacaaatactatttttaaaaggcaaatagattgggagaagtratgttgctattcaggtaaaatctccaaagtgatatgaaaagaaaaaaaggaattgtgggagaaatagagcttcctaagagaagttaagaagagttaatat

SEQ ID NO: 55893 - DNA, 201 bp, Homo sapiens
tatgttccatttatagaaaaatgaaacattatgtacatatgcttatatatacatagaaattacctggaaggacacacactaaataatgaacagtactttgycttgaggattggtttatgggtagtgtgactggggaacattgaacttttacatgatattcttttataccattacatttttttttctgtaagcatggattac

SEQ ID NO: 55894 - DNA, 201 bp, Homo sapiens
agaactggttaaattgtgttatgttccccatactcctggggaataccatatcattgtttttttctttagacaaggtttcactctgttgcccaggccaaagygcagtgatgcgatcacggctcactgtagcctcaacctcctgggcttgggccgggcacggtggcttatgcctgtaatcccagcactttgggaggccgagac

SEQ ID NO: 55895 - DNA, 201 bp, Homo sapiens
ctgcatatatggagatcatgtctaattgcccataattgggaattggataaataagaactggttaaattgtgttatgttccccatactcctggggaataccrtatcattgtttttttctttagacaaggtttcactctgttgcccaggccaaagtgcagtgatgcgatcacggctcactgtagcctcaacctcctgggcttg

SEQ ID NO: 55896 - DNA, 201 bp, Homo sapiens
tctgaaagattagccctggataaagtgctgtatggggaatttgggcaatcagagagcacatgagtcctgaatgggatcaggggaagtggtatcgaagtaaktaacagataaatctcaaaaacgtaatgttgagcaagagaaaacagacacatcaagtacatactatacgattcatttatacaaaggttaaaaatgggcaaa

SEQ ID NO: 55897 - DNA, 201 bp, Homo sapiens
gaagctacttaaagcatgggatagaagactttataccttcatcagtgttttctttaatcaaattactttcctcctagtaacaggaactgctgctttgcagwttcacatcgtattctatagtaaatgctgctccctggattcaggcaacattgtgcctctgctagatctagctgtgataggtatagggaataggaattgtga

SEQ ID NO: 55898 - DNA, 201 bp, Homo sapiens
atatattagaaaaataggaacaataattaatatcatctgcattgaattatttttccatcttaagtcttaaaagccatagtgtactaaaaatcgcaaaattwtgtttcaaaatgcttgaaacaaaaaacaaagacttcctttttaaaaagttgtataaagaataaggagaggtagagccagtgtttggggtagatggtatag

SEQ ID NO: 55899 - DNA, 201 bp, Homo sapiens
caggggtctttggagaaatggggctgggaaaatgcaagatgagcccagaatatcttattttgccagcaagtaaagaagtgattaacaaaggttgaggccaygtcagaagaacataggagccagcatgaagaggccccaagtaatcaaatatgagacactttaagcatcaaaataagtagtgatagtagcggattattatgc

SEQ ID NO: 55900 - DNA, 201 bp, Homo sapiens
tcagtcagagtgtagtgaggaaggcatctttatagagaaaggggtaacagtgatggtgatggagattcattaaatacagaggaattgaacacataactctrtgagtgataatggtgaagggagttagaaatagcgaaagtgagaaaataggaatgatctctgtgctgttggattgaaatttcagtgtatcatgatgaagtt

SEQ ID NO: 55901 - DNA, 201 bp, Homo sapiens
ccttccttagtttataaatgacagtttattttcttaggattctcttatttatgttttttaactgtaaggattcttgacatgtaggtttttaaaatgttttwttgtagtaaaatatatataacttaaaatcgaccattttactattttggtatacaattcagtgccattaagtatgttcacaatgggctgggctcgatggct

SEQ ID NO: 55902 - DNA, 201 bp, Homo sapiens
aattagtctcccggagcagttcaagaaatggagattaataatcatttatatcttttccttaccagggtcatttgtatgtttgtatggtctgagataaatcrtattcttttttttttttttgtctctagctgcttcattcagttgctacctaggtaacatagttggaagctacttaaagcatgggatagaagactttatacc

SEQ ID NO: 55903 - DNA, 201 bp, Homo sapiens
atacattatattataatgtatatttatatataatatatagtatatattataatatattataatgtatatttatatataatatattataaattatataatayatataatatgttatatattaatatatataatatataatatattataatatatattatatattaaatatatattagtatataatatatataatatataaat

SEQ ID NO: 55904 - DNA, 201 bp, Homo sapiens
aggtgcttaaaatgaaatattttgggttaaaaattagtatccctggctggcgtgttggctcaagcctgtaatcccagcactctgggaggccagggcaggcrgatcacctgaggtcaggagttcaaggccaacctggccaacatggtgaaaccccatctctactaaaaaatgtaaaaattatttgggtgtggtggtgtgtgc

SEQ ID NO: 55905 - DNA, 201 bp, Homo sapiens
accaacagggaaaaaacccgtctctgctaaaatacaaaattagcccggcatggtggcacatgcctgttatcccagctactcgggaggctgaggcaggagarttgcttgaacctgggacgcagaggttgcggtgagccgagattgcgccattgcactacagcctaggcaacaagagcaaaactctgtctaaatatatataat

SEQ ID NO: 55906 - DNA, 201 bp, Homo sapiens
aaatttatcaaaaatgcatgcaaacacagactgcatggtgccatgattctagggattccaggaggcactgactcacaggtaggcttttctcctggtattgmgagccaggatggggtcgatgctggagtctagggcaatttgacttttggcatgatatcttctgggggatggcagttaggtgcttaaaatgaaatattttgg

SEQ ID NO: 55907 - DNA, 201 bp, Homo sapiens
ccacagagagaaaaacaggcagttaattttaaaggactccagctctttctcttcctcggggaattgggttttcttacatacaactgagtttttgcttatamagtctttaatttcttttaattcctgttccagtactagtctgttttataatttactaccataaaatatacacaaatctattataaaaagttaaaatttatc

SEQ ID NO: 55908 - DNA, 201 bp, Homo sapiens
ctcaggtgatcctcctgcctcggcctcccaacatgctgggattacaggcgtgagccatgcactcggccaattttttcaataaatatattggaaaagttttyggagatttgtgacactttgaaaaaactcacagatgaactccgtagcctggaaataccaaaaaaattaagaaaaagtatgtcatgaaaacataaactatgt

SEQ ID NO: 55909 - DNA, 201 bp, Homo sapiens
tacttatttgtagattttttgttttttgttttttttttttgagacagaattttgctcttgttgcccaggttggagtgcagtggcacaatctcaactcaccrcaacctctacctcccaggttcaagcaattctcctgcctcagcctcccgagtagctgagattacaggcatgtgccaccatgcccagctaattttgtatttt

SEQ ID NO: 55910 - DNA, 201 bp, Homo sapiens
tgggagtagtgggaactaccactgagctgctgaacccattggaacaactcttctgcaacacagagctgtggggaatagaggactgcgtaggctgtcattakctgttatgctttgatcttccctaccgagtagcatttaggagtcagggaaagggtgccgctttcaggctgccttgaaggctctcgcatagcccttccacac

SEQ ID NO: 55911 - DNA, 201 bp, Homo sapiens
ggggttggggagttaggagctgatactgtggctcactttgcatcttcctcagcacaaagccttttgagatgcaatctctggatgttcactagttgcaaacrtacaaacctggaatagctctaggaaactgggagtagtgggaactaccactgagctgctgaacccattggaacaactcttctgcaacacagagctgtgggg

SEQ ID NO: 55912 - DNA, 201 bp, Homo sapiens
gggtggtggtggtaatgggggcctgttcttcagtggctctcctatctgggtcctccctaaatagcagaagcttggggttggggagttaggagctgatactrtggctcactttgcatcttcctcagcacaaagccttttgagatgcaatctctggatgttcactagttgcaaacatacaaacctggaatagctctaggaaac

SEQ ID NO: 55913 - DNA, 201 bp, Homo sapiens
acctatttttctgtactcccattataagcatataccttagatgatttgatatttccttctaccttgcagcctcactcggtagagttagtttgtatatccartgtttatctggatgtattgtctctgactttttacctttttgtgaaaattaactatgattcaggtcccttatcttttctggatgtagtaaatagtgctatc

SEQ ID NO: 55914 - DNA, 201 bp, Homo sapiens
cacaggcgtgcagtcatagcacactacagccttgtatggagatcagccaatcctcccgcctcagtctcctgggtagctgggaccacaggcatgtgtcaccrtacttggctgttcacactttttaactacttggcaacttgaagcttcttttcaaatttaagattatgtataatgctttatgggtttcactaaataggaagc

SEQ ID NO: 55915 - DNA, 201 bp, Homo sapiens
agttaacctaaggagaccttttcatgactctttaaacttttaggtttaaaggttgactcggaaaagaaaaacaatttatatcaataaatctaaggtaggcwtatatgaatgctgcatacttttcatcactgcagtgttgtggaatgaaaagtaattgtatggattttatactatacaacattaaactcatagttatttgga

SEQ ID NO: 55916 - DNA, 201 bp, Homo sapiens
tttgcaggagtactatacaacaactgttcactttgatgaatctgaggcctttaaggttcagaactgctttccctatatcaatttttttttttcaaaaaagsctttacaaaataatttaacattgagtatttaattttacattgcaggtactggaaaatatttgttgaagaaattaattattccttaaaactttattattga

SEQ ID NO: 55917 - DNA, 201 bp, Homo sapiens
ctattgaagcatagatatctattttagattttgtcatcttcagggaaattcttaggatcattgtttaaggttctcattgttttctcaagatttggttcacygatgcttttataatttacattgaaactgataaaaacccattatgtttggtttgttattaatcattaactaaatatgtacatagacatatattattctata

SEQ ID NO: 55918 - DNA, 201 bp, Homo sapiens
attaataaacacctttcttaaaagtgctatataaaagtatgcttataataggaatgtttcctttaatttgtctagaattgaaagggaaataggcagggggsttcaaaaaacaaaagggaaattgaaggcatccagaaacttattttatttttgagaccgagtctcgctctgtcacccaggctggagtgcaatggtgtgatc

SEQ ID NO: 55919 - DNA, 201 bp, Homo sapiens
ctatattaacaaagttttggaatatatgtgtcagtaaagaacatagatgtgctattttggaaatcttttttatgatgatattagcttcttactctctattraagcatagatatctattttagattttgtcatcttcagggaaattcttaggatcattgtttaaggttctcattgttttctcaagatttggttcaccgatgc

SEQ ID NO: 55920 - DNA, 201 bp, Homo sapiens
gtagctatagccattaaccaaaggacagatgatatatatatatatgatatatatatatatataagttcttttttagctgtacctacgtacttatatcagcmccatgtatgtaggtgtgatagtactttcaaacagcgcctccacctggcctactctgttatttccacctgtttgggtagggccatttaacttccattatgc

SEQ ID NO: 55921 - DNA, 201 bp, Homo sapiens
ccattcccaaatatattaaaatggtatatggaaggtgcatatatatatatatataaatatagatatatatatttatttatttttttgagatgagatcttaytatgtcgcccaggctgatctcaaactcctgagttcaagcaatcctcctacctcaaccttctgagtagccaggctcctgagtagctgggattacaggtgtg

SEQ ID NO: 55922 - DNA, 201 bp, Homo sapiens
tattagtaagaatggaaatgcgccatcgattttaagatgcagctccattcccaaatatattaaaatggtatatggaaggtgcatatatatatatatataaatatagatatatatatttatttatttttttgagatgagatcttactatgtcgcccaggctgatctcaaactcctgagttcaagcaatcctcctacctcaac

SEQ ID NO: 55923 - DNA, 201 bp, Homo sapiens
ctgtattagtaagaatggaaatgcgccatcgattttaagatgcagctccattcccaaatatattaaaatggtatatggaaggtgcatatatatatatatataaatatagatatatatatttatttatttttttgagatgagatcttactatgtcgcccaggctgatctcaaactcctgagttcaagcaatcctcctacctc

SEQ ID NO: 55924 - DNA, 201 bp, Homo sapiens
acagtgcccagagcataaattgctccatagtcttgatccaaataaagttgggcacctcggcaggggcaaggtattgcccgtctttgataatcctttccccwtcctttcctggaaacaatctctgtgctatggagcaggagttggagagggtggtggtggtaatgggggcctgttcttcagtggctctcctatctgggtcct

SEQ ID NO: 55925 - DNA, 201 bp, Homo sapiens
ggagttaaatttacatatatctatattacatagatctataagggtattggttggcctgtgcctcctgtttgaagaagataggaattaattgagaaggattyggactatttggttggtttaatgtggaatagggcaggttattgagttaccatcattaaaagaaatgttttgtatagcttcatgaacaggaaaccaaacttg

SEQ ID NO: 55926 - DNA, 201 bp, Homo sapiens
caaaaataggtaactacaatgatattttgagagaccacattcacatataacttttattatagtacattgttataattgtcctattttcattgttaatatcktactgtgcctaatttataagttaaactttatcataggtatatatgtatagaaaaaacatagtgtatactgtatggggttcagtattagctgtggtttcag

SEQ ID NO: 55927 - DNA, 201 bp, Homo sapiens
ggctggtctgtctctattggtgtcacagcaagctgttagtctccactgattgctagctgctggctctgttgtttttgacagtgcccagagcataaattgckccatagtcttgatccaaataaagttgggcacctcggcaggggcaaggtattgcccgtctttgataatcctttccccatcctttcctggaaacaatctctg

SEQ ID NO: 55928 - DNA, 201 bp, Homo sapiens
tcgtctttcccctcccatctcctcagatcggtggacgtgctcgcctccactcggggccaggtctatgtcccggtttcccgcagtcgcgggcagggcgccamggcggcaggaggagggtgagcggtcaagagacctccaggaagagcggctctcggctgtttgcatcgccgatagaggtgcggtccgcgggacggtacggaa

SEQ ID NO: 55929 - DNA, 201 bp, Homo sapiens
ttttactgttgaatctgtgtttctggttaggagactactttcatggttgagggagttgatgaatttgtactgtgttcagccaaggagtagaggctcagacrttccctctctatttacttctcagaaggcacagctttgggcatgagaacaatcttctagaacaccaggaagactatgctcttagcaggtctctgtttcctt

SEQ ID NO: 55930 - DNA, 201 bp, Homo sapiens
gatgttttcaccttttactgttgaatctgtgtttctggttaggagactactttcatggttgagggagttgatgaatttgtactgtgttcagccaaggagtmgaggctcagacgttccctctctatttacttctcagaaggcacagctttgggcatgagaacaatcttctagaacaccaggaagactatgctcttagcaggt

SEQ ID NO: 55931 - DNA, 201 bp, Homo sapiens
gacctcaggtgatccgcccaccttggcctcccaaagtgctgggattacaggagtgagccaccatgcccggccccttgtcttaaattaaaacaaaaaaaaamaaaaactttaattcgtggattctttcttctgccagcccagatctactgttgagcccctctatggcagtttccattttgtttcttgtccttgtcaactcca

SEQ ID NO: 55932 - DNA, 201 bp, Homo sapiens
attatacactctcctttcttgtgtctggcttctttcagtcaacataatgtatgttaaggtttattcatattgttgtatgtatgaatactttattctttttrttgttgactagtattccactttatgaacatacagttgtgcattatcctgttgatggacatttgaattgcttcttgtttagttctatttttgagtaaagtt

SEQ ID NO: 55933 - DNA, 201 bp, Homo sapiens
tttcttcccattttaggccagtttgaaatagaaaaaagttgtgagttactttttcagatggcagagtctgttgattatgattatgatgttcaagataccaycctcgatggcttgttaatattgccgtgttatggatcaatgacaactggtaatttctcattagaatagaaaatttgatttttttaaaaaactttttattga

SEQ ID NO: 55934 - DNA, 201 bp, Homo sapiens
aagcaatcctcctgctttggtctcccaaagtgctgggtttacaggtgtaagccactatgcccggcctaaagtttggaaatttaactttgatacaatattaytatctaatccagaatccatattgaaattgtccattttccctagaatctacagaaagtagtttgagaattggtaagttatagtactgtgaaaaacaaccct

SEQ ID NO: 55935 - DNA, 201 bp, Homo sapiens
tggactagcttttctcctttgttaacaatttggtgagtcttctcaaatacagggtgaaaagcttgacgatgataaatatttttattcctttagagatttargtttcttagaaactgatgtttcttctacttcgaattttattgttgaaatatggtacagcttatgtgttcatctcctttacattaaatgagagatttacaa

SEQ ID NO: 55936 - DNA, 201 bp, Homo sapiens
tttgagagagagtctcactctgttgcccaggcagttagtgcagtggtgggatcatggctcactgcagccttgacctcccgggctcaagcaattctcccacytcagcctccttagtagctgggaccacatgcatatgctaccatgcctgactaatttttaaaaattttttgtagagatgaggtctccccatgttgcccaggt

SEQ ID NO: 55937 - DNA, 201 bp, Homo sapiens
cgagatattcttttggaaacattcaagcagttttgtgttgattggccaaaaacaatttagctctaataggaagacaattgctaacattgttgtgtttcttyatctctggttttgatagggttttcacaacatggtatgattggtgtaactcaaccacgaaaagtagctgctatatcagttgctcagagagtagctgaagaa

SEQ ID NO: 55938 - DNA, 201 bp, Homo sapiens
ttttgtttgagagagagtctcactctgttgcccaggcagttagtgcagtggtgggatcatggctcactgcagccttgacctcccgggctcaagcaattctyccacttcagcctccttagtagctgggaccacatgcatatgctaccatgcctgactaatttttaaaaattttttgtagagatgaggtctccccatgttgcc

SEQ ID NO: 55939 - DNA, 201 bp, Homo sapiens
aaactagtggcataacttttcaaatagcagcaccctcctaataggaattagtagtttccttgtttacctttttcctctgccttgtactaatgtcagaagtragggattgtcacaatctttgcctttttggagattacttaagtattttgaaatttaaccaaatgcaatagcacctggactagcttttctcctttgttaaca

SEQ ID NO: 55940 - DNA, 201 bp, Homo sapiens
tagtacattaatcaaaattaggaaattgttttgttttgtttgagagagagtctcactctgttgcccaggcagttagtgcagtggtgggatcatggctcacygcagccttgacctcccgggctcaagcaattctcccacttcagcctccttagtagctgggaccacatgcatatgctaccatgcctgactaatttttaaaaa

SEQ ID NO: 55941 - DNA, 201 bp, Homo sapiens
aggctcattagtaaatatatgtaaaacacactgaccttttaatagaaagaaattaaatagtgaaatattgttttttgttggtctgtcttagatagaaatgwaacctgactaaacagacctgagttaattccattatttcaaaggacatttcaccaggttcttctttgggtggtggcattgtactgtgtgataacaacacat

SEQ ID NO: 55942 - DNA, 201 bp, Homo sapiens
aattggaagcattgtgctcccttaccacaaaatatttacatctgtattaggcaagaacaagggcaatctctcatttaaccatagtacattaatcaaaattmggaaattgttttgttttgtttgagagagagtctcactctgttgcccaggcagttagtgcagtggtgggatcatggctcactgcagccttgacctcccggg

SEQ ID NO: 55943 - DNA, 201 bp, Homo sapiens
atctcagtttgcattgagaggactgtgagagcagtagtatcaagggaatgctggatctagttaaggcaagaacatggaagcagccttgcaggaaaggtggsttttatggaggagtttgttcttagaagaatgggaatacaccttcaagttactaaatgaaacaaaacagaatcaaaaacaaatttttttttgagacggagt

SEQ ID NO: 55944 - DNA, 201 bp, Homo sapiens
aattgtgatagtgttattgataaaaaatttctgtatctcagtttgcattgagaggactgtgagagcagtagtatcaagggaatgctggatctagttaaggsaagaacatggaagcagccttgcaggaaaggtgggttttatggaggagtttgttcttagaagaatgggaatacaccttcaagttactaaatgaaacaaaac

SEQ ID NO: 55945 - DNA, 201 bp, Homo sapiens
aatgtatacactttgatgagttttgacatttgcgtaaaacaactatcaagataatggtacatatccatcatctcccagttttctcatcctcccccccaccyttttttttttttgagatggagtctcactctgtcacccaggctgaagtgcagtggcgtgatctcggctcactgcaatctccacctcccaggtttaagcaat

SEQ ID NO: 55946 - DNA, 201 bp, Homo sapiens
gtgccaaaaacactggattcattggaggtgcttattttctgcatttcgtgtggaagctcaacttcgagaactaatcaggaagcttaaacaggtgattgccrtaatgttttttttcttgagtagcattttggacctatatatttcatattgaagtttcattgatgtacattagcaccctttctattctaccacccttccatt

SEQ ID NO: 55947 - DNA, 201 bp, Homo sapiens
tacctttttgtgaaaattaactatgattcaggtcccttatcttttctggatgtagtaaatagtgctatcaaatttttgggtaaatttagtaaggaaacacwaagaaattttaagtctggactgacaactaatgcaaagttctttaagactgggttatttatcatttaccgaatatattttatttctttagctaagtctgat

SEQ ID NO: 55948 - DNA, 201 bp, Homo sapiens
gaatagctctaggaaactgggagtagtgggaactaccactgagctgctgaacccattggaacaactcttctgcaacacagagctgtggggaatagaggacwgcgtaggctgtcattatctgttatgctttgatcttccctaccgagtagcatttaggagtcagggaaagggtgccgctttcaggctgccttgaaggctctc

SEQ ID NO: 55949 - DNA, 201 bp, Homo sapiens
aaaatatttcaaaacctattacagagtattgaagtaggagttaagagtgcagggttctgtccagctccactactacctaattatctgaccatggccctagyttttctagatttcatttttcatttgtaaaaccaagaagttggattaaggtgaccaactctaatagtcttttaaggctagaaaaagaaaaatgttttttcc

SEQ ID NO: 55950 - DNA, 201 bp, Homo sapiens
tcaagtgacccaccagccttggcctcttaaaatgctggtattacaggcctgagccattgcacccagcagttgcagtctgaaatgtcagaattttaattctrgtaatacccctaattgcaattttttgttctaataaaatgctgtataaaaataagtaatgttaactggttttcatgaggcagtatcagagctaaaaatacc

SEQ ID NO: 55951 - DNA, 201 bp, Homo sapiens
tggtctcaaactcctgagctcaagtgacccaccagccttggcctcttaaaatgctggtattacaggcctgagccattgcacccagcagttgcagtctgaartgtcagaattttaattctggtaatacccctaattgcaattttttgttctaataaaatgctgtataaaaataagtaatgttaactggttttcatgaggcag

SEQ ID NO: 55952 - DNA, 201 bp, Homo sapiens
tttgtatttttatagagatggggtttcactctgttgcccaggctggtctcaaactcctgagctcaagtgacccaccagccttggcctcttaaaatgctggkattacaggcctgagccattgcacccagcagttgcagtctgaaatgtcagaattttaattctggtaatacccctaattgcaattttttgttctaataaaat

SEQ ID NO: 55953 - DNA, 201 bp, Homo sapiens
ctccccagcagctgggaccacagatgcttgctactatgcctggctaattttttgtatttttatagagatggggtttcactctgttgcccaggctggtctcraactcctgagctcaagtgacccaccagccttggcctcttaaaatgctggtattacaggcctgagccattgcacccagcagttgcagtctgaaatgtcaga

SEQ ID NO: 55954 - DNA, 201 bp, Homo sapiens
ttaatttaaaaaatttttaaattttattgagacaaggtctcactgtgttgcccaggctggagtgcagtggcgtgatcttggctcattgcaacctctgcctyccaggctcaagtgatcctcccatacctcagcctccccagcagctgggaccacagatgcttgctactatgcctggctaattttttgtatttttatagagat

SEQ ID NO: 55955 - DNA, 201 bp, Homo sapiens
ggagtgcagtggcctgatctcggctcactacaagctctgcctcccagattcgtgccgttctctcgcctcagcctcccgagtagctgggactacaggcgccygccacaacgcccggctaattttttgcatttttagtagagacagggtttcactgtgttagccaggatggtctcaatctcctgaccttgtgatccacccgcc

SEQ ID NO: 55956 - DNA, 201 bp, Homo sapiens
actgtgtgcttgctcaggaagggaaatgggtccccatacctacctaccaggcccctcctccaggttggcagcgtggtaactgctctgtgccctgcccaccyggaacctggggcttcagttgcaatgccagctgccagtgtgcccatgaggcagtctgcagcccccaaactggagcctgtacctgcacccctgggtggcatg

SEQ ID NO: 55957 - DNA, 201 bp, Homo sapiens
ggctccgagtatgtcatgccaggtgagctggcacagggcctggggcacagatgagtggctggctcataggcacaagagtggatgctgggcatgacccaaasggaagatgaggagtggggaggagggaggaagggaggtcagggaggccaaagtactgatctccggggacaaaacagctctcttggactcctgcccatcgct

SEQ ID NO: 55958 - DNA, 201 bp, Homo sapiens
ttagaaggtaccaacagaaggggaactccaggcccctgcctccaacttaacccttacccaaaaaaaggagactagagtttcctggcggctctgatgccggyctgcctccttggctgtctccccaggctgccctctggggacatttggtgctaactgctcccagccatgccagtgtggtcctggagaaaagtgccacccaga

SEQ ID NO: 55959 - DNA, 201 bp, Homo sapiens
ccccacccaccccagctcatagcatagaatctggcccagccagctcccactgtgtgcttgctcaggaagggaaatgggtccccatacctacctaccaggcycctcctccaggttggcagcgtggtaactgctctgtgccctgcccacccggaacctggggcttcagttgcaatgccagctgccagtgtgcccatgaggcag

SEQ ID NO: 55960 - DNA, 201 bp, Homo sapiens
gcggagcctccctagtgacccccttaccccagcgatgtgcgaatcccactgaccacgcggaggggtcgggaagctgccctgcccctgcccagctcagaccrcgccacgcccccgcctctgcccccagctgccacccgatgaacggggagtgctcctgcctgccgggctgggcgggcctccactgcaacgagagctgcccgc

SEQ ID NO: 55961 - DNA, 201 bp, Homo sapiens
gtgcccaccctccgtacatctttcacagccctgattgcagctgtgttcactcaccaggtacctgcagaaggcctacagggtgccaggcacttctttaatgkgttctttctttatgtgattatttgattaatctctgcctcccccactagactgtaagctccctgaaggcaagaatcctgtgcttatgctcaatattagctc

SEQ ID NO: 55962 - DNA, 201 bp, Homo sapiens
tgacccccttaccccagcgatgtgcgaatcccactgaccacgcggaggggtcgggaagctgccctgcccctgcccagctcagaccgcgccacgcccccgcytctgcccccagctgccacccgatgaacggggagtgctcctgcctgccgggctgggcgggcctccactgcaacgagagctgcccgcaggacacgcatgggc

SEQ ID NO: 55963 - DNA, 201 bp, Homo sapiens
ccgcctctgcccccagctgccacccgatgaacggggagtgctcctgcctgccgggctgggcgggcctccactgcaacgagagctgcccgcaggacacgcaygggccagggtgccaggagcactgtctctgcctgcacggtggcgtctgccaggctaccagcggcctctgtcagtgcgcgccgggttacacggtgaggcgcg

SEQ ID NO: 55964 - DNA, 201 bp, Homo sapiens
ctgcaaggaagcgaggcaggtggagaggccaaggaatgggccgcccctctcacccgctcaccctctttcagggccctcactgtgctagtctttgtcctccygacacctacggtgtcaactgttctgcacgctgctcatgtgaaaatgccatcgcctgctcacccatcgacggcgagtgcgtctgcaaggaaggtaataggg

SEQ ID NO: 55965 - DNA, 201 bp, Homo sapiens
gttttgcttggagccgcacggccagctgatagtaaactggtgtatgtatccaggccccatctgcttctctttgccttgaagaggctgaagaggagaggagygcagtgggagtggagggagtggggagagtggtgggaggagccactccctcttatcttgtcctcatgtttccagaccgagactctgtgggctcccagcccc

SEQ ID NO: 55966 - DNA, 201 bp, Homo sapiens
ggagacgggggctctgggccccatttctagaggaagtgtgagccgggggaggggacagagggctgattaccagttgcctcctcctcctcagggagcagccrcctggaccgaagctacagctatagctacagcaatggcccaggcccattctacaataaaggtatgggcacaggggcaacaagggaggtggctgagctgggg

SEQ ID NO: 55967 - DNA, 201 bp, Homo sapiens
tcagtgccaggctggctggatgggtgagcattctggggccccaggcctactgtggattgggggatgcatccataggaaatgtgtccagaagagccccctgraactgaagggggcccagccaggcacacccgactgctgtctcccacaggtgcccgctgccacctgtcctgccctgagggcttatggggagtcaactgtagc

SEQ ID NO: 55968 - DNA, 201 bp, Homo sapiens
gacagagggctgattaccagttgcctcctcctcctcagggagcagccgcctggaccgaagctacagctatagctacagcaatggcccaggcccattctacrataaaggtatgggcacaggggcaacaagggaggtggctgagctggggctgaggaaccagtgcctccatgcggcctgacttctttcctctatccttagggc

SEQ ID NO: 55969 - DNA, 201 bp, Homo sapiens
aggccaaagtactgatctccggggacaaaacagctctcttggactcctgcccatcgctgagctcaccctgtgcttgtgtctgtcatgcagatgtccctccsagctacagtcactactactccaaccccagctaccacaccctgtcgcagtgctccccaaaccccccaccccctaacaaggtcagtgccgggggagggggtg

SEQ ID NO: 55970 - DNA, 201 bp, Homo sapiens
aaagggaagatgaggagtggggaggagggaggaagggaggtcagggaggccaaagtactgatctccggggacaaaacagctctcttggactcctgcccatygctgagctcaccctgtgcttgtgtctgtcatgcagatgtccctccgagctacagtcactactactccaaccccagctaccacaccctgtcgcagtgctcc

SEQ ID NO: 55971 - DNA, 201 bp, Homo sapiens
acagaccagcttctctggaaagccctgtccttgcctcttgctctccctcctgcactgtcccctcttaggttccaggcccgctctttgccagcctgcagaamcctgagcggccaggtggggcccaagggcatgataaccacaccaccctgcctgctgactggaagcaccgccgggagccccctccagggcctctggacaggg

SEQ ID NO: 55972 - DNA, 201 bp, Homo sapiens
ggcctttggggtcagcttcgggctcaaatcaggcatgacggggaggcgacgtggcctctcagagcctgtgtcctcatctggagaacagtatggtgtacctwcttcgcagagctcaggatagaagtggggtcgtacagcatcagagtggtggagttggtacccagaaaagtagggagccaggcaggtgataaagtctcctca

SEQ ID NO: 55973 - DNA, 201 bp, Homo sapiens
gtagccctggtggcactgttcattggctatcggcactggcaaaaaggcaaggagcaccaccacctggctgtggcttacagcagcgggcgcctggacggctscgagtatgtcatgccaggtgagctggcacagggcctggggcacagatgagtggctggctcataggcacaagagtggatgctgggcatgacccaaagggaa

SEQ ID NO: 55974 - DNA, 201 bp, Homo sapiens
tccttgcctcttgctctccctcctgcactgtcccctcttaggttccaggcccgctctttgccagcctgcagaaccctgagcggccaggtggggcccaaggrcatgataaccacaccaccctgcctgctgactggaagcaccgccgggagccccctccagggcctctggacaggggtaggtgccgggaggccagggtctctg

SEQ ID NO: 55975 - DNA, 201 bp, Homo sapiens
cttttctttctttctttctttcctttctttctttcttttctttcttctttctttcttcttttctctccctccctctctctttctttcttttttttttttttgacacggaatctcactctgttgcccaggctagagtgcagtggcatgatctcagctccctgcaacctctgcctctggtttagttaattcttttgcctcagc

SEQ ID NO: 55976 - DNA, 201 bp, Homo sapiens
cagcagagaactgggacaagggaggcagaaaaacagaaggaacagagggagaagagaaggcatgatgtggcatcaagagtgaggcctttggggtcagcttygggctcaaatcaggcatgacggggaggcgacgtggcctctcagagcctgtgtcctcatctggagaacagtatggtgtaccttcttcgcagagctcaggat

SEQ ID NO: 55977 - DNA, 201 bp, Homo sapiens
gctgtgactgtgaccactctgatggctgtgaccctgttcatggacgctgtcagtgccaggctggctggatgggtgagcattctggggccccaggcctactrtggattgggggatgcatccataggaaatgtgtccagaagagccccctggaactgaagggggcccagccaggcacacccgactgctgtctcccacaggtgc

SEQ ID NO: 55978 - DNA, 201 bp, Homo sapiens
actggcaaaaaggcaaggagcaccaccacctggctgtggcttacagcagcgggcgcctggacggctccgagtatgtcatgccaggtgagctggcacagggyctggggcacagatgagtggctggctcataggcacaagagtggatgctgggcatgacccaaagggaagatgaggagtggggaggagggaggaagggaggtc

SEQ ID NO: 55979 - DNA, 201 bp, Homo sapiens
tcgcctgctcacccatcgacggcgagtgcgtctgcaaggaaggtaatagggtggagtttcccagagagaagacttgggggatggccaagggaagaagggaragtccaagagtatgggtgggccaagggcaggggagcggctgcagggtaagggtggaggggcagcagctggacacagggaaagtatccaggctactttctt

SEQ ID NO: 55980 - DNA, 201 bp, Homo sapiens; identical to SEQ ID NO: 53294

SEQ ID NO: 55981 - DNA, 201 bp, Homo sapiens; identical to SEQ ID NO: 53295

SEQ ID NO: 55982 - DNA, 201 bp, Homo sapiens; identical to SEQ ID NO: 53296

SEQ ID NO: 55983 - DNA, 201 bp, Homo sapiens; identical to SEQ ID NO: 53202

SEQ ID NO: 55984 - DNA, 201 bp, Homo sapiens; identical to SEQ ID NO: 53297

SEQ ID NO: 55985 - DNA, 201 bp, Homo sapiens; identical to SEQ ID NO: 53298

SEQ ID NO: 55986 - DNA, 201 bp, Homo sapiens; identical to SEQ ID NO: 52999

SEQ ID NO: 55987 - DNA, 201 bp, Homo sapiens; identical to SEQ ID NO: 53035

SEQ ID NO: 55988 - DNA, 201 bp, Homo sapiens; identical to SEQ ID NO: 53037

SEQ ID NO: 55989 - DNA, 201 bp, Homo sapiens; identical to SEQ ID NO: 53043

SEQ ID NO: 55990 - DNA, 201 bp, Homo sapiens; identical to SEQ ID NO: 53046

SEQ ID NO: 55991 - DNA, 201 bp, Homo sapiens; identical to SEQ ID NO: 53047

SEQ ID NO: 55992 - DNA, 201 bp, Homo sapiens; identical to SEQ ID NO: 53048

SEQ ID NO: 55993 - DNA, 201 bp, Homo sapiens; identical to SEQ ID NO: 53122

SEQ ID NO: 55994 - DNA, 201 bp, Homo sapiens; identical to SEQ ID NO: 53049

SEQ ID NO: 55995 - DNA, 201 bp, Homo sapiens; identical to SEQ ID NO: 53123

SEQ ID NO: 55996 - DNA, 201 bp, Homo sapiens; identical to SEQ ID NO: 53052

SEQ ID NO: 55997 - DNA, 201 bp, Homo sapiens; identical to SEQ ID NO: 53128

SEQ ID NO: 55998 - DNA, 201 bp, Homo sapiens; identical to SEQ ID NO: 53054

SEQ ID NO: 55999 - DNA, 201 bp, Homo sapiens; identical to SEQ ID NO: 53131

SEQ ID NO: 56000 - DNA, 201 bp, Homo sapiens; identical to SEQ ID NO: 53055

SEQ ID NO: 56001 - DNA, 201 bp, Homo sapiens; identical to SEQ ID NO: 53134

SEQ ID NO: 56002 - DNA, 201 bp, Homo sapiens; identical to SEQ ID NO: 53136

SEQ ID NO: 56003 - DNA, 201 bp, Homo sapiens; identical to SEQ ID NO: 53003

SEQ ID NO: 56004 - DNA, 201 bp, Homo sapiens; identical to SEQ ID NO: 53332

SEQ ID NO: 56005 - DNA, 201 bp, Homo sapiens; identical to SEQ ID NO: 53142

SEQ ID NO: 56006 - DNA, 201 bp, Homo sapiens; identical to SEQ ID NO: 53221

SEQ ID NO: 56007 - DNA, 201 bp, Homo sapiens; identical to SEQ ID NO: 53226

SEQ ID NO: 56008 - DNA, 201 bp, Homo sapiens; identical to SEQ ID NO: 53265

SEQ ID NO: 56009 - DNA, 201 bp, Homo sapiens; identical to SEQ ID NO: 53269

SEQ ID NO: 56010 - DNA, 201 bp, Homo sapiens; identical to SEQ ID NO: 53150

SEQ ID NO: 56011 - DNA, 201 bp, Homo sapiens; identical to SEQ ID NO: 53270

SEQ ID NO: 56012 - DNA, 201 bp, Homo sapiens; identical to SEQ ID NO: 53271

SEQ ID NO: 56013 - DNA, 201 bp, Homo sapiens; identical to SEQ ID NO: 53272

SEQ ID NO: 56014 - DNA, 201 bp, Homo sapiens; identical to SEQ ID NO: 53014

SEQ ID NO: 56015 - DNA, 201 bp, Homo sapiens; identical to SEQ ID NO: 53274

SEQ ID NO: 56016 - DNA, 201 bp, Homo sapiens; identical to SEQ ID NO: 53276

SEQ ID NO: 56017 - DNA, 201 bp, Homo sapiens; identical to SEQ ID NO: 53275

SEQ ID NO: 56018 - DNA, 201 bp, Homo sapiens; identical to SEQ ID NO: 53017

SEQ ID NO: 56019 - DNA, 201 bp, Homo sapiens; identical to SEQ ID NO: 53016

SEQ ID NO: 56020 - DNA, 201 bp, Homo sapiens; identical to SEQ ID NO: 52981

SEQ ID NO: 56021 - DNA, 201 bp, Homo sapiens; identical to SEQ ID NO: 53277

SEQ ID NO: 56022 - DNA, 201 bp, Homo sapiens; identical to SEQ ID NO: 53280

SEQ ID NO: 56023 - DNA, 201 bp, Homo sapiens; identical to SEQ ID NO: 53279

SEQ ID NO: 56024 - DNA, 201 bp, Homo sapiens; identical to SEQ ID NO: 53339

SEQ ID NO: 56025 - DNA, 201 bp, Homo sapiens; identical to SEQ ID NO: 53078

SEQ ID NO: 56026 - DNA, 201 bp, Homo sapiens; identical to SEQ ID NO: 53080

SEQ ID NO: 56027 - DNA, 201 bp, Homo sapiens; identical to SEQ ID NO: 53023

SEQ ID NO: 56028 - DNA, 201 bp, Homo sapiens; identical to SEQ ID NO: 53082

SEQ ID NO: 56029 - DNA, 201 bp, Homo sapiens; identical to SEQ ID NO: 53024

SEQ ID NO: 56030 - DNA, 201 bp, Homo sapiens; identical to SEQ ID NO: 53319

SEQ ID NO: 56031 - DNA, 201 bp, Homo sapiens; identical to SEQ ID NO: 53084

SEQ ID NO: 56032 - DNA, 201 bp, Homo sapiens; identical to SEQ ID NO: 53026

SEQ ID NO: 56033 - DNA, 201 bp, Homo sapiens
tctttcctcactaacaggtcaaaatatgtattctgaatttttctggaagcttcacagttcaacctaaaatctttcctttaggtcattaatccacctggggytgagttgtgtgtatagtgtgaagtgctgtcccctctccttgttctcagatgagggccagctaccctgcaccctgcatgaagagcccggcccccctgttca

SEQ ID NO: 56034 - DNA, 201 bp, Homo sapiens
gctcagagaggcccccagcctggcagagcctccccgcttcctgccttatgtgggtggctctggacctagctttgcagcctgggctgccaccggtgacctgygagcttgagcatcttttcacgtcgttgctgggtcatcctccagcgaggtgcctgttcaggtctggtgaccatttccactgtgccttttctggctgacatg

SEQ ID NO: 56035 - DNA, 201 bp, Homo sapiens
attgcttgaacccagggagggccaaggctacagtgagctgtgatcataacactgtactccagcctgggtgacagagtgagaacctgtctcaaaaaaaaaaagaaaaaaattagtcacccaatattactgaaaataatagtgcatgtttgtattttacacgtacccctgagctatttggggtcacaaggaagctgttagtat

SEQ ID NO: 56036 - DNA, 201 bp, Homo sapiens
ctaattcttatatttttagtacagatgatgtttcaccatgttggctacagttgtgagccaccacaccaggccttctctcggaattttttttttttttttttgagacggagttttgctcttgttgcccaggctggagtgcaatggtgcaatcttggctcaccgcaacctccacctcccgggttcaagcaattctcttgcctc

SEQ ID NO: 56037 - DNA, 201 bp, Homo sapiens
gaccgagaagaagaggggggctggaggccatggccgcacccggagaaaagatgccagcaaggccacagggggtgtgaggggacactcgagtgccgccaccrgcagaggagctgcaggttggtcaccgtcctcgagtggaaacccgatggccaagccagagtcccgcaggttgaagcaagctgctctgcaaggtgaagccac

SEQ ID NO: 56038 - DNA, 201 bp, Homo sapiens
cgcccagaacacaggtgaggcccagcttgcggggcgggagggctggccatgggaggctgctgcctgcattcgaagcaggggtgcagggatgcccatgtgcraccctgctgaggcatgtgctggtggggaccgtggggatggccctgagtgttgagagtggtcctgggagcctgcggggccgactgtgtagctgtaggggcc

SEQ ID NO: 56039 - DNA, 201 bp, Homo sapiens
tcaagcaattctcctgcctcagactcctgagtagctgggattataggcccgcgccaccacgccaggctaatttttgtatttttagtggagacggggtttcmccatgttggtcaggctggtctcaaactcctgacttcatgatccgcccacctcagcctctcaaagtgctgggattacaggcatgagccatcacgcctggcc

SEQ ID NO: 56040 - DNA, 201 bp, Homo sapiens
ggattcaccacgttggccagactggtctcgaactcctgacctcaggcgatccacccgccttggcctcccaaagtgttgggattacaggcgtgagccaccgygcccgcgtaaataagtctttatattgagtttctttttcagagatttagaaaaaaatgggaaaaaagtaagttctttacttctcctttgcacccgaagaat

SEQ ID NO: 56041 - DNA, 201 bp, Homo sapiens
gcgacaggtggacctttttatcttttttgttttttccgcaaatgttttgaaggcaacaatttagatttttttttctttctttcttttttttttttttttttgagacagagtcttgctgtgtcacccaggctggagtgcagtggcacaatctcagctcactgcaacctccgcctctggggttcaagcaattctcctgcctca

SEQ ID NO: 56042 - DNA, 201 bp, Homo sapiens
gatatttaaagtctttgcctgtttttctgtggattgttcttttttgaggcggagtttcgctctgttgcccaggctggaatgcaaaggtgggatctcggctyatcgcaaccaccgcctctcaggttcaagcgattctcctgcctcggcctcctgggtagctgggattacaggcatgcgccaccacgcctggctaattttgta

SEQ ID NO: 56043 - DNA, 201 bp, Homo sapiens
ccccggaggttgaagctgcagtgagccgtaattatgccactgcactccagcctgggaaacagaacaaaaccctatctcaaaaaaagaaaactttttttttktttgttttctgttaggtcaattaagaataagaaaagattttattttaccttcacttacttctctctgatgctctccctttttttacatacattttagttt

SEQ ID NO: 56044 - DNA, 201 bp, Homo sapiens
gctcactgcaagctctgtctcctgggttcactccattctcctgcctcagcctcctgagtagctgggactacaggtgcgcgccaccacgccaggctaatttmttatatttttagtagagttggggtttcaccgtgttagccaggatggtctccatctcctgacctcgtgatctgcgcacctctgcctcccgaagtgctggga

SEQ ID NO: 56045 - DNA, 201 bp, Homo sapiens
aagcgattctcctgcctcggcctcctgggtagctgggattacaggcatgcgccaccacgcctggctaattttgtattattagtagagacagggtttctccrtgttggtcaggctggtcttgaattcctgacttcaggtgatccacccgcctcagcctcccaaagtgctgggattacaggtatgaacaaccgtgcccggcca

SEQ ID NO: 56046 - DNA, 201 bp, Homo sapiens
acatctgtgttgtttccactttggggctgttgggaatggtgctgctgtaaacattcatgggcagcgtcctgtggggacaggtgtgtcatttctgctgggtrtgcatgtctccaggagtggcagtcctgggccactgctccacacttaacctctcaggcacatgccagatggtcttcactaggctgtgccagttcacgtccc

SEQ ID NO: 56047 - DNA, 201 bp, Homo sapiens
attaagcttttaatggccatgggattaacagtgattgaccccctcccttcttttttttttaaatgatatcaataatttgtaccttctctctttttttttttccttttttctttcttgagacagggtcttgctctgacacccaggctgaagggcactggtatgattttggctcaccgcaacctccgcctcctgagctgaggt

SEQ ID NO: 56048 - DNA, 201 bp, Homo sapiens
catgaaaatttaaatttcttgcaggaaatttaaatttttgtttttgtgttttggttgagatttcaataaaagaaaaatgaaatcagaaaagaaatgcctasaaaagcctgtctggtttatttaaagaggtggaaagtgacaaatagactaggtcctttatagtattttttgtttcatgtttaaatttatttttttctaatg

SEQ ID NO: 56049 - DNA, 201 bp, Homo sapiens
ttcttaccgtacaagaaagcaaaagccccttgaggtccctcagtatcccttcccaccacctgcaccccacaggtggagaaattgcctgcttttagggagayagcagtgtaggcctctgaagtagaggagagccaccagggatggggagtggttgaagtatctttattttttaattatagaagtaatacacagtttttttaa

SEQ ID NO: 56050 - DNA, 201 bp, Homo sapiens
cactcatggtgcctgccccagacaggtggactttttgttgttgttgttgtttttgagacggagtctcgctttgtggcccaggctggagtgcagtggtgcartctcggctcactgcaagctctgtctcctgggttcactccattctcctgcctcagcctcctgagtagctgggactacaggtgcgcgccaccacgccaggct

SEQ ID NO: 56051 - DNA, 201 bp, Homo sapiens
atgatactgctctattaagcttttaatggccatgggattaacagtgattgaccccctcccttcttttttttttaaatgatatcaataatttgtaccttctytctttttttttttccttttttctttcttgagacagggtcttgctctgacacccaggctgaagggcactggtatgattttggctcaccgcaacctccgcct

SEQ ID NO: 56052 - DNA, 201 bp, Homo sapiens
gttacagccgagtccccacgctcacagccagatcacgggctccacgatggctgttccttttccgtgtaccttttttgagttaaaaatgttatttttttttkgtttgcttaatgtttacatgcttatccctgagtcagcaccatgcgttctgccggtatctaaaactcagcttgggtactcagatgtgatacctgaattcca

SEQ ID NO: 56053 - DNA, 201 bp, Homo sapiens
tttcctttttacattaccacctagacctttaatctctctcacatttgttttttgagtgacgcagcgtataattctaactcttccagatgagtgacccagtrgtcccaacaccattcatcgaattccatcctgactccacagatttggaatgtcatacatacattaaaccacatccacataaatataggggtctgtttcttt

SEQ ID NO: 56054 - DNA, 201 bp, Homo sapiens
actgggggtcagtcctgatcccgtccccatcagtctgtctgctgcttttgcgggcctggaggagacgccgggggtcagtcctgatcctgtccccgtcagcygtcttctgcttgtgcgggcctggaggagacactgggggtcagtccaatcctgtccccatcagtccgtcttctgcttgcgcgggcctggaggagacactgg

SEQ ID NO: 56055 - DNA, 201 bp, Homo sapiens
gagccccgtggcagtcgctgtggggtgtgctccgcacaggccagagagccggcccaaaaacctgaggtttgcaaagcctctttctttctttttttttttttgagaaaacgtctctgtcgcccaggctggagagcagtgacacgacctcggctcactgcaacctccgcctcccgggttcaagcaattcttgtacctcagcct

SEQ ID NO: 56056 - DNA, 201 bp, Homo sapiens
gccagcagcgattccttgagggtacattgttagcacgtctatgaaccacgtgttcgcggtcttgcttgcccactgagttataaacgttcttgatacagtarggataccaacgcctgttaaatattattcacctgtttcctaagttcagcaatttaacacttgcttcaaaatctgttttctttttattcctttatggattca

SEQ ID NO: 56057 - DNA, 201 bp, Homo sapiens
ctcggccactgggccaggccacatgtgcggccctccttggttccaagctgttcttggacgtggtctcctccacccccagagcctttgctttcctttccccmgatcttcttttcccagacttcctggaatttataatccaaaggttgtgtaatttcagaagctgcgatggttccaagaactcctgtccccgtcagtccgtct

SEQ ID NO: 56058 - DNA, 201 bp, Homo sapiens
ggcgcctgaggcggggctgcgcttccggggcggggccggcggaggctggagggggccgcccgggagcagaggcaggacttgcggcgcgtgcccctcacccyagcccggggctgtcctgcctcgtggggagtgtgaaggccatgcccggcgccgcggccctggtgcccctgttccactgggaccctggggggcgccgccagg

SEQ ID NO: 56059 - DNA, 201 bp, Homo sapiens
atacattttactggttactttatttaccattgtttgctgtatccaagtttcccctcctttttggcagtatttaatgactttttttttttttttttttttttgagacaatctcagactggagtgcagtggcatgatctcgtcttactgcggccacgaccccctgggctccagcgatcctctcacctgagcctcctgagtagc

SEQ ID NO: 56060 - DNA, 201 bp, Homo sapiens
gcgcggtggcgtgaccctggcgctggggggcgagcgcggccctcccggtcccgcaggcgcaagagagggcggagatgcggcgcctgaggcggggctgcgcwtccggggcggggccggcggaggctggagggggccgcccgggagcagaggcaggacttgcggcgcgtgcccctcaccctagcccggggctgtcctgcctcg

SEQ ID NO: 56061 - DNA, 201 bp, Homo sapiens
gcccgcctcggcctcccaaagtgctgggattacaggcgtgaaccaccgtgcccaacctcagggtgctttttttctttctttttctttttcttttttttttytttttttttttttttttgagaaggagtcttgctctgtcacccaggctgaagtgcagtggcatgatctcggctcactgcaacctccacctcttgggttcaa

SEQ ID NO: 56062 - DNA, 201 bp, Homo sapiens
gatgaggggccgggagaagaccccgtggctggggaagcaggagtggggagggcggggcctccgggccgaggggcgcggtcgctgtggtctgtggaggggcyggcgaggctcccgcctctgctcttgctggagctcttgagtgagccctgtgacgcctgctaggtgaggtggcagccagtgagcgcgccccaccgcccagcg

SEQ ID NO: 56063 - DNA, 201 bp, Homo sapiens
ttgcttgatgttttccgagcttcctggatctgtggtttggtgtcatcgataattttggaaaactctgaactatggttaattcaaatacttctgctcctttyatctctttctggcattcccattatgctcatgtaacacttttgccccacaattctccaatattctgattttttttttccgtttttttctctttgcatttca

SEQ ID NO: 56064 - DNA, 201 bp, Homo sapiens
ccgccccaggcctctgagccaggccagaccctgaggcttctcaggggccacccccccagctcccagaggcccctcctgtcctccagcgaggcactgacccmccacttctcacagcatccgtatgtgtgttttggtggctgtgggttgtatctgtgacctattttccctcaaaatcaagttcagggaaaaggttttttcgtt

SEQ ID NO: 56065 - DNA, 201 bp, Homo sapiens
gcaaggccacagggggtgtgaggggacactcgagtgccgccaccggcagaggagctgcaggttggtcaccgtcctcgagtggaaacccgatggccaagccrgagtcccgcaggttgaagcaagctgctctgcaaggtgaagccacacccagggcggcccaggaggccgccagccaggagcaggcccagcaagctctggaac

SEQ ID NO: 56066 - DNA, 201 bp, Homo sapiens
gctgaagggcactggtatgattttggctcaccgcaacctccgcctcctgagctgaggtgatcctcccacttagcctcctaagtaggtgggactacagatgsgtgccaccatgccctgctaatttttgtatgttttgtagagacagggttttgccatgttgcccaagctggtctggaactcctgagctcaagctatctgcct

SEQ ID NO: 56067 - DNA, 201 bp, Homo sapiens
ggagtacagtggcgcgatctcggctcattgcaacctctgccccctgggttcaagcgattctcctgcctcagcctcctgagtagctgggagtacaggcacgygccaccacacccagctaattttttgtatttttagtagagactgtgtttcaccttgttagccaggatggtctcgatctcctgacctcgtgatctgcccgcc

SEQ ID NO: 56068 - DNA, 201 bp, Homo sapiens
agcacaggctgtgccatacagcctaggtgcgtggtacgcggtaagtgcactctgtgacgtttgtacaatgatgaacttgcctcatgacgtgtttgtcaacrcatcccccatcagtaagtgctgcttgactgaaaggtgaagtaagtgtgccttgtttggagggcatccatccccttaacctggctggcactcgggctgtgt

SEQ ID NO: 56069 - DNA, 201 bp, Homo sapiens
gcttctggcttttctcgaaatattagatctgcagtaggtgctgcagcttggatggcagcagaccctggggccaggagccaaggccctgagctgtgaggccracctcactccccaccacatcccctgctctgaggccacccagaaccctgtgctgcagtaacatagtaaacactcttgggataaaatgcttttagttttttt

SEQ ID NO: 56070 - DNA, 201 bp, Homo sapiens
ggggtcacaaggaagctgttagtatgtggttctcatattcttaccgtacaagaaagcaaaagccccttgaggtccctcagtatcccttcccaccacctgcwccccacaggtggagaaattgcctgcttttagggagatagcagtgtaggcctctgaagtagaggagagccaccagggatggggagtggttgaagtatcttt

SEQ ID NO: 56071 - DNA, 201 bp, Homo sapiens
cgttcttgatacagtaaggataccaacgcctgttaaatattattcacctgtttcctaagttcagcaatttaacacttgcttcaaaatctgttttctttttrttcctttatggattcattatctacatataattcttgaaatctggattgtcaaaatccaagtacaaaacaagtgaaccttaatgtaaactatggaccctat

SEQ ID NO: 56072 - DNA, 201 bp, Homo sapiens
gaagaggagaggtgggaggtgagaggcaccgggcagggcgctgtgtgtggctccagccctctctggccctctgcacctgccccaaggtatgcgactcacamcacagtggtgtcatttgttttaatttgaacagatgtttagaaattgggatattttagcctaaaatcagcttctggcttttctcgaaatattagatctgca

SEQ ID NO: 56073 - DNA, 201 bp, Homo sapiens
tgagctgtgaggccaacctcactccccaccacatcccctgctctgaggccacccagaaccctgtgctgcagtaacatagtaaacactcttgggataaaatkcttttagtttttttaagttttctgctttttgaaatattaatttgtttggggaggtttttctttataacatttttattgaggtgtaattcgcataagtgaa

SEQ ID NO: 56074 - DNA, 201 bp, Homo sapiens
aattttcttactcattcttaagcatttcctcttctagatgaacttttgaataaacatctcaaggcttataaaatgtacatcaagactgcattgaatacatkaatgaatttgggtagaattgacatattttcatgggtagcaatatgcagcgtgacagtgtattacggtgactttaggtcatgttttgtgtattttagtata

SEQ ID NO: 56075 - DNA, 201 bp, Homo sapiens
agggacagtggctaggctgctgccacgttccacgcggcccgaagtggtggagggtgcagggggagcggccccaggagcaggttaacctggtgaggtgcagygtagacagaaggaggcgccgccgctgcttgtttactgcctgacctgttgtccctgtccaaattaaactccattaagattcagagcaaataacagcaagcc

SEQ ID NO: 56076 - DNA, 201 bp, Homo sapiens
agcctcgtttgtctttcttcgtctgcttgtccacttccttaccagtaacacatttttagctctcacagctgtatattacatgttaatgtctaagggaacgkttcccacattttttctccaaattttcttactcattcttaagcatttcctcttctagatgaacttttgaataaacatctcaaggcttataaaatgtacatc

SEQ ID NO: 56077 - DNA, 201 bp, Homo sapiens
gcaagaggctgaagaaagatgtggaaccaagctgcagtgggagcagcctgggacccgacaagggcctggcccagagccctcccagctcatcacttaccgcracaccgcagaagccttcccagagcccctctgcccctcctgccgacgtcaccccaaagccagccacggaagccgtgcagagcgagcacagcgacgccagcc

SEQ ID NO: 56078 - DNA, 201 bp, Homo sapiens
actcgtcactccgcccagacctctggccagtccctctttcataaaattcacctaacctccaaagctccttccagctctgaaattctgtgatctgggctgtyattgtcttttactttcttctgagacgtgatctttcatagtggaactacaattcccagaatgcaccatttaaagttagcattcacttcctgcagagccatt

SEQ ID NO: 56079 - DNA, 201 bp, Homo sapiens
acttgttttgcttttacagttgattattttaaggggagacatttaattatttctaattactttttgtcatttgtcctgtaggttccccctaaaggactcamaacgtctaatccaatggttaaaagctgttcagagggataactggactcccactaagtattcatttctctgtagtgagcatttcaccaaagacagcttctc

SEQ ID NO: 56080 - DNA, 201 bp, Homo sapiens
agaagccgcactcgtcactccgcccagacctctggccagtccctctttcataaaattcacctaacctccaaagctccttccagctctgaaattctgtgatstgggctgtcattgtcttttactttcttctgagacgtgatctttcatagtggaactacaattcccagaatgcaccatttaaagttagcattcacttcctgc

SEQ ID NO: 56081 - DNA, 201 bp, Homo sapiens
aagatgagtctccagccaccctctaggagacagaaaaggacatgccaggggtggccagagggactgctctggagagagaaagcatttaggatgtgcctgtytctgtggtgttgccttcctctgctgtagctggtggaggaggctgagggtagaagccgcactcgtcactccgcccagacctctggccagtccctctttcat

SEQ ID NO: 56082 - DNA, 201 bp, Homo sapiens
gaagatgagtctccagccaccctctaggagacagaaaaggacatgccaggggtggccagagggactgctctggagagagaaagcatttaggatgtgcctgkctctgtggtgttgccttcctctgctgtagctggtggaggaggctgagggtagaagccgcactcgtcactccgcccagacctctggccagtccctctttca

SEQ ID NO: 56083 - DNA, 201 bp, Homo sapiens
ggatgggtaagcctgctttcagtgtcttgggccaaaacatgaaaatttaaatttcttgcaggaaatttaaatttttgtttttgtgttttggttgagatttyaataaaagaaaaatgaaatcagaaaagaaatgcctagaaaagcctgtctggtttatttaaagaggtggaaagtgacaaatagactaggtcctttatagta

SEQ ID NO: 56084 - DNA, 201 bp, Homo sapiens
tcagcctcccaagtagctcggattacaggctcccaccaccatggccggctaattttttgtatttttagtaaagacggggtttcaccatgttggccaggcckgtctcgacctgacgtcaggtgatccaccctcgttggtctcccaaagcgctgagatgacaggcgtgagccaccatgcgcagtctagaaccaaatgttttaa

SEQ ID NO: 56085 - DNA, 201 bp, Homo sapiens
ttcattttctccctgatgctctttgtctccttcacacactcttcacaccagggcaccgtgcctcccgtgtgagctgctttcagccttgctgtaggacatgkaggacccctgagctatttggggtcacaaggaagctgttagtatgtggttctcatattcttaactgtacaagaaagcaaaagccccttgaggtccctcagt

SEQ ID NO: 56086 - DNA, 201 bp, Homo sapiens
cccgcctgcccctgggccctcacactctggctgctccgagaccctgcatcccctttcattttctccctgatgctctttgtctccttcacacactcttcacrccagggcaccgtgcctcccgtgtgagctgctttcagccttgctgtaggacatgtaggacccctgagctatttggggtcacaaggaagctgttagtatgtg

SEQ ID NO: 56087 - DNA, 201 bp, Homo sapiens
cctgggggctttggggacctctaccgagcgacttaatggacagaagctggaagcacaacctgaggggctgggcctccccattgggttgacatcagcaggaytgaggaagccaggaagcacacacagaaggcagggaccttgaggctagaaggagagcaggaggcaagaagagctgggtcttggagggccagtcctactagg

SEQ ID NO: 56088 - DNA, 201 bp, Homo sapiens
acttacaggctttctttgaccatttagaaggccagtttgcatgactgttccagaggaacttgaagaaggcattccttagttttgtttttgtttttgtttttgtttttgttttgagatggagtttcgctcttgtcacccaggctggagtgcaatggtgcaatctcggctcaccgcaacctctgcctcccagtttcaagcgat

SEQ ID NO: 56089 - DNA, 201 bp, Homo sapiens
gttggagacttattttacgccccagtatatggcctaacttcatgaatatttcatgtacacttaacgaatgtagcattcaatagttataaaagtcccctccrcaagctggaaaccctgggatgccagtgtcatggctcagtccaagtccaaaggcttcagaaccagggaagtcagtggtgtcactcttggtcctgggccaaa

SEQ ID NO: 56090 - DNA, 201 bp, Homo sapiens
actctcagaaaaagcaaatatcagaaactgttaaaatcatgaggaggttctttctgttcacgttttaaggaatatccttgaagttaaatcatcatgaacaktaataattattttaacatctattcaattaaaacatctgttgaggctggactcggtggctcacacctgtaatcccagtactttgggaggctaaggtgggca

SEQ ID NO: 56091 - DNA, 201 bp, Homo sapiens
cctctgaaacacattttcaagcaaacctgctgttttcagccttcatccacggccactggtagagacactcaggccacgccacggagcttttgtggggtgttaaggcaggctgttcgcctgtccccagtgctgcattcagcctcggccttcctgggtcggctgtgtcgggtccccgtgtgcgtctcatttccagcccctcac

SEQ ID NO: 56092 - DNA, 201 bp, Homo sapiens
gtgaggctttcctttagctgctccgtggcatctgggggatcaggctgggatgggacgtgtgagtgtctttactgtttgtgtgggtgttggtgggcatggcscagactgcaggccccacagagggtagcaatgcctcaatgagctgtgtactgagcctggtggagcctgtgagctgccgagggtccctggccagcttgcccc

SEQ ID NO: 56093 - DNA, 201 bp, Homo sapiens
tgttttttgttttgttttgtttgagacagagccttgctctgtcgccaggctggggtgcagtggcgtgatcatctcagctcattgcaacctccacctcccakgctcaagcaattctcctgcctcagccttctaagtagctgggatcacaggcgcccgccaccagccccagtgtcgtatttttagtagagacagggattcacc

SEQ ID NO: 56094 - DNA, 201 bp, Homo sapiens
ataactggactcccactaagtattcatttctctgtagtgagcatttcaccaaagacagcttctccaagaggctggaggaccagcatcgcctgctgaagccyacggccgtgccatccatcttccacctgaccgagaagaagaggggggctggaggccatggccgcacccggagaaaagatgccagcaaggccacagggggtg

SEQ ID NO: 56095 - DNA, 201 bp, Homo sapiens
ctcctctccctaggctctgggaacccgcattctcctgtctctatgaatttgattactctgagtacctcatgtgagtggtatcatgcagtgtttgttttttkgcacctgccctatttcattcagtataatgtcctcaaggatcatctgagttggttgattttttttgaggggagaagaccgggtttcactctgttccccagg

SEQ ID NO: 56096 - DNA, 201 bp, Homo sapiens
agctgccataggcttggattcttgttggaaacagctgctataatttattctgatgaattactgttccaaagatggtatttctgagctttccaagaacacaytggacatcagttctagttacagtgaaagtgggaggcagtggagaagggaagcactggaagctcagcgcttgtctgatcaggtatatgatttgtagagacc

SEQ ID NO: 56097 - DNA, 201 bp, Homo sapiens
cactgtactccagcctaggtgacagtgagaccctgtctcaaaaaacaaaatttcctgtgtaatctttgtatgtatattagctctatttctgttttttcccrtattttactgttaagtatttcttaaaattggtttctagatgtttacatatggcggatggtttcctttgcctgtcgtgtacataggaaaaccatattccta

SEQ ID NO: 56098 - DNA, 201 bp, Homo sapiens
tcagttagcatttttggtttgcagcaatttcctttttgttcttttgtccatcactcctcttacattgcccatgttttcttgcctatcacccactttttccrttagagcccttagcatattaattgtactgattttattattattactattattttgagatggagtcttgctctgttgcccaggctggagtgcagtggcaca

SEQ ID NO: 56099 - DNA, 201 bp, Homo sapiens
tcatccacctcccaagttctattccttgttgttattaaaaatttggtgtgtaagccaggcacagtagctcttgcctgtaatctcagcacttcgggaggccraagagggaaggttacttgagtccagaagttcaaaccagcctgggcaacatagggagaccccatctctataaataatttaaaaattagccgagtaccatgg

SEQ ID NO: 56100 - DNA, 201 bp, Homo sapiens
tcagaaactgttaaaatcatgaggaggttctttctgttcacgttttaaggaatatccttgaagttaaatcatcatgaacattaataattattttaacatcyattcaattaaaacatctgttgaggctggactcggtggctcacacctgtaatcccagtactttgggaggctaaggtgggcagatcacttgaggtcaggagt

SEQ ID NO: 56101 - DNA, 201 bp, Homo sapiens
ggtctcgaactcccgacctcaggtgatccacccgcctcggcctcccagcttctcttggaattttaaagctgtttgtagttatcagagctaatgctgctttwgacagcttctctctgttcctcttggttaaacttcctgaagtttgtctccattacaggtttttgcaaacagccagcccttcgtgtctctgagttgttgttt

SEQ ID NO: 56102 - DNA, 201 bp, Homo sapiens
aactcctgacctgaggtgatctgcccgtctcggcatcccaaagtgctgggattacaggttcagtgagccattgcgcccggcccaaagcctctttcttttcrgtgctgagctggataaagtctaccaaactgaaaggtctccaaggctatagctggctgtctgagaaattatggtgtttgtttagcccatcttaggacttgg

SEQ ID NO: 56103 - DNA, 201 bp, Homo sapiens
cgtgcaaaaatacttgttttgcttttacagttgattattttaaggggagacatttaattatttctaattactttttgtcatttgtcctgtaggttcccccyaaaggactcaaaacgtctaatccaatggttaaaagctgttcagagggataactggactcccactaagtattcatttctctgtagtgagcatttcaccaaa

SEQ ID NO: 56104 - DNA, 201 bp, Homo sapiens
tttctgagacagggtctcgctctgtcacccaggttggagtgtagtgatgtgctctcggctcattgcgatctctgcctcccaggcccaagcgatcctcccasctcagcctcctgagtagctgggacgacaggcacgtgccaccacgcccagccaattttttgtagttctggtagagacagtgttttgctatgttgcctgggc

SEQ ID NO: 56105 - DNA, 201 bp, Homo sapiens
gacatctgtgttgtttccactttggggctgttgggaatggtgctgctgtaaacattcatgggcagcgtcctgtggggacaggtgtgtcatttctgctgggwatgcatgtctccaggagtggcagtcctgggccactgctccacacttaacctctcaggcacatgccagatggtcttcactaggctgtgccagttcacgtcc

SEQ ID NO: 56106 - DNA, 201 bp, Homo sapiens
tatccaagtagcctgctgtcgcccagccgcggtcagtaccggagcctcgcgtacccatgttcccttcccgttaggaggggtttctctgcaaggtggccagygtcccctgagcatttctgggaggtgtcacaagctccctgcgctctcaggaggaagctctggtcgtaaccataccttgtggatgagggaatccaggttaga

SEQ ID NO: 56107 - DNA, 201 bp, Homo sapiens
attcctatcctgtgccttgcctttctgtttcctagacagtaccatttgaagaaccaaatgttgttttttttggtgggggtggggggtttcttttctttttyttttttttttttgagacattgtttgctctcgttgcccaggctggaatgcaatggcctgatctcagctcactgcaacctctacctcccagattcaagcgat

SEQ ID NO: 56108 - DNA, 201 bp, Homo sapiens
caagatgaacccagtggtggagccactgtcctggatgctgggcacctggctgtcggacccacctggagccgggacctaccccacactgcagcccttccagwacctggaggaggttcacatctcccacgtgggccagcccatgctgaacttctcgtaagttgtctccctccaccccaccctgcttgactcatgggccgccta

SEQ ID NO: 56109 - DNA, 201 bp, Homo sapiens
cctgatcccgtccccatcagtctgtctgctgcttttgcgggcctggaggagacgccgggggtcagtcctgatcctgtccccgtcagccgtcttctgcttgygcgggcctggaggagacactgggggtcagtccaatcctgtccccatcagtccgtcttctgcttgcgcgggcctggaggagacactgggcatcagtccgat

SEQ ID NO: 56110 - DNA, 201 bp, Homo sapiens
ggttccaagaactcctgtccccgtcagtccgtcttctgcttgcgcgggcctggaggagacactgggggtcagtcctgatcccgtccccatcagtctgtctkctgcttttgcgggcctggaggagacgccgggggtcagtcctgatcctgtccccgtcagccgtcttctgcttgtgcgggcctggaggagacactgggggtc

SEQ ID NO: 56111 - DNA, 201 bp, Homo sapiens
cgagcgagactctgttatcagaaaagaaaaaaaaagatcttcacatactattcagattgctcacagtgtgcaattctgtggtttttagtatgttcacagcyctgtgtacccatcactacagttaatttcagaacatttatcttctgtggcacaatcataactcactgcagcctcaacccccctggactcaggtgatcctcc

SEQ ID NO: 56112 - DNA, 201 bp, Homo sapiens
attttagtatatagaaaagctttatttctttatagttttaattatacaggtcttgtacatttcatgttagggtaaactcaagtgttttatcatttttgttrcttgtaaatagattttttcccatttaatcttcagattgattattgataattgtgtggacacttctgatttctctgtgttgaactgggccactggtgtaac

SEQ ID NO: 56113 - DNA, 201 bp, Homo sapiens
aacatttatcttctgtggcacaatcataactcactgcagcctcaacccccctggactcaggtgatcctcccacctcagcctcctcagtagctgggactgcraatgcgcaccaccacacctggctcatttttttgtttgtttttgatttggggtttttctttaagagagggtctcattccatcacctaggctggaatacagt

SEQ ID NO: 56114 - DNA, 201 bp, Homo sapiens
tgtgctgtattttgtttatccattcctcattgatgggcaagttgttcgttactgaatcttggctgttaagaagaatactgtgcctcgcgtggtggctcacrcgtgtaatcccaacactttgtggggctgaggcaggagatcacttgagcccaggagttcaagaccagcctggacaacatagcaaaacctggtttcacaaaa

SEQ ID NO: 56115 - DNA, 201 bp, Homo sapiens
gcgtgacagataagagtggcatttctatggatgactttacgcccccaggatctggggcgtgcaaatttatcggctcacttcattcgtacagtttctcctcyaagcacacccgagaaaggccatctgtcccccgagagcccattgaccgcaagaggctgaagaaagatgtggaaccaagctgcagtgggagcagcctgggac

SEQ ID NO: 56116 - DNA, 201 bp, Homo sapiens
accaccaagagaatcattgagaatggccaagaaagggtggaagtggaggaagatggagagttgagttaaagtccttcataataaacggcatagagcagttrctccccattgacaccaagtaattccagtccacatttgcctttaagcacatctggaggaatagcggactttttttaggattgaaagtgaactttactttca

SEQ ID NO: 56117 - DNA, 201 bp, Homo sapiens
taaaaaaatcaccaccaagagaatcattgagaatggccaagaaagggtggaagtggaggaagatggagagttgagttaaagtccttcataataaacggcawagagcagttgctccccattgacaccaagtaattccagtccacatttgcctttaagcacatctggaggaatagcggactttttttaggattgaaagtgaac

SEQ ID NO: 56118 - DNA, 201 bp, Homo sapiens
atggtaaaaaaatcaccaccaagagaatcattgagaatggccaagaaagggtggaagtggaggaagatggagagttgagttaaagtccttcataataaacrgcatagagcagttgctccccattgacaccaagtaattccagtccacatttgcctttaagcacatctggaggaatagcggactttttttaggattgaaagt

SEQ ID NO: 56119 - DNA, 201 bp, Homo sapiens
gatggtaaaaaaatcaccaccaagagaatcattgagaatggccaagaaagggtggaagtggaggaagatggagagttgagttaaagtccttcataataaayggcatagagcagttgctccccattgacaccaagtaattccagtccacatttgcctttaagcacatctggaggaatagcggactttttttaggattgaaag

SEQ ID NO: 56120 - DNA, 201 bp, Homo sapiens
gagggcggctgcgcaggcggcaggcccttcaaggaccccttcgagtacgtcttcagcttccgtgaccccgccgaggtcttcagggagttctttggcggccrggacccattctcctttgacctcttgggaaacccgctggagaatattttggggggtcagaggaactccctgggaagcagaagcagagggtctgcacccctt

SEQ ID NO: 56121 - DNA, 201 bp, Homo sapiens
ggaagtggaggaagatggagagttgagttaaagtccttcataataaacggcatagagcagttgctccccattgacaccaagtaattccagtccacatttgmctttaagcacatctggaggaatagcggactttttttaggattgaaagtgaactttactttcagaacagctgtacccaagaatttataaacactttatgcc

SEQ ID NO: 56122 - DNA, 201 bp, Homo sapiens
ggactttttttaggattgaaagtgaactttactttcagaacagctgtacccaagaatttataaacactttatgccaatgcctgtctttattgttgggactrcacggataggacctctgtttgtctttcgatcattgtaaatatctgtatgcaatttgctatttattaaacttaagcctgaggcagacaatgattatttcct

SEQ ID NO: 56123 - DNA, 201 bp, Homo sapiens
caagagaatcattgagaatggccaagaaagggtggaagtggaggaagatggagagttgagttaaagtccttcataataaacggcatagagcagttgctccscattgacaccaagtaattccagtccacatttgcctttaagcacatctggaggaatagcggactttttttaggattgaaagtgaactttactttcagaaca

SEQ ID NO: 56124 - DNA, 201 bp, Homo sapiens
tgtcggacgcgtagaaacgcgatatctatgaccgctatggcgaggcgagggcggagggcggctgcgcaggcggcaggcccttcaaggaccccttcgagtasgtcttcagcttccgtgaccccgccgaggtcttcagggagttctttggcggccgggacccattctcctttgacctcttgggaaacccgctggagaatattt

SEQ ID NO: 56125 - DNA, 201 bp, Homo sapiens
gggattccagacatgtgatttcacttcttccttctagttctgtcttagcattggctttgggggtagatggagaagttcagtggtggggagggggtcagatytaactgagattggatctagtgtggacactacaggtcatgactctttggagtggtctcagaagctggctgggtcctgggccaaatcagatggcatgggagc

SEQ ID NO: 56126 - DNA, 201 bp, Homo sapiens
ccgttgcctgtgcccgcactgcgtcagcctacagacaggctcccacatggacccccggggcaactcggagctgctctaccacaaccagactgtcttctacmggcggccatgccatggcgagaagggcacccacaagggctactgcctggagcgcaggctgtaccgtgtttccttagcttgtgtgtgtgtgcggccccgtgt

SEQ ID NO: 56127 - DNA, 201 bp, Homo sapiens
ccacttgccatgaagggccaggatgcccagatgcttggcccctgtgaagtgctgtctggagcagcaggatcccgggacaggatggggggctttggggaaarcctgcacttctgcacattttgaaaagagcagctgctgcttagggccgccggaagctggtgtcctgtcattttctctcaggaaaggttttcaaagttctgc

SEQ ID NO: 56128 - DNA, 201 bp, Homo sapiens
ctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcaggaa

SEQ ID NO: 56129 - DNA, 201 bp, Homo sapiens
gctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcagga

SEQ ID NO: 56130 - DNA, 201 bp, Homo sapiens
agctggagactgtcgcctgccagactaatggagtcgcagacctgtgggacatctacttttcagtgtttttcatctttctttctttctttctttttttttttttgccatgaaatcctttcagaataagtaaataagtcttcccatgcactctcaagtatgcttataatataagcttgcacagcgtctggaagaatgtgcagg

SEQ ID NO: 56131 - DNA, 201 bp, Homo sapiens
attcatgagttacagccgtctagtatttaccctctgtcctttacctttggactctaagtaattagagaaaagcaggtattcaccccttttttgcaaaaagkatgggagaaattggccttgcctaaattcacacagcaaattacatcaggtgaaagtagaccacattgaagcactgaaagataatcagcatctctcctgggg

SEQ ID NO: 56132 - DNA, 201 bp, Homo sapiens
atatttcatggaggcttgagcagcttgcctctcacatggggagcagggaaggtgttccagcagtactgatcgcaccaagcgagtgatgcctgaacgcaccragatgaagctgatacactttgctttcatttagaaaaggcccattttgtacatgatttgtactctagtctattaagggaagaattggtaatgtttagctgg

SEQ ID NO: 56133 - DNA, 201 bp, Homo sapiens
taggaagaatggttttgaacaggatatgaacaaatgacttattaaaaattgctgatctggtgtaggtggcagctgaaactacatccatgtctccataaggyatccctcaaaggcccaggcgctgccagggggtttgtcctggtagctggaggaaccgatttcagggagtagacactggagacaatactgactccaggcatg

SEQ ID NO: 56134 - DNA, 201 bp, Homo sapiens
ggcagctgaaactacatccatgtctccataaggtatccctcaaaggcccaggcgctgccagggggtttgtcctggtagctggaggaaccgatttcagggartagacactggagacaatactgactccaggcatggctcatggaagtaggattctggttctttgttcctattccctcagctaatcccaacctgggaatcaga

SEQ ID NO: 56135 - DNA, 201 bp, Homo sapiens
ctttcttctgagttgagcagactcactggcttaagcatcccataagcctattatttagtgtgaatttgggacttttatttgtatgttgtcttaacttactragcctgtgacttgtatttagctgtagtcaagcctcaccagccatatctcatctctgagaggaagactggatagtgagtttggttttggttttggttttaa

SEQ ID NO: 56136 - DNA, 201 bp, Homo sapiens
catagatagcaaaccagcttagatacttttacccagtgtgttgtctctttgcaaatctgtgtgtttatcatgccaggcactgtgtttctttcaagtggctmagttttgaagtggtaggtcatgccaaatacctaactttattgtatctcatgtaatttttattagtgtcatctcgtgttctcttggattcttggatatcag

SEQ ID NO: 56137 - DNA, 201 bp, Homo sapiens
tagtggagatcatttcctttttaactttgttcaggttgcccttcaccatggatacagtccggtacccttaaacatttaagggctgttttttttttctttayatgatgttcagcttggtattaaccaaacttaaattttttttccagaagtattaaaatttagttaaagcaagatgaagtcttttcccatgaatgtgtcccc

SEQ ID NO: 56138 - DNA, 201 bp, Homo sapiens
gcacatgattggtggttatgctaaatgcccaagccagtggttacatgactggctgcctttttaatgtcaaagctcttgagtccagtggaaacaatgacacygtcccaggttgagaccgagttggtccctggaaagttacagtgatgctatagtttctctgggagcacaggcaatggggcaaaggagaaatggtttctagag

SEQ ID NO: 56139 - DNA, 201 bp, Homo sapiens
tcatttagtatcttacggtttctatatgtcaggaatttgggagcagcttagcagactggttctggccaagatctctaaggttgcaattaagatgtcatccrggtctttataacctggaggtctgactggggctggaggttcctcactcacatggcttttggtaggaggcctcagttcctcccaacatggacttgtcattct

SEQ ID NO: 56140 - DNA, 201 bp, Homo sapiens
ggagatggaagatactcattcctggagctaagggtagctttaggtatctagcttcatcaggcatattttagaaatggactgcctaatatctatttacctarcaacaaaacaacccttacttacccatcagtcctctagtcctccaaactactgtagcagatactttgccaccttttaacttgtttgaagaagctatataaa

SEQ ID NO: 56141 - DNA, 201 bp, Homo sapiens
ttctacaatttgttaataaagcaattatggtagataaaattaaaagccaaatcttttgcaaacatagtactggaggaggtaaggtaataagacacagttcstgaggatggaatgggtaggacagaaaatggaaaagaaggaaaggaagtggaaaagtgtctcattgtttattactacataacaaagcacccccagaagttt

SEQ ID NO: 56142 - DNA, 201 bp, Homo sapiens
gcaggggccggagtcgcggctggagtggggcctgcgcgtgtgagtggccgagagttgcccgtgccggagacctcaaactccgggcgggagcgctttcggtsggccgagccgccgtcgcccgcggcaccgtgtccccaaggcccagacagcggggcgggggtctatcaggcgcgggactggcttctctcaggccgacccttc

SEQ ID NO: 56143 - DNA, 201 bp, Homo sapiens
tttctttcatttcttttgcagtaaaacttgctcaaaagtttataaagtttcagtaaactggagcaaggttccccggagtgagtatgtatttcagagagaartcaataggcaaattacagtgcagagatggaattgcagagaaacattggtctttacacttttgtgacctgagcttgtattcaaagacctccctcctgataa

SEQ ID NO: 56144 - DNA, 201 bp, Homo sapiens
tttagactggctggtaaaatgtttctactgtatgagatagatagattcctgtaaaccatgtgtaaatcaagtgctacattaaaagcacctgctgggaactrctgggcaaaaggaaatcagtatgtggaagaaacatccacacccccatgtttattatagcattattcacaatagccaatatatggaatcaacctaggtgtc

SEQ ID NO: 56145 - DNA, 201 bp, Homo sapiens
ccatagtgctaatgtgttgtctattgttccaaagtgcagggagactgtgatgttccctatggaaaaaatacatgtgttagataggcttctttcaggcatgrgttatggttctgctggctgtgggttcaatgctaatgagtcaacaatatgcattaaataagatgtctttaaacagaaatacatatacaacaaggttatgta

SEQ ID NO: 56146 - DNA, 201 bp, Homo sapiens
tttacccaaagaacagcttcttcctttaggatctggccagttgtcagtggaggaaggtgtttgtcccctcaggtggctgaaaggtaactacataattgataagagtattaggaataactatagtcttgcccttcaaactgatcttgaaccaactgtgtacatactttggggcactaaggaaaacatacctggggcaggaac

SEQ ID NO: 56147 - DNA, 201 bp, Homo sapiens
tttgagaacagccttctggcatatttgagaggccacacatttgtgttgtgcttaatcctcacaatgtgttgtctcatttaatcctcacactagctgtgtgwtgtgaatggccaggcagtgtttgtcctgatttggagagggagatgcggagaggtcgagtcgcttaccaaggcctcaccactagttgttggcagagatgac

SEQ ID NO: 56148 - DNA, 201 bp, Homo sapiens
ctataaaacacatacagaaatcctatgaaaattttccttcaattcccatctctgtgttcccatctcacatgcacacacacacacacacacacacacacacwcactcactctctctctctctctctctctctcatgcccccataggtgtccagtcagtaatgtgggcttcatcctcctagttctctatttacaaaatcataa

SEQ ID NO: 56149 - DNA, 201 bp, Homo sapiens
aaacacatacagaaatcctatgaaaattttccttcaattcccatctctgtgttcccatctcacatgcacacacacacacacacacacacacacactcactcactctctctctctctctctctctctcatgcccccataggtgtccagtcagtaatgtgggcttcatcctcctagttctctatttacaaaatcataatagtt

SEQ ID NO: 56150 - DNA, 201 bp, Homo sapiens
ttgcagtaaaacttgctcaaaagtttataaagtttcagtaaactggagcaaggttccccggagtgagtatgtatttcagagagaaatcaataggcaaattmcagtgcagagatggaattgcagagaaacattggtctttacacttttgtgacctgagcttgtattcaaagacctccctcctgataatgacagctgcagtgc

SEQ ID NO: 56151 - DNA, 201 bp, Homo sapiens
ctgcaaggaagggactgacgcgttcccactttcttactctgcacctccccactctcttcccattcaagaacgagtttctcttccctctccattggaaatcytgctccggaggtccgaaacacgtattttaagcgtgcccttcctcacctcctggagcacccttagaagtattgcctacttatccgggctgagaatccttca

SEQ ID NO: 56152 - DNA, 201 bp, Homo sapiens
tttatgagcataaaaagttatccattggggagctccattttccctgctgagtgagctagattgccttccccacccacccacttaagtctgtcttaaagccrtagctggctcccaccaccagtaccatctccatttgaatggcagggctaaattcccccagccattatctcacactgaccacccagagctttagaagagagc

SEQ ID NO: 56153 - DNA, 201 bp, Homo sapiens
tgacgcgttcccactttcttactctgcacctccccactctcttcccattcaagaacgagtttctcttccctctccattggaaatcttgctccggaggtccraaacacgtattttaagcgtgcccttcctcacctcctggagcacccttagaagtattgcctacttatccgggctgagaatccttcatttttgacctggctt

SEQ ID NO: 56154 - DNA, 201 bp, Homo sapiens
ctctcctggggcaaactggggattccatataggtagccagccatgcagtttaccattctgagaggaggatgataccgttcagcatgaaaaggcaaagtcakctatctatttttcatctcgttcttgtaaactgacattataggaagagtcaaaggggatattggtacatggtgggagaaaacacatagattttcaaatctt

SEQ ID NO: 56155 - DNA, 201 bp, Homo sapiens
aattcctggcctcaagcaatcctcctgcctcagcctcccagagtgttgggattataggcataagccactgcacccagcctttttttttttttaatatattyttaagggatcaaaaattagtcttcctgatttagtgaaatcctaaactttaccatttggaaacaaaatttgcggagtagcttttcttttagtgttttaaat

SEQ ID NO: 56156 - DNA, 201 bp, Homo sapiens
tacctgcaggaactccttctgttttatgtgacatttgaaacctttgtatccagtagatgaacccttaataggtcatattatttattcatttaagtgctttrccctgcctcccctggttaattcactggttattcatttaaaggagataattgcatggcaaaacgtgtactattgctaataaagctatacccataatcactt

SEQ ID NO: 56157 - DNA, 201 bp, Homo sapiens
tggttatgctaaatgcccaagccagtggttacatgactggctgcctttttaatgtcaaagctcttgagtccagtggaaacaatgacactgtcccaggttgrgaccgagttggtccctggaaagttacagtgatgctatagtttctctgggagcacaggcaatggggcaaaggagaaatggtttctagagagttcattcctt

SEQ ID NO: 56158 - DNA, 201 bp, Homo sapiens
ctggcctagtgcatgctcaagctgggttctctcagaacctagcacaagactggttagcctgtacattccctggcaatacttactgattaatctgtggatgyattctgggggaggctagaatgttctaggacaatctcagatagttaagtagacctaataattccttgttgcctacactaaacttctttcctcttaacagaa

SEQ ID NO: 56159 - DNA, 201 bp, Homo sapiens
agtttgggcttagtgtttggtgtctcagcaggtgcatcctgtatttatttgcctgcctgggagctgagcagagaggaatgtgtgttggtatctcggggatycatattgctgtcctttcccttctttggcactttgcagtttttccctgcatgtcagtcagtggagtaaattccttttcttatcttgaaagacatagaatga

SEQ ID NO: 56160 - DNA, 201 bp, Homo sapiens
aacattgctcaattcacccatccagggattcctttttctgactgctctgtacctgtgtttacaggatacttatgtaatttatagcttagctgagcttttcrggtaatttctttgggaatgcaaataaagtactacattttaaaaatgtagtacttgtacatataatagacctggcaatcagtcaacaaatatttattgaac

SEQ ID NO: 56161 - DNA, 201 bp, Homo sapiens
agttaggcttgtagttcagctataggcttgtgctgtagcttgttttgatcacatatagcaattatttatttatatatttcaaaacattgctcaattcaccyatccagggattcctttttctgactgctctgtacctgtgtttacaggatacttatgtaatttatagcttagctgagcttttcaggtaatttctttgggaat

SEQ ID NO: 56162 - DNA, 201 bp, Homo sapiens
aacacatacagaaatcctatgaaaattttccttcaattcccatctctgtgttcccatctcacatgcacacacacacacacacacacacacacactcactcactctctctctctctctctctctctcatgcccccataggtgtccagtcagtaatgtgggcttcatcctcctagttctctatttacaaaatcataatagttt

SEQ ID NO: 56163 - DNA, 201 bp, Homo sapiens
tgttactgtcatagagtatattaagccagccctaaaagttgtttatgagagtcttttcctttctgtaagtgcataacatgtatttaaaaataaatattcgyccttctgaaaatcgttaacaaaaataatgatgggatctttgggttggaagggtctttggctttaggtatggacctgtctaatcaatattagcagatacat

SEQ ID NO: 56164 - DNA, 201 bp, Homo sapiens
ttagctttgaccttttcccccacacaagtatttttctattttagaaaagcagtacaaactctcttgaattctcctttagtaggagacagaactgtggtggaatgtcttgtcctaacattgtgctacatcatcttacggttgcactcttagcaccagcttagcgggtggcacatacccctagactgggtttaaagcacatct

SEQ ID NO: 56165 - DNA, 201 bp, Homo sapiens
caaaatattagtacaaaggatatgattcacagaaaaatgtgtttgcactgcttccagcagtgcatgttctatccctcatggtgatgtttagtgcctcccgwttttgtattagctggctgcctggcaaatcacttgctcctgtccaccacaccttcctctggctcttctctttagcctagataccattctaccaggaacatt

SEQ ID NO: 56166 - DNA, 201 bp, Homo sapiens
acatacagaaatcctatgaaaattttccttcaattcccatctctgtgttcccatctcacatgcacacacacacacacacacacacacacactcactcactmtctctctctctctctctctctcatgcccccataggtgtccagtcagtaatgtgggcttcatcctcctagttctctatttacaaaatcataatagttttta

SEQ ID NO: 56167 - DNA, 201 bp, Homo sapiens
ggaggccgaggtgggtggatcacgaggtcaggagttcgagaccagcctggccaacatggtgaaaccttgtctctactaaaaatacaaaaattagccaggcrtggtggcgagcacctgtaatcccagctacctgggaggctaaagcaggagaatcacttgaacccgggaggcagaggttgcagtgagctgagatcgtgccat

SEQ ID NO: 56168 - DNA, 201 bp, Homo sapiens
cttccccagagtgactaatccaaggagagcaaagaagaaggcataggaccttttgtgacctaatttctaaagttgccagttgtcacttccactttattctsttctgtagaagcaagttacttatgtcaggctacactctagggaaggggaagtaggtttcacctcttgaagggaagaagactatcaaagaatttgtagaca

SEQ ID NO: 56169 - DNA, 201 bp, Homo sapiens
atgaaaatgatagtaaccaaaaatcttttatcatttctttaagcctgaacttggctttcatatttatcctgctgtctatatattaaggggaaccttttgcktatgtcaggaaacagatcaggtcagatcagctccccaacttaagaggtcattgagttcacctcctcattttacatgtaaggaaactgacctactaagtca

SEQ ID NO: 56170 - DNA, 201 bp, Homo sapiens
tcacttgaacccaggaggcagaggctgcggtgagccaagatcactgcactgtactccagcctgggcaacagagcaagactgtctcaaaaaaaaaaaaaaaragagagagagagaaaggaaaaaattcttagcacagtacttattacaatctgatttcttttctttgtttttctgtcaccttttactaggatgtatgctcca

SEQ ID NO: 56171 - DNA, 201 bp, Homo sapiens
gtaatcttggtgctgctggcctagtgcatgctcaagctgggttctctcagaacctagcacaagactggttagcctgtacattccctggcaatacttactgrttaatctgtggatgcattctgggggaggctagaatgttctaggacaatctcagatagttaagtagacctaataattccttgttgcctacactaaacttct

SEQ ID NO: 56172 - DNA, 201 bp, Homo sapiens
tagctgtgtgatgtgaatggccaggcagtgtttgtcctgatttggagagggagatgcggagaggtcgagtcgcttaccaaggcctcaccactagttgttgkcagagatgacaaggctactgtcatgttaccagtgcgccatctggtagggaagtgctggcacgtatttccgagggccttttgggtcttttcttttttaagt

SEQ ID NO: 56173 - DNA, 201 bp, Homo sapiens
gaggctgaggcaggagaatagcttgaacctaggaggcagaggttgcagtgagccaagatcataccactgcactccagcctgggtgacagagtaagactccmccaaaaaaaaaaaaaaaaaaaaaaaaaaaaaaacaggcgtggtggttcacgcctataatcccagcactctgggaggcccaggtgggcgaatcacctgagg

SEQ ID NO: 56174 - DNA, 201 bp, Homo sapiens
tactttggcagtgtctcactgtgttgcccaggctggtctcaaattcctggcctcaagcaatcctcctgcctcagcctcccagagtgttgggattataggcrtaagccactgcacccagcctttttttttttttaatatatttttaagggatcaaaaattagtcttcctgatttagtgaaatcctaaactttaccatttgga

SEQ ID NO: 56175 - DNA, 201 bp, Homo sapiens
tgaaattctgcctaaagtggtctagtcacaaggtgaagcaagatatttcggaaagttatttagttagtgtgaaatagctcctagaaaacaagatcctgctyatttaggaaatgggtgtcgcataggcacctgagcaagggtacatttcctttactgctgacacatgcattccttcccccatcaaccaaatgttcacagtga

SEQ ID NO: 56176 - DNA, 201 bp, Homo sapiens
gggctggaggttcctcactcacatggcttttggtaggaggcctcagttcctcccaacatggacttgtcattctggggctactcgagtgtcctcacagcatrgcagctcccttccccagagtgactaatccaaggagagcaaagaagaaggcataggaccttttgtgacctaatttctaaagttgccagttgtcacttccac

SEQ ID NO: 56177 - DNA, 201 bp, Homo sapiens
caggaacaaaagtttggtaaattactgaggtattacattttaccaaaatgaaattttgaagtgatccttcatcattagctttcttcctgtccaattgttgrgggagtgtgtgataattacagcatcttttgagtaatttaagattttgggatcttgtgctgccaggacagggtaaagaataacacttgccttcactctttg

SEQ ID NO: 56178 - DNA, 201 bp, Homo sapiens
gcgagggacaaagcaaagacagacgattgatggtcaaaaccaggaaaaggagtttacttcagtacttgacatagtaatggttgttcggtgctgctggcctrcttgtctaatttacgtctttagtggattccataactttatttatttccactctaggatatcctgtaccttcacaactctttagaggaggtaaacagtgcc

SEQ ID NO: 56179 - DNA, 201 bp, Homo sapiens
agtagctcactcttaatgtgtatggtgccttatgacactttccattcagttctatttaatctttcaaaattattcatgaaataattcatgagttacagccktctagtatttaccctctgtcctttacctttggactctaagtaattagagaaaagcaggtattcaccccttttttgcaaaaaggatgggagaaattggcct

SEQ ID NO: 56180 - DNA, 201 bp, Homo sapiens
atgggttctatttaattcaactttttagactctgaattccaaagtgtgacttttctaatgcctgaatctgatctgacattctagaatgcatctgttagagkccagagcaattccagagaaagtaatgggagggtgcctcatctccattttagttacatatataagctttgctatagctttccacagatgttggcattattt

SEQ ID NO: 56181 - DNA, 201 bp, Homo sapiens
agtatggcagatgtttgttggatgagtttttctttataacctaactgaaaatgtataggaaattcagtgaaatgaatttagactggctggtaaaatgtttytactgtatgagatagatagattcctgtaaaccatgtgtaaatcaagtgctacattaaaagcacctgctgggaactactgggcaaaaggaaatcagtatgt

SEQ ID NO: 56182 - DNA, 201 bp, Homo sapiens
cacccagtcccagcaaatcgtatcatctctacttctgctactacctctactaccactcaagtctaaaccaccattatctcttgccgagactacacagatckccttcttactggtctctccatttctactgacagccatagtagtcttcctccaaggtgtctccattcatgtaattatcctgcttacacacccctgcctatc

SEQ ID NO: 56183 - DNA, 201 bp, Homo sapiens
gaattctggctttgcaaaactagctgtaaaacttagacaagtcacttattctttctgggccttcactttctcatctataaaacataaagatgtatttgtgytaccaaagcactttgggcattcctctgtcataacatcggtcacactgtatagtaattctgtgaccgtgcctggctccccactagactaagagcttcaggg

SEQ ID NO: 56184 - DNA, 201 bp, Homo sapiens
ttctgggaccaaagagtgaatcatgtaggtagtcctcttccctctttccccctcctgtctagctgaggccaaacaattccaaaaggagcaatttagagtgygagggacaaagcaaagacagacgattgatggtcaaaaccaggaaaaggagtttacttcagtacttgacatagtaatggttgttcggtgctgctggcctgc

SEQ ID NO: 56185 - DNA, 201 bp, Homo sapiens
atttttctcatttttagtactatttcagggtttatgagcataaaaagttatccattggggagctccattttccctgctgagtgagctagattgccttcccmacccacccacttaagtctgtcttaaagccgtagctggctcccaccaccagtaccatctccatttgaatggcagggctaaattcccccagccattatctca

SEQ ID NO: 56186 - DNA, 201 bp, Homo sapiens
aatataacttataatctcaccttgggcattaatggagtagatttataaatcttaattgactaatctaaaagctccttaattgagctggtcagtacttagcrtttatcatctatgaccagctgtcttaagtgctttgcagccattctctcacttaatattaacagtcctgtgaaagtatattttatcgctgtattacagatg

SEQ ID NO: 56187 - DNA, 201 bp, Homo sapiens
acccttaaacatttaagggctgttttttttttctttacatgatgttcagcttggtattaaccaaacttaaattttttttccagaagtattaaaatttagtyaaagcaagatgaagtcttttcccatgaatgtgtccccttatctcattatagcttatgctcagtttcactttcttggaaaggttaaaacaaattagcctgg

SEQ ID NO: 56188 - DNA, 201 bp, Homo sapiens
tagcatattcttttatcttctatttcattttgagttttggggtgatttaagacttaagaaaatactgtttactacttatgaaaaagattaaaaatcttagycctcgtaacagcattcgaaaggtggtaaaacctcccccttgcagttgactaaggtagaaaaagatttaagcatttagaaatataacttataatctcacct

SEQ ID NO: 56189 - DNA, 201 bp, Homo sapiens
gttgttttctcatattaagaaatttaaatctactttgttttagtgaagctattttggtaatgtataagcaattttggttctgtttagggagaattcagggyttccatgacttgatttgagctttgcatatttcaaataagtaacacagccattttaatttagctaaataaaaaaatttcttttttctctcaatgtgtctga

SEQ ID NO: 56190 - DNA, 201 bp, Homo sapiens
ataaaacacatacagaaatcctatgaaaattttccttcaattcccatctctgtgttcccatctcacatgcacacacacacacacacacacacacacactcwctcactctctctctctctctctctctctcatgcccccataggtgtccagtcagtaatgtgggcttcatcctcctagttctctatttacaaaatcataata

SEQ ID NO: 56191 - DNA, 201 bp, Homo sapiens
cctgcgcgtgtgagtggccgagagttgcccgtgccggagacctcaaactccgggcgggagcgctttcggtcggccgagccgccgtcgcccgcggcaccgtrtccccaaggcccagacagcggggcgggggtctatcaggcgcgggactggcttctctcaggccgacccttctagccgggctccggatcttcctcggcctcg

SEQ ID NO: 56192 - DNA, 201 bp, Homo sapiens
cttgaaccaactgtgtacatactttggggcactaaggaaaacatacctggggcaggaacccttcctagcattttatgattgggcatgttacagtggtctcrgaaagccccgtgagggcatggaagaaagggtcagccaagaaaacccatcaaaccctttgcaaagttatgtggcgtctttttcctgtgtgtgtatttcttt

SEQ ID NO: 56193 - DNA, 201 bp, Homo sapiens
ggaagaagagtttttacccaaagaacagcttcttcctttaggatctggccagttgtcagtggaggaaggtgtttgtcccctcaggtggctgaaaggtaacyacataattgataagagtattaggaataactatagtcttgcccttcaaactgatcttgaaccaactgtgtacatactttggggcactaaggaaaacatacc

SEQ ID NO: 56194 - DNA, 201 bp, Homo sapiens
aaaagtgctaggtgttcaagttttaatgtttgcctttaatcttccctttgtttgtttgtttttgttttgccctttaagatgggtgatagatctgccactcygaaaagacagtctttggatcaagtcaccaacagaacagatacagtaaaaatccaaagcataaaggtaaataatgggaggcttaccctgaagtaaaagtaa

SEQ ID NO: 56195 - DNA, 201 bp, Homo sapiens
cagaactgtggtggaatgtcttgtcctaacattgtgctacatcatcttacggttgcactcttagcaccagcttagcgggtggcacatacccctagactggstttaaagcacatctcccaggatgtcaagatctttgatatccagccactgttcttgccacttgacagcttaagctcttaccatctaaacatgtttaatgct

SEQ ID NO: 56196 - DNA, 201 bp, Homo sapiens
cctatgggtaaggactatgtcttgtttactcccagcccctagcacagtacctggtactcctgaatatttgttaaataaatgaatgagttacctacacattrcaattaaatgcttaaagcatagaagacttaaatttttctatcaccatttaaatgtgattacttttcttccctgttcctgactttttttttttctgttttc

SEQ ID NO: 56197 - DNA, 201 bp, Homo sapiens
gttttctggggaggaggggaagtgttgtgtttaatgggaacacaagcttcctgccactttccattgttaaatcaatatttgatgagaatgaatgggggaargctattaggtcagagtaaggaatagcagtcttaacacttgtgcttcagtcctcagcataggccttaaatacttttggatgactatacttttggaatgacc

SEQ ID NO: 56198 - DNA, 201 bp, Homo sapiens
tgtatccagtagatgaacccttaataggtcatattatttattcatttaagtgctttaccctgcctcccctggttaattcactggttattcatttaaaggarataattgcatggcaaaacgtgtactattgctaataaagctatacccataatcacttttgtactcatggttgaatttgtcctcttgagcaggggagactat

SEQ ID NO: 56199 - DNA, 201 bp, Homo sapiens
cacagtggcttatgcctataatcccagcactttgggaggccgaggtgggtggatcacgaggtcaggagttcgagaccagcctggccaacatggtgaaaccytgtctctactaaaaatacaaaaattagccaggcgtggtggcgagcacctgtaatcccagctacctgggaggctaaagcaggagaatcacttgaacccggg

SEQ ID NO: 56200 - DNA, 201 bp, Homo sapiens
atcagtttaaaaaaattgagcaggccgggcacagtggcttatgcctataatcccagcactttgggaggccgaggtgggtggatcacgaggtcaggagttcragaccagcctggccaacatggtgaaaccttgtctctactaaaaatacaaaaattagccaggcgtggtggcgagcacctgtaatcccagctacctgggagg

SEQ ID NO: 56201 - DNA, 201 bp, Homo sapiens
gtaatcattttattcttagcctgccattatttttaatgcaagaagcacctgagaaggcagatacagtaaatctcaatgtcattgataggtttttggaaackgtaaacttaagtaaatggcatataatgaaaccagttttatcataggctaattaatataaagaagacttaaggtcaggtgtggtggctcacacctgtaatc

SEQ ID NO: 56202 - DNA, 201 bp, Homo sapiens
taaccttaatagcatgagcacaccaggaaactgaccacaaggctttctcaaggtcataaagaaatctggctccagaactggaattaaagttcttactttcsatcttaagcctagattacagtatcctcactttcccatctgaagcctagaagattgcaatatcccaacttctcttggctgcctacagttactcaagttttg

SEQ ID NO: 56203 - DNA, 201 bp, Homo sapiens
gttcccttcaccttgtaccttccccttttttgttcttcctagacatactgtcaagacagcaatctatgatatgctttgatattccaggaaagaaagtgtgrttacagtattctctgattagagtgttaaactctgggctaagataaaagaaaagccaggaagattatgaccaagtgactaaattaccatctcaaatgcata

SEQ ID NO: 56204 - DNA, 201 bp, Homo sapiens
tgcagtgcctttaggttcttccttttacctgcaggaactccttctgttttatgtgacatttgaaacctttgtatccagtagatgaacccttaataggtcayattatttattcatttaagtgctttaccctgcctcccctggttaattcactggttattcatttaaaggagataattgcatggcaaaacgtgtactattgct

SEQ ID NO: 56205 - DNA, 201 bp, Homo sapiens
actgaccttcctaagtgtttgtgatgaggcccttgagaaaatgccagaagaaactattgatagacattctctaatcattttggctcaatattgccattgarataaaaaagatacagatcaactggtaatattgctctttttctttttactgatttttaaaaagtagagagcatgcactttggagagataattcctctggtt

SEQ ID NO: 56206 - DNA, 201 bp, Homo sapiens
taatattgctctttttctttttactgatttttaaaaagtagagagcatgcactttggagagataattcctctggttcttttttattgaaatacaattcacrtaccataacattcacctttttaaaatgcagtgtttttaatccagtgttttttagtgtattcacaaggtcatgcaaccatcaccactatctaattccagaa

SEQ ID NO: 56207 - DNA, 201 bp, Homo sapiens
catttgggtattcctgagactttatagagcgtgtattgtttgttatacgaacctaacctaccttgttgttttctcatattaagaaatttaaatctactttkttttagtgaagctattttggtaatgtataagcaattttggttctgtttagggagaattcagggtttccatgacttgatttgagctttgcatatttcaaat

SEQ ID NO: 56208 - DNA, 201 bp, Homo sapiens
gtcttggagcttacattttaggaagttattttatatgggtcttttatgccagtttttagttttaaggaagcatataataactaaggcggtctgtggctttaaaaaaaaaaaaaggatgtaggttttattctggaggaccagccattattaatattttattttctatgaaaagggaaaatgctctttaaagaaagaagagaa

SEQ ID NO: 56209 - DNA, 201 bp, Homo sapiens
taaagaactgtcacttatttgatatttcatctgtaccaggtactatgctaagagctttgattatatgtctcatttaattctcatagcctgtattgatcatytgttccttggttacaaattaccccaaaacttagtggcctaaaacaacagtcatttagtatcttacggtttctatatgtcaggaatttgggagcagcttag

SEQ ID NO: 56210 - DNA, 201 bp, Homo sapiens
gttccagatttataaactaatattttttctttagggaagatttggttttcctctaggaaaaatcatttaaattaagaaaattacttgtttgattgatagaraaagagtcctgttaattatctcagtatacactacatgtaatcatagtttgaagatatttgaaataatcagaaacaccgattttcattagggcagtgtttc

SEQ ID NO: 56211 - DNA, 201 bp, Homo sapiens
tagtgacaggttttgtttgctgcacacctcattggcttgcttaccaacaccagctagaagtggtccctctttcatatccaaaccagaacacatttgggtawtcctgagactttatagagcgtgtattgtttgttatacgaacctaacctaccttgttgttttctcatattaagaaatttaaatctactttgttttagtgaa

SEQ ID NO: 56212 - DNA, 201 bp, Homo sapiens
tgttctcatcctagaatttagaatgggaaagcggtttagaactaagagtctttcaagtgtttcgagccaaactgcaaagcttttagaatattgtctctgcrgcctgaaactgactattacacaggttcccccagttcccattcaagagcgaagtctagatgtttagaattctatgcctaaatagcagaacggaagcctcat

SEQ ID NO: 56213 - DNA, 201 bp, Homo sapiens
aggcagtgcttatgcaccagcaggacaagtagcatctgaaataatggcattgcagtcaatgcttagcgtgcaaaaggcaagagactcctaccctaggggtrggagtctagaacttggtgtaacctctacttatggcttgcatctccccaagcataaagtggcaatgacaacactgggctattccttccacctcacagggcc

SEQ ID NO: 56214 - DNA, 201 bp, Homo sapiens
cgatcctgctggcattggctttcagctgcttcttaactttgggtgaaacggcagctgccaaccagtcacactggctttttgtgagaccactaccattcccragatacttctgattagccatgcactctgccatagcctcaggaggttggaactttcagtacctggaagaagagtttttacccaaagaacagcttcttcctt

SEQ ID NO: 56215 - DNA, 201 bp, Homo sapiens
attgcagtcaatgcttagcgtgcaaaaggcaagagactcctaccctaggggtaggagtctagaacttggtgtaacctctacttatggcttgcatctccccragcataaagtggcaatgacaacactgggctattccttccacctcacagggccatttgagaaagaatgtgggagcatctgtcaaacgattgcctctttaga

SEQ ID NO: 56216 - DNA, 201 bp, Homo sapiens
tttataaactaatattttttctttagggaagatttggttttcctctaggaaaaatcatttaaattaagaaaattacttgtttgattgatagagaaagagtmctgttaattatctcagtatacactacatgtaatcatagtttgaagatatttgaaataatcagaaacaccgattttcattagggcagtgtttcattagggc

SEQ ID NO: 56217 - DNA, 201 bp, Homo sapiens
agtgtttgcagcacagagaaaagtgcagcagcacctcactcgatcctgctggcattggctttcagctgcttcttaactttgggtgaaacggcagctgccarccagtcacactggctttttgtgagaccactaccattcccgagatacttctgattagccatgcactctgccatagcctcaggaggttggaactttcagtac

SEQ ID NO: 56218 - DNA, 201 bp, Homo sapiens
agtaagcccacaaataaagtcaaactctggttcatggaaagcagcatttgaactggctctgccacagtggagccttggcaagttgcctggacttggctttraagggtggagttggaagacctgttccccctcctgctttacagagttgtataatttactacaaagctgtgaagattaaaggagctttattttacgaagccc

SEQ ID NO: 56219 - DNA, 201 bp, Homo sapiens
taactgccattcattaaatgctttctttgtgccagccattattaggtgcactgcacatgtgatctcctttcttggcttctacagtcctatgaagtaggagrtgttctctccattttacagttaagaacactgaggttcaaagaagttaagtagcttgtccacagtcactcagctgtgtagcaatactaaaagtaaaatatt

SEQ ID NO: 56220 - DNA, 201 bp, Homo sapiens
aaagcaggagaatcacttgaacccgggaggcagaggttgcagtgagctgagatcgtgccattgcactccagcctgggcgacaagagcaagactctgtctcaaaaaaaaaaaaagtacgagcagaggactcacaggaacctaacctgtgtttccccaaggaacagttgttcaatattcactaattgaatgttttgttgcaag

SEQ ID NO: 56221 - DNA, 201 bp, Homo sapiens
tcaaatcattttctttacaaaataatccggtgagatgggtattatttttattattttgtgctcttagaaggattaagtaatttgttcagtgattaagtatracagagctgagcgtcctcttgccccttgctgcccaaattcacatttataacactactgtctgcaccactgttcctggtggccttgtaagcctatgcacat

SEQ ID NO: 56222 - DNA, 201 bp, Homo sapiens
ctatgcatctgttcaaaagatctaataagcagtatacattgattgttctacaatttgttaataaagcaattatggtagataaaattaaaagccaaatcttktgcaaacatagtactggaggaggtaaggtaataagacacagttcctgaggatggaatgggtaggacagaaaatggaaaagaaggaaaggaagtggaaaag

SEQ ID NO: 56223 - DNA, 201 bp, Homo sapiens
agtgaggattggattcacaaacagtaggtgtctttgaatgcctgtagcttttgcaacaggcattcagagcttacatagatagcaacagagcttacatagayagcaaaccagcttagatacttttacccagtgtgttgtctctttgcaaatctgtgtgtttatcatgccaggcactgtgtttctttcaagtggctcagtttt

SEQ ID NO: 56224 - DNA, 201 bp, Homo sapiens
tttcaacttcgtctctggcctttctccctctctcctcccatctcccactcctctgcaatttctgttgagagtgttctgagatcctttaaataagtttgackaatttgtttaaaagtgctaggtgttcaagttttaatgtttgcctttaatcttccctttgtttgtttgtttttgttttgccctttaagatgggtgatagat

SEQ ID NO: 56225 - DNA, 201 bp, Homo sapiens
ctaatttacgtctttagtggattccataactttatttatttccactctaggatatcctgtaccttcacaactctttagaggaggtaaacagtgccctagtsgggtaccagagacagaatgatcttaaactcgagggaatgaacgagacagtcagtaatcttacccagagagtcaacctgatagaaagcgatgtggttgcta

SEQ ID NO: 56226 - DNA, 201 bp, Homo sapiens
ggatgaagaaaatgtagtatatatacacagtagaatactattcagccataaaaagagtgaaatcctgtcattctcagcaatatggatggaactgaaggacrttgttaagtgaaatgagctgggaacggaaagttaaacactgcatgttctcactcatatgtggaagataagaaaagtttatctcactgggtatggtaactc

SEQ ID NO: 56227 - DNA, 201 bp, Homo sapiens
aagacagacgattgatggtcaaaaccaggaaaaggagtttacttcagtacttgacatagtaatggttgttcggtgctgctggcctgcttgtctaatttacrtctttagtggattccataactttatttatttccactctaggatatcctgtaccttcacaactctttagaggaggtaaacagtgccctagtggggtaccag

SEQ ID NO: 56228 - DNA, 201 bp, Homo sapiens
atcctctctacctagtctagacttgagatttagtaaccactgccctgatcattcttcataaaatcatggtgtttccatccttcttctccccttcacccccyaccaacccagattatattttagagctgcacattacaaatctggctcatgtgcaaactctgcagctcctgctacagcttaaaagagctcagtcttcagagc

SEQ ID NO: 56229 - DNA, 201 bp, Homo sapiens
agcgcagttgcattctggccactttgaccttatagctcccaaatgatgagtttgtcatctttatgaactcatgacaggataataagcttgaagacctgctrtagttagatatgggctttaatccttcccatgcaccagtcagctgaacaaaagcataagccaaacatcctgtttaaactgtagaataaccagatattccca

SEQ ID NO: 56230 - DNA, 201 bp, Homo sapiens
aggggatgttccaggtaaggggagcagcaacataaacaaaggtacagaggcatgaaaccaccttaaccatttggggatgtttgagcaaattttcatcatartacctgttgtactttcatttgtttacttttatgcctgtctctcccactggatagtgagctccttgaggtagggagtctgacttatttatttctatatcct

SEQ ID NO: 56231 - DNA, 201 bp, Homo sapiens
tgtttacttttatgcctgtctctcccactggatagtgagctccttgaggtagggagtctgacttatttatttctatatcctcagatcccagcaacagcttyactgcccaggctgtcccttgccctctctaccccttcactatggcaggcccagttgcagctgtagccactagcagggttgaccctggtcctggtacagccc

SEQ ID NO: 56232 - DNA, 201 bp, Homo sapiens
ctgaccaaggtagtatcataacaggttttattcaagtgtatatctggttagtcaagaacttagttctcactcacaaactggttcttagagctgggtaactrttgctgtcttattccccccttgaaatatatttaacagttattagggaactggatgaagaggaataatgtgaacatgtacattaatttattcagtaaacat

SEQ ID NO: 56233 - DNA, 201 bp, Homo sapiens
ccaggctgtcccttgccctctctaccccttcactatggcaggcccagttgcagctgtagccactagcagggttgaccctggtcctggtacagcccccaggkctgcttgcagctctggccaggcaggtgccatgcccgactaagcagaaacccctggtgaggctctttattgaggaggagccggcccactacagagagaaga

SEQ ID NO: 56234 - DNA, 201 bp, Homo sapiens
tggcaggcccagttgcagctgtagccactagcagggttgaccctggtcctggtacagcccccagggctgcttgcagctctggccaggcaggtgccatgccygactaagcagaaacccctggtgaggctctttattgaggaggagccggcccactacagagagaagaaaaacatcccatctacatgacagtgaagggagtgg

SEQ ID NO: 56235 - DNA, 201 bp, Homo sapiens
aattattcttagagatggtcaccatctactgcttgaccattaaggtctgtgacagagaagggatgctgctggcttctctggtttaatgttttgctggcctycactataataaagcatctgaagtactggattatcagctagttctttgtttttccctgaaggaggggtgggagcttaggttaagtttctatcaagcacaca

SEQ ID NO: 56236 - DNA, 201 bp, Homo sapiens
acacttttggcagtaagtttttagtgggaattttccatgaccttttggggtttaattttggctatatgaacatggtgataatggacaagtacctctgaccractagaactgcagaatgtatagcaaaagtaagagttgtctgaggtgactcttttgcaaagtttgagagtgtagcccgtgttctaacccccatctctgtca

SEQ ID NO: 56237 - DNA, 201 bp, Homo sapiens
cagctctggccaggcaggtgccatgcccgactaagcagaaacccctggtgaggctctttattgaggaggagccggcccactacagagagaagaaaaacatyccatctacatgacagtgaagggagtggtgttttatgtcacctccagaaaggaattttatggaagaaggggccccctataatgcattgaccaggaaagtcc

SEQ ID NO: 56238 - DNA, 201 bp, Homo sapiens
tgtattcaagtaaaagcttgacacctagtaaggaggctataggattcttgtctgaagaggtgatccagcaagatgacctcaaaattctaagtaccctgaawgtaagtacctgagagactaagccctgtgtaaacctagggaacagcctgcaaaagaaaaatgttacacaggccccttgaggattaacaacagttgaataac

SEQ ID NO: 56239 - DNA, 201 bp, Homo sapiens
ctttttatttatttattttattttatgagacagagtctcactctgttgcccgggctagagtgcagtggcgtgatctcggctcactgcatcctccgcctccygggttcaagcggttctcctgcctcagcctcccaagtatctgggatcacaggcacccgccactatgcccagctaattttttgtatttttagtagagacggg

SEQ ID NO: 56240 - DNA, 201 bp, Homo sapiens
gatgacctcaaaattctaagtaccctgaatgtaagtacctgagagactaagccctgtgtaaacctagggaacagcctgcaaaagaaaaatgttacacaggycccttgaggattaacaacagttgaataacaggatttctttttccagtttctttatttctaggcctgtgcccagttcttactaactgaaggcaaatttttc

SEQ ID NO: 56241 - DNA, 201 bp, Homo sapiens
ctctaactcctaatcattcttcaggatacagttccaagtgtcccttcctctggcactcttccctaccctgggttaagtgcctcttttagattacatgtttyttattatttcacaatcatctatcattcaaccagcatttctgagtactttttgggttgcaaggcattggtgacaacacagcagatacctgcctacaggggg

SEQ ID NO: 56242 - DNA, 201 bp, Homo sapiens
tgatttgctcttgaggcatgtgtgaatttaagaaaggtaaaatggatgaagtagttattggccttcatcaatcttaattatcttgccctaccagaaacagmaggatgaattggggggaataccagccagggagtctagaggtctagtcctggctgtgaccttggctggccacttgaccttgagcccatccctgaacctcat

SEQ ID NO: 56243 - DNA, 201 bp, Homo sapiens
ggttttatagggggcttttcccccttttgctcattcttcttcctgtcaccatgtgaagaaggatgtgtttgcttccccttccaccatgattgtaagattcytaacgccttcccagccctgtggaactgtgagtcacttaaacctctttccattataaattacccagtctctggattaagaaaatatggcacatttacacca

SEQ ID NO: 56244 - DNA, 201 bp, Homo sapiens
ggggcattccaggcaaggtgattttatcaaatgtgtggaacagaaggtaagaccttcccccatttgtggtgtttgcttaccagcactccttcaccctcctyaccctcacccttatccttaaagttggtttattgatgggtcagctgggtgaactgaacatagtctctcccaactccatttccatccataaatgtttatcct

SEQ ID NO: 56245 - DNA, 201 bp, Homo sapiens
gagcaggggtcatcaaattttttctgtaaagaactagatgttaaatattttaggcattgtgggccgtatggtcttctttgtgactactcagctctgccatyatagtgcaaaagcaggcctagaccgtacgtaaatgaataggtatggttctgtcccagtaaaacttaatctacaaaaatatttggcagactagatttagtt

SEQ ID NO: 56246 - DNA, 201 bp, Homo sapiens
aaatgaataggtatggttctgtcccagtaaaacttaatctacaaaaatatttggcagactagatttagtttcctgacaaccagccaaccctgccaacccayccccatccattcccatgttgaggaattagcttaaacagaggaagagctttgaaagtaaaaggggtttcaggagacagcaaggtactatgcccagttaaaa

SEQ ID NO: 56247 - DNA, 201 bp, Homo sapiens
tcatgtgcaaactctgcagctcctgctacagcttaaaagagctcagtcttcagagccagccaaggggagtagatttcaactgtgaaatgcactagtccatraaagtggcaattacacaggcacattgctttctttagaacttgatttggtagctgcttgtgccattttgtttttaaacgtatggtcacaatgatggattca

SEQ ID NO: 56248 - DNA, 201 bp, Homo sapiens
attttacattgcaattcagtacacatgtaggtatatgattgtaactgaaaaaaaaatgtataaaataatgctaacttttacaacatgcagtccattcttaytactttttattctctttcatcttttaaaaaactctgatcacaatccactaaatgtatttcacaacctattatttgaaaaattctaacctaggatggtgca

SEQ ID NO: 56249 - DNA, 201 bp, Homo sapiens
ttggatggctcagtttgttacattttgttttgttttgttttttgagacaggatcttacagtgttgcccaggctggagtgcagtggtgtgatcatagcttaytgcagcctcaatctcttcagctgaagcaatacccccacctcagccttctaagtagctgggattacaaacatgcacccccatgctcagctaattttttgta

SEQ ID NO: 56250 - DNA, 201 bp, Homo sapiens
ctttgttattgttaaggtatcagttctctcctaattggtctctagatgaaatacaatactaatcaaaaccccactaggcatttaagaaattgatgagctgkttttaaaattttacttggatatttaaaggactgagatagctaaaacaattttgaaaaagaacaaagcttgaggacttacatttcctgatttcaagactta

SEQ ID NO: 56251 - DNA, 201 bp, Homo sapiens
tcagtcctgtccaacagtaagtttctggtgatcacgtaagggttgcttatcaatgttgccaaacaagtattttccagcccatcacgtcatattccatactrtctcacatgttatagtgctctgtttacttaataaagatgctcacatgttgattgtactaataagttatagtgctctgtttacttaataaagatgctcaca

SEQ ID NO: 56252 - DNA, 201 bp, Homo sapiens
caaagcttgaggacttacatttcctgatttcaagacttattacaaagatacagtaattaaaacagtatggtattggcacaaagatagacatgtagattaayggaacagagtagagtcctgaaatagacaaacatatatgtggttagttgtttttcaacaaaggtgtctataaattagagaaaggataatcttttcaacaaa

SEQ ID NO: 56253 - DNA, 201 bp, Homo sapiens
aaagcttgaggacttacatttcctgatttcaagacttattacaaagatacagtaattaaaacagtatggtattggcacaaagatagacatgtagattaatrgaacagagtagagtcctgaaatagacaaacatatatgtggttagttgtttttcaacaaaggtgtctataaattagagaaaggataatcttttcaacaaat

SEQ ID NO: 56254 - DNA, 201 bp, Homo sapiens
gccataaaaaagcatgagttcatgtcctttgcagggacatggatgaagctggaaaccatcattctcagcaaactatcacaaggacagaaaaccaaacaccrcatgttctcactcataagtgagagttgaacaatgagaacacatggacacagagtggggaacaccacacactggggcctgtcagggggtggagggctgggg

SEQ ID NO: 56255 - DNA, 201 bp, Homo sapiens
tagtaggaggacccctttatccaaacaaaatcttactatgtaaaaccccaggatatgacagctaaaacaggtgaagggacctgaggcacctccacagagcmcctaggactctacagaatagtttgaacagcagtgttgtagtgtgaacacagctgaacttactcctaccttcccaccccaagcttcagataaaagttgatg

SEQ ID NO: 56256 - DNA, 201 bp, Homo sapiens
tggtattggcacaaagatagacatgtagattaatggaacagagtagagtcctgaaatagacaaacatatatgtggttagttgtttttcaacaaaggtgtcwataaattagagaaaggataatcttttcaacaaatgctgctaaaacaattgaatatcatgcacaaaaaaaaggaacctctacttttacctcacagtgtata

SEQ ID NO: 56257 - DNA, 201 bp, Homo sapiens
aagtgttaaggctaaagaaataagttaggcattaaactctttgggcttaaggagtacaggcaggataatttagctgctaagaggatgggctctggggccakatgccaaggactgaatcctaacccttccacttactagctgggtgactctgagcaaattgttacttctccatgcctcagtttgcttatctgtaaaacagga

SEQ ID NO: 56258 - DNA, 201 bp, Homo sapiens
aaggcagggggagaataagggctggtgggggttgcctttctataaccctccatgagaggtagacatctctctctgtgtcttaccttcctatcctactcacygtactagtggtcttcaaaaactttttttttttttttggagacagtcttgctcttttcaccaaggctggagtgcagtggctggatctcggctcactgcaag

SEQ ID NO: 56259 - DNA, 201 bp, Homo sapiens
cacaaataacactgtgcaaactgtcagtttcactgtgcctttgcaggcctgaccttaccaccacataccagtcctccaactcaccagccacccaaggggctgttaagagccagaatttcctctagactgtctattgctttgaaattgcagtttgttgtgatggtaccttattgagccttgataagtgttccaccttgcaga

SEQ ID NO: 56260 - DNA, 201 bp, Homo sapiens
tcttctgtatctagctagatagaggaaggctaacggctaacacatattttccattcccacagtcttgtctttactactttgagttattggttccccaccayatgggactcaacatcccccttttataatacattttttaaaaattctcccttttctaccctgaaataaaacaataggtatgtaaaaatataacctacctgt

SEQ ID NO: 56261 - DNA, 201 bp, Homo sapiens
tatccctggcccaaagggagtaatatttcctggagatgacacccagactgaaccttcaaacagcaggagttagcctaataaagaaggggagaaatgtttcygacagagggaatagcataagtaaatgctgagagacataaaatgacttggagtattgtaaagagtttggtatcacttgtgtgtgtgtgtgtgtgtgtatgt

SEQ ID NO: 56262 - DNA, 201 bp, Homo sapiens
gctgggcacagtggctcatgcttgtaatcccagcattttgggaggacaaggtgggtggattgcttgagctcaggagtttgagaccagcctggccaatgtgrtgaaaccctgtgtctacaaaaaaatacaaaaattagccaggcgtggtggcatgcaccttgtaatctcagctgctcggaaggctgaggtaggaggatcact

SEQ ID NO: 56263 - DNA, 201 bp, Homo sapiens
cttttcaacaaatgctgctaaaacaattgaatatcatgcacaaaaaaaaggaacctctacttttacctcacagtgtatacaaaaattaaagtagatcataraagtaaatgtaacttttttttttttttttttttgagacggagcttgctttgtcacccagggtgcaatgtagtatgatctcagctcactgcaacctccacc

SEQ ID NO: 56264 - DNA, 201 bp, Homo sapiens
aataaagaaggggagaaatgtttccgacagagggaatagcataagtaaatgctgagagacataaaatgacttggagtattgtaaagagtttggtatcacttgtgtgtgtgtgtgtgtgtgtatgtgtgtatatgtaaggtttggtggtttttgtttagagatttggctttaccctgagggcatgaaaagagtcattaaagg

SEQ ID NO: 56265 - DNA, 201 bp, Homo sapiens
aataatttgatcatgcaagtgagtgacaatatagagattgtactatattttctggtcttcggcaaagcacagcatctaatcatattaaaagtggatcctayaggtcagaggaggcccattctgctgtttgccatttttaccacctcactctggtggtctcaaactgctgtgcagttctcatcattgttaaaatttgcttcc

SEQ ID NO: 56266 - DNA, 201 bp, Homo sapiens
agtaattacagcaattggaacgagctaattcagcagcattagaaagtttagaaattgaaacatccatcaagagaaggataaatagtgataaacttctacartagaattccatacaacagtgagatatttatgaattcagagttatagatatcaacatggataaatctcagaagcatactatgaagtaaaaaagttacaaaa

SEQ ID NO: 56267 - DNA, 201 bp, Homo sapiens
acctacctgtatgtataacctcaggtgggaaaatcaatataatgccctaaccataatataaagaaaagtattttttaacaaaatacatattttagcatgtraatattagggcacgactacactgtgagacctaatgtagtcatgaggtgcttccacccatttctgaaataaccttgaacatgtaagcagcaaatactgact

SEQ ID NO: 56268 - DNA, 201 bp, Homo sapiens
tctagaggaaagaggactaccccttggtaggactagaaacccttggctgaggctcaaggacacagaatagctgcttactcccagcatttattattgtggcrcagatgaattgtcatactttttgtgttggactagttttctagggcctcctcaatacctagaaattggaaaagactccaaaacaccttctctgactacttc

SEQ ID NO: 56269 - DNA, 201 bp, Homo sapiens
ctcaggtgggaaaatcaatataatgccctaaccataatataaagaaaagtattttttaacaaaatacatattttagcatgtaaatattagggcacgactayactgtgagacctaatgtagtcatgaggtgcttccacccatttctgaaataaccttgaacatgtaagcagcaaatactgactggcaaatgggtgttatgtt

SEQ ID NO: 56270 - DNA, 201 bp, Homo sapiens
acccctcccataatgtagatatcaatatccaataaactattatgataaccataaaattatctgcacagatttccaaagcatccatagtagggaagtaaaayacccatttaaagttcttattaaatgcttctgatttttgacatgtagtttcaactgctttaattaccttatttcatcaaatctaaagctcactcttatttt

SEQ ID NO: 56271 - DNA, 201 bp, Homo sapiens
ttcagacagatgccttggggaaacagtctgtgaacagaggattcactaaggacaaggtaggtttctaattaaatataggaaaaaaagcttgaagtcatatrggacatctagaacaagaggctgcaaatttgaacataagtactgtggctcagtgattttgtgtaaggtgattttccagctgtagaagtgagaaatatttct

SEQ ID NO: 56272 - DNA, 201 bp, Homo sapiens
ctcggccttccagagtgctgggattacaggcatgagccaccacgctgggccaaaaactctttattcttaaagaaatacagaaattatttaataacaaaaartattattaaagaaaaatagtatttcaagttttattagaacacagccatattcatttatttacatattatctatggcctgaaggaagttaaaggtgaatgc

SEQ ID NO: 56273 - DNA, 201 bp, Homo sapiens
ggctgaggctcaaggacacagaatagctgcttactcccagcatttattattgtggcacagatgaattgtcatactttttgtgttggactagttttctaggscctcctcaatacctagaaattggaaaagactccaaaacaccttctctgactacttctggttctcttttgtctcttccccagacctctagttgtatatact

SEQ ID NO: 56274 - DNA, 201 bp, Homo sapiens
tacgagacaaaataatcactttcagttgttggtggcctttttttaagggtgtctaatttgatagaggaaacattaagattgaacactcaaaatgactctartctgctgaggatgcctaccatcaaagtgttgtcagagataagcagtatccttggataacacatctttccatttcttacctctcccatggctcagtgtgga

SEQ ID NO: 56275 - DNA, 201 bp, Homo sapiens
tacatagaagaaagtggcctcagatgttagttcacattgtctaataagtgatagagccaggattgagcccaggttatctgacttcaaagtctgtgaacttratcattatgggattgtgttaggaactgtgctaagacttggagatctgtgagacaaggtccctgccttcatggagctaatattcaggtataggagaaagat

SEQ ID NO: 56276 - DNA, 201 bp, Homo sapiens
cctgaccttatgattctctcgcctcggcttcccaaagtgctgggattacaggtgtgagccactgcgcccagccaacaataatttttaaaatagtgttaaawttttagaacaattattataaaaagtggagagaagtgagttctcacatgcaaaattatttaatgagattgggtacttcacctagcttagttaccttttttc

SEQ ID NO: 56277 - DNA, 201 bp, Homo sapiens
agatggtagaatgccctggaagctaaaattgaatgtttcaaggaatagggactgctcaactcaccaaatctcccttgtttattagggcaaatgagattagractgagaatttactgatttcacaaacatggaagtcactgggggccttataagagcagtttcataaaagtgtgattggagtagacttaagagaggatggga

SEQ ID NO: 56278 - DNA, 201 bp, Homo sapiens
cggttttaagtcctagctctgccactatctataggacttggacaagttaatcaacttgtctgggctttagtttccctatttaaagtggagcaaataatagyacttacctcatagagttatttggataattaaatgagttaacatttattatcacttagaacagtccctggcatagagtaagtgctatatttatgtttttta

SEQ ID NO: 56279 - DNA, 201 bp, Homo sapiens
agctatcctgcctgtttggtcatttatatttttatacctgtgattcttttctctctaataagctatttttctggcattctttatagttccatgaattatayattaggtagattgagaggatcaaaataataataaaagcagcatactctgtatcaggtacaatgcctaatgcttcatatgcattatttcattaaattctct

SEQ ID NO: 56280 - DNA, 201 bp, Homo sapiens
tccagcccatcacgtcatattccatactgtctcacatgttatagtgctctgtttacttaataaagatgctcacatgttgattgtactaataagttatagtkctctgtttacttaataaagatgctcacacgttgattgtactaataagtgacattttcagccttatgaaatcatgtgggtttgacccagtaagcctctggc

SEQ ID NO: 56281 - DNA, 201 bp, Homo sapiens
cacccctcccataatgtagatatcaatatccaataaactattatgataaccataaaattatctgcacagatttccaaagcatccatagtagggaagtaaartacccatttaaagttcttattaaatgcttctgatttttgacatgtagtttcaactgctttaattaccttatttcatcaaatctaaagctcactcttattt

SEQ ID NO: 56282 - DNA, 201 bp, Homo sapiens
tctttatagttccatgaattatacattaggtagattgagaggatcaaaataataataaaagcagcatactctgtatcaggtacaatgcctaatgcttcatrtgcattatttcattaaattctcttaaccaccccgtgaagtgggtgccattattcccagtttacagttgaggaaactgtgacttaaagagattatgtaact

SEQ ID NO: 56283 - DNA, 201 bp, Homo sapiens
ctggctcgttccacgtttgtctgctttggttctccaaacgctaaggtggactcttatgacagccctgaggcaggcagctcagagacacctgtcctcattayagaaatgggaaaacgccttctagagaagggacttgacttgctcaaggtcacatattaagatagctgaggcctggctcagagctggagttcccaggctggt

SEQ ID NO: 56284 - DNA, 201 bp, Homo sapiens
cttaccaccacataccagtcctccaactcaccagccacccaaggggctgttaagagccagaatttcctctagactgtctattgctttgaaattgcagtttrttgtgatggtaccttattgagccttgataagtgttccaccttgcagacccgaggggaagctgcagccagccagctgattttatatcactatcctgaactt

SEQ ID NO: 56285 - DNA, 201 bp, Homo sapiens
ataaagaaggggagaaatgtttccgacagagggaatagcataagtaaatgctgagagacataaaatgacttggagtattgtaaagagtttggtatcacttgtgtgtgtgtgtgtgtgtgtatgtgtgtatatgtaaggtttggtggtttttgtttagagatttggctttaccctgagggcatgaaaagagtcattaaaggg

SEQ ID NO: 56286 - DNA, 201 bp, Homo sapiens
taaagaaggggagaaatgtttccgacagagggaatagcataagtaaatgctgagagacataaaatgacttggagtattgtaaagagtttggtatcacttgtgtgtgtgtgtgtgtgtgtatgtgtgtatatgtaaggtttggtggtttttgtttagagatttggctttaccctgagggcatgaaaagagtcattaaagggt

SEQ ID NO: 56287 - DNA, 201 bp, Homo sapiens
aaagaaggggagaaatgtttccgacagagggaatagcataagtaaatgctgagagacataaaatgacttggagtattgtaaagagtttggtatcacttgtgtgtgtgtgtgtgtgtgtatgtgtgtatatgtaaggtttggtggtttttgtttagagatttggctttaccctgagggcatgaaaagagtcattaaagggtt

SEQ ID NO: 56288 - DNA, 201 bp, Homo sapiens
acaagcgcccaccaccacgcccagctaattttgtttttgtatttgtagtagagacggggtttcaccgtgttagccaggatggtctcgatctcctgacctcrtgatccgcccacctcggcctcccaaagtgctgggattataggcgtgagccaccacgcctggcccaaacttctttttaaagtagtaggaggacccctttat

SEQ ID NO: 56289 - DNA, 201 bp, Homo sapiens
aagtctgtgaacttgatcattatgggattgtgttaggaactgtgctaagacttggagatctgtgagacaaggtccctgccttcatggagctaatattcagstataggagaaagatccagaaacataattacaataaaagtgattagtataatattagaatgatgaccaaaatgatcagtgtaacattagaagtatgttcaa

SEQ ID NO: 56290 - DNA, 201 bp, Homo sapiens
aagtgttcgaggttataacaagagacagccaaggacctacaagacagttgacttgattttgcacagtgtaacagcgcagttgcattctggccactttgacsttatagctcccaaatgatgagtttgtcatctttatgaactcatgacaggataataagcttgaagacctgctgtagttagatatgggctttaatccttccc

SEQ ID NO: 56291 - DNA, 201 bp, Homo sapiens
gctggagtacagtagcgtgatctcagctcgctgcaacctctacctccctggttcaagtgattctgctgcgtcagcctcctgaggagctaggattacaggcrcatgccaccatacctggcttatttttgtattgttgtagagacagggtttcactttgttggccaggctggctggtctcgaactcctggcctcaagtgatcc

SEQ ID NO: 56292 - DNA, 201 bp, Homo sapiens
cataaagagatggattttaagacctagcctattaattattaactttaattatttgcttcctaaacattgtgtagttcaagtctagtcagtatgataatttrgaagtcagttgcaatagtctgcacaagaagtggtgaaaacttgaactacagcagtggtatagagatggaggaaagagaatgaccccaggaatatgtaggg

SEQ ID NO: 56293 - DNA, 201 bp, Homo sapiens
acaactggaagttgtgccagttgccatgggtttcctttgtatgctgtatcatttattttagcacacatttaatgcataccaattaaatgtcagactctgtkccagatacagagataaatgagagaatcctcatccccaaggagttttagcctccgcaaaacggatcagatcagcacagggttctttctattaatagaggca

SEQ ID NO: 56294 - DNA, 201 bp, Homo sapiens
ttctgctgcgtcagcctcctgaggagctaggattacaggcgcatgccaccatacctggcttatttttgtattgttgtagagacagggtttcactttgttgkccaggctggctggtctcgaactcctggcctcaagtgatccaccaccttgacctcccaaagtgctgggattacaggtgtgagccaccgtgcctggcctgac

SEQ ID NO: 56295 - DNA, 201 bp, Homo sapiens
aagaagtggtgaaaacttgaactacagcagtggtatagagatggaggaaagagaatgaccccaggaatatgtagggaataaaatagtcaggacttggtgcrttgattgtagatttgaaaattgaaagagagggaggaatcaaacttgttaaaatacctctttattgagcagcacagggaattagtatgtttatcttattgg

SEQ ID NO: 56296 - DNA, 201 bp, Homo sapiens
tatgcaaatgatcttattatgaagtagcatatcctaggcatcttaagagagatataaaatatgaaagcaagggggaggaaataaataaaatagaaaagcarctcataggaaaacttctgactgtaatatcaagggaaactgcatggaagaagaagcatataggctcagcttcagagtacaggaagaatttgggaggtcaga

SEQ ID NO: 56297 - DNA, 201 bp, Homo sapiens
ggaggacccctttatccaaacaaaatcttactatgtaaaaccccaggatatgacagctaaaacaggtgaagggacctgaggcacctccacagagcccctakgactctacagaatagtttgaacagcagtgttgtagtgtgaacacagctgaacttactcctaccttcccaccccaagcttcagataaaagttgatgtcaga

SEQ ID NO: 56298 - DNA, 201 bp, Homo sapiens
ctattatctttctaaaattcaataattctgaatctaagacacatcaggccctaagggtttcagataagagattgtagacaagtaaatggcttcttaattayagggaagagttgtattgaagcctaggatagctctcaatattttatcttccttcatactgttcatttatacaacattcatcatttatagtgtttttctttc

SEQ ID NO: 56299 - DNA, 201 bp, Homo sapiens
ggacatcccactattctctgagccgtgtctattttgttgcacctttgagtctatgtattgagagagacagatagtatttttttaaactggggaagctgctrtcctttcactatttctctaaaggttgagctgttaactaatgtaaattctggacctgcttctggtcctggcagtttatcttttgagaaacttgagtcttat

SEQ ID NO: 56300 - DNA, 201 bp, Homo sapiens
tggaaggataaagccaggccttttggtggttatgatggtatcgctatctttttttttaatctctcatatatatatacccttatcctacatgaattcaacarccagaagaagagtctgcactttttgtgatgttttagatctctgatactgactcattgtttaaacaggccttcttacctctccctcaaactgacttggtga

SEQ ID NO: 56301 - DNA, 201 bp, Homo sapiens
cgatacatgaggcttcatgactgaaaggtgaaagcagctgtgcaagtggaggttttgttttgtttttgtttcgttttcatggtacacctgagaatgagtgktatgaaaatgaaattctcatcaggcacagtggctcatgcctgtaatcccaacactttgggaggccgaagcgggcagatcacttgaggccagaagtcaaga

SEQ ID NO: 56302 - DNA, 201 bp, Homo sapiens
tctcatatatatatacccttatcctacatgaattcaacagccagaagaagagtctgcactttttgtgatgttttagatctctgatactgactcattgtttraacaggccttcttacctctccctcaaactgacttggtgacttgatgtctctgacaattgttaaagttccctggagcattggtgcacctagtctttacaca

SEQ ID NO: 56303 - DNA, 201 bp, Homo sapiens
cttttccagttgaagacacaaataacactgtgcaaactgtcagtttcactgtgcctttgcaggcctgaccttaccaccacataccagtcctccaactcacyagccacccaaggggctgttaagagccagaatttcctctagactgtctattgctttgaaattgcagtttgttgtgatggtaccttattgagccttgataag

SEQ ID NO: 56304 - DNA, 201 bp, Homo sapiens
tgatttgatctggaaccgggctcagtcctgtccaacagtaagtttctggtgatcacgtaagggttgcttatcaatgttgccaaacaagtattttccagccmatcacgtcatattccatactgtctcacatgttatagtgctctgtttacttaataaagatgctcacatgttgattgtactaataagttatagtgctctgtt

SEQ ID NO: 56305 - DNA, 201 bp, Homo sapiens
aactgtgaaatgcactagtccataaaagtggcaattacacaggcacattgctttctttagaacttgatttggtagctgcttgtgccattttgtttttaaaygtatggtcacaatgatggattcactgcctactgtaaacattttctgggaaaaaagccaaaccttttccagttgaagacacaaataacactgtgcaaactg

SEQ ID NO: 56306 - DNA, 201 bp, Homo sapiens
attttcagccttatgaaatcatgtgggtttgacccagtaagcctctggctttttagctccctaccacatcagccctttctgatgtagatcttaatctatcrgtacaagtgcgttttggaagacatctgagaccttaatcttttcaacttctttttttttttttttttgcttttattattatttttaattgacacataatta

SEQ ID NO: 56307 - DNA, 201 bp, Homo sapiens
cagtctggtggtcaaggcaaggcacacatggtagtaggctagaggtatcagagaaaatttcccatgggagatggaacctgacctaggctaggaacgttgtrggggatttaaattaagtagagaggaaggaatgggactttgatgtagagcaggggtcatcaaattttttctgtaaagaactagatgttaaatattttaggc

SEQ ID NO: 56308 - DNA, 201 bp, Homo sapiens
tcaggaaacaacaggtgctggagaggatgtggagaaataggaacacttttacactgttggtgggactgtaaactagttcaaacattgtggaagtcagtgtrgcgattccttagggatctagaactagaaataccatttgacccagccatcccattactgggtatatacccaaaggattacaaatcatgctgctataaagac

SEQ ID NO: 56309 - DNA, 201 bp, Homo sapiens
tttatttgtaacaaccaatgctggaaacaatgcaaatgtctgtcactagtgcacaggaattgtggaaagagagaatgtgcatgtgtgtgtgtgtgtgtgtktatgtgtgtatacatacacaatggaataatattcagcagtaaaaggaatgaactattgatacatgcaacaacatggtgttctgtgaaagggccatatgtg

SEQ ID NO: 56310 - DNA, 201 bp, Homo sapiens
agttcatgtcctttgtagggacatggatgaagctggaaaccatcgttctcagcaaactatcgcaaggacaaaaaaccaaacactgcatgttctcactcatrggtgggaatcgaacaatgagaacacatggacacaggaaggggaacatcacacactggggcctgttgtggggtcgggggagtggggagggatagcattagg

SEQ ID NO: 56311 - DNA, 201 bp, Homo sapiens
cctgaacttaaggaagaaaagggcatagtgctgatgactgcagaaatggattccacatttctggtaagaattaacttgcaaaactctttggatttacctcrtggcactgaaggtattactcttctgccaaagctcatgagagagaaaatttcaaagagctacatataccttgtttcttacttattttaaagttgacagtga

SEQ ID NO: 56312 - DNA, 201 bp, Homo sapiens
tgttaaatgacgagttaatgggtgcagcacaccaacatggtacatgtatagatatgtaacaaacctgcacgttgtgtacatgtaccctaaaacttaaagtwtaataaaaatagaaaaaaataaaataaaatgactaattgagttaattagaacaggattaatagtaaatgggttgccaggcgcagtggctcacgcctataa

SEQ ID NO: 56313 - DNA, 201 bp, Homo sapiens
tatagttatatagtatctatacctattatctttctaaaattcaataattctgaatctaagacacatcaggccctaagggtttcagataagagattgtagayaagtaaatggcttcttaattacagggaagagttgtattgaagcctaggatagctctcaatattttatcttccttcatactgttcatttatacaacattca

SEQ ID NO: 56314 - DNA, 201 bp, Homo sapiens
gcgtggagccaggaggcggagcctgcagtgagcggagatcacaccactgcactccagcctggacgacagagtgagactccatcttaaaaaaaaaaaaaaaraaagaaatttagctttatgataaaatgtagaatatgtaaagatttaatttaaattgtggcagctcttaggtaaatattcacttgctatcttctgtatcta

SEQ ID NO: 56315 - DNA, 201 bp, Homo sapiens
aaattctcccttttctaccctgaaataaaacaataggtatgtaaaaatataacctacctgtatgtataacctcaggtgggaaaatcaatataatgccctamccataatataaagaaaagtattttttaacaaaatacatattttagcatgtaaatattagggcacgactacactgtgagacctaatgtagtcatgaggtgc

SEQ ID NO: 56316 - DNA, 201 bp, Homo sapiens
aatcccagctacttgggaggctgaggcaggagaatcgcttgaacctgggaggcggaggttacagtgagctgaggtcatggcactgcattccagcctgggcaaaaaaaaaaaaaataacagatgggttaattataataaggttggggagcaaattcaactcctatgacaaatagagtttacaactttatgtgagcaaacaat

SEQ ID NO: 56317 - DNA, 201 bp, Homo sapiens
tagatgatagtttactgagagagaaatcttatctctgaatctcagaatcttagaagaaagttgttttcttataaacaataatttttatttttatttctttwtatttatttattttattttatgagacagagtctcactctgttgcccgggctagagtgcagtggcgtgatctcggctcactgcatcctccgcctcctgggt

SEQ ID NO: 56318 - DNA, 201 bp, Homo sapiens
tgacctttatgagagataatggctacgagacaaaataatcactttcagttgttggtggcctttttttaagggtgtctaatttgatagaggaaacattaagattgaacactcaaaatgactctagtctgctgaggatgcctaccatcaaagtgttgtcagagataagcagtatccttggataacacatctttccatttctta

SEQ ID NO: 56319 - DNA, 201 bp, Homo sapiens
ctctgagcatgtgggttttcttatacttgttttctacttttggaaatctgtttcattgtcctgacatgtttgccacaggcttagagatagagttaagctgtttttttttttttttaattatgtgttaattgctttttattgtctctttcaagactctcagttcaatctttaacattgagatggtaaaagaaaaaactgcag

SEQ ID NO: 56320 - DNA, 201 bp, Homo sapiens
aaggtaataataaaaggcaaaagtgatgaattacttgaagaacaatgtcataagaaaacttgtcttctttgtcactcttatatgtctaatcaacttgtatktctagtttctttttcattcccataatccacatctcgtgtaaccctcatcagtactctgtacctggattactgcactacctttccaaataggtttcccttc

SEQ ID NO: 56321 - DNA, 201 bp, Homo sapiens
gtatgagaggggtacttcctgctcccaagaggagcagtctggtggtcaaggcaaggcacacatggtagtaggctagaggtatcagagaaaatttcccatgrgagatggaacctgacctaggctaggaacgttgtgggggatttaaattaagtagagaggaaggaatgggactttgatgtagagcaggggtcatcaaatttt

SEQ ID NO: 56322 - DNA, 201 bp, Homo sapiens
ccttttggtggttatgatggtatcgctatctttttttttaatctctcatatatatatacccttatcctacatgaattcaacagccagaagaagagtctgcrctttttgtgatgttttagatctctgatactgactcattgtttaaacaggccttcttacctctccctcaaactgacttggtgacttgatgtctctgacaat

SEQ ID NO: 56323 - DNA, 201 bp, Homo sapiens
caagagctttgtggccctgtgcaagaaaggacctcattattctttttaccttacagaatgttgctgaggcacagtgcatcgccaaccaagttcagctcttytacgctactgatcggaaagagacctacgggttagtggagacctttaacctcagaccaaatgagttcaaatatatgtctgtcatcgctgaattggagcaaa

SEQ ID NO: 56324 - DNA, 201 bp, Homo sapiens
gtctgtgaacttgatcattatgggattgtgttaggaactgtgctaagacttggagatctgtgagacaaggtccctgccttcatggagctaatattcaggtwtaggagaaagatccagaaacataattacaataaaagtgattagtataatattagaatgatgaccaaaatgatcagtgtaacattagaagtatgttcaaga

SEQ ID NO: 56325 - DNA, 201 bp, Homo sapiens
ccatccctggagagatgaagaagcatcagcaaagattaagaaggaatggccatgaggtaaaaggaaaattaagatggtagaatgccctggaagctaaaatygaatgtttcaaggaatagggactgctcaactcaccaaatctcccttgtttattagggcaaatgagattaggactgagaatttactgatttcacaaacatg

SEQ ID NO: 56326 - DNA, 201 bp, Homo sapiens
atacctggcttatttttgtattgttgtagagacagggtttcactttgttggccaggctggctggtctcgaactcctggcctcaagtgatccaccaccttgrcctcccaaagtgctgggattacaggtgtgagccaccgtgcctggcctgacatttctttattgatctaacatgctccactctgctgctcctgcctaagatc

SEQ ID NO: 56327 - DNA, 201 bp, Homo sapiens
tgactctgagtccagggtccctaacaccacctcttagcttccagagggaaggatctggagcttagaggggcttaaggtgcatatgaggggctataggagcrtctgaagagttcaagtgggaagagctaaaggagatcagaggtgaaaattaaaggggcttgggagagaatttagcagggtaagaaggtagttgtcttatga

SEQ ID NO: 56328 - DNA, 201 bp, Homo sapiens
ttcaaaacatttaaaacttttaaaataaaagtcaatattttaaatcataactaggattggcattctatatttggaggtcaaatgtggcaaaaaacaagcaygaattatattggctttgaagttggggtaaagaatgcaaaatagaatgaaggaacagctttttactttgctattttgtaatatgtctaacaaccctttatt

SEQ ID NO: 56329 - DNA, 201 bp, Homo sapiens
taccctagtccctgccagtctctctctagttttatctgttagcaaacttcctttgaaaaagaatggagaggaggggatgttccaggtaaggggagcagcarcataaacaaaggtacagaggcatgaaaccaccttaaccatttggggatgtttgagcaaattttcatcataatacctgttgtactttcatttgtttacttt

SEQ ID NO: 56330 - DNA, 201 bp, Homo sapiens
tatagctcccaaatgatgagtttgtcatctttatgaactcatgacaggataataagcttgaagacctgctgtagttagatatgggctttaatccttcccakgcaccagtcagctgaacaaaagcataagccaaacatcctgtttaaactgtagaataaccagatattcccatcaggttaaagacttcatctagatgatgcc

SEQ ID NO: 56331 - DNA, 201 bp, Homo sapiens
gaggaaatgatggaaaaaggagtaagaagtggccattcgttttaatcattcctcctggatttgtcctcagtccccaactgccaagtaggatgtgtccatgkataaatgtgtggggcatgactaaagtaccacgtagctgttctttatatttatttacctagaaagatctggcaaagaactcaaagaaaattgtaccattta

SEQ ID NO: 56332 - DNA, 201 bp, Homo sapiens
gaagaacaatgtcataagaaaacttgtcttctttgtcactcttatatgtctaatcaacttgtatgtctagtttctttttcattcccataatccacatctcstgtaaccctcatcagtactctgtacctggattactgcactacctttccaaataggtttcccttctccttttttttccactccacccataatattctcatc

SEQ ID NO: 56333 - DNA, 201 bp, Homo sapiens
aatatacaataaattattgttaattatagtactccatagtgccgtagaacactagaacatatttctcccatctagctgtacttttgtatcccttaaccaamctttggctattcgttcctctagtaaccactctcctactctctccttctatgagatcaggtttttttttttttttagcttccaacatgtgagaacatgtgg

SEQ ID NO: 56334 - DNA, 201 bp, Homo sapiens
tgtattaggaacctggtcacaaatgttcagtgacttcctgtattccttttctgggcattcatagctctccattatcacaggaccttcttcaggaagcttcytgaacactttccttcaaagcactcatgagctatcctgcctgtttggtcatttatatttttatacctgtgattcttttctctctaataagctatttttctg

SEQ ID NO: 56335 - DNA, 201 bp, Homo sapiens
gacacaatgggaggtaattgaatcataggggcagttacctccatgctgttcccatgataatgagttctcacgagatctgatggttttatagggggcttttrccccttttgctcattcttcttcctgtcaccatgtgaagaaggatgtgtttgcttccccttccaccatgattgtaagattcttaacgccttcccagccctg

SEQ ID NO: 56336 - DNA, 201 bp, Homo sapiens
gcagggacatggatgaagctggaaaccatcattctcagcaaactatcacaaggacagaaaaccaaacaccgcatgttctcactcataagtgagagttgaayaatgagaacacatggacacagagtggggaacaccacacactggggcctgtcagggggtggagggctgggggagggatatcattaggagaaatacttaaag

SEQ ID NO: 56337 - DNA, 201 bp, Homo sapiens
ttaaagtaaatgacaagttgatgggtgcagcaaaccaacatggcacacgtatacctatgtaacctgcatgttgtacacatgtaccctagaacttaaagtayaataataataataataataataataataataaataaataaataaattgcccagtctcaggtatatctttattagcagtgtgagaatggactaatacaata

SEQ ID NO: 56338 - DNA, 201 bp, Homo sapiens
tctcacatgttatagtgctctgtttacttaataaagatgctcacatgttgattgtactaataagttatagtgctctgtttacttaataaagatgctcacaygttgattgtactaataagtgacattttcagccttatgaaatcatgtgggtttgacccagtaagcctctggctttttagctccctaccacatcagcccttt

SEQ ID NO: 56339 - DNA, 201 bp, Homo sapiens
caataatttttaaaatagtgttaaaattttagaacaattattataaaaagtggagagaagtgagttctcacatgcaaaattatttaatgagattgggtacytcacctagcttagttaccttttttcttatgagtaaagtgtagattaatatcttgtcttatatatttcagacagatgccttggggaaacagtctgtgaaca

SEQ ID NO: 56340 - DNA, 201 bp, Homo sapiens
gaagctctttagtttaatggcaatcattaaaaagtcaggaaacaacaggtgctggagaggatgtggagaaataggaacacttttacactgttggtgggackgtaaactagttcaaccattgtggaagtcagtgtggcgattcctcagggatctagaactagaaataccatttgacccagccatcccattactgggtgtata

SEQ ID NO: 56341 - DNA, 201 bp, Homo sapiens
aataaaatagaaaagcagctcataggaaaacttctgactgtaatatcaagggaaactgcatggaagaagaagcatataggctcagcttcagagtacaggargaatttgggaggtcagaggtaggagagagaggctttctagtcagagccaataacatgtaaaaaggcatgggaaggcaaaaaaaaggtagtaaaaaataag

SEQ ID NO: 56342 - DNA, 201 bp, Homo sapiens
tctagtaaccactctcctactctctccttctatgagatcaggtttttttttttttttagcttccaacatgtgagaacatgtggtatttgtctctctgtgcrtggcttatttcacttaacataatgttctccaagctcatccatgttgtcacaaatgacagaacttgttcttttttgtggctaaatagtattccattgtgta

SEQ ID NO: 56343 - DNA, 201 bp, Homo sapiens
aaagtcagttctctaaccttagcaggcagttgcctttacttttcctatgtttattgcctcttgagaagctgcattttacagccctgagagtttttattatrccctgagcaccagagattggaagctccatatggtatatttatggctcttgttttcctcctttctactttagaaatgtctctgagtcaagtctctgacaag

SEQ ID NO: 56344 - DNA, 201 bp, Homo sapiens
agatatctcttcaacatactaatttcctttcctttggatatatatccagtagtgggactgctggatcatgtggtagttctctttttagttttttgaggaamcttcataatgttttccataatggctatactaatttacgttccaccaatattatacaaaagttcctctttctccacatcttcaccagcatttttttttttt

SEQ ID NO: 56345 - DNA, 201 bp, Homo sapiens
ctctctcctgccctcagcccggctggccagccccctcccccgggaggaggagatcgtgtttccagagaagctcaacggcagcgtcctgcctggctcgggcrcccctgccaggctgttgtgccgcttgcaggcctttggggagacgctgctactagagctggagcaggactccggtgtgcaggtcgaggggctgacagtgca

SEQ ID NO: 56346 - DNA, 201 bp, Homo sapiens
ggagatcgtgtttccagagaagctcaacggcagcgtcctgcctggctcgggcgcccctgccaggctgttgtgccgcttgcaggcctttggggagacgctgytactagagctggagcaggactccggtgtgcaggtcgaggggctgacagtgcagtacctgggccaggcgcctgagctgctgggtggagcagagcctggcac

SEQ ID NO: 56347 - DNA, 201 bp, Homo sapiens
cctgcctttcctttctccatgagcctcctttcttggtaaggctcaggcctctccccttcacccttctcctagccagacccaccgagggttctcagaggtgrgtcacagactctgggctgggaataactgctccctctccccaccccaccccttcctggccatggcatctcctactgacacagtccccagcagtaaaggtct

SEQ ID NO: 56348 - DNA, 201 bp, Homo sapiens
tgcgcagcttctgtgcctggcagcggggcctcaacacccctgaggactcggaccctgaccactttgacacagccattctgtttacccgtcaggtgaggccscagtcagcaccgcaggccatgcactgcacaattctaagaagcgccactacatagactatgatgcaaatgatgttcctggagttgtgtgacatggtgcctt

SEQ ID NO: 56349 - DNA, 201 bp, Homo sapiens
ctgctccaggtgtagacatacatttacatttttctattaaataaattagttggtcgaaactactgtgaactcctctgtgtgtgtgtgtgtgtgtgtgtgtstgtctgtgtgtgtgtatttggagggggagtcagagacaatgggtggggtcacagttgggaatgttggctataaggaaaagtgggtagggagggaccctga

SEQ ID NO: 56350 - DNA, 201 bp, Homo sapiens
cccaactggctcaggtgaggagtaggggggatgggagcccttgggaggggacagtagagcaggaaggactgtcccttgagtgcaagaccaagggggtgttkattcccctgctgctgtggggagtgcctttaacctctgggaattgtccttggccgtctgcagggaagagcagagctgtgctgtctagagttctcaggggtt

SEQ ID NO: 56351 - DNA, 201 bp, Homo sapiens
tggatctgatcatccacagctgcagccagatttattatggagtccctcagggcatggggaagggaccctcagatcctatcagggcctttgctcccacaggycatgtcttcaacatgctccatgacaactccaagccatgcatcagtttgaatgggcctttgagcacctctcgccatgtcatggcccctgtgatggctcatg

SEQ ID NO: 56352 - DNA, 201 bp, Homo sapiens
ttgaggctgtagtgagccatgatcatgccactgtactgcagcctgagcgacagagcaagactctgtctcaggaaaaaaaaaaaaaagtaagtaattaaaayaaaaattataaataacaaaaatttaaatcctcttatagtcctaggattgtttttctaggctccatcaggccccagggagcctaagctttctgctggcaat

SEQ ID NO: 56353 - DNA, 201 bp, Homo sapiens
caagacccgccaggagtcaggaatcccgtggggtgtgtggggcccagctgactatgctgagttccagacccaggaagtgagggattggagaatcgaccgamccatgggtctgagaggctatttcaggatcttcctctccctttttctctacagcgctttgcttcactgagtagatttgtggagacactggtggtggcagat

SEQ ID NO: 56354 - DNA, 201 bp, Homo sapiens
ctaggtatagggctattactcctctctgctccaggtgtagacatacatttacatttttctattaaataaattagttggtcgaaactactgtgaactcctckgtgtgtgtgtgtgtgtgtgtgtgtgtgtctgtgtgtgtgtatttggagggggagtcagagacaatgggtggggtcacagttgggaatgttggctataagg

SEQ ID NO: 56355 - DNA, 201 bp, Homo sapiens
  misc_feature (1)...(201): n = A,T,C or G, or insertion/deletion polymorphism (see Tables 1-2)
gacttcaatgtgagatcctagggcaggggtggggtaaagggcccgggggtgtggggactggccttaagcccaggagagagttcacttatgccccacttccnttctgtgcctttgcagattccacaggctggtggctggggtccttggggaccatggggtgactgctctcggacctgtgggggtggtgtccagttctcctcc

SEQ ID NO: 56356 - DNA, 201 bp, Homo sapiens
ttctttaagcaggtgtagatgtgtgactgtaagttacttcacctctctgtgtttgtagttgatatgtcagataagtataatagcggtacctatctcatagktatttgccatgattaaatagtgctggtcaagcatttagccaatgctcatctcataataagcatccaataaactatagctgcccattaaagcctcttacag

SEQ ID NO: 56357 - DNA, 201 bp, Homo sapiens
ccccggccgaccccttcaacgccacgccccactccccaggactggctgcaccgaagagcacagattctggagatccttcggcggcgcccctgggcgggcargaaataacctcactatcccggctgccctttctgggcaccggggcctcggacttagctgggagaaagagagagcttctgttgctgcctcatgctaagactc

SEQ ID NO: 56358 - DNA, 201 bp, Homo sapiens
aggggctgacagtgcagtacctgggccaggcgcctgagctgctgggtggagcagagcctggcacctacctgactggcaccatcaatggagatccggagtcrgtggcatctctgcactgggatgggggagccctgttaggcgtgttacaatatcggggggctgaactccacctccagcccctggagggaggcacccctaact

SEQ ID NO: 56359 - DNA, 201 bp, Homo sapiens
cccgaagagccaaggtaggcatctctggagtctgtgtcctgcggtgtcctcccgccatgtctgtcctactgacccctattcaccctctctccacccacttmcacttctggccgttctgcttccctcccttctgcctgcctttcctttctccatgagcctcctttcttggtaaggctcaggcctctccccttcacccttctc

SEQ ID NO: 56360 - DNA, 201 bp, Homo sapiens
ctgagctccccatctactccttccacacaggtacggatacaacaatgtggtcactatccccgcgggggccacccacattcttgtccggcagcagggaaacsctggccaccggagcatctacttggccctgaagctgccagatggctcctatgccctcaatggtgaatacacgctgatgccctcccccacagatgtggtact

SEQ ID NO: 56361 - DNA, 201 bp, Homo sapiens
attctggagatccttcggcggcgcccctgggcgggcaggaaataacctcactatcccggctgccctttctgggcaccggggcctcggacttagctgggagraagagagagcttctgttgctgcctcatgctaagactcagtggggaggggctgtgggcgtgagacctgcccctcctctctgccctaatgcgcaggctggcc

SEQ ID NO: 56362 - DNA, 201 bp, Homo sapiens
tagcatgctgcctgattcatactcagtgctctgaaaatgctggctagatgttatatgtgataataattattattgttatgattatcacccacatggtggcyggcactcacccatctacatcccctacttcatccaacttttccgacaacattgcttccctgatgggacatgggtctcgtttgatttaccaaccccttttga

SEQ ID NO: 56363 - DNA, 201 bp, Homo sapiens
tcctctgactccccatcttctaatgctgcatttggtgagaatcgaatgtgtggcctttgggacaagtccttcacccctcttccatgggctcctctgtcaamttatagtggtggtttcattcagctcctggacagccagtccctcaatggacaggcctcctggagatgactgaagtccctacactccctctctgtgataggg

SEQ ID NO: 56364 - DNA, 201 bp, Homo sapiens
tggccttggctcttttctctgctccaaatttgattttcatcccccactcccagctataggagtcaggtttgaggccctagggcttggtgtctggcttctgmtgctgcctttaaaatcactgtggcaaactgcaaactagggcaggagtggcaagagagggagggtatcccatacctccttctggtcaatccccttcacaca

SEQ ID NO: 56365 - DNA, 201 bp, Homo sapiens
cgcaccgacctcttcaagagcttcccagggcccatggactgggttcctcgctacacaggcgtggccccccaggaccagtgcaaactcacctgccaggcccrggcactgggctactactatgtgctggagccacgggtgagggtcaggacacccccaggccctgtctatggtcacacacacccgcagtgctccctctgcttt

SEQ ID NO: 56366 - DNA, 201 bp, Homo sapiens
ctcctcggtctgtgtccagggccgatgcatccatgctggctgtgatcgcatcattggctccaagaagaagtttgacaagtgcatggtgtgcggaggggacsgttctggttgcagcaagcagtcaggctccttcaggaaattcaggttctttcaccatcattcctccctctaccttcctggacattctgggtcctagtgatg

SEQ ID NO: 56367 - DNA, 201 bp, Homo sapiens
cctctgcagtgtgggaaggggtgagaaatgctgctgtctttgtgtagttctcacttcctcccagaataaatagcatagctagaggaggcgaattttggctyagtagaattagaactgactttctgagggccagaactgtccaccactggaatgggctggctatgaaggaggtgattaccttgtcacgcagtgaggtatgca

SEQ ID NO: 56368 - DNA, 201 bp, Homo sapiens
atggggtgactgctctcggacctgtgggggtggtgtccagttctcctcccgagactgcacgaggcctgtcccccggaatggtggcaagtactgtgagggcygccgtacccgcttccgctcctgcaacactgaggactgcccaactggctcaggtgaggagtaggggggatgggagcccttgggaggggacagtagagcagg

SEQ ID NO: 56369 - DNA, 201 bp, Homo sapiens
ggggccgctagctgcggggaagggccgcggcggcggcgactgacagctgggccccggcccctgccatcttggcgggcgctgcccgggccggcgtgtgcccsggcgcgtgcctgggggccgccgccgggggatgggggggcggggggcgagctggctggggtccgggcggcgggaacgcgtgcgcgtccgcctgagactcgg

SEQ ID NO: 56370 - DNA, 201 bp, Homo sapiens
tcggggccgctagctgcggggaagggccgcggcggcggcgactgacagctgggccccggcccctgccatcttggcgggcgctgcccgggccggcgtgtgcsccggcgcgtgcctgggggccgccgccgggggatgggggggcggggggcgagctggctggggtccgggcggcgggaacgcgtgcgcgtccgcctgagactc

SEQ ID NO: 56371 - DNA, 201 bp, Homo sapiens
gagtctcgctctgtcgcccaggctggagtgcagtggcgcgatctcggctcactgcaagctccgcctcccgggttcgcgccattctcctgcctcagcctccsgagtagctgggactacaggcacccgccaccatgcccggctaattttttgtatttttttttagtagagacggggtttcaccgtgttagccaggatggtctc

SEQ ID NO: 56372 - DNA, 201 bp, Homo sapiens
ggcggcggcgactgacagctgggccccggcccctgccatcttggcgggcgctgcccgggccggcgtgtgccccggcgcgtgcctgggggccgccgccgggkgatgggggggcggggggcgagctggctggggtccgggcggcgggaacgcgtgcgcgtccgcctgagactcggggcggcggcccctggcgagtgcgcgggc

SEQ ID NO: 56373 - DNA, 201 bp, Homo sapiens
gtagctgggactacaggcgcctgccaccacgcccggctaattttttgtacttttcgtagagatggggtttcaccatattagccaggatggtgtggatctcctgatctcgtaatccgcccacctcagcttcccaaagtgctgggattacaggcgtgagccaccgcacccagccacaaccatcctttttttaaaaaaaatatt

SEQ ID NO: 56374 - DNA, 201 bp, Homo sapiens
gcctcccgggttcgcaccattctcctgcctcagcctcccgagtagctgggactacaggcgcctgccaccacgcccggctaattttttgtacttttcgtagagatggggtttcaccatattagccaggatggtgtggatctcctgatctcgtaatccgcccacctcagcttcccaaagtgctgggattacaggcgtgagcca

SEQ ID NO: 56375 - DNA, 201 bp, Homo sapiens
gccaccacgcctggctaatttttgtatttttagtagagatggggtttcaccatgttagccaagctggtctccaactcctgacctcaggtgatcaatccacygcctcaaactcccaaagtgctgggattacaggtgtgagtcaccatgcctggcctattatttttcttaatcaacagaagtgctagccaaaagcctaaaaag

SEQ ID NO: 56376 - DNA, 201 bp, Homo sapiens
tcttacaatatttgctttactgctttattgtgcacccactgtatctccagggtaagtctactgcaaggttcctcaaacatgggcagtacacatattctctytaaaggggaaaaatctgtatgtgaaacaatatgatttaatttatattcattcagcttatatatataattgttacttttcttttttttaattttatttttg

SEQ ID NO: 56377 - DNA, 201 bp, Homo sapiens
tgattccagctactcgggaggctgagacaggagaatcgcttgaaactgggaggtggaggttgcagtgagccgagatcgcaccactgcactccagcctgggygaccagagcaaaactctgtctcaaatgataataataacatatcagtaataatgtatcatactaatataagatgttaattaacaggagaaactatatgtgt

SEQ ID NO: 56378 - DNA, 201 bp, Homo sapiens
ttgtttacttgagatagagtctcgctcctgtcacacaggttggagtgcagtggtgcaatctcggctcactgcaacctccacctcccgggttcaagtgattytccttcctcagtctcccaagtagctgggattacaggcgtgtgccaccatgccaggctaagttttgtatttttaatagagacagggttttgccatgttggc

SEQ ID NO: 56379 - DNA, 201 bp, Homo sapiens
attaatttcattgcccaactcagttattaccagcagttgttttccttaaacacagcatggctagttttccttcattcatccattcgtttaatgtgccttgmgctcctcggcacgtgtctgcctcctctcctgccctgctcactgcctcagcctgcctggcaaatcatcttcaatcctgctatgtgtcaggtctctcctgga

SEQ ID NO: 56380 - DNA, 201 bp, Homo sapiens
aagacaagggacttttttttttttttctttctgagatggagcttcgctcttgttgcccaggccagagtgcaatggcgcaatcttggctcaccgcaacctcsacctcctgggttcaagcgattcttctgcctcagcctcccaagtagctgggattacaggcatgcaccaccacacccagctaatcttgtattttaagtagag

SEQ ID NO: 56381 - DNA, 201 bp, Homo sapiens
gtccaagatgaaggcactggcaaattacctatctgatgaaggccttttcctcatagagccttcttgctgcatcctcacatgctaggaggggcaaacaagcyccctcaaaccccttttatttatttgtttgtttgtttgtttacttgagatagagtctcgctcctgtcacacaggttggagtgcagtggtgcaatctcggct

SEQ ID NO: 56382 - DNA, 201 bp, Homo sapiens
ctcccaagtagctgggattacaggcgtgtgccaccatgccaggctaagttttgtatttttaatagagacagggttttgccatgttggccaggctggtctcraactcctgacctcagttgatccacctgccttggcctcccaaagtgctaggattacaggcatgagccaccatgcccggcctctaacctcttttataaggac

SEQ ID NO: 56383 - DNA, 201 bp, Homo sapiens
agttctagaagctgagaagtccaagatgaaggcactggcaaattacctatctgatgaaggccttttcctcatagagccttcttgctgcatcctcacatgcwaggaggggcaaacaagctccctcaaaccccttttatttatttgtttgtttgtttgtttacttgagatagagtctcgctcctgtcacacaggttggagtgc

SEQ ID NO: 56384 - DNA, 201 bp, Homo sapiens
ctcatagagccttcttgctgcatcctcacatgctaggaggggcaaacaagctccctcaaaccccttttatttatttgtttgtttgtttgtttacttgagawagagtctcgctcctgtcacacaggttggagtgcagtggtgcaatctcggctcactgcaacctccacctcccgggttcaagtgattctccttcctcagtct

SEQ ID NO: 56385 - DNA, 201 bp, Homo sapiens
gcctgggcagcaagagtgaaactccgtctcaaaaaaaaaaaaaaaaaaaaaaaaaattgggttgtcttttcattgttgagatgtcttagtctattcaagckgctataacaaaaataccagaaactgggtggcttataaacaatatttatttctcacagttctagaagctgagaagtccaagatgaaggcactggcaaatta

SEQ ID NO: 56386 - DNA, 201 bp, Homo sapiens
atcatctttgtcaagctctccactgtcccggtgcagagaggcatctcaggagacaacactggcaagccccacggcattccttgcaaggtgacagaccactscaactctgtgctggtacacctcatctctacacacagagacaatggtttcatcttgatctctgtgcccaaaaagctgttgatgatggctggcattaaggac

SEQ ID NO: 56387 - DNA, 201 bp, Homo sapiens
tgggattacaggcgtgagccacaacgcccagtgttttgtttttgtttttgttttttaaaggcactccaagccattcgccaacaactcaggctcagataatscacactcctactctgggacttaatttccctttgtaccatgaaagaatagccagatgttaaatttttaaattaataaataattaatttttttttttttttt

SEQ ID NO: 56388 - DNA, 201 bp, Homo sapiens
tctttgtacataaggagccgtggcggggccggagagttgcagctttggggcgatatcagtattcgaagtatctcccccagctcaacaagagcccacacggstccccagaaccacagcctgtgaaaaatcacatttaccgtacacagcgtcaagtagttcgtccaggttgtctctggtttttaaatccccatctttcctaaa

SEQ ID NO: 56389 - DNA, 201 bp, Homo sapiens
gcgcggcggtcaaagcccgacacaaaaggcgcggggccccaccgtccgcgcctccgggagcgctgagcttgaggctgcgaggggcggggcggacgagagtkgcggggctgaggggcggggctttgagggaagcgcgaggggcgtggccggggtgggggcggggcgccgggcgggcacgtggcgcggtgcgctccctcccgg

SEQ ID NO: 56390 - DNA, 201 bp, Homo sapiens
ggcgactgacagctgggccccggcccctgccatcttggcgggcgctgcccgggccggcgtgtgccccggcgcgtgcctgggggccgccgccgggggatggsggggcggggggcgagctggctggggtccgggcggcgggaacgcgtgcgcgtccgcctgagactcggggcggcggcccctggcgagtgcgcgggcggctcc

SEQ ID NO: 56391 - DNA, 201 bp, Homo sapiens
ttcaattttgtaaaaatgtttcacttgtacctgggaatgataaaggaactacaccacaggtttgatgtggttatctgtaaagagcaggatcaatgcttatstgtattgtcttctttatatcataccattctgttttcatactctccttaactgtttcatgaagggaccggccactcttctcaccctcaccccgacatcagc

SEQ ID NO: 56392 - DNA, 201 bp, Homo sapiens
acattctttatatgtgtcagcggatttaatcctgagggaatggcaaagagatcttgttatttttcccatttgataaatgaggaacctgagggacagagagrtaaagtaatttgctcatgatcacatagttcaaaagtggcagagctgatcacactcaaattcaggctgcctgactccagaatctgtactcttaatcactac

SEQ ID NO: 56393 - DNA, 201 bp, Homo sapiens
atcataagctgagaacttctcatgtattctcatttgatcctcacaaaaccctctgaagaaagtgaactgtcctcatttatacttgagaaaaacggaggctyataaaggttacgtaaattgctaaaagtcagctgataagtagtacctctggggcagaatccaggtctgactctaaaacccaggctgctcagtatacagggg

SEQ ID NO: 56394 - DNA, 201 bp, Homo sapiens
aaggcccagggactatagtggaagaggggggtgcgtgagattgtaagggtcgattttgagagataaaataagttcagtttctctataagttaaccattaaygtcataggtacactgatgcaagaccagcatacgggctcctatgtcggattaacaagcttttcttgaagcattagccaactccttaataaaggctataaag

SEQ ID NO: 56395 - DNA, 201 bp, Homo sapiens
ctcaagaaataaagtctttcacgcctcttcatgacatgcaaagtcttatttctccaattctttcttccactaaaactcttcacacaccttcaaattcagtyagacattcacagttcccaaaatctgtcaggacctcccttctcgggcccatggaccagctggatgaggttctttgctgctccctaatgtgagccgctgccc

SEQ ID NO: 56396 - DNA, 201 bp, Homo sapiens
ggggtggagtagggcagataactaacctttactgaatatcataagctgagaacttctcatgtattctcatttgatcctcacaaaaccctctgaagaaagtkaactgtcctcatttatacttgagaaaaacggaggctcataaaggttacgtaaattgctaaaagtcagctgataagtagtacctctggggcagaatccagg

SEQ ID NO: 56397 - DNA, 201 bp, Homo sapiens
tcaatatggaatttatgctcagttctaaaatgcacaaaaattgcatttgaaaaatgagaagctttcagaagtcggaagtgtgtgtgtgtgcgtgcacacamacacacactctcttccatatgttccagagaggtggaaatatgcacaagaagaatctgatgaccctcccattccgcctcctttattttcatttcttagaaa

SEQ ID NO: 56398 - DNA, 201 bp, Homo sapiens
cttatttctccaattctttcttccactaaaactcttcacacaccttcaaattcagttagacattcacagttcccaaaatctgtcaggacctcccttctcgrgcccatggaccagctggatgaggttctttgctgctccctaatgtgagccgctgcccacgtgctgctccctcactgctccctctccgaggggctgagattc

SEQ ID NO: 56399 - DNA, 201 bp, Homo sapiens
ggtggtgcatgcctgtaatcccagcaacttgggaggctgaggcaggagaatcacttgaactcagggggcagagatagtggtgagccaagatcacgccattkcactccagcctgggcagcaagagtgaaactccgtctcaaaaaaaaaaaaaaaaaaaaaaaaaattgggttgtcttttcattgttgagatgtcttagtcta

SEQ ID NO: 56400 - DNA, 201 bp, Homo sapiens
caagaacagtttttatattttattttcacatagaaaatcaatcagatttgcttcagcctcaaagagtgtgtttatgtaaaattaaatgagcactggcagcragctgtactttttctaaacaggaaaagggttaaattaaaataagctagagaaagaaaatgttattaagaaactcacaagagaaaatatatttactattca

SEQ ID NO: 56401 - DNA, 201 bp, Homo sapiens
ccagaagcagaggctgcagtgagggaagactgcgccattgcactccagcctgggcaacaaggatggaactctaagtcaaaaaaaaaaaaaaaaaaaaaaaagaaagaaagaaacaatctgaaaagacttataattaataaagaaattgaagcagtaatcaaaaacctctcaacaaagaaagatgtcttcactggagaattt

SEQ ID NO: 56402 - DNA, 201 bp, Homo sapiens
aaagggggaagggggaaaagagagtagtaatcatacctacctcttggagatattgcaaagattaaatgagataatgtatgttaactggttagaacaatgcctggcatgtaaaaatactcaacaaatgagttatttttactatttatgttaattgagaaatagaattgaagtccccttaccaagttgcacttttgaactcag

SEQ ID NO: 56403 - DNA, 201 bp, Homo sapiens
atcttggggccccaaattcactaagcaaaagggaaaagtcaaactgggaactgcttagggtaaacctgcctaccattctattcaaagtcatccctcagctmactgagataaatgcatacctgatcgcctcctttggaaaggctcatcagaaatgcaaaagaatgcaacagctcatgcttgtaatcccagcactttgggagg

SEQ ID NO: 56404 - DNA, 201 bp, Homo sapiens
ttaaggttattacatccatgtatctttctgtatgtgcttttaaagtccttgtgacactgagttacagggctttgactcctgggtctaaaaaggacaccagrtcctgttaaatgttaaacagtgatagcaattaaagcctcatcttcaggcctggaaggagatgccaatcgaaataaactccattcctgagatgcagggcca

SEQ ID NO: 56405 - DNA, 201 bp, Homo sapiens
tcccaaagttagtttggcctatgctcagcaatgaacaaggacagcttggaggttagaagcaagatggaggcggtcagatcatatctttttcactgtctctmttataattttgcaatggcaagcttcacaactttaaatgatgactgttgtagttttcataagtaatctaggtaaatgattagaataaaataattaggtaaa

SEQ ID NO: 56406 - DNA, 201 bp, Homo sapiens
agatcacgccattgcactccagcctgggcagcaagagtgaaactccgtctcaaaaaaaaaaaaaaaaaaaaaaaaaattgggttgtcttttcattgttgaratgtcttagtctattcaagctgctataacaaaaataccagaaactgggtggcttataaacaatatttatttctcacagttctagaagctgagaagtccaa

SEQ ID NO: 56407 - DNA, 201 bp, Homo sapiens
aaatccacaggaaagttccaaattatggggaacgaggcctctgaagtggctaaatccccctcacccccaacacacacaaaagtgttgtcggtgtggggggkggggggaaatggccagcaaaaggggaaaaaaaaaaggaaagattttttgacttaaagggctttatttacgtcacacggccacctttttgctagccatgcc

SEQ ID NO: 56408 - DNA, 201 bp, Homo sapiens
ggggttcacattctggtaaccacgaaaggattctgagtgaaggtgcccctaacctttgacaaatctcctactggtgcttgtaccagcttgagctatctttwtggctcaaaccaacaggacaatttgctgaggcctggaagcacccctccagagaatctctgatttcccaaaatctggatgagatttaaagtttattttgct

SEQ ID NO: 56409 - DNA, 201 bp, Homo sapiens
gtctgataagaaacattttacaacgtgctctctctaaagtctgagagtttcctctgcacaataaaacttggtctccacaatcctttatcttaacctgaacrttcctttccgttaatcccaggtcttcagataaacttaaccaatttccaaccagaaaatgtttaaatttacctacagcctggaagcccctgctttgagttg

SEQ ID NO: 56410 - DNA, 201 bp, Homo sapiens
cctgggcgacagaacgaaactctgtctcaaaaaaaaaaaaaaaaaaagattaacaaccagctggttttatttgctccttaccattaaagcattcagtaatygtataagttgtgccatcgtttgttttgcttgactgttttgtctttgtttctgtttttgttgttgttttggtctttttcccattgggtttcatcaactcta

SEQ ID NO: 56411 - DNA, 201 bp, Homo sapiens
gtagcatgaatctccagaattgaatattgactcaaactgttcctgaaaatgcaaaaatcagggacttttactgatagtaactgtggactaatcagaacaakcagaacaatcctccatctaaaaagaactagaaacgctgggaaaaatgtaagaaatacctgcttggaggcacgggggaggaaagcaagtcagagcctgaga

SEQ ID NO: 56412 - DNA, 201 bp, Homo sapiens
tgactgccctacaccagcagttctcaactggggatgattctgggccccaggaacatttggcaacgtctggagatacttttagcagtggcgactgggaaatraggttgggtgttgcttctagcatccaatgggtagaagccagagatgttgctaaacatcctactatgtacaggtagtcctccacaacaaagtattatctgt

SEQ ID NO: 56413 - DNA, 201 bp, Homo sapiens
ccactgtcccggtgcagagaggcatctcaggagacaacactggcaagccccacggcattccttgcaaggtgacagaccactgcaactctgtgctggtacabctcatctctacacacagagacaatggtttcatcttgatctctgtgcccaaaaagctgttgatgatggctggcattaaggactgccacacctcagtcaggg

SEQ ID NO: 56414 - DNA, 201 bp, Homo sapiens
accacaatcaatggtagctaatattatcaaatatgcctcaaaaacccatcgagttgccctcctgaccaaaaccagtctcaactgatctctaaaactcctgrattcctatcacaatcaataaccatttttaaaatgttcacacattgtcttatgctgaacaactcagttcattacgtgtcttgggaccctagtcaaagagag

SEQ ID NO: 56415 - DNA, 201 bp, Homo sapiens
atagtcaaggacatgaagattaagtccctgaagctctatctcctctccctgcccatcaaggaggctgagatcatcgactttttcctgggggcaaccctcamgaatgagtttaagattatgccagtaaaaatggagacttgcactggccagtggtccagattcaaggcacttgttgccattggggactaaaatatccatgtc

SEQ ID NO: 56416 - DNA, 201 bp, Homo sapiens
ccccggcccctgccatcttggcgggcgctgcccgggccggcgtgtgccccggcgcgtgcctgggggccgccgccgggggatgggggggcggggggcgagcyggctggggtccgggcggcgggaacgcgtgcgcgtccgcctgagactcggggcggcggcccctggcgagtgcgcgggcggctccgagtcctcgagggagag

SEQ ID NO: 56417 - DNA, 201 bp, Homo sapiens
tggcagatgagtgagcattactgcctgcagtctgcctcctgtcagatgagctgaagtattagattctcatagaagcgtgaaccctattgtgaactgtgcaygcaagggatccagattgtgcactccttatgagaagctaatccctgatgatctgaggtggaacagttttatctggaaactacccccctaaccccccaagga

SEQ ID NO: 56418 - DNA, 201 bp, Homo sapiens
agaatatttgaaaccagaactgtcccatatcctcatggaagataaaccctagaaaataaatacagggtggtgaggctggggtggggtggagtagggcagawaactaacctttactgaatatcataagctgagaacttctcatgtattctcatttgatcctcacaaaaccctctgaagaaagtgaactgtcctcatttatac

SEQ ID NO: 56419 - DNA, 201 bp, Homo sapiens
ttcagacactagaacaggcactgaatgaaccaaaccttgagaaccactgtgttacacgcaagaacatgagggtttcagagatttcattaatatggtaagtkacctaagaaaagagtcagtctgatctcctcactttgagcaaagaaacagaaaaacgcagcaccttgcctagggtcacacaatcacagtcagagatggaat

SEQ ID NO: 56420 - DNA, 201 bp, Homo sapiens
gaggaagtgatgtttcaaataagatttgaaggctaagaagttagcaaggtaaagaggaaaaggaagcagctagactgagatcaacttgcatgatttagcawcagatcttttcttatttaagaattctttgagagagaagggagaagagaagataagtgcaataaacacagctccacaaaagcagcagagcagcaggcagga

SEQ ID NO: 56421 - DNA, 201 bp, Homo sapiens
caggaaagttccaaattatggggaacgaggcctctgaagtggctaaatccccctcacccccaacacacacaaaagtgttgtcggtgtgggggggggggggraatggccagcaaaaggggaaaaaaaaaaggaaagattttttgacttaaagggctttatttacgtcacacggccacctttttgctagccatgccaaaccaa

SEQ ID NO: 56422 - DNA, 201 bp, Homo sapiens
aaacagttacagaagaggaaatatgggatatcacaaaggtaattaacaggaaagggccctcagctaggctaagggtcaaaggctgcctccctgaggaagtratgtttcaaataagatttgaaggctaagaagttagcaaggtaaagaggaaaaggaagcagctagactgagatcaacttgcatgatttagcaacagatctt

SEQ ID NO: 56423 - DNA, 201 bp, Homo sapiens
ttgtttgtttacttgagatagagtctcgctcctgtcacacaggttggagtgcagtggtgcaatctcggctcactgcaacctccacctcccgggttcaagtkattctccttcctcagtctcccaagtagctgggattacaggcgtgtgccaccatgccaggctaagttttgtatttttaatagagacagggttttgccatgt

SEQ ID NO: 56424 - DNA, 201 bp, Homo sapiens
tgactctggcataacaaggaagaaaatcaaaatgttttacctcaaaatatatttccttgccataccttgaaattgccctgcaaagtctcttgtgggaaaawtctgcattctatagagaaccccctcttttccctttgtttttcttccttcctttccagatccaggagacaatcaactaagagccaggcacccttttaagtc

SEQ ID NO: 56425 - DNA, 201 bp, Homo sapiens
tacgtgtcttgggaccctagtcaaagagagtccctggggatggaactagaatggctagaaggtgaggcctgaggggtttaactccccacaacctcaaagasagtccctggggatggaactagaatggctagaaggtgaggcctgaggggtttaactccccacaacctccatcagacaagaaatacacacacaatctaagta

SEQ ID NO: 56426 - DNA, 201 bp, Homo sapiens
tgaatatcataagctgagaacttctcatgtattctcatttgatcctcacaaaaccctctgaagaaagtgaactgtcctcatttatacttgagaaaaacggrggctcataaaggttacgtaaattgctaaaagtcagctgataagtagtacctctggggcagaatccaggtctgactctaaaacccaggctgctcagtatac

SEQ ID NO: 56427 - DNA, 201 bp, Homo sapiens
gcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttggggat

SEQ ID NO: 56428 - DNA, 201 bp, Homo sapiens
accctgataggtctgtcctctcttcacccattcctcaaaacactgacttcagacctatctccatttcacaacaactctactcccacggccctccccatacytttcttgtcctaatcttttcctctcccagaatcaaaatcattcatcttggtcaatggacactaagcatatactgcatgcccagctgtggcataagacacc

SEQ ID NO: 56429 - DNA, 201 bp, Homo sapiens
agcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttgggga

SEQ ID NO: 56430 - DNA, 201 bp, Homo sapiens
gtcatttgagatcttgataaggcaggaattttaagtcttcatccaggccatataattagattatccttaagagcaacttactatccacgtgaccaagagamtatagataaacacccacaagtacaggaatgcagggctgacagagtatcatagtcaatttagtcaaaactttactcttgggcaatagtctaagccatccaa

SEQ ID NO: 56431 - DNA, 201 bp, Homo sapiens
aagcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttgggg

SEQ ID NO: 56432 - DNA, 201 bp, Homo sapiens
tcatgctcactgcagaattattcacaatagccaggagtggaagcaacccaaattccactgacgaatgaatgaatgtttaaaaagtagcatctctctctctmtatatatatagagtataatattttgcagcctttaaaaaagggtatctgatcacatgctacaacatggatgaacctcaaggacattatgctaagtgaaatt

SEQ ID NO: 56433 - DNA, 201 bp, Homo sapiens
taacaacaacaaaagaaattatccctttgcactttgtgtcatttgagatcttgataaggcaggaattttaagtcttcatccaggccatataattagattayccttaagagcaacttactatccacgtgaccaagagaatatagataaacacccacaagtacaggaatgcagggctgacagagtatcatagtcaatttagtc

SEQ ID NO: 56434 - DNA, 201 bp, Homo sapiens
caagcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttggg

SEQ ID NO: 56435 - DNA, 201 bp, Homo sapiens
agcattaatctgataccaaaaccagacaaagacaaaataagaaaactacaaaccaatatctgatgaataccgatgaaggagtccttaacaaaatactaacraactgaattcaacaacacattaaaaggattaaacgaccgggcgcggtggctcacgcctgtaatcctagcactttgggaggccaaggtgggcagatcacga

SEQ ID NO: 56436 - DNA, 201 bp, Homo sapiens
aggtacaaggacaaattgattaagaccttcccacggattgctaatgccacactgggatttgttaggtgactgactacatttgaaaatgcagttattttttwaaagatatattcatactaccatgaaaaaaatgggcatttgattattttctaagcctccttctcaagccattcaactctttcttggaccctaaagcaaata

SEQ ID NO: 56437 - DNA, 201 bp, Homo sapiens
ccaagcacagaaagacaaacttcacatgttctcactcatttctgggagctaaaaattaaaacaattgaacttgtgagaagaatgagagctaaaaattaaatttaagttaaaaattagaataggggctaaaaattgaaacaatcgaacttgtgagtagaatagagagtagaatgatggttaccagaggctgggaagggttgg

SEQ ID NO: 56438 - DNA, 201 bp, Homo sapiens
gtggagatgaaacagaaggagccacaaatggaagtcagctatgatcatgactaaaaatactattcttttctcatggcccaatcaaggatctttccaatggscagggggctgagcggtaataagaggaattcaacagtgtcttcagaggcccatttctccctggtttcacttctacaaccctaattaagacccttctagcct

SEQ ID NO: 56439 - DNA, 201 bp, Homo sapiens
caacatacaaccatggtatttaaattaataggtacaaggacaaattgattaagaccttcccacggattgctaatgccacactgggatttgttaggtgactkactacatttgaaaatgcagttattttttaaaagatatattcatactaccatgaaaaaaatgggcatttgattattttctaagcctccttctcaagccatt

SEQ ID NO: 56440 - DNA, 201 bp, Homo sapiens
aggctcagataatgcacactcctactctgggacttaatttccctttgtaccatgaaagaatagccagatgttaaatttttaaattaataaataattaattwtttttttttttttttgagacagagtcttactctgtcacgcaggctggagcgcagtggtgcaatctcagctcactgcaacctctgcctcccaggttcatgt

SEQ ID NO: 56441 - DNA, 201 bp, Homo sapiens
tgggaactggattagtctagagaaagaagtcgaacccagggcacgcctgggatcctgggtaaagcatgtaacacatcccaccccctaccagaactgtgcasgttggggagagaggagagaaggctgaaaggaatgagaatgcaacctgttccgctgtgatctgcctaattacctcatcttcctctggctgctgctgctata

SEQ ID NO: 56442 - DNA, 201 bp, Homo sapiens
agctaacaggggaggcagctagaaaaccatgtgatcattccagcaagtctgattaatgcagtgtatgcttaggctccaggctgggaactggattagtctakagaaagaagtcgaacccagggcacgcctgggatcctgggtaaagcatgtaacacatcccaccccctaccagaactgtgcaggttggggagagaggagaga

SEQ ID NO: 56443 - DNA, 201 bp, Homo sapiens
gtggttttaatagcagattatatacagcagaggaggggtgatggagagagacagacagtgagaaggagataaccagaataaagaagagagagagaaacatstaaaatgcagagaaacagttaagagacatagaagatatagtgaaatggaataacatgggggtcctcaacccctggacatgaactagtatcggtccatggc

SEQ ID NO: 56444 - DNA, 201 bp, Homo sapiens
tgtgcctgtagctgcagctacttgggaggctaaggtgggagtttaaggctgtagtgagtcatgactgagccactgcactctagcctgagcaaaggaatgaractctgaaaaataataaaaataaaaaacaaaaaagaaatttaaaaataatttttaaaaaccctgaaattaaaaactcaatgggtggttttaatagcagat

SEQ ID NO: 56445 - DNA, 201 bp, Homo sapiens
gtggcggatgtctgtaatcccagctactcgggaggctgaggcaggagaatcacttgaacctgggagatggaggttgcagtgagctgagatcgcaccactgygctccagcccaggcaacagagtgagactccatctaaaaaataaaaataaaaaataaattaaatttctattcaggaggactggttagagcataatttttat

SEQ ID NO: 56446 - DNA, 201 bp, Homo sapiens
aaatacacacacaatctaagtaataacagcatgcttggtatgcaaatacagcttcaaaaggaagccattacaattctgggccactatcctcaaattatccyattttgaaattgtggggagtccactagcactgaccttggttttagtcctaatctttcacaaggcacagcaattcttagtcatacattgtaagtcttagag

SEQ ID NO: 56447 - DNA, 201 bp, Homo sapiens
agagtttttaacgcaacagaaaggaagttgttattagtttgaagtagattgttataactttaagatgttttatgtaattgtaatggtaatcacaagtaaawtatctatagaatacatacaatgggaaatgataagggaatcaaaatatgtcactacaaaaaaaatcaataaaacacaaaagcagcaacaagagaagaaatg

SEQ ID NO: 56448 - DNA, 201 bp, Homo sapiens
aaatttctattcaggaggactggttagagcataatttttatcaaataaataaggaaatcaagacaggagaaaggaaccatggaaaggagataaaagtaccygccccccaaatcttttgttttaatgacctgagctaaactgctatttttttcaattaattatttattaagaggagttaaagacttattcttaaagttatct

SEQ ID NO: 56449 - DNA, 201 bp, Homo sapiens
ttttagcagtggcgactgggaaatgaggttgggtgttgcttctagcatccaatgggtagaagccagagatgttgctaaacatcctactatgtacaggtagycctccacaacaaagtattatctgtcaatagtgctgaggttgaggaactctgccctacacctaatagtgggagggcagaaccaggaaagctgtccgtgctt

SEQ ID NO: 56450 - DNA, 201 bp, Homo sapiens
tcctactatgtacaggtagtcctccacaacaaagtattatctgtcaatagtgctgaggttgaggaactctgccctacacctaatagtgggagggcagaacyaggaaagctgtccgtgcttttctttctttctctttctctctctgtctctgtctgtctctccctctctctctctctctctcctctctctctgaaagtatct

SEQ ID NO: 56451 - DNA, 201 bp, Homo sapiens
gagccaagatcgcaccactgcacttcagcctgggcgacagaacgaaactctgtctcaaaaaaaaaaaaaaaaaaagattaacaaccagctggttttatttkctccttaccattaaagcattcagtaatcgtataagttgtgccatcgtttgttttgcttgactgttttgtctttgtttctgtttttgttgttgttttggtc

SEQ ID NO: 56452 - DNA, 201 bp, Homo sapiens
attcagttagacattcacagttcccaaaatctgtcaggacctcccttctcgggcccatggaccagctggatgaggttctttgctgctccctaatgtgagcygctgcccacgtgctgctccctcactgctccctctccgaggggctgagattcccacagggcagcgcactgctctctcttcttggctgccacctgcgtggca

SEQ ID NO: 56453 - DNA, 201 bp, Homo sapiens
aggccaaggccaaggccaaggagtaggtccccatcatcaaactgggcagcatagtcaaggacatgaagattaagtccctgaagctctatctcctctccctrcccatcaaggaggctgagatcatcgactttttcctgggggcaaccctcacgaatgagtttaagattatgccagtaaaaatggagacttgcactggccagt

SEQ ID NO: 56454 - DNA, 201 bp, Homo sapiens
gctcataaatgtaggggtagtaagtccagttgtagacatgctgaattgcacgtacttatgctctatctccttggaactaggctacatgtgtagaaaaccargtcttcaattcatagtccagaaatctgcacagtgaactcaataaatatttgtgcaattattaccatatgtgcacttcacagtcatgctgcctcatcaccc

SEQ ID NO: 56455 - DNA, 201 bp, Homo sapiens
tactcaagtctcaacaaaagataataaggtatacaaagaaacagggaaacatggcccaatcaaaaccacaagttaaatctccagaaactaaccctaaatasatttatatgaattaccaaagaattcaaaatagccactgtaaggatgctcaatgaactaaaagacaacacagatagaaaactaaagaaatcaggaaaacaa

SEQ ID NO: 56456 - DNA, 201 bp, Homo sapiens
ctacaaactgtcacactcaccctagttaatctggattcacttcctctttctagtgtcattcctaagaataccctccctagccccagcggtactaccatggyagaacactcatctgcagttactggacatgtgagctgcccgggacttctccggagaaacaaacatggagacgctgatacaaacacaaacatgaacaggaaa

SEQ ID NO: 56457 - DNA, 201 bp, Homo sapiens
aggcatgagccactgtgcccagccaataattgtcttatttttaaaaataacacttccatggaaccctaatacatacaactgatcaaagtagaatagttccrgctgaagaaggtggaggggccctagagtccctgctgcaaggccttccctctctctaccaggacaggctcaacctgaacacactggcctaaatgactctgg

SEQ ID NO: 56458 - DNA, 201 bp, Homo sapiens
aagaatgagatctgagaatgctcttatgctactgtagactcaaaaattaaatgttctggccaggcacggtggctcatgcctataatcccagcactttgggrggccgaggtgggcgaatcacgaggtcaggagtctgagaccagcctggccaacacagggaaaccccgtctctactaaaaatacaaaatattagccgcgcgt

SEQ ID NO: 56459 - DNA, 201 bp, Homo sapiens
agccagcagaaaagttcatggcatatactttccacagcctctccccagcacagcatagcaccattggaaaaaaaaaaaaaatcccaaatcccttctttctkggatgaaaagataaaagtagagcacacattcaatgttctcactttgatggggtggtgggggaggggggaagctacctgagggactggtttcttaactgaa

SEQ ID NO: 56460 - DNA, 201 bp, Homo sapiens
cgtaaccagacctgttgacaggctggactggccatgcctcacatgtacaaggctggccccgggggaggcaggtaactttctgagaattagaggtgattctmactcatgtaggcattaccagccacaaccatgcaccccgggatgttgggatccagatgcctgcacggccgtccaacccagaaaatgttgctgttatctcta

SEQ ID NO: 56461 - DNA, 201 bp, Homo sapiens
gcagaggcggtaggacactgacccttttgggctattttatgtagctggccaggtgaatccccaaatttcatggccaagcaagagacctgccagggctaaamaaaagtgcctcaactgttccaggaagtgagaggtagacacctcagctgacatggcattggggtccaaatgggaaccaagtctgcttcaaaggctagaaat

SEQ ID NO: 56462 - DNA, 201 bp, Homo sapiens
gagagcacaggaagatgatggaatagaaaacaccagatcctccttcccctatggagatgaattaacaatgttagatggcctctgtgagaaatccagaaacyagttaagaggtttctgtaccccaagtatgccaagaagaacctcatgaaagccagcagaaaagttcatggcatatactttccacagcctctccccagcaca

SEQ ID NO: 56463 - DNA, 201 bp, Homo sapiens
agatcttgttatttttcccatttgataaatgaggaacctgagggacagagaggtaaagtaatttgctcatgatcacatagttcaaaagtggcagagctgaycacactcaaattcaggctgcctgactccagaatctgtactcttaatcactacagaataagttaaaaccaaaagggcacaaatatatttattcctatgtga

SEQ ID NO: 56464 - DNA, 201 bp, Homo sapiens
tttgttgttgttttggtctttttcccattgggtttcatcaactctatccgacctgatcaaatccacaggaaagttccaaattatggggaacgaggcctctraagtggctaaatccccctcacccccaacacacacaaaagtgttgtcggtgtgggggggggggggaaatggccagcaaaaggggaaaaaaaaaaggaaaga

SEQ ID NO: 56465 - DNA, 201 bp, Homo sapiens
aagtaacttgtccagggtcatacagctataagtagcagagtaatgacatggattccggctgagctaactccaacatgctctcctggtgtccttacaccaaygatccaaccagctcaggctgcctccagaagaggacttatttgatagactgtcaggcagcctgtggccctgcagaggcggtaggacactgacccttttggg

SEQ ID NO: 56466 - DNA, 201 bp, Homo sapiens
tcatcagaaatgcaaaagaatgcaacagctcatgcttgtaatcccagcactttgggaggccgaggtgggcggatcacgaggtcaggagatcgggaccattytggctaaaacggtgaaaccccgtctttactaaaaatacaagaaatgagccgggcatgatggcacgcgcttgtagtcccagctgctcgggaggctgaggca

SEQ ID NO: 56467 - DNA, 201 bp, Homo sapiens
atgaagagactaccactccttggaagtatcctgtctgctcaatgggtggctcatttaattttgtggggacctctagactctgtgcctgctctccaccagtkactcaagactctccttttgcaggtataaccagcacctttcagggcaattcataaggtcctggtagaggacagttggtagaaatggtgaaaaatcaaatcc

SEQ ID NO: 56468 - DNA, 201 bp, Homo sapiens
acccaggaggcggaagttgcagtgagcagagatcgcgccactgcactccagcctgggtgacagagcgagactccgtctcaaaaaaaaaaaaaaaaaaaaaraaagaatgcaacagtttgtctcttatctacctatgacctggaagctccatccttgcttgagttgtcctgcctttctggacaaaatcaatgtacatcttac

SEQ ID NO: 56469 - DNA, 201 bp, Homo sapiens
tgagccgctgcccacgtgctgctccctcactgctccctctccgaggggctgagattcccacagggcagcgcactgctctctcttcttggctgccacctgcrtggcatccaacattgtgtttgcctctcctgcaaatctaagagttccttgaggacaggaatgtgtgaagttaatttctgtattcccaatgcctgacatagc

SEQ ID NO: 56470 - DNA, 201 bp, Homo sapiens
tttacattagccatacaagaaatgccaaaggagttacacttaggcaaacaattatttttgcaagtgattaaaaaaaggaatgcgtaataaagatgggaaaygacacaaactgaaggtctacatcatgtaataacagagtatctaaaatttctgagttatgacattttgagcagtccagtcagtaccgtgactctcaagctt

SEQ ID NO: 56471 - DNA, 201 bp, Homo sapiens
gggaggctgaggcagaagaatcgcttgaacccagaagcagaggctgcagtgagggaagactgcgccattgcactccagcctgggcaacaaggatggaactytaagtcaaaaaaaaaaaaaaaaaaaaaaaagaaagaaagaaacaatctgaaaagacttataattaataaagaaattgaagcagtaatcaaaaacctctca

SEQ ID NO: 56472 - DNA, 201 bp, Homo sapiens
acagtagaaatttcagagaagcaaatactagctgagtataagaagaaggaagaaataactagggctagtttagtaattcaataaattgcctcataatccayggactgacttactactacaagtataaaagcaggagctgggtgaacgcctgccacagataacagctatgattacattcattcatttaacagatatttactg

SEQ ID NO: 56473 - DNA, 201 bp, Homo sapiens
cttatgcctgtaataccagcaatttcagaggtccaggtgggtggatcacctgaggtcaggagttcgagaccagcctggccaacatggtgcaactcagtctytactaaaaatacaaaaaaattagccgggtgtggtgacgcacacctgtgattccagctactcgggaggctgagacaggagaatcgcttgaaactgggaggt

SEQ ID NO: 56474 - DNA, 201 bp, Homo sapiens
gacggtacctactaccatccaaggagtcatcatctttgtcaagctctccactgtcccggtgcagagaggcatctcaggagacaacactggcaagccccacrgcattccttgcaaggtgacagaccactgcaactctgtgctggtacacctcatctctacacacagagacaatggtttcatcttgatctctgtgcccaaaaa

SEQ ID NO: 56475 - DNA, 201 bp, Homo sapiens
ctcaatgaaaatatgaaaatacatagagtctgttagaaaaagagaaacaagaattcaggcagtagtctagaaaataaagaaaaactgagacttagacttcwttatttgaataagtcgattcaatagtacttttttgctaaaataagtggacatgtgcctcgagtgtttagctcacttgttagaatgcatctccagcgttat

SEQ ID NO: 56476 - DNA, 201 bp, Homo sapiens
taggaggaaaagtgaacagaacaggtttgtcttcacaagaactgcagctcagcttagagatatttcaatccctgaaactgtactgaaggcaacgccaattstaagtgctcccatgtgccttataacagcagatattaattatctctggaagaaaaaagcatcatcttaggcctcaaattattcctacaaataattttgcaa

SEQ ID NO: 56477 - DNA, 201 bp, Homo sapiens
ttaatcaattattttctttcacttctttttctctattcactcccgtcatacctgtttattcagtttttgaatctcttgacctggttctgtaatagtcgtayctctgttcttacccctattctttgccttttggtcaactttcatcaagttttcctcaactatatcttccaaactttgtattgagtttttcatttttgccat

SEQ ID NO: 56478 - DNA, 201 bp, Homo sapiens
ccagcatgggcaatagagtgagactccgtctcaaaaaaaaaaaaaaaagaaaaagaaagaaaagaaaaggctatcctatgacctcacatgttaaagataarggattgtgtttttatatttttgtattctgtaatggtcatggtagatgctttacgttactccttgtctagtctcagcgcaagttgaaccaaacttaaagac

SEQ ID NO: 56479 - DNA, 201 bp, Homo sapiens
caggctaagtggaaagtgcttttacaattctcttttatcaccatacccgggttttgataaacttagtattctccttagtaaaagttttcatcagatacttsctcttttttatcttgtgataacttttcttcactcaaatcaatagggaaatacagtatttgctgtataaaaacatagaagcctaccttagagctgaattca

SEQ ID NO: 56480 - DNA, 201 bp, Homo sapiens
gttgttgtaaggagttaagaatttacatattagaacacctggcacatattaagcattcaaaaaatgtgagttattttctattttaatgctgttattttgtraataaggaaattgaagcctggtaaaaggtcactttctcaagttttacttgaattagctaccaaatgatatatgttgtttgtatgataataaataaggtga

SEQ ID NO: 56481 - DNA, 201 bp, Homo sapiens
actaatagagactgagtaggtgaaaaagagggaagactggatagaacttattgggatttgtgtcatttgctgaaggatgtttagagttgataaccagttcragaggcaattaattccagggggctaacatgcaaggcaccagctaagaaaaagaatcgttccaaaaacttaagcacagagactatgtcaagaaactgaaat

SEQ ID NO: 56482 - DNA, 201 bp, Homo sapiens
cagagtctcactctgctccacaggctggagtgcaatggtgcaatctcagctcactgcaacctccgccttctgggttctagcaattctcctgccttagccayctgattagctgggattacaggcacctgctaccaagtccggctaatttttgtatttttagtagagacggggtttcatcatgttggccaggctggtcaaaac

SEQ ID NO: 56483 - DNA, 201 bp, Homo sapiens
tgccttagccacctgattagctgggattacaggcacctgctaccaagtccggctaatttttgtatttttagtagagacggggtttcatcatgttggccagrctggtcaaaacttctgacctcaggtgatctaccagtctcagcctcccaaagtgctgggattacaggcgtgagccacgatgcctggctcttttttttcttt

SEQ ID NO: 56484 - DNA, 201 bp, Homo sapiens
ccagtctcagcctcccaaagtgctgggattacaggcgtgagccacgatgcctggctcttttttttctttttaaaaaaattattttatctaccactaagagrgagaaagaaattctttcttagtaaagagagttgaaagtttaagtgcaccaaagcaatagtttgcttagtttaacaattctcaaactgtactccttggatc

SEQ ID NO: 56485 - DNA, 201 bp, Homo sapiens
ggcaccaaaggtaaaggcccatctacgtgctcttgaaatcaggacccagatgataagggagactacccagggctgtcatgatcatatcttcaccagtatayttcactagtatgcaggggaggagcaagggccagcagcttaggtaaaaacccaggtctaccagggagcaattagaaacagttaagtattaagtgtcaaatg

SEQ ID NO: 56486 - DNA, 201 bp, Homo sapiens
tgtataactgaaaacccaaaagaagataaacaaaacaatggaacagaattaacacttaaataagaaaactttccaaaaattaaagcagacctttacctttrtatttataggacctacttttgattcagattggtcaactctaagacatattttagtaaaactattgtattctaagaaaatttcttctaaacttctggcaaa

SEQ ID NO: 56487 - DNA, 201 bp, Homo sapiens
ccttaacatttaggtcaaatgccaggaaaccagcttcttggaacaaaactacctgagcagaagtggcaagtcctttttttcttctggctgggatgagaatrcaggggggagggagggtgatagaatgagtctttttcttgcagttgtgattccaaagaatccctatcctgcctccgatgtgaatactgagaagcccagcat

SEQ ID NO: 56488 - DNA, 201 bp, Homo sapiens
caagaagaagacagaagcaatgactgagcactgaggtgctctacatttagagattaggatttcctcttacccacctgtccttttccttatagacagcctargtcgttgcctaatttgaatagagcctcaaattactgttttcatcttccttcttttctctctttcacaagtttatgactccaacccttcttacctagagac

SEQ ID NO: 56489 - DNA, 201 bp, Homo sapiens
taaaaaattatttttaattgtaggtatgtaattgttatacatatttatggggtacatgtgatattttgatacaggcatacagtgtgtaaggattaaatcarggttattgggatatcaatcacctcaagcatttatcttttttttttttggtttagaatcaaaggagaatatccacaattacctgaaaaggttatttcagta

SEQ ID NO: 56490 - DNA, 201 bp, Homo sapiens
agtgttttgtaattatcttcatatggatttttcatatttcctgttaactttgttcctgagtatttctgcctctgttacattatctaactgatttgctatayatgaaggctgttgagttttgtatgtcagttacgtattctgttaccttgctcaattctttcactgtttgagctagcttcatcactgattttatagggatgc

SEQ ID NO: 56491 - DNA, 201 bp, Homo sapiens
tatcttcatatggatttttcatatttcctgttaactttgttcctgagtatttctgcctctgttacattatctaactgatttgctatacatgaaggctgttragttttgtatgtcagttacgtattctgttaccttgctcaattctttcactgtttgagctagcttcatcactgattttatagggatgcactgtccaataga

SEQ ID NO: 56492 - DNA, 201 bp, Homo sapiens
gttagaataagttagagggagagagactggttagttcaccatttcagtgattaagacaagggattttgaggatgtatattaaagttgaggcagtggtattkgagtggaagaaatgaatttgattagctagctgtggtggcacatgcctgtagtcccaactacttgggagactgaggcaggaggattgcttgagcccaggag

SEQ ID NO: 56493 - DNA, 201 bp, Homo sapiens
cacctagactagagtgcagtgacaccatcatggttcagtgcagccatgacttccagggcttaagtaatcctcccacctcagcctccagagtcactgggacyacaggtgtgcaccaccatgcccagctaattttttaaaaaatttttgtagagactgggtcatgctatgttgcaaggctggtttcaaactcctggcctcaag

SEQ ID NO: 56494 - DNA, 201 bp, Homo sapiens
ttattagttttctttcggttagtgtttatagagtacattattttcatctgtttgcttttctcttcctgtgtttttatattttgagtgtctttgtatctcarggccctcttataaacaaatataattgagttctgggggttttttttggtctggtttgttcatttattcctactgactgttttacttaatccacccttcttt

SEQ ID NO: 56495 - DNA, 201 bp, Homo sapiens
accccgtctctagaaaaaatttaaaaattagctaagagtggtggcacgtgcctgtagtcgcagctacttgggagaccgaggtggaagaatcgcttaagccsaggagattgaggctgcagggagctgtgtttgcaccattgcacaccagcctgggtgacagagcaagaccctgattctagaaataaataaataaaatgcatt

SEQ ID NO: 56496 - DNA, 201 bp, Homo sapiens
tgcctagaaaaaaagttagtaaaaaagcatgagatatttatagaggaaatttttaaatgtatgttgaagaaatctgcattaaagaaatcttggccaggcayggtggctcatgcctgtaatcccagcactttttgggaggccaaggcatacggatcacttgaggtcaggagttcgagaccagcttgggcaacatggtaaaac

SEQ ID NO: 56497 - DNA, 201 bp, Homo sapiens
ggcaacatggtaaaaccccatctctacaaaaaataacaaaaattagcagagtgtggtggtgtgtgcctgtaatcccagctacttgggaggctgaggtaggmggatcacttgaccctgggaggcagaggttgcagtgagccaggattacaccactgcactccagcctgggtgacagaaccagaccctttctccaaaaaagaa

SEQ ID NO: 56498 - DNA, 201 bp, Homo sapiens; identical to SEQ ID NO: 37934

SEQ ID NO: 56499 - DNA, 201 bp, Homo sapiens
gtaatcccagctacttgggaggctgaggtaggaggatcacttgaccctgggaggcagaggttgcagtgagccaggattacaccactgcactccagcctggktgacagaaccagaccctttctccaaaaaagaaagagagagagagagagagagagagagagaaaggaaatcttaacaagtggaaaagactatcatgtttat

SEQ ID NO: 56500 - DNA, 201 bp, Homo sapiens
ggtgttcctttttttgttattgtaaacaatgccaaggctttttacataaaacctttttcttgtattttggagtatttttccttagcatagaatctcggaartggattactttattaaaaactgttaatacatactgccaaattggaaaagtatttaatcttatactttctttccacatgactatttttctctccctctgca

SEQ ID NO: 56501 - DNA, 201 bp, Homo sapiens
gaggtaggaggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatat

SEQ ID NO: 56502 - DNA, 201 bp, Homo sapiens
aggtaggaggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatata

SEQ ID NO: 56503 - DNA, 201 bp, Homo sapiens
ggtaggaggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataa

SEQ ID NO: 56504 - DNA, 201 bp, Homo sapiens
ggaggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataataaa

SEQ ID NO: 56505 - DNA, 201 bp, Homo sapiens
aggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataataaagg

SEQ ID NO: 56506 - DNA, 201 bp, Homo sapiens
ggatcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataataaaggt

SEQ ID NO: 56507 - DNA, 201 bp, Homo sapiens
ttccctttaaaaaggactatactggctgggtgcagtgggtcacgcttgtaatcccagcactttgggaggccaaggcaggcggatcacggggtcaggagttygagaccagcctgaccaatatggtgaaaccctgtctgtactaaaaatacaaaaatgagctgggcgtggtggcaggtgcctgtagtcccagctacttgggag

SEQ ID NO: 56508 - DNA, 201 bp, Homo sapiens
ttatttctgaaggatattttcactgggtgtataattctatctttggtagtctgtttcttttagccctttaaggatactattctacttcttcttgcttacamagttttattaaagagcctgctatcactcttattgttgctccggtaatgctgtttttctctctgactgctttttaaaatatatctttgtatttcctccctg

SEQ ID NO: 56509 - DNA, 201 bp, Homo sapiens
ccccttatagttttaaaatatctttaagaggagatcagccatgtatttggggtatactacctacttctagtggaaccttatctcctaaaaccacaagattrtaggagattttattctgccttttaaaagctctcagtctagctttgaagttccaatgtgctggcccaaaattcagcagatacccaatgagaaaaactggcc

SEQ ID NO: 56510 - DNA, 201 bp, Homo sapiens
gtatactacctacttctagtggaaccttatctcctaaaaccacaagattataggagattttattctgccttttaaaagctctcagtctagctttgaagttycaatgtgctggcccaaaattcagcagatacccaatgagaaaaactggccacatgcaggggctccttaagtttccagtttgtcgcagcagctctcatttct

SEQ ID NO: 56511 - DNA, 201 bp, Homo sapiens
gtccctcccctgctcaaaaccctctagtggcttccctttatatttagaataagttcagttcattttcacaggctgcagtcctacacaattttactgctackcactctctaacctaatttctctctaccctcccctttgctcactcagttacagctctactgacctcctttccaatttctcaaacacactaacatgttcctg

SEQ ID NO: 56512 - DNA, 201 bp, Homo sapiens
taaaactcaacattttgaattttttgtaaaatgtcttatcttgaactcctcaagtttttgaggacttagaacctcctcacgtaattcatttcatatttagacatatttattggtcaaaaatttgctctttttgtaatttctgttagtcatccctctgactttctggccatatgaaacagggttagcctatttttcacttac

SEQ ID NO: 56513 - DNA, 201 bp, Homo sapiens
cattgtgcctttacctctttcgggagctctgtgtaaatgtcatctcctcaaagaggacttcccttaaaattttgtttccttaccctgcattaattttaatyacagcacttagcactacctgacattataccgtatattgtgttatttttttaattttctttctctctcactaggaggtaagctccatgagagtggaagtct

SEQ ID NO: 56514 - DNA, 201 bp, Homo sapiens
gctctttttgtaatttctgttagtcatccctctgactttctggccatatgaaacagggttagcctatttttcacttactggccctgatttttagagagaarctctagggactgccttctcattgccactctgccgctttcatagttgaatctcacacctagattattaaaacagcttcctaactagtcttttttgcctcca

SEQ ID NO: 56515 - DNA, 201 bp, Homo sapiens
gtgtaaatgtcatctcctcaaagaggacttcccttaaaattttgtttccttaccctgcattaattttaatcacagcacttagcactacctgacattatacygtatattgtgttatttttttaattttctttctctctcactaggaggtaagctccatgagagtggaagtctggtttgttcacagttctatccccagagctt

SEQ ID NO: 56516 - DNA, 201 bp, Homo sapiens
ctcattgccactctgccgctttcatagttgaatctcacacctagattattaaaacagcttcctaactagtcttttttgcctccagccctatcaccctcctrcccattctttacactacagccagaatgacttcaccccaaacgcttgaagacttcctcttctcagtaatacagtatatttggctcgctaatgactgaacac

SEQ ID NO: 56517 - DNA, 201 bp, Homo sapiens
cggccaggcgccgtggctcacgcctgtaatcccagcacttaatgggaggccgaggcgggcggatcatgaggtcaggagatcgagaccatcctggctaacaygatgaaaccccatctctactaaaaatacaaaaaattaaccaggcgtggtggtgggcgcctgtagtcccagctactcgggaggctgaggcaggagaatgac

SEQ ID NO: 56518 - DNA, 201 bp, Homo sapiens
catgctaattgttcatgttccttcacctggtcctcaggtgatgtggttttgggtctgtttaccatcactaggtaatcatttaaactcagatttgctctctstcaaagtgtagttttcagaactatatcccaggtattattttattagtctaagaaagaataggaatattacttgtgtgcttcttttcattcactcagaaac

SEQ ID NO: 56519 - DNA, 201 bp, Homo sapiens
cgatgaaaccccatctctactaaaaatacaaaaaattaaccaggcgtggtggtgggcgcctgtagtcccagctactcgggaggctgaggcaggagaatgaygtgaacccgggaggtggagcttgcagtgagcggagatcgtgccactgcactgcagcctgggtgacagagcgagactccgtctcaaaagaaaaggcagggt

SEQ ID NO: 56520 - DNA, 201 bp, Homo sapiens
tgggtctgtttaccatcactaggtaatcatttaaactcagatttgctctctctcaaagtgtagttttcagaactatatcccaggtattattttattagtcyaagaaagaataggaatattacttgtgtgcttcttttcattcactcagaaactcatattgagcctctattaaatttcaggcactgtgttaaacagtaaaga

SEQ ID NO: 56521 - DNA, 201 bp, Homo sapiens
ctgagttccagtatggagatgatacccagttctccctgggcattctatcccaatctcattaattcctccatcccaatctcattaattcctccctagggttmgtttgtttgtctgttggtttgttttgcttgtttattagcttccactgacttcagtccttgtacaatataagctcctcaaggtcaagaacctaatcttttt

SEQ ID NO: 56522 - DNA, 201 bp, Homo sapiens
gatcacttgaccctgggaggcagaggttgcagtgagccaggattacaccactgcactccagcctgggtgacagaaccagaccctttctccaaaaaagaaaragagagagagagagagagagagagagaaaggaaatcttaacaagtggaaaagactatcatgtttatggatgggaaggcttgatagtatataataaaggtt

SEQ ID NO: 56523 - DNA, 201 bp, Homo sapiens
ccctctggaccagctgacgtatttgtttgtttgtttgtttgtttgtttttgctccatgtggagcaaaatattgtttgtttgtttgtttgtttgtttttgcyccatgtggagcaaaacattgtttgtttgtttgttgtaagctccatgtgggcaaactttggctgtattgtattttgctatatatcaccagtgcctagaacc

SEQ ID NO: 56524 - DNA, 201 bp, Homo sapiens
tcacttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataataaaggttat

SEQ ID NO: 56525 - DNA, 201 bp, Homo sapiens
acacttttataagcattatttactaaatgagatggctttttctcatctgtaaagtcttagcttagacatttcctctgaagagtatctgtccatgactttamtaagatagctcccagtctctatcacatcacctcattttattcccttcaagttcttttcacttactgccttgtttatttattgtttatgtgttagttgtgt

SEQ ID NO: 56526 - DNA, 201 bp, Homo sapiens
acttgaccctgggaggcagaggttgcagtgagccaggattacaccactgcactccagcctgggtgacagaaccagaccctttctccaaaaaagaaagagagagagagagagagagagagagagaaaggaaatcttaacaagtggaaaagactatcatgtttatggatgggaaggcttgatagtatataataaaggttattt

SEQ ID NO: 56527 - DNA, 201 bp, Homo sapiens
tcccaggtcctactttgctctaaattaacagttctttgtcactttgcaccccagagcaacacagcggtggctaggatgggggtgcagcgggggtaggtgasagagagccagtttttagagtgaggattcaactataatctcactcatctggcttcccctcccctcaaatcatctcgccccttgtctctagacagccttttc

SEQ ID NO: 56528 - DNA, 201 bp, Homo sapiens
aagaaagagagagagagagagagagagagagagaaaggaaatcttaacaagtggaaaagactatcatgtttatggatgggaaggcttgatagtatataataaaggttatttccacccaaatttatctataaattcgttgtaattccagtcaaaatcctaatagggtttatatatggaactcgaaaaaactgattgaaattt

SEQ ID NO: 56529 - DNA, 201 bp, Homo sapiens
agaaagagagagagagagagagagagagagagaaaggaaatcttaacaagtggaaaagactatcatgtttatggatgggaaggcttgatagtatataataaaggttatttccacccaaatttatctataaattcgttgtaattccagtcaaaatcctaatagggtttatatatggaactcgaaaaaactgattgaaattta

SEQ ID NO: 56530 - DNA, 201 bp, Homo sapiens
aagagagagagagagagagagagagagagaaaggaaatcttaacaagtggaaaagactatcatgtttatggatgggaaggcttgatagtatataataaagkttatttccacccaaatttatctataaattcgttgtaattccagtcaaaatcctaatagggtttatatatggaactcgaaaaaactgattgaaatttatat

SEQ ID NO: 56531 - DNA, 201 bp, Homo sapiens
aggcttgatagtatataataaaggttatttccacccaaatttatctataaattcgttgtaattccagtcaaaatcctaatagggtttatatatggaactcraaaaaactgattgaaatttatatgaaagacagagaatgaatagcaaaaacaatattgaagaatgacaaagtagggggacttttcctatcagatatccatt

SEQ ID NO: 56532 - DNA, 201 bp, Homo sapiens
ctactcaggaggctgagggaggagaattgcttgaacctgagaggcagaggttgcagtgagccaagatcgcaccaatacactgcagcctgggcgacagagcragactctgtctcaaacaaaaacaagcagtgcaagatgatgttggagaagtgggcaggtgccaaatcatgtaggaccttgtaaaccagagtgggaatattg

SEQ ID NO: 56533 - DNA, 201 bp, Homo sapiens
aagctttgtattttaatgtctgctaaggctaattccctcagctctcacattctgttgttttcttagttattgttatggtttctgctttgtgtgtttggggttttttttttttttttggttttgttttgttttttgaaacaagggtctcattatattgctcaggctggtctccaactcctgagctcaaacgatcagcttccc

SEQ ID NO: 56534 - DNA, 201 bp, Homo sapiens
agaaacatatgttcacacaaaaacacataatgaacattcatggcagcattatttatagtagccaaaaagataaaacaacccaaatgttcatcatctgatamatggataaataaaatgtggtatagctagaggacaaaatactaattggcaataaaaaaggaataaagtactaatacatgctacagtatagatgcatcttaa

SEQ ID NO: 56535 - DNA, 201 bp, Homo sapiens
tgtgtttggggttttttttttttttttggttttgttttgttttttgaaacaagggtctcattatattgctcaggctggtctccaactcctgagctcaaacratcagcttcccaagcaggtggtactacaggtatgcactgctgcacccagctagtttgttgttgttgctgttgtttagagacagcatcttgctatgttgca

SEQ ID NO: 56536 - DNA, 201 bp, Homo sapiens
tgaggtcaggagttcgagaccagcctggccaagttggtgaaaccctgtctctactaaaaatacaaaaattagctgggcatggtggcgtgcacctgtaatcmcagctactagggaggctgaggcaggagaatcgcttgaacccaggaggtagaggttgcagtgagccaagatcgtgccactgcactccagcctgagtgacag

SEQ ID NO: 56537 - DNA, 201 bp, Homo sapiens
attttaaaaagaaaggctgggcgtggtggctcatgcttgtaatcccaacactttgggaggccaaggcgggcagatcacaaggtcaggagatcgagaccatyctggccaatgtggtgaaaccctatctctactaaaaatacagaaattagctgggcgtggcggtgggtacctgtaatcccaactactcaggaggctgaggca

SEQ ID NO: 56538 - DNA, 201 bp, Homo sapiens
tcacagactgaatgtgatgtgccacatttatcttttacctacttttcatttttttaactgtagagaactttttaaaaggtattttgatttgtgtcagttayacacattcatagtttaaaggaatgaagggtctacacaacttattacaaaaacaaaacaaacatacctcgtatccccctgtcaattactattccccagggg

SEQ ID NO: 56539 - DNA, 201 bp, Homo sapiens
atgaaacacaaagagaaaaaggaatttagaacctgtgaactatgggttaacttcaggtgaccaaatagacgtgtaattggagtcccagaggagagaagtgrtgggggatagaaaaaatatttgaagaaataatggctaaaatttttccaaaattaaaaataacagctgggcatggtgtctcaggcctgtaatcccagcaat

SEQ ID NO: 56540 - DNA, 201 bp, Homo sapiens
ccagtaccctaaaatttcactttggatatattttcacctaccatactggacacttttattttataaaatttttaaaaatgagctgagcatggtggctcacrcctgtaatcccagcactttaggaggccaagacggacggattacttgaggccaggaattcaagaccagcctgatcaacatggcaaaaccccttctctacca

SEQ ID NO: 56541 - DNA, 201 bp, Homo sapiens
aagtatactattacaaggttctcatgcatgaagtagtactatcttacttgataaggtagactgtggtaagttaaagatgtttgtactataaactctaatgyaaccactagaataatgggaaaaaatagcaaaatgttttatttaaacccagctatatcaataatcaaatgtaaatggtttaaatgttaaaaagcggaaatt

SEQ ID NO: 56542 - DNA, 201 bp, Homo sapiens
atggagtcttgctctgtcgcccaggctgaagtgcagtggcgcgatctcagctcactgcaaccttcacctcccaggttcacgccattctcctgcctcagccwtccgagtacctgggaccacaggcgcccgccaccacacccgactaattttttgtatttttagtagagatggggtttcaccatgtcagccaggatggtctcg

SEQ ID NO: 56543 - DNA, 201 bp, Homo sapiens
tatactattacaaggttctcatgcatgaagtagtactatcttacttgataaggtagactgtggtaagttaaagatgtttgtactataaactctaatgcaamcactagaataatgggaaaaaatagcaaaatgttttatttaaacccagctatatcaataatcaaatgtaaatggtttaaatgttaaaaagcggaaattggc

SEQ ID NO: 56544 - DNA, 201 bp, Homo sapiens
actatgttgcccaggtctcaaactcctgggctcatgcagtcttcccaccttgatctcccaaagtgctgggattacaggtgtgagccaccacccccagctgrttcaatttgttgctgtctacaaaataaattctgggattttgattaggattgcagtcaatctctacattgacttggaaagaactgacatcctgacaaaatt

SEQ ID NO: 56545 - DNA, 201 bp, Homo sapiens
attttcaaaagactgaccatattaaatagtggcaaagatgtagaacaaatggaactttcatatgctgctggtgaaaatgcagaatggttcaactactttgsgtggggtgggggaggaactaacaaatacgaaaaatttatataaagaaaaccttagaagatgcctgaccaaaattttgattcattaaaaaaatagagtgga

SEQ ID NO: 56546 - DNA, 201 bp, Homo sapiens
aacatcctattatgggaaagcctagggtacccagcttatcccttatttttcatatagtctcctaaaaaggcccacccaaaatgaaacaagctgcacaattyggacatctccatctctacattagcttatgatatccaggcttcttccaaattctttctaacaagaaatcacaccctttgttcttcttggccagtgcccatt

SEQ ID NO: 56547 - DNA, 201 bp, Homo sapiens
gcggtttcactgtgttggccagggtggtctcgacctcctgccctcatgatccgcccgcctcagcctcccaaagtgctgggattacaggcgtgagccaccaygcctggcctgtttcctctattgatttcctgtttttgatttcattgatttctgctctataatctttacgattttttattttctgcttactttggatttaat

SEQ ID NO: 56548 - DNA, 201 bp, Homo sapiens
gcaggagaatcacttgaacccaggaggcagaggttacagtgagccgagattgtgccactgcactccagcctgggcaacaagagtgaaactccatctcaaamaaaaaaaaaggctgtttaatgttacggttttttaattttggaaacctaatggccaaaagtaagagtggcacagggcactaagatttgtttccagagccca

SEQ ID NO: 56549 - DNA, 201 bp, Homo sapiens
ctatacttcctctcaggaagctgtgctaaattgagaattagagagcatgtatcatgggctccctaggtacttatttaacgttttcccccattaaaaaaaawtttgtaatgtaaaatttcaaacatataaaaaggtagagaaaaatagcatagtgaatgctcatgtaaccttcattgttgaagtcaatataattttatctat

SEQ ID NO: 56550 - DNA, 201 bp, Homo sapiens
tgaagcagaagaataacttgaacccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaa

SEQ ID NO: 56551 - DNA, 201 bp, Homo sapiens
aacacttcccctttcatcgatcttccaataagattttcttcactttcccttaaaccttcactgacagcctcattaagaacctttaggccgggcgcggtggrtcacacctgtaatcccagcactttgggaggccgaggcaggcggatcatgaggtcaggagatcgagaccatcctggctaacacggtgaaaccccgtctcta

SEQ ID NO: 56552 - DNA, 201 bp, Homo sapiens
gaagcagaagaataacttgaacccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaat

SEQ ID NO: 56553 - DNA, 201 bp, Homo sapiens
gaacccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaatggtcatggtagatgcttt

SEQ ID NO: 56554 - DNA, 201 bp, Homo sapiens
taaaactgtaaatttgatatatattttaccacaaaaaaaattaccaggcatgcaaacaagcaagagaaaaactcacccattataattagaatccagaaatmacacagattatagaattaatagacaaggacattaaagcagttgtttatattgcatatgttcaagaagatagaggaaatcatgagcgtcatgagtagagaa

SEQ ID NO: 56555 - DNA, 201 bp, Homo sapiens
aacccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaatggtcatggtagatgcttta

SEQ ID NO: 56556 - DNA, 201 bp, Homo sapiens
acccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaatggtcatggtagatgctttac

SEQ ID NO: 56557 - DNA, 201 bp, Homo sapiens
cccaggaggcagaggttgcagtgagccgagatcgtgccactgcactccagcatgggcaatagagtgagactccgtctcaaaaaaaaaaaaaaaagaaaaagaaagaaaagaaaaggctatcctatgacctcacatgttaaagataagggattgtgtttttatatttttgtattctgtaatggtcatggtagatgctttacg

SEQ ID NO: 56558 - DNA, 201 bp, Homo sapiens
ccagtgaagcaagtagcattgggattattattcccattttactaataagaaaactgagattcagttaagttacagcctgaagtctttttgttttttggggtttttttttttttttttgaccaagtctcactctgtcgcctaggttggagtgcagtggcatgatctcagctcactgcaacctccgcctcctgggttcaagtg

SEQ ID NO: 56559 - DNA, 201 bp, Homo sapiens
gatgggttggaggtattgttttatataggatgatgagggaaagcttcactgaaaggtatcatttgagcagagatatggctgtctaggaaaaagaatttttwttttttttttgaggcagagtctcactctgctccacaggctggagtgcaatggtgcaatctcagctcactgcaacctccgccttctgggttctagcaattc

SEQ ID NO: 56560 - DNA, 201 bp, Homo sapiens
cagtgaagcaagtagcattgggattattattcccattttactaataagaaaactgagattcagttaagttacagcctgaagtctttttgttttttggggtttttttttttttttttgaccaagtctcactctgtcgcctaggttggagtgcagtggcatgatctcagctcactgcaacctccgcctcctgggttcaagtga

SEQ ID NO: 56561 - DNA, 201 bp, Homo sapiens
catttacattaggtatatctcctaatgctatccctcccccctccccccaccccatgacagccccgtgtgtgatgttcctcaccctgtgtccaagtgatctyattgttgaattcccatctatgagtgagaacatgcggtgtttagttttctgtccttgcgatagtttgctgagaatgatggtttccagcttcatccatgtcc

SEQ ID NO: 56562 - DNA, 201 bp, Homo sapiens
gatagtttgttgaggatgatggtttccagcttcatccatgtccctacaaaggacatgaactcatcattttttatgactgcatagtattccatggtgtataygtgccacattttcttaatccagtctatcattgatggacatttgggttggttccaagtctttgctattgtgaatagtgccgcaataaacatacgtgtgcat

SEQ ID NO: 56563 - DNA, 201 bp, Homo sapiens
tccagtctatcattgatggacatttgggttggttccaagtctttgctattgtgaatagtgccgcaataaacatacgtgtgcatgtgtctttatagcagcaygatttataatcctttgggtatatgcccagtaatgggattgctgggtcaaatggtatttctagttctagatccctgaggaatcgccacactgacttccaca

SEQ ID NO: 56564 - DNA, 201 bp, Homo sapiens
gttaggggtgttccttctgagtgatcccttccaccttccagaatcctcccagcatttcagtaatggtgccacccttaaaatatgtatgaaatttctctgattttttttttttaacaatcattgatggtgacaaactttggtacaatgaaagtaaggttgacttattgcaaaatctggtggatgaaatgggtgggtaatcat

SEQ ID NO: 56565 - DNA, 201 bp, Homo sapiens
cccagtaatgggattgctgggtcaaatggtatttctagttctagatccttgaggaatcgccacactgtcttccacaatggttgaactagtttacagtcccrccagtagtgtaaaagcattcctatttctccacatcctctccagcacctgttgtttcctgactttttaatgatcgccattctaactggtgtgagatggtat

SEQ ID NO: 56566 - DNA, 201 bp, Homo sapiens
ttcctgactttttaatgattgctattctaactggtgtgagatggtatctcattgtggttttgatttgcatttttctgatggccagtgatgatgagcatttyttcatgtgtctgttggctgcataaatgtcttcttttgagaagtgtctgttcatatccttggcccactttttgatggggttgtgtgtttttttcttgtaaa

SEQ ID NO: 56567 - DNA, 201 bp, Homo sapiens
ttaccagttttgtgacttcaggcaaattacttaatctttctaagcctatttcctcatctttaaaatgggagtaaaacctactttgcaggttataatgaacmcaggagataatggacgtagtctggcatggtacaggcaaatggaagacagtgatagctgctgttgtttttggttttgtcgctaatatgaatgataataaca

SEQ ID NO: 56568 - DNA, 201 bp, Homo sapiens
tggattcctaggtattttattctctttgaagcaattgtgaatgggagttcactcatgatttggctctctgtttgtctgttattggtgtataagaatgcttktgatttttgcacatcgattttctatcctgagactttgctgaagttgcctatcagcttaacgatggggttttctagatatacaatcatgtcctctgcaaac

SEQ ID NO: 56569 - DNA, 201 bp, Homo sapiens
attcagtatgatattggctgtgggtttgtcatagatagctcttactattttgagatatgtcccatcaatacctaatttattgagagtttttagcatgaagkgttgttgaattttgtcaaaggccttttctgcatctattgagataatcatatggtttttgtcgttggttctgtttatatgctggattacatttattgattt

SEQ ID NO: 56570 - DNA, 201 bp, Homo sapiens
tctcctgcctcagcctcctaagtagctgggactacagacatgcaccaccacgcccagctaattttttatatttttagttgagatgcggtttcactgtgttrgccagggtggtctcgacctcctgccctcatgatccgcccgcctcagcctcccaaagtgctgggattacaggcgtgagccaccacgcctggcctgtttcct

SEQ ID NO: 56571 - DNA, 201 bp, Homo sapiens
tttcttctggctgggatgagaatgcaggggggagggagggtgatagaatgagtctttttcttgcagttgtgattccaaagaatccctatcctgcctccgaygtgaatactgagaagcccagcatccacagcagcaccaaaactgtcttggaacatcaaccagggcagagggggcgtaaaccaggaaagaagcggggccgga

SEQ ID NO: 56572 - DNA, 201 bp, Homo sapiens
ccaaagtgctgggattacaggcgtgagccaccacgcctggcctgtttcctctattgatttcctgtttttgatttcattgatttctgctctataatctttaygattttttattttctgcttactttggatttaatttgctcttctttttctagtttcctaagatggaagctcagattgctgcttttagatcttcttttctaa

SEQ ID NO: 56573 - DNA, 201 bp, Homo sapiens
acccagctaattttttgtattttttgtagaaacagggtctcactgtgttgcccaggctggtctttaaattttgggctgaagtgatcctcctgcgtcagtcycccaaaatgctgcgattacaggtgaaagccactgtgcccggcctgcagctccactcttaaatccagtttcatcagctggccagtttaaagagatggaccc

SEQ ID NO: 56574 - DNA, 201 bp, Homo sapiens
ggtgccacctattaaactgagatgggataactggaggaaagaacaagtttggagggaatagtagaatcaagagtactgtcttaaacttattcattttacgwtttcttagacatccaagtagagttatagactgaggtagttggatatatgaacatgaaaccctgagcagaggttttggctagatatataaattgacagtca

SEQ ID NO: 56575 - DNA, 201 bp, Homo sapiens
gcatttactagcatgaccctagacaagctgcttctctgagttttcattttttatcatctgtagagtagggataataatagtgcctgcccatgttatttcaratattgagtaagaaatggcatataaaatgtttaatacatggtaagcattcaatatatattaactattatgataatattgtaatgatttccaaagctgaga

SEQ ID NO: 56576 - DNA, 201 bp, Homo sapiens
gagaacagagggctctagtatatttcaaaatggttccttttcccctctccctgccaaaagcatgagggtatttttctcttatatttactgtgagaatccgrttgagctcctggaggcaaaactcacaaaagtttccccctcctccccagtgactgggactccctggagttttaatctcaaacttcttcacactgagcctct

SEQ ID NO: 56577 - DNA, 201 bp, Homo sapiens
gccgcagttagatatgggcatttaagcacttcagagctttcatcccccaggagcaatacatagaagggacttaagaaatgaagctccctgtttgcccccaraaggagtttatgacacactattccagcagcttcttgtttgtttggcttctaactaacttacattgggggagtttaggggcagtcaaatattaacctgcca

SEQ ID NO: 56578 - DNA, 201 bp, Homo sapiens
tccccctcctccccagtgactgggactccctggagttttaatctcaaacttcttcacactgagcctctgacaagtcatcaagtacagtttaggttttcctkccctagcactagttccagagacttcggcttattcacctgtctgtctcttcaaatttgagggctaatagtttgccctgagaccttacttctctgacagatg

SEQ ID NO: 56579 - DNA, 201 bp, Homo sapiens
cctactctacggtattgtgggggtattgatggaatgtggtacatcctaagctcgaggggaccatcaaaaaagagacagcagtctgaataaacacagagatwagagagcaccttaaaatttttggctggatggattggtgagatccttctcctacatgaggccagtctgacaagtctgggagaggttatattcttatgtaat

SEQ ID NO: 56580 - DNA, 201 bp, Homo sapiens
ggaatccaacttacaaaggatgtgaaggacctcttcaaggagaactacaaaccactgctcaacgaaataaaaggacacaaacaaatggaagaacattccamgctcacggataggatgaatcaatatcgtgaaaatggccatactgcccaaagtaatttataggttcagtgctatccccatcaagctaccactgactttctt

SEQ ID NO: 56581 - DNA, 201 bp, Homo sapiens
aaatgaatacagctcatctctgcgccacatggcatcagttggggtacctcaattggggcttatgataattccattcacataactagcagaactcatgttgyctgttggttctcgccaaaggataacttgggctttgccataccatggtggctgcgttcctagagcaagtttctcaagagataggaagtgaaagctaccatt

SEQ ID NO: 56582 - DNA, 201 bp, Homo sapiens
ttcctgactttttaatgatcgccattctaactggtgtgagatggtatctcattgtggttttgatttgcatttctctgatggccagtgatgatgagcatttyttcatgtgtctgttggctgcataaatgtcttcttttgagaagtggctgttcatatcctttgcccactttttgatggggttatttgattttttcttgtaaa

SEQ ID NO: 56583 - DNA, 201 bp, Homo sapiens
attccctttgactgtatcctctacaggagcagagtttcagggtcccagaacaattagggtcaagagtatcattttgccgtagttgcctgatgagtgttttmtttcttttcctctccaatctaccctgctcttcacctcccacatagcaacatagtagcagaaagttcactacagtcagatgagaacaaggctaaggtttat

SEQ ID NO: 56584 - DNA, 201 bp, Homo sapiens
taggagcttgctcaagatcacgtggctagtaagcggcagaacagggatccaaaacctgtatttgttattgcttctcaagaagtgaggcagtgagtctatcmgttgaattttctaatggggtaaaagttactgtaaagggtattgaattaggtttgcctatgctgctagttaagtctcaacactaagagcatcctgcttctg

SEQ ID NO: 56585 - DNA, 201 bp, Homo sapiens
ggattcggtttgccagtattttattgaggatttttgcatccatgttcatcagggatattggtctaaaagtgtctttttttgttgtgtctctcaactaacatttttttttttttttttgacacggagtctcgctctttcgcccaggccggagtgcagtggtgctatcttggctcacagcaagctccgcctcccaggttcaca

SEQ ID NO: 56586 - DNA, 201 bp, Homo sapiens
tcccagaacaattagggtcaagagtatcattttgccgtagttgcctgatgagtgttttctttcttttcctctccaatctaccctgctcttcacctcccacrtagcaacatagtagcagaaagttcactacagtcagatgagaacaaggctaaggtttattgagcgttcactatgtagccagtgccggactgatctcttcaa

SEQ ID NO: 56587 - DNA, 201 bp, Homo sapiens
aaatgtgaaggtattccattcctcatctccaaccccccaagagcccctctgagccttatgcatacctctgccaaggagaatacccacagattctgcttcastgagcctctaaactgattccccccatctacctgattgacctgtccgtacagaaagtataggagaaagaatccagagggggctatgttgtggcagcaggag

SEQ ID NO: 56588 - DNA, 201 bp, Homo sapiens
ctttttttgttgtgtctctcaactaacatttttttttttttttttgacacggagtctcgctctttcgcccaggccggagtgcagtggtgctatcttggctyacagcaagctccgcctcccaggttcacaccattctcctgcctcagcctcccaagtagctgcgactacaggcacccgccactgcgcccagctaattttttg

SEQ ID NO: 56589 - DNA, 201 bp, Homo sapiens
aggggaattgtctagattttcttttcagtgcacagaagacaaagtgcaaactctgtgtcttggcctttggtctgggccactcttccagtcttcccacagaytttgatcatgcagtttgggttggcagtagctgggcacagccttttcttgaccctccaccctctacctcccacagcatttcaccagctcagctgctaggaa

SEQ ID NO: 56590 - DNA, 201 bp, Homo sapiens
tgctaccattgcataaataaatacacacacacacacacacacacacacaccagaaactatatatattgtgtatagattattatatatagtatattgtacartaatatgtaatactgtatatgtattgcttaataaacttgtacacatgtattttcatatttggaggtgtatcttcagggtaaatgaccagaagcggtattc

SEQ ID NO: 56591 - DNA, 201 bp, Homo sapiens
atttcagagcctgttattggtctattcagagattcaacttcttcctggtttagtcttgggagggtgtatgtgtcgaggaatttatccatttcttctagatwtcctagtttatttgcgtagaggtgtttatagtattctctgatggtagtttgtgtttctgcaggattggtggtgatatcccctttatcattttttattgca

SEQ ID NO: 56592 - DNA, 201 bp, Homo sapiens
ctgtttgagctagcttcatcactgattttatagggatgcactgtccaatagaaatgtaatttgagctatgtacataattaaaatttttgtagtacattttwaaaagaaaggctgggcgtggtggctcatgcttgtaatcccaacactttgggaggccaaggcgggcagatcacaaggtcaggagatcgagaccatcctggc

SEQ ID NO: 56593 - DNA, 201 bp, Homo sapiens
ttcagagcctgttattggtctattcagagattcaacttcttcctggtttagtcttgggagggtgtatgtgtcgaggaatttatccatttcttctagatatyctagtttatttgcgtagaggtgtttatagtattctctgatggtagtttgtgtttctgcaggattggtggtgatatcccctttatcattttttattgcatc

SEQ ID NO: 56594 - DNA, 201 bp, Homo sapiens
ctcttactattttgagatatgtcccatcaatacctaatttattgagagtttttagcatgaagagttgttgaattttgtcaaaggccttttctgcatctatygagataatcatgtggtttttgtcgatggttctgtttatatgctggattacatttattgatttgtgtatattgaaccagccttgcatcccagggatgaagc

SEQ ID NO: 56595 - DNA, 201 bp, Homo sapiens
ccagccttgcatcccagggatgaagcccacttgatcatggtggataagctttttgatgtgctgctggattcggtttgccagtattttattgaggattttcrcatcaatgttcatcaaggatattggtctaaaattctctttttttgttgtgtctctgcccggctttggtatcaggatgatgctgtttggcatgtttttggc

SEQ ID NO: 56596 - DNA, 201 bp, Homo sapiens
tgttgatcttttcaaaaaaccagctcctggattcattgattttttggaagggttttttgtgtctctatttccttcagttctgctctgatgttagttatttyttgccttctgctaacttttgaatgtgtttgctcttgctttctctagttcttttaattttggatctttcctgctttctcttgtgagcatttagtgctgtaa

SEQ ID NO: 56597 - DNA, 201 bp, Homo sapiens
gagtgcaatggtgcgatctcagctcactgcaacctccacctcccaccttcaagcaattctcctgcctcagcttcccaagcagctgggattacaggcacacrccaccacacctggctaattttttctttttcttttttttttttttttctgagatggagtctctctctgtcccccaggctggagtgcagtggcccgatctca

SEQ ID NO: 56598 - DNA, 201 bp, Homo sapiens
tgctctaatatattttttcatattttctcactgtactttattttggatgttttctattttttcatcaagtttattaatcctttctattggctcttgtctgyccttaaacccatgcaatgagttattcctaatattgtattttttagttataagatgtccatttagttttttatatagatatttctgtgggtactatctacc

SEQ ID NO: 56599 - DNA, 201 bp, Homo sapiens
gggtggggagttctgcagatgtctgttaggtctgcttggtgcagagctgagctcaattcctggatatccttgttaactttctgtcttgttgatctgtctamtgttgacagtggggtgttaaagtctcccattattattgtgtgggagtctaagtctctttgtaggtctctaaggacttgctttatgaatctgggtgctcct

SEQ ID NO: 56600 - DNA, 201 bp, Homo sapiens
gtgtcttttacttggagcatttagcccatttacatttaaggttaatattgttatgtgtgaatttgatcctgtcattatgatgttagctggttattttgctygttagttgatgcagtttcttcctagcctcgatggtctttacagtttggcatgtttttgcagtggctggtaccagttgttcctttccgtgtttagtgcttc

SEQ ID NO: 56601 - DNA, 201 bp, Homo sapiens
caatgtagcaagacttctctactaaaaataaaaattaaaaaattaatcaagcatggtggtgcatgcctgtagccccaagctactcaggaggctgaggcagraggatcacttgagcctgggagattgaggctgcagtgagttacgatagtaccactgcactctaacctaggtgacagagtgagaccctgtctcaaaaaaaga

SEQ ID NO: 56602 - DNA, 201 bp, Homo sapiens
tttttctcctgtggtaccttatatctcagtctcttgggaaatattcagaatatgcaagatgggtaggagggtaggtgggtgggtacatggatggaaggatdgatggatggatggatggatggatggatggatggatggatgattttagtgatgatgttaccaatctcagttgtctcttatttttggcttcgaattctcagt

SEQ ID NO: 56603 - DNA, 201 bp, Homo sapiens
atcaagcatggtggtgcatgcctgtagccccaagctactcaggaggctgaggcaggaggatcacttgagcctgggagattgaggctgcagtgagttacgayagtaccactgcactctaacctaggtgacagagtgagaccctgtctcaaaaaaagaaagaaatttaaaaaaaggtcataattaattttgtctttacttttt

SEQ ID NO: 56604 - DNA, 201 bp, Homo sapiens
caatcattgtttactgcagccttgacctcctgggctcaagcgatcctcccacctcagcctcccaagtagctgggactataggcatgtgccactatgcccarctaatttttaaaaaaaacttttgtagacatggggccttgctatgttgcccaggctggtctcaaactcctgggcccaagcaattttcccacctagacctcc

SEQ ID NO: 56605 - DNA, 201 bp, Homo sapiens
ctgaatttgaatgttggcctgccttgctaattggggaagttctcctggataatatcctgaagagtgttttccaacttggttccattctccccatcactttyaggtacaccaatcagacgtagatttggtcttttcacatagtcccatatttcttggaggctgtgttcgtttctttttattcttttttctctaaacttctct

SEQ ID NO: 56606 - DNA, 201 bp, Homo sapiens
tgtttgcctgggtatcagcagcggaggctgcagaacagcggatattggtgaacagcaaatgttgctgcctgatcgttcctctggaagttttgtctcagagsgccgtgtgaggtgtcagtctgcccctactggggggtgcctcccagttaggctacttgggggtcagggacccacttgaggaggcagtctgtccattctcag

SEQ ID NO: 56607 - DNA, 201 bp, Homo sapiens
ccagtgtccaagggcaggagaagatggatgtcctagctcaagaaacgagataattcactcttccttcacctttttgtgctatttggaccctcagtggattggataatgcccacacacattggtgagggcaatctttactcagtctactgattcaaatgttaatctcttcaataaataccaccacagatacactcagaaata

SEQ ID NO: 56608 - DNA, 201 bp, Homo sapiens
aagcatggtggtgcatgcctgtagccccaagctactcaggaggctgaggcaggaggatcacttgagcctgggagattgaggctgcagtgagttacgatagyaccactgcactctaacctaggtgacagagtgagaccctgtctcaaaaaaagaaagaaatttaaaaaaaggtcataattaattttgtctttacttttttct

SEQ ID NO: 56609 - DNA, 201 bp, Homo sapiens
cagtgtccaagggcaggagaagatggatgtcctagctcaagaaacgagataattcactcttccttcacctttttgtgctatttggaccctcagtggattgrataatgcccacacacattggtgagggcaatctttactcagtctactgattcaaatgttaatctcttcaataaataccaccacagatacactcagaaataa

SEQ ID NO: 56610 - DNA, 201 bp, Homo sapiens
cttcaattcctttctctttttcttttccttctagtatcaccattatatatagattacatctgttatagttatcccacagttcttgaatattctgttatggtttttttttttcagtcttttttttctttgcttttaattttgggagtttctttcccttgagatatatttgtaaaggaaaattagaaattctctggacccgcc

SEQ ID NO: 56611 - DNA, 201 bp, Homo sapiens
ctacttaatctctaatgctctaatatattttttcatattttctcactgtactttattttggatgttttctattttttcatcaagtttattaatcctttctrttggctcttgtctgcccttaaacccatgcaatgagttattcctaatattgtattttttagttataagatgtccatttagttttttatatagatatttctg

SEQ ID NO: 56612 - DNA, 201 bp, Homo sapiens
tactttattttggatgttttctattttttcatcaagtttattaatcctttctattggctcttgtctgcccttaaacccatgcaatgagttattcctaataytgtattttttagttataagatgtccatttagttttttatatagatatttctgtgggtactatctaccttttcttatattttgttcatcttttttacattt

SEQ ID NO: 56613 - DNA, 201 bp, Homo sapiens
ctgccaagtgatactccattaaatgaatatacactcacgtattacttaatcacggggatatgatcagagaaatgcatcattagccagtatcctcattttgkgaataccatagtacatcgatcttcaacctttttggcaccaaggactggttttatggaagacaggtgttccatggaccagtggcatgggggatggtttcag

SEQ ID NO: 56614 - DNA, 201 bp, Homo sapiens
ccttgaactcctgggctcaagcagttctcccacctcagcctcccaagtagctgggaacacaggcacatgccaccacacctagcaaattttctgtagagatrtggtctcactgtattgcccaggctggtctcaaactcctggctttaagtgatccttccgcctcagcctcacaaagtgctgtgattacagatgtgagccact

SEQ ID NO: 56615 - DNA, 201 bp, Homo sapiens
aaaaaaaaaaaaaaaaagactgggaagtgcctgggaaattaagccttatgtcccttctgaggcccagcctactccctggtctcttctttgtttctgtgtartggtctgtaggaacctggccttctttactgcctctctttagctgctctcctataccctctctggggttcttctcctgcctcaaaactggttcttgagaat

SEQ ID NO: 56616 - DNA, 201 bp, Homo sapiens
aaaaaaaaaaaaaaaagactgggaagtgcctgggaaattaagccttatgtcccttctgaggcccagcctactccctggtctcttctttgtttctgtgtaayggtctgtaggaacctggccttctttactgcctctctttagctgctctcctataccctctctggggttcttctcctgcctcaaaactggttcttgagaatg

SEQ ID NO: 56617 - DNA, 201 bp, Homo sapiens
ttctagatccttatccctagataaaaggtggttcgcaattccccttctgagtttcagactgcatgtggagccaccaagaagtcacagaacgtctcccagtktgaacctggcagcaaaggcctaacacacatctcccttgccagcaggaaggtttagtctcaggctacagattgagaaatttgctccctggtgattggccat

SEQ ID NO: 56618 - DNA, 201 bp, Homo sapiens
aaaagcactgcttctagagaatgtgcccagggaagtgactgttcccccattctccttccccctttccctcatagatacttctgtacccaaatccgtattgyttatgtgacttgcaagcaggtcaaaaagatacctgaattttaaatactctgtgggggccagaccatctgatccctgcagccatttctatgatcccctggc

SEQ ID NO: 56619 - DNA, 201 bp, Homo sapiens
aaagagacaatgattagagaaaaactagaaaagcttcctagataaacaaatttgtaaaataaatttaaaaagagagcatttcaagtgaaagagacatcttatattgtaaaggtgtggaccaggtaaaagtgcaagtttttaaagaagcaatagagatttagtagaataggagatttaagggaatggcaggtaatgaggtga

SEQ ID NO: 56620 - DNA, 201 bp, Homo sapiens
aggaagcaaactttagccagactcttcttgcctcaccaactaagagaaacaaagaccaaggtatcacattctgccattagctgctacctctcccttccccrttttcagacagattgagcccactttttgtgtcctcctctgctcttaagctgtttctcatcgtgggtgctcagcaacttgtctgctctcactctagtttct

SEQ ID NO: 56621 - DNA, 201 bp, Homo sapiens
aagagacaatgattagagaaaaactagaaaagcttcctagataaacaaatttgtaaaataaatttaaaaagagagcatttcaagtgaaagagacatcttatattgtaaaggtgtggaccaggtaaaagtgcaagtttttaaagaagcaatagagatttagtagaataggagatttaagggaatggcaggtaatgaggtgaa

SEQ ID NO: 56622 - DNA, 201 bp, Homo sapiens
agtgtccaagggcaggagaagatggatgtcctagctcaagaaacgagataattcactcttccttcacctttttgtgctatttggaccctcagtggattggwtaatgcccacacacattggtgagggcaatctttactcagtctactgattcaaatgttaatctcttcaataaataccaccacagatacactcagaaataat

SEQ ID NO: 56623 - DNA, 201 bp, Homo sapiens
gtgtccaagggcaggagaagatggatgtcctagctcaagaaacgagataattcactcttccttcacctttttgtgctatttggaccctcagtggattggataatgcccacacacattggtgagggcaatctttactcagtctactgattcaaatgttaatctcttcaataaataccaccacagatacactcagaaataatg

SEQ ID NO: 56624 - DNA, 201 bp, Homo sapiens
ttcattgttggttcagtgctactgatttttatatgttgattttatgtcctgcagctttcctgaatttgtttatcagttctaagaattttttggtacagcgtttttttttttttttttgagatggagtctcgctctgtcgcccaggctggagtgcagtagtatgaacatggctcactgcagccttaacctctcaaaagatcc

SEQ ID NO: 56625 - DNA, 201 bp, Homo sapiens
taaggccagcagtggatttcacagcagaaaccttacagatcagaagagagtaggatgatacattcaaaaccctgaaaggaaaaaaaaaaaaaaaaaaaacwctgccagcaaagcatactatacccagcaatcctgtctttcaaaaaacaaagggatgatcaagactttctcaaataaaaacagaatttatccccactagac

SEQ ID NO: 56626 - DNA, 201 bp, Homo sapiens
gctccaggtgccagcatggatgccagctctctgtgaggctgcagctggaccaggcacaccacaagcagcttccctggctggcaccaaagaatgcagtagtscccaaaagcttggaggaaccacagggccggaaagagggagtcacagccctgactccggaagctcccaggtctgggccccccaaacggctgcagctcttcc

SEQ ID NO: 56627 - DNA, 201 bp, Homo sapiens
tccgcagcctcaaactcctgggcagaagcgatcttcctgcctcaactgggtagctagaactacagacatgccaccatgcctggctaatttttttatttttattttttttatagagatggtttctcgccatgttgcccaggctggtcttgaattcctggcctcaaacaatcctcctgcttcagcctcacaaagcattgggat

SEQ ID NO: 56628 - DNA, 201 bp, Homo sapiens
ctggcaccaaagaatgcagtagtgcccaaaagcttggaggaaccacagggccggaaagagggagtcacagccctgactccggaagctcccaggtctgggcyccccaaacggctgcagctcttccctccttctctttgcccaaactgcagcaagcagggggcatatttcagcccttttggtgttacagcaactcttttagcc

SEQ ID NO: 56629 - DNA, 201 bp, Homo sapiens
tccagatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccggttgagctcctggaggcaaaac

SEQ ID NO: 56630 - DNA, 201 bp, Homo sapiens
aaagaatgcagtagtgcccaaaagcttggaggaaccacagggccggaaagagggagtcacagccctgactccggaagctcccaggtctgggccccccaaasggctgcagctcttccctccttctctttgcccaaactgcagcaagcagggggcatatttcagcccttttggtgttacagcaactcttttagccacgccgtt

SEQ ID NO: 56631 - DNA, 201 bp, Homo sapiens
ccagatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccggttgagctcctggaggcaaaact

SEQ ID NO: 56632 - DNA, 201 bp, Homo sapiens
gttcaagcagttctcctgccttagcctcccaagtagctgggattataggtgcctgccaccacgcccagctaatttttgtatttcttttagtagagacgagrtttcatcatgttggccaggctggtcttgaactcctgacctcaggtgatctgcccgcctcggcctcccaaagtgctgggattacaggagtgaaccactgcg

SEQ ID NO: 56633 - DNA, 201 bp, Homo sapiens
acgcccagctaatttttgtatttcttttagtagagacgagatttcatcatgttggccaggctggtcttgaactcctgacctcaggtgatctgcccgcctcrgcctcccaaagtgctgggattacaggagtgaaccactgcgcccggcccaaatgtcaacttttgtatcaccttatcaagatgtcttttttgactgccctgg

SEQ ID NO: 56634 - DNA, 201 bp, Homo sapiens
gacgagatttcatcatgttggccaggctggtcttgaactcctgacctcaggtgatctgcccgcctcggcctcccaaagtgctgggattacaggagtgaacyactgcgcccggcccaaatgtcaacttttgtatcaccttatcaagatgtcttttttgactgccctggctaaaatagcacaccttctttacctcttactttt

SEQ ID NO: 56635 - DNA, 201 bp, Homo sapiens
ggaactgaaccaaactggaaataccatcttaatttactgaatccagaactaaaacaaacccctgccatccataaatcagtgtttggtgggatttttccccmaaaaaaattacttgtaagataaattgaactgaaactaaacctaaacattttctaactttattgacaaataaaaactgaaatattaaaatattatcaagta

SEQ ID NO: 56636 - DNA, 201 bp, Homo sapiens
gattgtgccaccacactccatcctgggtatctgagtgaggctttgtctcaaaaaaaaaaaaaaaaaaagttggcttatacttgtaatcccagcactttggkagtccgaggcaggaagatgacaagcctaggagtttgcaactagcctgggcaccatagggaaaccctgcctctaagaagaaaaatcagtatgttctttcta

SEQ ID NO: 56637 - DNA, 201 bp, Homo sapiens
caaactactcagcaacaagaaaacagccctgttaaaaataagcaaaggacttgaatagacatttttcaaaagaaaacatataaatgggccacagatatatkaaaaaagtccaacatctctaatcatcagagaaatgcaaatgaaaaccacagtgagataccctatagccaacaccttttaggttggctcttatcaaaaaga

SEQ ID NO: 56638 - DNA, 201 bp, Homo sapiens
tgcatgctctttgtccactaatcccacccttaggacaaatcccaaatctgtgtctcatgcctgtaatcccagcactttgggaggccgaggcagttagatcrcttgagctcaggagttcgagaacagcctgggcaatttggcatagccctgtctctacaaaaaatacaaaaattagctaggaatggtggcacacacctgtag

SEQ ID NO: 56639 - DNA, 201 bp, Homo sapiens
aggttgcagtgagccaaaatcacaccactgcactccagtctgcgtgacagagctagaccctgtctccaaaacaacaacaacaaaaaaagatggctgactaraagcatttcatatgctcacctcctccacttagaaaaaccaaaagagtatatagacaatcatacttctgataaattatctaagatagaacactggaattca

SEQ ID NO: 56640 - DNA, 201 bp, Homo sapiens
gccactgcactccagcctgggcgacagagcgagactctgtctcaaaaaaaaaaaaaactaatgaaatttaacattaataaaatactactaggccaggtgcrgtggctcatgcctgtaatcccggcactgtgtgatgccaaggtgggcagatcacttgaggtcaggagttcaagaccagctgggccaacatggtgaaatcct

SEQ ID NO: 56641 - DNA, 201 bp, Homo sapiens
tttttctatctttcacgacgtgacattggcattttgaataatccaggccagttgttttactttaggtcatcaaatatttacaaatacttactctgtgcccrattctatactagactctagggagacagaggtgagacagactccatccctgtgctcaaagagctgagacaggtagagatatgtgaacatgtatgtggtgaa

SEQ ID NO: 56642 - DNA, 201 bp, Homo sapiens
gctggtgaaaactaaaagaggcccagccaggcacagtggctcatgcctgtaatcccagcactttgggaggccaaaagtggatcacctgaggtcgggagttygagaccagcctggctaacatggtgaaaccctgtctctactaataatacaaaaattagctgggcgtggtggtgcatgcttgtaatcccagctacttgggag

SEQ ID NO: 56643 - DNA, 201 bp, Homo sapiens
gctttctctgttgttgctgcttgctccactcaaacaggtatctgggagccagcactctggcagtccttctaagctctaactctggttttactgtttttcargtgaaacctttgtcctggggaatagtctggcccgctccttggaaccacactcagactcaatggactctgcctcaaatcccaccaaccttgtcagcacctc

SEQ ID NO: 56644 - DNA, 201 bp, Homo sapiens
ctggtcagggaaggggttaggagcgctgatagactggactagtcttaaagaagatggggaaaaatggaccaaagaaaaggggatgatttgcaggaaacctmagggcccaactatgcttggagactagttggccagtttgcacaagctatggttttcttctgtgattcttagcaacctagtaggtatgggatgagaaaagac

SEQ ID NO: 56645 - DNA, 201 bp, Homo sapiens
cagatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccggttgagctcctggaggcaaaactc

SEQ ID NO: 56646 - DNA, 201 bp, Homo sapiens
atggaaagtttgacatgccaaagaactttgtgatataatggttacagtggacatacgtcccaagagagctgaaaagatggaaggttggggtcagagaatgkgatgcttaaaattctgaagtggatttattccaagggattgcaagaatcagacagtggtgttggcagtaggtatttggagtagaatggaggtgagagtcac

SEQ ID NO: 56647 - DNA, 201 bp, Homo sapiens
agatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccggttgagctcctggaggcaaaactca

SEQ ID NO: 56648 - DNA, 201 bp, Homo sapiens
gatcagttaggctctgaaaaatccctaatagtttaggctgtggtaaaatagtttctcctgagggaagaccttgttgagaacagagggctctagtatatttcaaaatggttccttttcccctctccctgccaaaagcatgagggtatttttctcttatatttactgtgagaatccggttgagctcctggaggcaaaactcac

SEQ ID NO: 56649 - DNA, 201 bp, Homo sapiens
ttttttaaatttcaaaatagccaggaattgtataattaatctggtgtctctgttaccctctggaccagctgacgtatttgtttgtttgtttgtttgtttgkttttgctccatgtggagcaaaatattgtttgtttgtttgtttgtttgtttttgccccatgtggagcaaaacattgtttgtttgtttgttgtaagctccat

SEQ ID NO: 56650 - DNA, 201 bp, Homo sapiens
ctggttgttaggatggagtggcaacttccaaactccttatgtgccagacctttctctgaatttttttaataacctccaattctaatttaatggatctagtaaaaaaaaaaaaatgacagtatacacaaatatccttatgacctcaagattgggaaggatttttaaaataagacaataagcataaactataaaggaaaagat

SEQ ID NO: 56651 - DNA, 201 bp, Homo sapiens
aattgtataattaatctggtgtctctgttaccctctggaccagctgacgtatttgtttgtttgtttgtttgtttgtttttgctccatgtggagcaaaatattgtttgtttgtttgtttgtttgtttttgccccatgtggagcaaaacattgtttgtttgtttgttgtaagctccatgtgggcaaactttggctgtattgta

SEQ ID NO: 56652 - DNA, 201 bp, Homo sapiens
tgaggcaggagaatggcgtgaacccaggaggcagagcttgcagtgagctgagattgcaccactgcactccagcctgggcgacagagtgagactccatctcaaaaaaaaagaaattccgaaatccagctgggcacatgttggccaactccttaattaggtccagtattactttctgggagttgttttccatggatcttggtt

SEQ ID NO: 56653 - DNA, 201 bp, Homo sapiens
attgtataattaatctggtgtctctgttaccctctggaccagctgacgtatttgtttgtttgtttgtttgtttgtttttgctccatgtggagcaaaatattgtttgtttgtttgtttgtttgtttttgccccatgtggagcaaaacattgtttgtttgtttgttgtaagctccatgtgggcaaactttggctgtattgtat

SEQ ID NO: 56654 - DNA, 201 bp, Homo sapiens
atggaccagtggcatgggggatggtttcaggatgaaactgttccatctcagatcatcagccattaattagattctcataaggagcacacaacctagatccsttgcatgcgcagtttacaataggattcatgctcctgtgaggatttaatgccactgttgatctgacaggaggcggagctcaagtagtaatgctcactcgcc

SEQ ID NO: 56655 - DNA, 201 bp, Homo sapiens
ttgtataattaatctggtgtctctgttaccctctggaccagctgacgtatttgtttgtttgtttgtttgtttgtttttgctccatgtggagcaaaatattgtttgtttgtttgtttgtttgtttttgccccatgtggagcaaaacattgtttgtttgtttgttgtaagctccatgtgggcaaactttggctgtattgtatt

SEQ ID NO: 56656 - DNA, 201 bp, Homo sapiens
tgaggcaagagaattgcttgaacctgggaggcggaggttgcagtgagctgagatcgtgccattgcaccccagcctgggtgacagagcaagactccgtctcaaaaaaaaaaaaaaaaaaaaaagactgggaagtgcctgggaaattaagccttatgtcccttctgaggcccagcctactccctggtctcttctttgtttctg

SEQ ID NO: 56657 - DNA, 201 bp, Homo sapiens
tgtataattaatctggtgtctctgttaccctctggaccagctgacgtatttgtttgtttgtttgtttgtttgtttttgctccatgtggagcaaaatattgtttgtttgtttgtttgtttgtttttgccccatgtggagcaaaacattgtttgtttgtttgttgtaagctccatgtgggcaaactttggctgtattgtattt

SEQ ID NO: 56658 - DNA, 201 bp, Homo sapiens
gaggcaagagaattgcttgaacctgggaggcggaggttgcagtgagctgagatcgtgccattgcaccccagcctgggtgacagagcaagactccgtctcaaaaaaaaaaaaaaaaaaaaaagactgggaagtgcctgggaaattaagccttatgtcccttctgaggcccagcctactccctggtctcttctttgtttctgt

SEQ ID NO: 56659 - DNA, 201 bp, Homo sapiens
cttctgctcatttgaaataaaagggactgaatttatacttccacctgaaacaatttatttaaaaagacaacatatgttaataatggtttgttttgttttgytttgttttgagacagagtctcgctctgtcacccaggctggagtgcggtgtcttgatcttggctcactgcaacttctgcctcccggcttcaggtgattctc

SEQ ID NO: 56660 - DNA, 201 bp, Homo sapiens
cagtgatcattgactaatcaagtcttccagccccagtctttgacacctgcaccagtgatttcaaagtttgttttgttttaccagtagaactcctttttttaaaaaaaaaaaaaaagttttttggcaaaggtaaaattatatataaaatttgtatacactccagtgcataaaaattaaaaccagagtagttttgatagaagc

SEQ ID NO: 56661 - DNA, 201 bp, Homo sapiens
catttaagctaagacctgaatgatgaaaagccagacatgtgaatattgaggtggaacattccagggagtgtaaaggccccaaggtcataaggaacttggcytccaacaggagctgagaagaccagtatagctggagcaaagcaaaaggtgagagccataggagatgaagtagaagaggtaagtaggggtcagatcatgcag

SEQ ID NO: 56662 - DNA, 201 bp, Homo sapiens
attaacttcaagtggatcatggacctaaatgtaagagttaaaactgcaaaactctttaaagaaaacatagaaggaaatcttcatgaccttggattagatawtataacaccaaaaacataaacaacaaaagaaaaaatagataatttaaacttcatcaaaattaaaagatttttgtttccacaccatcaggaaagtgaaaag

SEQ ID NO: 56663 - DNA, 201 bp, Homo sapiens
aagtcacctcggccgggcacggtggcttatgcctgtaatcccagcactttgggaggccgaggagggtggatcacgaggtcaagagatcaagactatcctgrtcaacatggtgaaaccctgtctctattgaaaatacaaaaaattagccggacgtggtagtgggcacctgtagtcccagctactcaggaggctgagacagga

SEQ ID NO: 56664 - DNA, 201 bp, Homo sapiens
ataatgttatagtttaataataagttatttttaaagtgcctaacacatagtttatgctcttctgctatgatggttctttaggttaacaacatgaaaatttrttttaacagaatgatcctagcctcttttccttgtaatctttccatttctttgttctgtaatagttcctttttcctaattccagttttataccttggcgtg

SEQ ID NO: 56665 - DNA, 201 bp, Homo sapiens
gcatgctttatttctttatttaccaattttcaatgaattggtttattagcatcctccaaaaatatttaaggaggattttgttgttgttgcttagtatcatragctcaaaacttcatacatatttgttgtgtttcactccatcacaccaattgaccttattgatgcttgaattatcccatcttttgccagaaggaaacttgt

SEQ ID NO: 56666 - DNA, 201 bp, Homo sapiens
gctaaaagagaaccatgcttattgtttttatcttaactatttttgtactacaagggtagaagtagacttatatactagaaaatttatgaaagctcctgttwtaaaaaacaattcttgaaaattcaaattttaaaaactgaggaagttacttcttctgctaagcactgctagacaatgtgtaggatataaaataagcctatg

SEQ ID NO: 56667 - DNA, 201 bp, Homo sapiens
tctgacaaagggctaatacccagaatttacaaagaaaaacaaatttacaagaaaaacacaaacaatcccatcaaaaagtgggcaacagatatgaacagacmcttctcaaaagaagacatttatgcagccaacagacacatgaaaaaatgctcatcatcactggtcattagagaaatgcaaatcaaaatcacagtgagatac

SEQ ID NO: 56668 - DNA, 201 bp, Homo sapiens
ttaccatcttaagacattaagtacatttatagtgtgtgtagcctgcaccattatccatccctagaattttttttaatcatcccaaatagaaattctgtacscattaaatataactctcctctctccaccagttccctggtaacccttatttaactttccatctctataaatttacctattataggttcgtcctgtaagtag

SEQ ID NO: 56669 - DNA, 201 bp, Homo sapiens
aaaatcacagtgagataccatctcacgccagttagaatggcgatcattaaaaagtctggaaacaatagatgctggagaggatgtggagaaataggaacacttttacactgttggtgggtatgtaaattagttcacccattgtggaagacagtgtcgcgattcttcaaggatctagaactagaaataccatttgacccagtg

SEQ ID NO: 56670 - DNA, 201 bp, Homo sapiens
tattttgaattataatgttggaataattgaaaacactcacattatatatgtttaaattataaaacattatacctatgttagttaataatattaatcttcgyaataatctctgagcccaaggatgaatgagattttcatgttctgcaatctcaagacaacctgtactacctcgtaaactttatcattatcataacagattat

SEQ ID NO: 56671 - DNA, 201 bp, Homo sapiens
gaggacttttgcattcttaagggctgtttttgaaattaaagttttattggaacacagccatgcccattcatttctgtatgatcggtattatctatggctastttcatgtttcaatagaggccacacggcctggtaagctgcaaatatttattatctggccttttttttttttttttttttttttttttgagagagagtttc

SEQ ID NO: 56672 - DNA, 201 bp, Homo sapiens
actacaccagtagtagttcttagtcacagatgttaatccaaattacctagggagccttggaaaatacatattctcaggccacacttggagcctactgaatragaacttctgaaggtgaggcccagaactttgtttaaagaaatgagactataagtatcacttgagagtcaatgatttataccagaggtctggcaaactact

SEQ ID NO: 56673 - DNA, 201 bp, Homo sapiens
tgatcttagctcaccacaacctccacctcccaggttcaagcaattctcctgcctcagcctgcccggtaggtgggattacaggcatgtgccaccaagcgcakctaattttgtatttttagtagagatggggtttctccaggttgctcaggctggacttgaactcccgatccacccacctcggcctcccaaagtgctgggatt

SEQ ID NO: 56674 - DNA, 201 bp, Homo sapiens
ttagttaagggtagtgggaaaggaaccagttataaaacagaagctataaaataaatagagtgtaaagtcttggcatcatctttggagtgatttagatttcwtcattcagtgactcatttttattcccagcatctagtgctttttgcatggcccaaaggggctctgtgctgctccactacagaggaaacttcaagaaatgct

SEQ ID NO: 56675 - DNA, 201 bp, Homo sapiens
atattttaggcggttatatttctcacagtaaattaataaattaacattctagtttacctattattgtgtaatgacctatagctctatccaaaagagtctgytccatttttaacagaatcagggttctgaactcataaagctgaggaaagtatcctggaaattggaaacttaaccaaattgctgcccttgagaagccctgtc

SEQ ID NO: 56676 - DNA, 201 bp, Homo sapiens
tagaacatctcataattgattgggcactgggtatgatactcaggaaggtgttgctcatattggaaaataattaaccttagcctgagtattgcttcagtccrgcctgacaaatcataaaggtaaaactcaagaagatcaaactacttcacaaataacttaactgcatcgaggaacaaagcccaagaagatttataggaatgc

SEQ ID NO: 56677 - DNA, 201 bp, Homo sapiens
accaaattgctgcccttgagaagccctgtctggataaccagccttctggcttcctctgatgaaatctaatttcactgcatatcttctttgatctacagtakttcatatttctatttttttctatctttcgcttttagatttctacatcgtactaaggaagaatgatttcctatttgatatagctgaaccatgcaaaaatca

SEQ ID NO: 56678 - DNA, 201 bp, Homo sapiens
ggatagatatataagatgttttcttatttaaatctgtgtaaaagataattgtgtagacaataaccgtatattgtgaggatgataacatataagtaaaatgkatgataagagtagcacaaaggcaggaagggaggaatcttaagtatactattacaaggttctcatgcatgaagtagtactatcttacttgataaggtagac

SEQ ID NO: 56679 - DNA, 201 bp, Homo sapiens
tcactccatcacaccaattgaccttattgatgcttgaattatcccatcttttgccagaaggaaacttgtcaagttgtctcctgactcttttatatactgtytgatactatttgatagctctcttggatttttgcaatttcaacatgttccaggttcatcttatatattttttgccccaaatatggaatcagctagttcttc

SEQ ID NO: 56680 - DNA, 201 bp, Homo sapiens
tatattaaaacttgtacacccgtatcaggcacttaccttgaatggagcttggaggactggaaattgctctgggtgagtcagtgagtaagtggtgaactgcktaccactgtcaacgttataaacgctgtacacccaggctacactaaatttatttaaaaatttttcattcttcagtaaagagttaaccttagcttactgtaa

SEQ ID NO: 56681 - DNA, 201 bp, Homo sapiens
gcatctcatcatagttatctcctaataaagtaaaagtaaatgaaggagagctggagacagagaatcagctgagatgtgctggaaatactcggctgggcgcrgtggctcgtgccttgtaatcccatcactttgggaggccgaggcgggtggatcacctgaggtcaggagttcaagaccaacctggccaacatgatgaaaccc

SEQ ID NO: 56682 - DNA, 201 bp, Homo sapiens
tctctgccccatccaagacagctgaacctttgaaattcccaaagaagagaggtcccaaacctggcagcaaggtaggtaaaatgtgggtttcccagaaaggrataagggattataaaggggtcattcggccaggcgccgtggctcacgcctgtaatcccagcacttaatgggaggccgaggcgggcggatcatgaggtcagg

SEQ ID NO: 56683 - DNA, 201 bp, Homo sapiens
gcagtaggtatttggagtagaatggaggtgagagtcactggaggcatggtagctggattgcctccaaggattagagcaggagttggggtggaacagtgggwagtgagctaagtaacaaaaagtcttcatttatcaaggggcagaaacccagatatctatgagtaacagtgagaaggaagagccaatggttgggtacatgtt

SEQ ID NO: 56684 - DNA, 201 bp, Homo sapiens
agtcactggaggcatggtagctggattgcctccaaggattagagcaggagttggggtggaacagtgggtagtgagctaagtaacaaaaagtcttcatttaycaaggggcagaaacccagatatctatgagtaacagtgagaaggaagagccaatggttgggtacatgtttggcctctgaagaacatgagctttcataggag

SEQ ID NO: 56685 - DNA, 201 bp, Homo sapiens
ttcatccattaactatttatttgaactccatttgtgtttggcatggggaagcaaaaatcagtcactttttatcttcaaggtattatggtgagagagacacktaaacagataattattaaacaatgtcttgagtgcagtgacagacatatgctttgggtaatatgaaaattacaagaaggaatacctaacccaagcttggtg

SEQ ID NO: 56686 - DNA, 201 bp, Homo sapiens
ccctcattcactttgttctgatacattggccttcctgctaaatcctacatgtgctatttgctcttctgcctcaaggtctttgctcaaatttcatcatttcrgagacatctctcctaatcaccatataaattagcaacttcctaccacctgccctcatggagtttatattctaatgggagtaggctgacagacaagcatata

SEQ ID NO: 56687 - DNA, 201 bp, Homo sapiens
tctcactgtaacctcgcacagccaaaggggcaagggagctctctgcaccgtgtttgatgagagtactaatctcattcatgagggctctgcccagaggtccyacctcctaatatatattatcatgtgggtagggaggggtaggatttcaacatgggaatgttgaggggatacatattcagtcagtagcatgtgtgtatttat

SEQ ID NO: 56688 - DNA, 201 bp, Homo sapiens
gcatgtgtgtatttatatatactatcatatatatgtgtgtataatatcatgtatgtatgtatatatggtatctagcctctgattagaggaattatctaagrtggtccaagaaagacacattcttgcatatacactctctccccatatcttctctctgttctccagagcctctctgcacttggtttctctcttagcatcaca

SEQ ID NO: 56689 - DNA, 201 bp, Homo sapiens
gcttgcagtgagccgagatcacgccactgcactccagcctgggggacagagtgagactccgtctcaaaaaaaaaaaaagaaaagaaaagaaaaaaagtcayctcagcggagagagctttcaggaaggctgaatcatgggaagaagcctgtggtgcccctccccccaccccaacccgagcagggcagcaaaatggaatctaa

SEQ ID NO: 56690 - DNA, 201 bp, Homo sapiens
gagccgagatcacgccactgcactccagcctgggggacagagtgagactccgtctcaaaaaaaaaaaaagaaaagaaaagaaaaaaagtcacctcagcggrgagagctttcaggaaggctgaatcatgggaagaagcctgtggtgcccctccccccaccccaacccgagcagggcagcaaaatggaatctaaagggctctc

SEQ ID NO: 56691 - DNA, 201 bp, Homo sapiens
aaatcacagtgagataccatctcacgccagttagaatggcgatcattaaaaagtctggaaacaatagatgctggagaggatgtggagaaataggaacacttttacactgttggtgggtatgtaaattagttcacccattgtggaagacagtgtcgcgattcttcaaggatctagaactagaaataccatttgacccagtga

SEQ ID NO: 56692 - DNA, 201 bp, Homo sapiens
aatcacagtgagataccatctcacgccagttagaatggcgatcattaaaaagtctggaaacaatagatgctggagaggatgtggagaaataggaacacttttacactgttggtgggtatgtaaattagttcacccattgtggaagacagtgtcgcgattcttcaaggatctagaactagaaataccatttgacccagtgat

SEQ ID NO: 56693 - DNA, 201 bp, Homo sapiens
tgtaacatatgatttgtatgtgtgtgtgtatatacatatgtattttccaagcactgttcattgaaagggcctagaagcaattacatctcagtagcaatgaygacaccttgattttggtttctaaaaatcacctgatacacctgtaatcccaacactttgggaagctgaggcaggaggatcccttaagcctaggagttcgag

SEQ ID NO: 56694 - DNA, 201 bp, Homo sapiens
tgtgcaggttagttacatatgtatacatgtgccatgctggtgtgctgcacccactaactcgtcatttagcattaggtatatctcctaaagctatccctccyccctcccccaccccacaacagtccccagagtgtgatattccccttcctgtgtccatgtgttctcattcttcaattcccacctatgagtgagaatatgcag

SEQ ID NO: 56695 - DNA, 201 bp, Homo sapiens
agctggacatggtgtcacgcatctgtggtcccagctacttgggagactgaggtgggagtatccccttgagtctgggaggtcgaggctgcagtgagccatgmtcatgctattgcactccagcctgggtgacagagtaaaacctcttctcaaaaaaaaaaaattaaagttggagggaagaaatctcctttacagaatgccagc

SEQ ID NO: 56696 - DNA, 201 bp, Homo sapiens
tttgctttttcttgttttttattttattttatttattattattattatactttaagttttagggtacatgtgcacaatgtgcaggttagttacatatgtayacatgtgccatgctggtgtgctgcacccactaactcgtcatttagcattaggtatatctcctaaagctatccctcccccctcccccaccccacaacagtc

SEQ ID NO: 56697 - DNA, 201 bp, Homo sapiens
cattgtgttttaccccaaggccaggtaggtaaggaccacatatgtggttgacgtgcccaccaaatcatgtggagttacggtggggttttttttgtttttgttttttttttgccctaaagggaaaaaaaagctgggcaagcaaaaaggaagtgatggcagttttagattgagtgataggaaagtccacattgctgttgatat

SEQ ID NO: 56698 - DNA, 201 bp, Homo sapiens
gcagccttgacctcctgagctcaggtgatcctcctgccttaacctcccaagtagctggaactataggtgcacacaccaccacacctggctaatttttatattttttttttttttgtagagatggggtttcaccatgtttctgagtctcaaactcctagagatgggggtctcactgtgttgtccaggctggtctcgaactct

SEQ ID NO: 56699 - DNA, 201 bp, Homo sapiens
tttctccctgtgtgcggagacaagagagtgtagaaataaagacacaagacgaagagataaaagacagctgggcccagggggaccactgccaccaagacacrgagaccagtagtggccctgaatgccaggctgcgctgatatttattggatacaagacaaaggggcagggtaaggagtgtgagccatctcccatgataggta

SEQ ID NO: 56700 - DNA, 201 bp, Homo sapiens
actgccaccaagacacggagaccagtagtggccctgaatgccaggctgcgctgatatttattggatacaagacaaaggggcagggtaaggagtgtgagccrtctcccatgataggtaaggtcacgtgggtcacgtgtccactggacagggggcccttccctgcctggcagccgaggcagagagagagagaggagagagaga

SEQ ID NO: 56701 - DNA, 201 bp, Homo sapiens
ggggtttcgccatgttggccaggctggtctcgaactcctgacctcaagcatccgtcagcctcagcctttcaaagtgctgggactacagacgtgagccaccrtgtctggccatgttacctgcctaacgtcttaaagggaaaataaacattaaggcaaaatagaggagattcagatcagggtaaaattttaacgtcaaattca

SEQ ID NO: 56702 - DNA, 201 bp, Homo sapiens
ctccctttcccggtctctaagtaatgggtgtttttccttgacactgacgctaccactagaccacggtccgcttggcaacgggcgtcttcccagacgctggygttaccgctagaccaaggagccctctggtggccctgtccgggcataacagaaggctcgcactcttgtcttctggtcacttctcactatgtcccctcagct

SEQ ID NO: 56703 - DNA, 201 bp, Homo sapiens
atagcaaaaaatctgtatctaaatttcctacttttcttataatgtagcctaattgttaataattagagatctcagtactttacaggtaataaatgttcttytccttcctccccacctaccttttttacagatggagaaattagcatacaaagaaactgacttgtcagaagtcagagcaaggtattggtggatccagggata

SEQ ID NO: 56704 - DNA, 201 bp, Homo sapiens
tatgtcctttaagcttctttaaatctacaagttcttatctgctctaatttttcttgcagtttatttgtttaaaaacctaagtcatttgtcttttaaatttyctaaaattatattttgttgattgtattcttgtggtatcattcaacatgtttctgtgtcctctagttcctaaaattggtagctaaatgtagagacttgatc

SEQ ID NO: 56705 - DNA, 201 bp, Homo sapiens
cagctccaggctgcttaaggtcaaatattgagactttgatgtccacatttacttatggcctgaagatgccttctcagaaattagttcagaaggattttttrgtagcttatgaagcagcaattatccccagaggaatatattagactataaggtcccatagattagattatatggtcccagcttccagtaatctctgtttac

SEQ ID NO: 56706 - DNA, 201 bp, Homo sapiens
ctgcttccctgtagtgaatgctttgtcgaatgcctccaatcaaaagactacattttgtgaaatccctgctgagcattccagtagcatgtaagctagaacargggtcttttatctgatttgtttagtgatatatctccagtgcctagaataatgactgacaaacagtggtaataaatatttgttgaatgaatgaatctaaac

SEQ ID NO: 56707 - DNA, 201 bp, Homo sapiens
aggctgagataaagtgcccaaggaagagcctctcctcccccatcctgagggctgaggtatagggctgtgttctctcaatgacagagaaatcactgtggtgytatgttggtggaacttgctaggaactcccctctatggtgctcaggaaagctgttcgttgagagatatctctctacagtaactctactatgaaaccaccca

SEQ ID NO: 56708 - DNA, 201 bp, Homo sapiens
tggcataaactatacggaaatcacgcaagactttgatactaaaagtctaaatgatgctaaaagcactgagtccaggaatttgagaccagcctgggccaccygtagcaagaccccgtctctagaaaaaatttaaaaattagctaagagtggtggcacgtgcctgtagtcgcagctacttgggagaccgaggtggaagaatcg

SEQ ID NO: 56709 - DNA, 201 bp, Homo sapiens
agagcggggctggggaagagagagagatgcaatgggaatattattcagccttaaagaggaaggaaattataacacatgctacaacataggtgaacctcgamgacatgctaagtgaaataagccagttataaaagcacaaatattgtatgatttcacttagatgagacatctagagaagtcaaatatatagagacagaaagt

SEQ ID NO: 56710 - DNA, 201 bp, Homo sapiens
gatggtgaaatgtgggtcgatctagcatatattaagtgggaaagccatcaagacttgctgattaattgggtttggtgggtgatagaaagggaagaatcaakgatgacttctagtcttttaggtctgagcacctgggtttaataaggggtgccacctattaaactgagatgggataactggaggaaagaacaagtttggagg

SEQ ID NO: 56711 - DNA, 201 bp, Homo sapiens; identical to SEQ ID NO: 37952

SEQ ID NO: 56712 - DNA, 201 bp, Homo sapiens
acactggccaatgttgctgcaatgtaatagaaaagggagaagtcataacacataagatagagaggtggcatgagtccaatcccatatggctttgtaaagcrcccttaattgagtatgaagctattggaggtccttcaggagagaaatgaccttatctgttttatgttttaaaatactcactctgacctagtattagggttc

SEQ ID NO: 56713 - DNA, 201 bp, Homo sapiens
cataggtgaacctcgaagacatgctaagtgaaataagccagttataaaagcacaaatattgtatgatttcacttagatgagacatctagagaagtcaaatrtatagagacagaaagtacaatagtagttgccaggagctgagggaggaggaggtgaagaggttgataataggtacagagtttcagttggggaaaatgaaaa

SEQ ID NO: 56714 - DNA, 201 bp, Homo sapiens
ccaagaatcatctgcttaaaatcgaccagaatatagcatcagaatggcacattttcctgcttccagcatatttttatatagaaaacatagaccccaggagstaggaggtcagcactgtcatataccagttacaacattcataactacagtagaacttattacaaaccagaggaaatatgtctaatttttttcccagttttc

SEQ ID NO: 56715 - DNA, 201 bp, Homo sapiens
acatgatatatagaagaacaaagaatgacagcaacttctcgtcagaaacagtgcaagccagaatacagtggagcagcatttttaagttctaaaaggaaaasaagttgttaagctagaattctataccaagcaagaatgtctttcaaaaataaaaatgaagacatttgcagaaatataaaagcttagagaattaatcacaag

SEQ ID NO: 56716 - DNA, 201 bp, Homo sapiens
cctttataaacttggggtggggaaagcctttttaaatatgattcaaaatctagatagaccgacaaatttgactttttaaaacatttttaggggaaaaaaayactccaagcaaagctaaaagacaaatgataaatgggagaaaatatttgcaacataaggcacagataactctccctaattcataaagaacactcataaata

SEQ ID NO: 56717 - DNA, 201 bp, Homo sapiens
aatcagattatttgttgttttgtgttttgggggggagttttttgttttttgctgttgtttgagctccctgcatgttctggatattaatcccttattggatkaatagcttacatatatttctcccattctgtactcttttccctctgttgattgtttcctttgctgtgcagaagctttttagtttgatataatctcgtgatg

SEQ ID NO: 56718 - DNA, 201 bp, Homo sapiens
gaaatctcctttacagaatgccagccaataaatatagaaggaatgaggctgggcaaagtggctcacacctgtaatcccagcactttgggaggccgagatgrgtggatcacatgagcccaggagtttgagaccagcctgggcaacatggtgaaactctgtccctacaaaaaaatacaaaaattatctgggcatgatgacaca

SEQ ID NO: 56719 - DNA, 201 bp, Homo sapiens
gggatccaaaacctgtatttgttattgcttctcaagaagtgaggcagtgagtctatccgttgaattttctaatggggtaaaagttactgtaaagggtattraattaggtttgcctatgctgctagttaagtctcaacactaagagcatcctgcttctgaattacctagcacttatgtaactcaggagtagttcttgtattc

SEQ ID NO: 56720 - DNA, 201 bp, Homo sapiens
tcagtagtagaatgaaccaggctaaatctagatctttcatctcagtttcttgatacagagaaaccatgtttaccctcaagtttgtaattctgtaggattcrtacaagaccctagataatgccatggatttataactccctcagtttttaaaagataagaatctgagactttagagaggatttacagaatggtttatggatg

SEQ ID NO: 56721 - DNA, 201 bp, Homo sapiens
cagcagaaaaatggctaaataaaatacagactggctgataagcctaaagagatctttgactttattagtaatcaaagaattgcaaataaaattataatagyattttattttttcactgataagatttgtcaaaattatggaaattgttaaaacacagttttagcaaatatgtggtaaacacacctgtgtactttcggtagg

SEQ ID NO: 56722 - DNA, 201 bp, Homo sapiens
tctttcatttgtaaggatggaataataaattgtaatgttttatttttctaacagcaaacaatgatgaaatgtattcagtccttgctttagggccctgtcamctagaagcaaactcttcattaaattctgataacgcctttaaaccttgacttcagaaaatagtcatctcatttgccctatggactaactgtctagtcatgt

SEQ ID NO: 56723 - DNA, 201 bp, Homo sapiens
taacaccaagcatgaaacagttccaaatgttgccaaaattctagtgcccttatgtagatcagaaattgtgtacccataccattgctggctatggctatatwctactcttctgccaagcttctctgttcttgggcagttcttgtgaaaatagcaccctaaatgagcagatttcctgggggaggtccaaccaagtgatggagc

SEQ ID NO: 56724 - DNA, 201 bp, Homo sapiens
atggccaaggcagaaggagggaagtgacatttggaaaggttccagagagagagaatgacttttgaactgaatcttttttattgtttaagtttttttaagasacagagttttgccgggcgcggtggctcatgcctgtaatcccagcattttgggaggccgaggtgggctgatcatgaggtcaggagatcgagaccatcctgg

SEQ ID NO: 56725 - DNA, 201 bp, Homo sapiens
ggctcatgcctgtaatcccagcattttgggaggccgaggtgggctgatcatgaggtcaggagatcgagaccatcctggttaacacggtgaaaccccgtctytactaaaaatacaaaaaattagccaggtgtggtggcgggtgcctgtagtcccagcaactccggagtctgaggcaggagaatggcttgaacgtgggaggcg

SEQ ID NO: 56726 - DNA, 201 bp, Homo sapiens
accctcccaaagtgctgggattacaggcgtgagccaccgcgcccagccatctttcctcttaatattgcttttgctgtatcccataggtttgggtatgttaygtttctattttcatttgtttcaagaaactttaaaattttctccttaatttcttcattgacccattggttattcagaaacatgtttaatttgtttcttttt

SEQ ID NO: 56727 - DNA, 201 bp, Homo sapiens
tctactaaaaatacaaaaaattagccaggtgtggtggcgggtgcctgtagtcccagcaactccggagtctgaggcaggagaatggcttgaacgtgggaggmgggaggcggagcttgcagtgagccgagattgtgccactgcactccagcctggatgacagagccagactgtgtctcaaaaaaaaaaaaaaaaaaaaaaaaa

SEQ ID NO: 56728 - DNA, 201 bp, Homo sapiens
atttgttctccagaaggggcttatagcacacacttccagcagctacttggcagcctggcttctaatgaacttacattcgggagctgatgggaaaacaaacrgtagccctctagctaatctcagtgataaatccaaggctactcattcttcctggaaggagtttcgtcatgtctcaagtgccacaacttctataacttccac

SEQ ID NO: 56729 - DNA, 201 bp, Homo sapiens
tcatttcatttgcccagccactattggggaggttcggggctcagaggtgcttgtcacttttgatgggtggcgaggggcctttgactactggtgccgcttcractcccgagacatcttccctgtgggctggtgttccttgactggagacaacctgcagcctcctggcaccaaaggtaaaggcccatctacgtgctcttgaaa

SEQ ID NO: 56730 - DNA, 201 bp, Homo sapiens
tctggtcccttgtaacattgacatctttcaacggtctgcttaggcagtgtgtgaactgataaaaaaaaaatggtaaaggttagtaatctcttatctgtccscaaagccatatgagtgagacctcagctgttcattttgttatcatgaaaagcttttattaggtgactcctgtttatagatgatgacatgcattcaaatctt

SEQ ID NO: 56731 - DNA, 201 bp, Homo sapiens
ctgctattatagttatattctatattataactatatcatattatactatatgattattacaatatgctatattatcattattataaaactaaccactaccwatgagagagtatatataaagtactagaatagtgtcacagactaaatgaacaataaaatgatacagatgatgacagtggagaagatccagaatagattttg

SEQ ID NO: 56732 - DNA, 201 bp, Homo sapiens
aaaactaaccactaccaatgagagagtatatataaagtactagaatagtgtcacagactaaatgaacaataaaatgatacagatgatgacagtggagaagrtccagaatagattttgaggtagctgcttttagtaaagataataataataatctcatcctcttaagtctaaaaagtactggtgaatctgagggaatgaaaa

SEQ ID NO: 56733 - DNA, 201 bp, Homo sapiens
ggtttctttgtacaaagcaaaaatttcaaaatcggactcaacatcgtggctcacgtacaggattcttacactggtctggagggtaataatttgatgcttaraaacaaaactttcagaatatcttttcctttttttatttggaaagtgctttccatacttaaagaatgttctctttttgttttaaaaccacatacgaaatta

SEQ ID NO: 56734 - DNA, 201 bp, Homo sapiens
cagtgagctgagattgcgccactgcactccagcctgggtgacagagtgagactccatctcaaaaaaagaaaaaggaaaaaagaaaatggctagattgtagkgtgtaagtagaggagcagaaagagataaggcacagcagaggaaggcgcagaatgcttccctcatagaccatcttaaggatctggatttttaccttatgag

SEQ ID NO: 56735 - DNA, 201 bp, Homo sapiens
ccaggtgagagagaaaattgaagcagtgacatggtggtgaggataagatggggtggggggcatattctttgaataaagaagacaaaatgcaagttcttaawgtgtatcacctattgtgactattttatttatttaacaaacaagccctgtaccatgtaaaataatgccaagttttcagtgtaagtatttatgaggagctaa

SEQ ID NO: 56736 - DNA, 201 bp, Homo sapiens
tagattaatggtttctagggactgggctgagagggtaatggggaatgactccactggggcagggggttcattttgaggggattctggaaatgttataaaawtagatagggatggtgtttacacaactctgagaatattctaaaaatcattgaattgtataccttaaaagggttaattttctgttttgtgatttaaacatat

SEQ ID NO: 56737 - DNA, 201 bp, Homo sapiens
gatttgtttccagagcccatattcactcacctctcagttactaaacacatgtacacctctacacctggaccaccccctgcccttccacccagctttttttyctaataagccacaacaaccaggagggtgtggtctctacaggtttggcagctaatatacccctcttgtctcctgagaaggtgtgttcactagccactagtt

SEQ ID NO: 56738 - DNA, 201 bp, Homo sapiens
tccatggaaacagaaagtagattaatggtttctagggactgggctgagagggtaatggggaatgactccactggggcagggggttcattttgaggggattmtggaaatgttataaaattagatagggatggtgtttacacaactctgagaatattctaaaaatcattgaattgtataccttaaaagggttaattttctgtt

SEQ ID NO: 56739 - DNA, 201 bp, Homo sapiens
agcacgtagtagatgcccactgtgcgttagttgcatctgaatcaagatccccaggcctcccaagaaaagggaactgcacgcagagccaggaaagtgctctrttttggtcaggaaaaataaatatgagatgaggcttctgcagtgaaccagtactctcataactgattttttcttggttatatgcttgtggtacacaaatag

SEQ ID NO: 56740 - DNA, 201 bp, Homo sapiens
cctgggtgacagagtgacaccctgtttctaaaaaagaaaagaaatgaatttgagacattcgggagacagtttctctggaaaagacattcttttttgagccrcattcctttaagctttcagtactagaggatcctaaaactagaagcagactaagatcaaatgctagggaaaccgtggacttgatgccaaactaagcaaaaa

SEQ ID NO: 56741 - DNA, 201 bp, Homo sapiens
taataaattaattaatatactattagctattatgtagttcatattagaatttcccctagttgtcacactaatgtcctttatagctgttgtttcctaatccrggattcaataaaggatcatccactgcatttaattctcctgtctctttagtttcctttatctagaacagttatccacctttttttttctatctttcacgac

SEQ ID NO: 56742 - DNA, 201 bp, Homo sapiens
tccgggattcaataaaggatcatccactgcatttaattctcctgtctctttagtttcctttatctagaacagttatccacctttttttttctatctttcaygacgtgacattggcattttgaataatccaggccagttgttttactttaggtcatcaaatatttacaaatacttactctgtgcccaattctatactagact

SEQ ID NO: 56743 - DNA, 201 bp, Homo sapiens
catagacaagaaggtgaaagagaccttataagctgcatggtatgtggaaagagttatatggcttatatatatatggcttatatatatatggcttatatatrgggattaagagtcctgattcaagtcccagtttgccactcagtggttctgtgatttaggcaaggagttgccgtgaatgatttctaagatctcttctcactc

SEQ ID NO: 56744 - DNA, 201 bp, Homo sapiens
aggttttaaaggatgagtagacgttttttaggtagactgaggaggtgaaagagggggcgatccagatggaaggagtcagcatatgtagtgtttggaactgyataaatcgtttattactgctgtgtattaaggttaagaagagctgactaaaggtgaggctagagggtaggcaagggctggatcatccgaggatgatttttg

SEQ ID NO: 56745 - DNA, 201 bp, Homo sapiens
aaatccgtattgtttatgtgacttgcaagcaggtcaaaaagatacctgaattttaaatactctgtgggggccagaccatctgatccctgcagccatttctrtgatcccctggctgatccttttctatggagggaacttctcctcacctaacccatgctagattgctttctttcagtaccagagtctctgagaaaagaaaaa

SEQ ID NO: 56746 - DNA, 201 bp, Homo sapiens
ttcactggaacaactcacagaacttaggaaagtgctgttcttattattacaggcttattataaaagataaatcagggacagccagatgaagagacacttargatgaggcctgggagaatctcaattgcagaacttctgtgccctccttccatggaattggggcacatcacccttctagcatgtcagtgtgttcacaaatta

SEQ ID NO: 56747 - DNA, 201 bp, Homo sapiens
ccatacgaactttaaagtagtttttttccaattttgcaaagaaagtcattggtagcttgatggggatggcgttgaatctgtaaagtaccttgggcaatgtgccattttcacgatattgattcttcctatccatgagcatggaatgttcttccatttgtttgtgtcctgttttatttcattgagcagtggtttgtagttctc

SEQ ID NO: 56748 - DNA, 201 bp, Homo sapiens
gggctgagacgatggggttttctaaatatgcaatcatgtcatctgcaaacagggacaatttgacttcctcttttcctaattgaataccctttatttctttytcttgcctgattaccctggccagaacttccaacactatgttgaataggagtggtgagagagggcatgcttgtgccagttttcaaagggaatgcttccagt

SEQ ID NO: 56749 - DNA, 201 bp, Homo sapiens
aatctgtagattgctttggatagtattgccatcttaacaatattagtctttcagtccatgaacacagaacagagtatcttttcatttacttacatcttctktaatttctttctgcaatattttgtagttttcagtgtacaagtctttagccgtgttagttaaatttattcctaaatattttattctttttgatactattta

SEQ ID NO: 56750 - DNA, 201 bp, Homo sapiens
ttcatagctagcatatagaaatgcaactaaactttgtgtgtgactttgtatcccgcaactttgctgaattcatttattagctctaatagcttttttgtggratctgtagaatttcctacatataagagtatatcatctgcaaacagagatcattttacttcttcctttcaaatctgaatgcctttaattcctttttcttgc

SEQ ID NO: 56751 - DNA, 201 bp, Homo sapiens
ttcctaaatagtagcaaaggatgatgatgaaggaaaaggaagcagcaacataaattaacattgactgagtgtttactatgtgccaggtactgttctaagtggtgtgtgtgtgtgtgtgtgtgtgtgtgtgtctcctatttaatcctctcaacaactaaatgagataattgctattattgtctttattttgctgcggaggaa

SEQ ID NO: 56752 - DNA, 201 bp, Homo sapiens
tcctaaatagtagcaaaggatgatgatgaaggaaaaggaagcagcaacataaattaacattgactgagtgtttactatgtgccaggtactgttctaagtgktgtgtgtgtgtgtgtgtgtgtgtgtgtgtctcctatttaatcctctcaacaactaaatgagataattgctattattgtctttattttgctgcggaggaaa

SEQ ID NO: 56753 - DNA, 201 bp, Homo sapiens
ccatccaagacagctgaacctttgaaattcccaaagaagagaggtcccaaacctggcagcaaggtaggtaaaatgtgggtttcccagaaagggataagggwttataaaggggtcattcggccaggcgccgtggctcacgcctgtaatcccagcacttaatgggaggccgaggcgggcggatcatgaggtcaggagatcgag

SEQ ID NO: 56754 - DNA, 201 bp, Homo sapiens
cctcttctttaaaaaaaattgaatacctactaagtgtcagactgtattaaacaccaatacatacatatcccatgattttcacaaaaccctaagagataaayagtgttaatgttattttatagtaaattgagacttacagatgtaaaatgatttttctaagatcacatggctagtaaatggcaaaagctacagagattggcc

SEQ ID NO: 56755 - DNA, 201 bp, Homo sapiens
tgatataatatattcttatacaatatctattaagatgaaaatacacataaactacaatctagcaattccactcctaggtatataccctttggaaactctcyaatgtatgcataaagggatgttcaaaaatattcatgcaacactgctacagcaaaaaatttgaactagtctaaatgcctgtcagtaaaagaatgaaaatat

SEQ ID NO: 56756 - DNA, 201 bp, Homo sapiens
aatgtaatcctagactacagagagaaaaactaggatagaggcaagaataatacaacttaaggctaacttgtaggtctcaacatgaggtcacctgatagacygatcttcctcatccatccatttattcaaattctaactatcaagtcatgattaagtactagtcattggctcagttgatggagattctgccgttagtgttta

SEQ ID NO: 56757 - DNA, 201 bp, Homo sapiens
aatgatcaatggtgcaactattctaaatccaatgacatacatacacacacacacacacacacacacatatgcccttgctaatattgccattgccccacagygccttacacatatatggtaagaggtacaaagaatatgtgaggcaaccaagtacaaaaaaatggaagtacgtacaagaggggaattgtctagattttcttt

SEQ ID NO: 56758 - DNA, 201 bp, Homo sapiens
aggcagagacagaggtcgacggggcggcgtggcccccaccgagagctggggcgcctagggcccggagctgtcagcagcgtcctgggggctgggccccggcyggccgactcacgtgtgccgcctgccccagtgccccgccggaaacgggcagggagagcggccccgcaccgaagtgagccacagcggccctgggggccagac

SEQ ID NO: 56759 - DNA, 201 bp, Homo sapiens
tcccaacactttgggagaccgaggtgggcagatcacttgaagccaggagttcaagactagcctggccaacatggcaaaatcccatctctgctaaaaatacaaaaaaaaaaaatcagtggggcatgatggcatgcactacttgggaggctgaggcacaagaattgcttgaacccaggaggtggaggttgcagaggagtgcag

SEQ ID NO: 56760 - DNA, 201 bp, Homo sapiens
gcacaagaattgcttgaacccaggaggtggaggttgcagaggagtgcagtgagttgtgccactgtattccagcctgggtgatagagtgagactctgtctcaaaaaaaaaaaaaagtatttgcaatcttcttttctggcactgtcctaccaaagagagcctcgtctgatcagccttgtcaggactaggaccccccagagctt

SEQ ID NO: 56761 - DNA, 201 bp, Homo sapiens
ctcaaaatgggaccctgttagtcatttttcctggaaaataggagtcagaaccctcatctgcagaaggaggtgggatatggcttaggtattatggaccctcrgacttatcttttcagaaccacttctaggaaagggtttcaacaattagcctccttgatataaaggtaaatagctgtctaatcctagattttactttgagct

SEQ ID NO: 56762 - DNA, 201 bp, Homo sapiens
cccaggccacccatacttctgaccagctggctacaaatctgaggggttcccatgatccctttcaggtttgacaattcactggaacaactcacagaacttargaaagtgctgttcttattattacaggcttattataaaagataaatcagggacagccagatgaagagacacttaggatgaggcctgggagaatctcaattg

SEQ ID NO: 56763 - DNA, 201 bp, Homo sapiens
tctcctgagtcatggagaacatactacttcctctgtagctcttttaaatggatgcagcacattctcctgcacccctcccatcccaaagaagagaggtgaarataactgtatttttttattctccactatatctggaccattacttcttcatcttcttaaaacccctgtgctctttggctatacacacccttggtttctgat

SEQ ID NO: 56764 - DNA, 201 bp, Homo sapiens
actccatatggggaggagaaggatccctgtcaccttctcctctcttcacggggcccttttgcagccctaggcctcatctgtgggaagggagtccctggctyatactgcccccaccacagctccttgccctggccagaactgctgtcgaagaaaatcaggccggaaggccaagaaggcgctaagggggatgggagggcaggt

SEQ ID NO: 56765 - DNA, 201 bp, Homo sapiens
caagctctcctaccacattgaccggctgaagcagggcaagttctgaaccaggagaggcagcctagacaaccaagtggcagcaggtgggggcattcttctargaatgaggggcatcagcccaccccaggcacctcagtggggttccgggccacctcaggactccaagaggctgtgtggagccaccactcctagccacagctg

SEQ ID NO: 56766 - DNA, 201 bp, Homo sapiens
tgtaactaatgttctggttgaaatatattcaaaatgcattgggcatggtaactcacacctgtaagtccagcactttgggaagccaaggtggtcaaatctcytgagcccaggagtttgagaccagcctgggcaacttggtgaaaccctgtatctgcaaaaaatacaaaaataagcttggcgtggtggaaacatattcaaagt

SEQ ID NO: 56767 - DNA, 201 bp, Homo sapiens
tttaatttctagggtacatgtgcacaatgtgcaggtttgttacataggtatacatgtgccatgttggtttgctgcacctattaacttgtcatttacattargtatttctcctaatgctatccctcccccagccctctaccctccgacaggccctggtgtgtgctgttcccctccctgtgtccaagtgttctcattgttcac

SEQ ID NO: 56768 - DNA, 201 bp, Homo sapiens
aatttttaaaacttgtcaaaattgggaatgattgtatgtggaattattttaaagagcagaaagaaaaaaaacaggggtcttgctatgttgtcaggctgttstcaaactcctagtctgaagtaatcctcccacctcggccttccaaagtgctgaaattacaggcgtgagccatcatgcctggccctaaactgaatcttaaag

SEQ ID NO: 56769 - DNA, 201 bp, Homo sapiens
tgtgatagtttgctcagaatgatggtttccagcttcatccatgtccctacaaagggcatgaactcatcctttttcatggctacatagtattccatggtgtrtatgtgccacattttcttaatctagtctatcattgatggacatttgggttggttccaagtctttgctattgtgaatagtgccgcattgccaatcttattc

SEQ ID NO: 56770 - DNA, 201 bp, Homo sapiens
taaagagcagaaagaaaaaaaacaggggtcttgctatgttgtcaggctgttgtcaaactcctagtctgaagtaatcctcccacctcggccttccaaagtgytgaaattacaggcgtgagccatcatgcctggccctaaactgaatcttaaagattgagaaggaattcaccagatagagggtgaggagatgaaagaagccct

SEQ ID NO: 56771 - DNA, 201 bp, Homo sapiens
ccacctgcatataggtagtatcacctctattttatacataaagaaactgagactcagagatagctggccaagattatgcagtttataagtaataggacttrgtttcaagcccagaccagcctgacttcaaccccagtcctcttttcatttcaccatatatgtgccccacagcagtgttatgtaattctgagactttatcag

SEQ ID NO: 56772 - DNA, 201 bp, Homo sapiens
aattctgagactttatcagtacaggaggcaaagtttacttgcaggaattgacacatatatttttagtctgaatatatcttctatctcaccaaacaatgtcrgcaaacaaaagatccctggttagaagaatgaaatggtttagcaaatcaaagtcatatttattttttaatttgagcagatatatgactagattcctcgtta

SEQ ID NO: 56773 - DNA, 201 bp, Homo sapiens
tttcatcagggactggatgactataggagggatcttttagggagagggaattagaagtattgggtagatggttgggttaaatggcctttaagatcattcaraactcaaaaactgattctgtgattgcctctgctctgctccctcaggaagtcttgaacgtagtaaccaaagtcctttttctttccagccttcttgaaagca

SEQ ID NO: 56774 - DNA, 201 bp, Homo sapiens
gtaaccaaagtcctttttctttccagccttcttgaaagcagtcattctcatcttttcctgtgttttatgtcctagcatttgatactcttaattctccttcrtgctcttttgcctacccctacaagtgtatatgccttccacttcacctgtgagccttatatccctttttgtttgttttgctttgatttttgaggcagggtc

SEQ ID NO: 56775 - DNA, 201 bp, Homo sapiens
agatttggtgtctgatgaggacccacttcctggttcatagacagccatcttctcactgtaacctcgcacagccaaaggggcaagggagctctctgcaccgtgtttgatgagagtactaatctcattcatgagggctctgcccagaggtcctacctcctaatatatattatcatgtgggtagggaggggtaggatttcaaca

SEQ ID NO: 56776 - DNA, 201 bp, Homo sapiens
aaggatctggatttttaccttatgagcatcgagaactgtattaggctgttcttgcattgccataaagaaatacctaagactgggtaatttataaagaaaaraggtttaattggcttagagttctgcaggctgtataaacacggtgctgcatagcttggcttctggggaggcctcagggagcttttactcatggtagaaggc

SEQ ID NO: 56777 - DNA, 201 bp, Homo sapiens
ccaggctggtcttgaactcctggcctcaagtggtccgcccagcttggcttcccaaagtgctgggattataggcatgagccaccgcgcctgggccctagccttttttttttttgctatgagcgtttggccatgccctattgaattttgtgtctgtgtgttatatatatataacaaaatttattatttcatcctctttttttt

SEQ ID NO: 56778 - DNA, 201 bp, Homo sapiens
ctttaattattttttaattgtggtaaaatatatgtaacataaaatttgccatttcaactatttttaacagtactaagtatagtcacattgctgcgcaaccmtcatcaccatccatctccagaacttgtttcattttgttaaactgaaactctatccattaaacaataattatacatcccattgtggagtcccaataagtaa

SEQ ID NO: 56779 - DNA, 201 bp, Homo sapiens
tttgttttattttaattgaatttgtctgctctttcagttttatgagtgacctttaagtaatctcttattgccaagagaagctgtttgccctctggaaaaartataagatttagggtcatttgaccaagatattctaatcctaaatccagtgattactagctgtgtgacctttataagtcatataaagtctctaaatctttt

SEQ ID NO: 56780 - DNA, 201 bp, Homo sapiens
ctgacatttgtcctatgtaccctgcagaattgtgagggccaaatgaagtggagggtatgaaagtgcaggtaaaccccagaaacaacaaatgcgggtaaacyctacaacagaacttgtgctatttactatcagctctatgactttacaccagttaaattatttgtacctcagtttattcacctataaaatgagaatattaat

SEQ ID NO: 56781 - DNA, 201 bp, Homo sapiens
acaaatggtgacaaaactcgtcaatacccataggacagttatcaattgcattacctgggcacagtttgcatttcagtggacaggaattatttgcattactrtgagttttcaacaagctgacatctttcttgacaaagctgtgaaatagcctaattaaagagagaccaagtaacacatctctatacaatcaggtaatcctgg

SEQ ID NO: 56782 - DNA, 201 bp, Homo sapiens
tgaattttgtgtctgtgtgttatatatatataacaaaatttattatttcatcctcttttttttttgtttttgtagaaatggtatcttgctatgttgcctargctagtcttgaactcctgggccaaagtgatcttcttacctcagccacccaaagtgctgggcctattttaaccatttttaaatgtacagttctgtggcatt

SEQ ID NO: 56783 - DNA, 201 bp, Homo sapiens
cctaaatagtagcaaaggatgatgatgaaggaaaaggaagcagcaacataaattaacattgactgagtgtttactatgtgccaggtactgttctaagtggtgtgtgtgtgtgtgtgtgtgtgtgtgtgtctcctatttaatcctctcaacaactaaatgagataattgctattattgtctttattttgctgcggaggaaac

SEQ ID NO: 56784 - DNA, 201 bp, Homo sapiens
cctaccaaagagagcctcgtctgatcagccttgtcaggactaggaccccccagagctttggagcatgatgctttcagtacatctcattaggataagatttyatgacttgccatcagtccagattttcagacccttcaactcagaatctacgtctcagtgttcttagcattgctgaaaggaagagacactcaatggtttgca

SEQ ID NO: 56785 - DNA, 201 bp, Homo sapiens
ttctctctaagatttctgctttccattacaccaaaagttgatggtattagtcctggttccaacctgtgtcaagatggcattggaaaaggactgagtatgcytcatggttttcttctcctcttatacaccagtttaccttgttcagatttcaaaaacatagcacaagatatgttccattaaaaagatatgaactttattttc

SEQ ID NO: 56786 - DNA, 201 bp, Homo sapiens
gagacactcaatggtttgcatcagcatctggtaagcctctggctttgtcatcataattattcttcacatctgttagctcatgtgaggcagacaatactatmcccagtcttagctgaataaaatgagaactagaagagtgaggttaccctgctgataaatgctgaaactggatgaaatatttttcttgtactatcacagaca

SEQ ID NO: 56787 - DNA, 201 bp, Homo sapiens
cttcccattctcctttggcccttcttcaaagcttcatttgagaccctggattttggcttccaaatcctgataaaaaataggaaagaaaaagtatggtgtartatcagagcactgaactgggttctagtcccagccaggccacaaacttggttacgtcattgagcaagtcattcttacatgtgagaggctgaactacatgat

SEQ ID NO: 56788 - DNA, 201 bp, Homo sapiens
tgcaagaaacaagtaccctggggtcagtatggtaaatgcattgtgaggaagcactgtgaggtaatagctctgtggaagcagcaagaagcgaggtaccttgraactgatagcagagtcatttttgttacttgaggctaaaacaggataagccttggtgctctgggctttattcagttaataggttgattttctcattttcat

SEQ ID NO: 56789 - DNA, 201 bp, Homo sapiens
cagtgagccaagatcgcaccaatacactgcagcctgggcgacagagcgagactctgtctcaaacaaaaacaagcagtgcaagatgatgttggagaagtggrcaggtgccaaatcatgtaggaccttgtaaaccagagtgggaatattggattttattctaaacatattagggaaccattagaaggtactaagccagggaag

SEQ ID NO: 56790 - DNA, 201 bp, Homo sapiens
agctggtccagacaaaggcaagttttaaatacctccagttaggcattcaggaactctgatctacatttcagacgtgaaagttaggcctacctgggattctraaagaatggatgcatgaatgggggttagcacatccatgaatgtagctgctagtttaaaaagagatttctcaaagaaataggaactccgaattcttaaatg

SEQ ID NO: 56791 - DNA, 201 bp, Homo sapiens
gagacaggagaattgcttgaacccgggaggcggaggttgctgtaagccgagatctcaccattgcactccagcctgggcaacaagagcaaaactccatctcaaaaaaaaaaaaaaaatctgtaacaatttggctacatgagaaataattattgagaaaggaaactattatttaatgaatttgtccactgtgtccagcagaaa

SEQ ID NO: 56792 - DNA, 201 bp, Homo sapiens
ggcctgggagaatctcaattgcagaacttctgtgccctccttccatggaattggggcacatcacccttctagcatgtcagtgtgttcacaaattaggaagmagcattgagcttcagtgtcaagagtttttattagggtttcattatatagacataattgataactcaatgttcaggccccttccctgccccagaggttggg

SEQ ID NO: 56793 - DNA, 201 bp, Homo sapiens
gttccttttttgcttaatattaatagttcattcctcaatttatttctttcctctcacattttactgtaagcaccaaggagaacccaggccatacttccacmctttgcttagaaatcgcctcagctaaatgtccaagtttatcacttgtaagttctacttttcacctagtggctcaacataattcggacaagttttctgctg

SEQ ID NO: 56794 - DNA, 201 bp, Homo sapiens
aaacacgtaggtgctgctgcctgacctctcagtaggaacatgtgtggagagcctcacctggtggggacaatacgagatgtttggggaggagggatgcttakagacaaaggctgaggagaacaggtaggcttcagcatcacagcaggtgaactggactccatgtggcgggcacttcccaggatggcctataatcagaacctg

SEQ ID NO: 56795 - DNA, 201 bp, Homo sapiens
gaagatagaagagacagggaaggatcttcagagagagcatgactctaccaacaccttgattttggacttctggcctccacaactatgagagaataaatttstgttgttttaagatactcagtttagagtactttgttacagcagccctgggaaactgaaatagagatgtttcctggaggtactatagtcatcggtgcaaaa

SEQ ID NO: 56796 - DNA, 201 bp, Homo sapiens
tttctgtagtctctttgctgtcacctacttaccttttcactattgcccagtattgagctttgagacagcagcttcactgaaataatttaaaggtttttttwaaaaaaaaatgtaagcaattataggggaggaaaatgtcttttcctcacctgtcctaggttcatggctaaagtccttatagcaaaagacatattaacaaga

SEQ ID NO: 56797 - DNA, 201 bp, Homo sapiens
ggctgggaatgcaagtatgtttcaaatatttgtaattaaattgtactttaacaacttacattgctttttacctctgatgaattttatttaccaagttattyattatttggatctatctgtactattcgtgttcctacactcttatttgtagcatggattcatttactggcatacagatcatccattgcattttccagagaa

SEQ ID NO: 56798 - DNA, 201 bp, Homo sapiens
caagctatcagacagggatgtttaaatctgcagaagttgtctgctgccttttgttcagctatgccctgcccacagaggtgaagtctatggaggcagtaggscttgttgagctgtagtgggctctgcccagttcgagcttcctggccactttgtttacctactcaagcctcagcaatggcagatgcccctcccccccgcgag

SEQ ID NO: 56799 - DNA, 201 bp, Homo sapiens
ttttttgtagagacgaggtctcactgtgttgctgagactgttctcgaactcctgggctcaatgaatcttcctgccttggcctcccaaagtactgggataayaggcatgggccaccgaactttttgaactatttgatgcctttctgcccttaactgttattttgttcattttgctgcataattgagtatggattttgttttc

SEQ ID NO: 56800 - DNA, 201 bp, Homo sapiens
cagaggtgtactgattttccaggtgcagtctgtcacggcctcccttggctaggaaagggaaatcccccaacccttgtgcttcacaggtgaggtgatgcccygtcatgcttcggcttgccctccgtgggctgtatccactgtccaaccagtcccaatgagatgaaccagatacctcagttggaaatgcagaaatcacccgta

SEQ ID NO: 56801 - DNA, 201 bp, Homo sapiens
actcagaaataatgtttaccagctatttgggcgtcccttagcccagttaagttgacacataaagttaaccatcacaagtactcgttttcaactcggcatcygtatgtatttccttaagccatacttgatctccaaatgaagacagtaacaaggtcattattctacctaacataaacagctatcctgcatacaacaaaaaac

SEQ ID NO: 56802 - DNA, 201 bp, Homo sapiens
aagggaaatcccccaacccttgtgcttcacaggtgaggtgatgccccgtcatgcttcggcttgccctccgtgggctgtatccactgtccaaccagtcccartgagatgaaccagatacctcagttggaaatgcagaaatcacccgtattctgcatcgatcatgctgggagctgcagactggagctgttcctattcagccat

SEQ ID NO: 56803 - DNA, 201 bp, Homo sapiens
cccttccccaggggagtgaagttcttcagtgatgtttactcttctcctgatagcctgtaacttaaatattatgatgtaaaattaacaatacttaaatattratataaagtcaatacaacttttgttacatgataagaaaataagacaggaaagaaagcaaagatatttgcttaatatgtgtgtatatacacacaaacattc

SEQ ID NO: 56804 - DNA, 201 bp, Homo sapiens
ttcctttacacacagattttcattttatcttctggtaactctgaacaaggtataattattttcagatacattttatttatgagaaaactgaagctcagatmattaaatgacttggctctgttgatatctgagtctagagagtgaaaccatggagatcttttagtagagccacctgtcaggaccaatatatcactgaggcat

SEQ ID NO: 56805 - DNA, 201 bp, Homo sapiens
ccattctcctttggcccttcttcaaagcttcatttgagaccctggattttggcttccaaatcctgataaaaaataggaaagaaaaagtatggtgtaatatsagagcactgaactgggttctagtcccagccaggccacaaacttggttacgtcattgagcaagtcattcttacatgtgagaggctgaactacatgatccct

SEQ ID NO: 56806 - DNA, 201 bp, Homo sapiens
caagcgtccaactaatccagagtacttggttataaaaggcagaagctttttacttttagcttattttttgtgacttaaaataaaactgaaacagatacatsctttagtttttaaatgtaaaaagcaaaatgaagaattcagtacatatggcatgactatgatgctaatcatacctttagccatcatgataatccacttgac

SEQ ID NO: 56807 - DNA, 201 bp, Homo sapiens
ttgacttccccttgctctgatttcaggctgggaaagccagtttcagattataccttagctccctatgtggattgatagcagcgagacaacatgagacccargctactttatatttttattataaattaatatattgctattctggattagtacattcgtctcttgtgacttcatatgttgttaaactggatctgtctgctg

SEQ ID NO: 56808 - DNA, 201 bp, Homo sapiens
tccaaaagctgaatcttcccttttcattttacccatacattgccagttttaaagtgtgggctcaggagtcagattgcctgaattttaatcctgtcttttcrtttgctcactttgaaatcttaagcaatttatttaacttcaaataaattgtacctgtttcctcatctataaaatgaagataatatctacctcctagggctg

SEQ ID NO: 56809 - DNA, 201 bp, Homo sapiens
ttcctcaagctttttaaggtactgatgtgtggtagaaaaaacatggacataggagtcagacaatttgaaccaaggttcaaattcctattcccacttaccarttttgtgacttcaggcaaattacttaatctttctaagcctatttcctcatctttaaaatgggagtaaaacctactttgcaggttataatgaacacaggag

SEQ ID NO: 56810 - DNA, 201 bp, Homo sapiens
cctacctccccttccttccctttagtaaccactattctgtctactatgaggtcaacttttttagcttccacatatgaccaaaaacatgtggtatttctttstgtgcctggcttatttcattaacctgatgttctacaagctaatccatgttgccacaaattacaaaatttcattctttttatagctaaatagtatcccatt

SEQ ID NO: 56811 - DNA, 201 bp, Homo sapiens
tttctttatctatttatctaatgatggacactttggttgatcccatatcttgactattatgaatagtgctgcaatgaacatgggagtgcagataactcttygacatactgatttcctttcctatggatatatacccagtattggaattgctggatcatatggtagtattcttttcagatttttgaggaaccttcatcctgt

SEQ ID NO: 56812 - DNA, 201 bp, Homo sapiens
agaaatggtaatttataagactgggaaagtacctttttttgttgttgttagagacgagatctcactatgttgcccaggctaagtggaaagtgcttttacarttctcttttatcaccatacccgggttttgataaacttagtattctccttagtaaaagttttcatcagatacttgctcttttttatcttgtgataactttt

SEQ ID NO: 56813 - DNA, 201 bp, Homo sapiens
agactccatctcaaaaaaaaaaaaaaaaaaagcaggtgaaattaattttaatactatatttaatccataatatccaaaacattatcatttcaatatgtaaycaatataagacattattagtgaaatagtttacattctttttctactgtgtcttcaaaatccagtgtgcattttatatttacagcacatctcagtttgaac

SEQ ID NO: 56814 - DNA, 201 bp, Homo sapiens
tcccattaagctttcctacctaagttgagactactacttttttctccaatgttttattttaaaaatttcaaacctacagaaaagttacaaaaatagaacartaagcaaccatgaactctttgcctatctttaccactttttgcagtatttacttcgtctgtttctcctaactatatatacacatataaatatacatacttg

SEQ ID NO: 56815 - DNA, 201 bp, Homo sapiens
gcgacaggtttctttgtacaaagcaaaaatttcaaaatcggactcaacatcgtggctcacgtacaggattcttacactggtctggagggtaataatttgaygcttaaaaacaaaactttcagaatatcttttcctttttttatttggaaagtgctttccatacttaaagaatgttctctttttgttttaaaaccacatacg

SEQ ID NO: 56816 - DNA, 201 bp, Homo sapiens
acaatcactttgggattctagggcagaaagagttaattaaattgtaatcctaggctaggcgcagtggctcacgcctgtaatcccagcactttgggaggccraggcaggcagatcacaaggtcaagagatcgagaccatcctggccaacatggtgaaaccccgtctctactgaaaatacaaaaattagctgggtgtggtggt

SEQ ID NO: 56817 - DNA, 201 bp, Homo sapiens
cactttgggattctagggcagaaagagttaattaaattgtaatcctaggctaggcgcagtggctcacgcctgtaatcccagcactttgggaggccgaggcrggcagatcacaaggtcaagagatcgagaccatcctggccaacatggtgaaaccccgtctctactgaaaatacaaaaattagctgggtgtggtggtgccca

SEQ ID NO: 56818 - DNA, 201 bp, Homo sapiens
ccaccacttggaacatgccatttattcagtaatatctgttaactgaaataggttatactatattttctgattccatttctgttgatcctcatctaaagccrttattcagatattcacttaattacaaaaaataagaatactactcgcatctatgacaaatttgacagattattaaaagctatttaaggccaggcacagtgg

SEQ ID NO: 56819 - DNA, 201 bp, Homo sapiens
ctgcaacttcaggtctataatctaagtctagctcttaaactccacactgataatgtcaatatcatatcttctcaggtgcagaacaaagacaaaggggactrgtcattcctccaccaacccagagatgtctgcataattgatttttactttaccccatttttgctcttcaaacattcacattatcttatgtaaaatgtagat

SEQ ID NO: 56820 - DNA, 201 bp, Homo sapiens
ccagtactctcataactgattttttcttggttatatgcttgtggtacacaaatagaaataggaaaatggggaagtgagatgggtggagtagattatgaagyagagaatctgggttctcccactgattgtaattaggtctgcccaagggaccagaaaaaaaaactcccattccatatctctcttccagaatccttaagctgc

SEQ ID NO: 56821 - DNA, 201 bp, Homo sapiens
tgagatgggtggagtagattatgaagcagagaatctgggttctcccactgattgtaattaggtctgcccaagggaccagaaaaaaaaactcccattccatrtctctcttccagaatccttaagctgccccttgactctgcccattcgctctctctcttgccctcacaaactccagatgcctgagaatggtagcagttttcg

SEQ ID NO: 56822 - DNA, 201 bp, Homo sapiens
ttactgttttcttgggaatacatagaacccatatagggtttttttggcaagcttttattgtaacacccactgtgccagcatcaatacatatcaatttacaraatccccaattttaaataagtgttggtgattttcaggaaaatcttactgaaaaccagtgataaattgtgttactaaatttcttcccttgggccgggcgca

SEQ ID NO: 56823 - DNA, 201 bp, Homo sapiens
caaggaaggcaacctataagcattttctgtgaattataaatttaaggtttcaaatgaaaattaaaaattttgaaaaaatgtgtatatccaccagaatgagytttacatcttatcaataaatacagacttcagagttactctttaccatttctctcccatctaaaagttacattggttaagaatcagttatttgccctacta

SEQ ID NO: 56824 - DNA, 201 bp, Homo sapiens
tttactgtaagctgaaatatgctttccccagtatctatccattggctctaatttggtttttctttcatccaaaaccttttcacatactcttgtttccctargtctttttttccccgctatttttgagattgtatagtttctaagcccctcatcatcttgagctctcttctttttttttttctccccgcctccccaacccca

SEQ ID NO: 56825 - DNA, 201 bp, Homo sapiens
ttactagcattacgcattagccagatccccaaaggaaaggtaaaaagcctcaggcatccatgaaggactgcctgcacagatcattcacaagtaaactcttygatggtctcccacaagcaaggacacaccagctgcaacttcaggtctataatctaagtctagctcttaaactccacactgataatgtcaatatcatatctt

SEQ ID NO: 56826 - DNA, 201 bp, Homo sapiens
tccaaacttgaagtgcaaatcaagcagtggtacgaaaccaacgccccgagggctggtcgcgactacagtgcatattacagacaaattgaagagctgcgaartcaggtgagagatgatgcttgtgtttcctactctgtgtttagcttcaagataaatcaagaggttatctatgttaggtaggtccaaatggactttgtaaag

SEQ ID NO: 56827 - DNA, 201 bp, Homo sapiens
agaataaagatttttttaaagctttccaatatatgataatttctgactttcagaaatagcaattttatatgctattatatagcatatataataaggttcarccttattatgttacccccactttacatatgaggataaatgaggactcatatgaagacatgagataaagactttcccaaagtcaagcagttaccaagtagt

SEQ ID NO: 56828 - DNA, 201 bp, Homo sapiens
gcattactcataaaagccccaaagcgaaacacctcaagtgtccatcaaccgatgaatggataaacaaaatgtaatatatccacacaatagaatcttattcrtcaataaaaaggaatgaagtactgatacatgctataacagagatgaacttcgaaaacatgctaagtgaaagaagccaaatccaaaaacaataaaaacaca

SEQ ID NO: 56829 - DNA, 201 bp, Homo sapiens
ttttcataatgttgttgtaagttaaatgacttagagcagcacctggaccacaataagcccaacacaagttattattttatatcttttttacttattcccartgaaagaggtcatgagactccttatgtcttttctgcccagccttatctgagaatgtgcttcagactaaaatcaatcagaaatttcactttcataggaagt

SEQ ID NO: 56830 - DNA, 201 bp, Homo sapiens
aatcgcttgaacccaggaggcagaggttgcagtgagctgcgatcacattactgcactccagcctgggcgacagagcaagactccgtcccaaaaaaaaaaaagaaaaagaaaaggcatttgtcagtttgacctgcattttattaaccaaagagagtcacatgacccagccaggtgtcaatggattaaaggaatctaatcctg

SEQ ID NO: 56831 - DNA, 201 bp, Homo sapiens
gtattaaacctaatacccattggttatttttcctgatcctctccctcctcctaccctccaccctctgttaggcccccatgtctgctattcccctgtatgtrtccattataccagatctcaaaatctaagataaaattttaagatggagaatggactagagacattccaggccaagcaaatcagcaagcccatgacaaatta

SEQ ID NO: 56832 - DNA, 201 bp, Homo sapiens
ttgagtcctggagtttgagaacagcttgggcaacgtggcaaaaccacatctctatacaaaaatacaaaaaaaattagctgggcatggtggcatacatctgstgtcccagctacttgggaggctgaggtgagaggattgcttgagccccaaaggttgaggctgcagtgagccatgatcacaccattgtactccagcctgagt

SEQ ID NO: 56833 - DNA, 201 bp, Homo sapiens
taatcttattgatttttcagcatcagtacaactctacaacctttgagctatatctgctttttcccattgcttccactgccttttaaaactcaacacagctytttgaataatttgagagtcaaattcaatcacaaatgctgagcagaataagagtgaagtacactatacttaaaatggaaatagattaaaaacaacattact

SEQ ID NO: 56834 - DNA, 201 bp, Homo sapiens
cttgagtcctggagtttgagaacagcttgggcaacgtggcaaaaccacatctctatacaaaaatacaaaaaaaattagctgggcatggtggcatacatctsctgtcccagctacttgggaggctgaggtgagaggattgcttgagccccaaaggttgaggctgcagtgagccatgatcacaccattgtactccagcctgag

SEQ ID NO: 56835 - DNA, 201 bp, Homo sapiens
cccagagccttgagatagaactccagtcccatctcagcatggtaaagcatatctaacttctctttctcaatctagtatgtgtttaccaaggtcctctgttwggaactatagaaatgcaaagacctacaagaaataacccttccccttgcagaactggcagggaaacaggccgaacaactgattataattaaaggacagaga

SEQ ID NO: 56836 - DNA, 201 bp, Homo sapiens
agtagaggaatccatgtaaattgcaaataaaccactttctaattttttcctgtttctgaattgtaaaaccccctttgggagtccctggtttcttattgagycaatttctgggttaatcttattgatttttcagcatcagtacaactctacaacctttgagctatatctgctttttcccattgcttccactgccttttaaaa

SEQ ID NO: 56837 - DNA, 201 bp, Homo sapiens
tttatcagactctgtaattgaatataaatgttttactcagaggagctgcaaattgcctgcaaaaatgaaatccagtgagcactagaatatttaaaacatcrttactgccatctttatcatgaagcacatcaattacaagctgtagaccacctaatatcaatttgtaggtaatgttcctgaaaattgcaatacatttcaatt

SEQ ID NO: 56838 - DNA, 201 bp, Homo sapiens
tgccctatttttcttgtgctcatagaaagagtctttggagcacactctagaggagaccaaggcccgttacagcagccagttagccaacctccagtcgctgytgagctctctggaggcccaactgatgcagattcggagtaacatggaacgccagaacaacgaataccatatccttcttgacataaagactcgacttgaaca

SEQ ID NO: 56839 - DNA, 201 bp, Homo sapiens
agattcatactcctttagagcaaagcgcatttacttaccagcaagtctgtttttcttgagttgtactaaacatcagggcaatttgattcggactccatggraagttactttggaattttagaaactatgggcatgtgaagcaatggcatttaaatagcccttccggaataaagttcatccttcgcaagctctcactaaaaa

SEQ ID NO: 56840 - DNA, 201 bp, Homo sapiens
tttagtgctggagtacctgactgtacaataggatgaccttaaatcatgctatttttaatgtttaacacaattacatacaaaatatgaacattttatcctcyggaataaaatgaatctttgtcacagcttatcacatcagggctaaatgtatagtgaacaatctttctgaaaagagctaaaaattaattacgtgataaatct

SEQ ID NO: 56841 - DNA, 201 bp, Homo sapiens
aaaatgttacatctataaaaattctttcatctacctttagtgctggagtacctgactgtacaataggatgaccttaaatcatgctatttttaatgtttaayacaattacatacaaaatatgaacattttatcctccggaataaaatgaatctttgtcacagcttatcacatcagggctaaatgtatagtgaacaatctttc

SEQ ID NO: 56842 - DNA, 201 bp, Homo sapiens
aaaagagcaatggttggtccacttgatagctcttaaagcttctccttagaaaaggcatttgtcctttgggaggccaaggcaggaggatcatttgaggtcargaggttgagaccagctggccaatatggtgaaaccccatctctactaaagatacaaaaataagctgggcatggtggtgtgtgcctgtaatcccagctactt

SEQ ID NO: 56843 - DNA, 201 bp, Homo sapiens
ttgagagtcaaattcaatcacaaatgctgagcagaataagagtgaagtacactatacttaaaatggaaatagattaaaaacaacattactgaaacccttckcaaggcaaaatgtgtctccttttgataataagctgcatatactatcaggtcctctctttctttatatggtgaacatatatttttaatgaaatgtctctca

SEQ ID NO: 56844 - DNA, 201 bp, Homo sapiens
ggaggccaaggcaggaggatcatttgaggtcaggaggttgagaccagctggccaatatggtgaaaccccatctctactaaagatacaaaaataagctgggyatggtggtgtgtgcctgtaatcccagctacttgggaggttgaggcaggagaatcgcttgaacccaggaggcagaggttgcagtgagctgcgatcacatta

SEQ ID NO: 56845 - DNA, 201 bp, Homo sapiens
cctgagactggataatttacaaacaatagacgtttacttggctcacagttctggaggccagaaagtccaatatcaaggtgccggcatcttgtaagggcctkcttgctgtgtcatcccatggcagaaagtagaagtgcaaaagagtgtccatgagaaccagagagcaagaggaggctaatctttcttttagaactagcccac

SEQ ID NO: 56846 - DNA, 201 bp, Homo sapiens
taaagaaaccctccacatgggaacttgggcacactcctcagaatggggtgattttcttggcctgtgctattgctatcttgaaacatcctgacatcctgaaraggaaaaacaagacaaaatttgaattccacttaaattcaagataatttatttcttgaatttttaagagtaggacatttgtaaatttggggagaagcacat

SEQ ID NO: 56847 - DNA, 201 bp, Homo sapiens
tataaaatggacttaagattttttgagaaagaggatgggtttaacatatttttctaaaagaaggaaataagtaaaaagaataataatttaaagttgaatawtataaatcagcagagtcatgtgcctgaattaacatttaatgtttaatatgaattcagatataaagaaaaccaggaagattaagacagtcgtgcaagaagt

SEQ ID NO: 56848 - DNA, 201 bp, Homo sapiens
gaaggggtggggtggcgggaatcctatttatcagactctgtaattgaatataaatgttttactcagaggagctgcaaattgcctgcaaaaatgaaatccartgagcactagaatatttaaaacatcattactgccatctttatcatgaagcacatcaattacaagctgtagaccacctaatatcaatttgtaggtaatgtt

SEQ ID NO: 56849 - DNA, 201 bp, Homo sapiens
gaagcctgagctcctccttgcaggcccctgtagtcagtacagtgggcatgcagcgcctcgggacgacacccagcgtttatgggggtgctggaggccggggyatccgcatctccaactccagacacacggtgaactatgggagcgatctcacaggcggcggggacctgtttgttggcaatgagaaaatggccatgcagaacc

SEQ ID NO: 56850 - DNA, 201 bp, Homo sapiens
agcagcacctggaccacaataagcccaacacaagttattattttatatcttttttacttattcccaatgaaagaggtcatgagactccttatgtcttttcwgcccagccttatctgagaatgtgcttcagactaaaatcaatcagaaatttcactttcataggaagtcgatggcctacacaagcatctgggcaacactgtc

SEQ ID NO: 56851 - DNA, 201 bp, Homo sapiens
ctttatcatgaagcacatcaattacaagctgtagaccacctaatatcaatttgtaggtaatgttcctgaaaattgcaatacatttcaattatactaaaccwcacaaagtagaggaatccatgtaaattgcaaataaaccactttctaattttttcctgtttctgaattgtaaaaccccctttgggagtccctggtttctta

SEQ ID NO: 56852 - DNA, 201 bp, Homo sapiens
tgagaaccagagagcaagaggaggctaatctttcttttagaactagcccactctcacaataactaacccattatcatggtaaccacattaatccatccatsagagaagagccctcatcatctaatcaccttttactaggccgcacctcccaacactgttacattggggattaagttttccacacatgaactccagggaaca

SEQ ID NO: 56853 - DNA, 201 bp, Homo sapiens
ttgagctatatctgctttttcccattgcttccactgccttttaaaactcaacacagctttttgaataatttgagagtcaaattcaatcacaaatgctgagmagaataagagtgaagtacactatacttaaaatggaaatagattaaaaacaacattactgaaacccttctcaaggcaaaatgtgtctccttttgataataa

SEQ ID NO: 56854 - DNA, 201 bp, Homo sapiens
tgagccgagattgtaccattgcactccagtctgggcaacagagcaagattctgtctcaataaataaataaataaataaataaataaataaataaataaatmaaaaagaaaatgtcattctttctcatgtattttccagattaaggatgctcaactgcaaaatgctcggtgtgtcctgcaaattgataatgctaaactggct

SEQ ID NO: 56855 - DNA, 201 bp, Homo sapiens
gtgagccgagattgtaccattgcactccagtctgggcaacagagcaagattctgtctcaataaataaataaataaataaataaataaataaataaataaakaaaaaagaaaatgtcattctttctcatgtattttccagattaaggatgctcaactgcaaaatgctcggtgtgtcctgcaaattgataatgctaaactggc

SEQ ID NO: 56856 - DNA, 201 bp, Homo sapiens
tacagtgagccgagattgtaccattgcactccagtctgggcaacagagcaagattctgtctcaataaataaataaataaataaataaataaataaataaataaataaaaaagaaaatgtcattctttctcatgtattttccagattaaggatgctcaactgcaaaatgctcggtgtgtcctgcaaattgataatgctaaac

SEQ ID NO: 56857 - DNA, 201 bp, Homo sapiens
gaaagaggtcatgagactccttatgtcttttctgcccagccttatctgagaatgtgcttcagactaaaatcaatcagaaatttcactttcataggaagtcratggcctacacaagcatctgggcaacactgtcaatgtggaggttgatgctgctccaggcctgaaccttggcgtcatcatgaatgaaatgaggcagaagta

SEQ ID NO: 56858 - DNA, 201 bp, Homo sapiens
ctcatttttttcttaattttcttccaagtcacgctagctagtaagttgcatttaaagatgttaagaatatttaaaagtgaattctttttcacctactgagwcacattccagaatagtctgaaactttgacatgcaaataccagactgtgaatctgattaataagaaacctatgcagatgggtttgtaactgattaggcctg

SEQ ID NO: 56859 - DNA, 201 bp, Homo sapiens
gcagaggttacagtgagccgagattgtaccattgcactccagtctgggcaacagagcaagattctgtctcaataaataaataaataaataaataaataaataaataaataaataaaaaagaaaatgtcattctttctcatgtattttccagattaaggatgctcaactgcaaaatgctcggtgtgtcctgcaaattgataa

SEQ ID NO: 56860 - DNA, 201 bp, Homo sapiens
acatggaacgccagaacaacgaataccatatccttcttgacataaagactcgacttgaacaggaaattgctacttaccgccgccttctggaaggagaagaygtaaagtaaggctcttagaatcaaggaataggtgtcaatatctgtatgcacttctattttaatgtccctgtcactcattacccagcaccaatgcaatccc

SEQ ID NO: 56861 - DNA, 201 bp, Homo sapiens
ccagctttgctggctaacatcacacatgacttgattcagtacaacttttgtcagaaaaggtattctcacctattctcattgccttcttttccaaagtgaaragatttcactcatttttttcttaattttcttccaagtcacgctagctagtaagttgcatttaaagatgttaagaatatttaaaagtgaattctttttcac

SEQ ID NO: 56862 - DNA, 201 bp, Homo sapiens
ccaacttaaagcattagtagtgatttttatttttgaattctctttcaaacatctctgttttctctcccctaggctcatttccaagattcctctcatcaggktattattttatcatcttcctgtctcctaccactttcaaaattctcccctgctttcaagaaccattgatctctggagcccagaagtcaatctcactcatac

SEQ ID NO: 56863 - DNA, 201 bp, Homo sapiens
tttggctataatcttatctttgctccctgcaagaaatcagccataagaaagcactattaatactctgcagtgattagaaggggtggggtggcgggaatccyatttatcagactctgtaattgaatataaatgttttactcagaggagctgcaaattgcctgcaaaaatgaaatccagtgagcactagaatatttaaaacat

SEQ ID NO: 56864 - DNA, 201 bp, Homo sapiens
ggaaacaatggaatggttctatataatactaataataggaggagcgggagaaacaggagaagggggaagagttggtggtgatagtgacagagatgatgackatgacaataatgatacaagccctaccttcttttcataatgttgttgtaagttaaatgacttagagcagcacctggaccacaataagcccaacacaagtta

SEQ ID NO: 56865 - DNA, 201 bp, Homo sapiens
tgaaagaaatttggctataatcttatctttgctccctgcaagaaatcagccataagaaagcactattaatactctgcagtgattagaaggggtggggtggygggaatcctatttatcagactctgtaattgaatataaatgttttactcagaggagctgcaaattgcctgcaaaaatgaaatccagtgagcactagaatat

SEQ ID NO: 56866 - DNA, 201 bp, Homo sapiens
tgataaaaagtaaagtgaggctgttttagtctgttttctgctgctgtgacagaatacctgagactggataatttacaaacaatagacgtttacttggctcrcagttctggaggccagaaagtccaatatcaaggtgccggcatcttgtaagggccttcttgctgtgtcatcccatggcagaaagtagaagtgcaaaagagt

SEQ ID NO: 56867 - DNA, 201 bp, Homo sapiens
tggataatttacaaacaatagacgtttacttggctcacagttctggaggccagaaagtccaatatcaaggtgccggcatcttgtaagggccttcttgctgygtcatcccatggcagaaagtagaagtgcaaaagagtgtccatgagaaccagagagcaagaggaggctaatctttcttttagaactagcccactctcacaa

SEQ ID NO: 56868 - DNA, 201 bp, Homo sapiens
gtgtccttttatacacaaatgttcatagcagcattactcataaaagccccaaagcgaaacacctcaagtgtccatcaaccgatgaatggataaacaaaatrtaatatatccacacaatagaatcttattcgtcaataaaaaggaatgaagtactgatacatgctataacagagatgaacttcgaaaacatgctaagtgaaa

SEQ ID NO: 56869 - DNA, 201 bp, Homo sapiens
ggtaggtccaaatggactttgtaaagcaaattaggctaaaatgttacatctataaaaattctttcatctacctttagtgctggagtacctgactgtacaayaggatgaccttaaatcatgctatttttaatgtttaacacaattacatacaaaatatgaacattttatcctccggaataaaatgaatctttgtcacagctt

SEQ ID NO: 56870 - DNA, 201 bp, Homo sapiens
gccgggcatggtggcggatgcctgtaaccccagctactcgggaggctgaggcaggataattgcttgaacctgggaggcagaggttacagtgagccgagatygtaccattgcactccagtctgggcaacagagcaagattctgtctcaataaataaataaataaataaataaataaataaataaataaataaaaaagaaaat

SEQ ID NO: 56871 - DNA, 201 bp, Homo sapiens
atttacttaccagcaagtctgtttttcttgagttgtactaaacatcagggcaatttgattcggactccatgggaagttactttggaattttagaaactatrggcatgtgaagcaatggcatttaaatagcccttccggaataaagttcatccttcgcaagctctcactaaaaatgttcgaaccacacctgtctcgtgtttc

SEQ ID NO: 56872 - DNA, 201 bp, Homo sapiens
ggctaacgcctgtaatcccagcactttgagaggctgaggcaggaggctcacttgagtcctggagtttgagaacagcttgggcaacgtggcaaaaccacatmtctatacaaaaatacaaaaaaaattagctgggcatggtggcatacatctgctgtcccagctacttgggaggctgaggtgagaggattgcttgagccccaa

SEQ ID NO: 56873 - DNA, 201 bp, Homo sapiens
ttgattcggactccatgggaagttactttggaattttagaaactatgggcatgtgaagcaatggcatttaaatagcccttccggaataaagttcatccttygcaagctctcactaaaaatgttcgaaccacacctgtctcgtgtttctgactctagtttggttcatctgaaatacacaggcacaggccatccgtcccattg

SEQ ID NO: 56874 - DNA, 201 bp, Homo sapiens
acagagagaaatcgaggaaagggcaatgtactgcatgaatgcagaggaaagagtaaatctggaagatttcacagggaaagtggcatttaaaccagatcttyttgtaacttttaagttcaggagtacatgtgcagatttatgatgtagttaaacttgtgtcatggggatttgttgtacaggttatttcatcactcaggtatt

SEQ ID NO: 56875 - DNA, 201 bp, Homo sapiens
ttctcatccacatgcatcaggatcagcctcaggtacctgattagacccccaagtaacaattccaacttaaagcattagtagtgatttttatttttgaattmtctttcaaacatctctgttttctctcccctaggctcatttccaagattcctctcatcagggtattattttatcatcttcctgtctcctaccactttcaaa

SEQ ID NO: 56876 - DNA, 201 bp, Homo sapiens
tttgattcggactccatgggaagttactttggaattttagaaactatgggcatgtgaagcaatggcatttaaatagcccttccggaataaagttcatcctycgcaagctctcactaaaaatgttcgaaccacacctgtctcgtgtttctgactctagtttggttcatctgaaatacacaggcacaggccatccgtcccatt

SEQ ID NO: 56877 - DNA, 201 bp, Homo sapiens
ttgaggatgtgaatggtaccactttgaattcctaagatgtaatataatatctaacacatagcaggcacttgattcattattttaaattgaaagaataaagwtttttttaaagctttccaatatatgataatttctgactttcagaaatagcaattttatatgctattatatagcatatataataaggttcagccttattat

SEQ ID NO: 56878 - DNA, 201 bp, Homo sapiens
tgagctatatctgctttttcccattgcttccactgccttttaaaactcaacacagctttttgaataatttgagagtcaaattcaatcacaaatgctgagcmgaataagagtgaagtacactatacttaaaatggaaatagattaaaaacaacattactgaaacccttctcaaggcaaaatgtgtctccttttgataataag

SEQ ID NO: 56879 - DNA, 201 bp, Homo sapiens
tcttcagcttccgcgacccagccgacgtcttcagggagttcttcggcggccaggacccattctcctttgacctcttgggaaacccgctggagaatattttkggggggtcagaggaactgctggggaagcagaagcagagcgtctgcaccccttttctctgccttcagtgaatttccagcttttgggggtgttttttcttct

SEQ ID NO: 56880 - DNA, 201 bp, Homo sapiens
caagagaatcattgagaatggccaagaaagggtggaagtggaggaagatggagagttgagttaaagtccttcataataaatagcaaagagcagttactccscattgacaccaagtaattccagtccacatttgactttaagcacatctggaggaatagcggactttttttaggattgaaagtgaactttactttcagaaca

SEQ ID NO: 56881 - DNA, 201 bp, Homo sapiens
ttactttcagaacagctgtacccaagaatttataaacacttcatgccaacacctgttcttatcgttgggactacacggataggacctctgtttgtctttcratcgttgtaaaatatctgtatgcaatttgctatttattaaacttaagcctgaggcagacaatgattatttgctagtggtaggacagaatgttcagttcag

SEQ ID NO: 56882 - DNA, 201 bp, Homo sapiens
tttcagaacagctgtacccaagaatttataaacacttcatgccaacacctgttcttatcgttgggactacacggataggacctctgtttgtctttcaatcrttgtaaaatatctgtatgcaatttgctatttattaaacttaagcctgaggcagacaatgattatttgctagtggtaggacagaatgttcagttcagcact

SEQ ID NO: 56883 - DNA, 201 bp, Homo sapiens
accaccaagagaatcattgagaatggccaagaaagggtggaagtggaggaagatggagagttgagttaaagtccttcataataaatagcaaagagcagttrctccgcattgacaccaagtaattccagtccacatttgactttaagcacatctggaggaatagcggactttttttaggattgaaagtgaactttactttca

SEQ ID NO: 56884 - DNA, 201 bp, Homo sapiens
taaaaaaatcaccaccaagagaatcattgagaatggccaagaaagggtggaagtggaggaagatggagagttgagttaaagtccttcataataaatagcawagagcagttactccgcattgacaccaagtaattccagtccacatttgactttaagcacatctggaggaatagcggactttttttaggattgaaagtgaac

SEQ ID NO: 56885 - DNA, 201 bp, Homo sapiens
agaatattttgggggggtcagaggaactgctggggaagcagaagcagagcgtctgcaccccttttctctgccttcagtgaatttccagcttttgggggtgktttttcttcttttgatacaggatttcgttcctttggctccctgggaagtgggggcctttcttccttctgcatgtcctacggtagtgatgggacaggcagc

SEQ ID NO: 56886 - DNA, 201 bp, Homo sapiens
atgaccgctatggcgaggcgggggcggagggcggctgcacaggcggcaggcccttcgaggaccccttcgagtacgtcttcagcttccgcgacccagccgasgtcttcagggagttcttcggcggccaggacccattctcctttgacctcttgggaaacccgctggagaatattttgggggggtcagaggaactgctgggga

SEQ ID NO: 56887 - DNA, 201 bp, Homo sapiens
cctacgaggtgttgtcggacgccaagaaacgcgatatctatgaccgctatggcgaggcgggggcggagggcggctgcacaggcggcaggcccttcgaggamcccttcgagtacgtcttcagcttccgcgacccagccgacgtcttcagggagttcttcggcggccaggacccattctcctttgacctcttgggaaacccgc

SEQ ID NO: 56888 - DNA, 201 bp, Homo sapiens
tccgcgacccagccgacgtcttcagggagttcttcggcggccaggacccattctcctttgacctcttgggaaacccgctggagaatattttgggggggtcrgaggaactgctggggaagcagaagcagagcgtctgcaccccttttctctgccttcagtgaatttccagcttttgggggtgttttttcttcttttgataca

SEQ ID NO: 56889 - DNA, 201 bp, Homo sapiens
gagggcggctgcacaggcggcaggcccttcgaggaccccttcgagtacgtcttcagcttccgcgacccagccgacgtcttcagggagttcttcggcggccrggacccattctcctttgacctcttgggaaacccgctggagaatattttgggggggtcagaggaactgctggggaagcagaagcagagcgtctgcacccct

SEQ ID NO: 56890 - DNA, 201 bp, Homo sapiens
gcgaggcgggggcggagggcggctgcacaggcggcaggcccttcgaggaccccttcgagtacgtcttcagcttccgcgacccagccgacgtcttcagggarttcttcggcggccaggacccattctcctttgacctcttgggaaacccgctggagaatattttgggggggtcagaggaactgctggggaagcagaagcaga

SEQ ID NO: 56891 - DNA, 201 bp, Homo sapiens
taagcacatctggaggaatagcggactttttttaggattgaaagtgaactttactttcagaacagctgtacccaagaatttataaacacttcatgccaacrcctgttcttatcgttgggactacacggataggacctctgtttgtctttcaatcgttgtaaaatatctgtatgcaatttgctatttattaaacttaagcct

SEQ ID NO: 56892 - DNA, 201 bp, Homo sapiens
ggactttttttaggattgaaagtgaactttactttcagaacagctgtacccaagaatttataaacacttcatgccaacacctgttcttatcgttgggactrcacggataggacctctgtttgtctttcaatcgttgtaaaatatctgtatgcaatttgctatttattaaacttaagcctgaggcagacaatgattatttgc

SEQ ID NO: 56893 - DNA, 201 bp, Homo sapiens
gaggaatagcggactttttttaggattgaaagtgaactttactttcagaacagctgtacccaagaatttataaacacttcatgccaacacctgttcttatygttgggactacacggataggacctctgtttgtctttcaatcgttgtaaaatatctgtatgcaatttgctatttattaaacttaagcctgaggcagacaat

SEQ ID NO: 56894 - DNA, 201 bp, Homo sapiens
atggtaaaaaaatcaccaccaagagaatcattgagaatggccaagaaagggtggaagtggaggaagatggagagttgagttaaagtccttcataataaatrgcaaagagcagttactccgcattgacaccaagtaattccagtccacatttgactttaagcacatctggaggaatagcggactttttttaggattgaaagt

SEQ ID NO: 56895 - DNA, 201 bp, Homo sapiens
ttgggatgcgaggcgctcataggcctcgaccaatgagatgtggctgcgtcataaggggcgtctctccaggcggcccaggtctccgagcactcgggcctgcrcctgggtgctggcagccttgccgctcgctgtgccagtgcctggtgggccgttctggccatccagcatggtggactactacgaggtgctggacgtgccccg

SEQ ID NO: 56896 - DNA, 201 bp, Homo sapiens
gatggtaaaaaaatcaccaccaagagaatcattgagaatggccaagaaagggtggaagtggaggaagatggagagttgagttaaagtccttcataataaayagcaaagagcagttactccgcattgacaccaagtaattccagtccacatttgactttaagcacatctggaggaatagcggactttttttaggattgaaag

SEQ ID NO: 56897 - DNA, 201 bp, Homo sapiens
aggaggaagcggagaggagattcaagcaggtggccgaggcctacgaggtgttgtcggacgccaagaaacgcgatatctatgaccgctatggcgaggcgggsgcggagggcggctgcacaggcggcaggcccttcgaggaccccttcgagtacgtcttcagcttccgcgacccagccgacgtcttcagggagttcttcggcg

SEQ ID NO: 56898 - DNA, 201 bp, Homo sapiens
ttaagcacatctggaggaatagcggactttttttaggattgaaagtgaactttactttcagaacagctgtacccaagaatttataaacacttcatgccaayacctgttcttatcgttgggactacacggataggacctctgtttgtctttcaatcgttgtaaaatatctgtatgcaatttgctatttattaaacttaagcc

SEQ ID NO: 56899 - DNA, 201 bp, Homo sapiens
atttgactttaagcacatctggaggaatagcggactttttttaggattgaaagtgaactttactttcagaacagctgtacccaagaatttataaacacttyatgccaacacctgttcttatcgttgggactacacggataggacctctgtttgtctttcaatcgttgtaaaatatctgtatgcaatttgctatttattaaa

SEQ ID NO: 56900 - DNA, 201 bp, Homo sapiens
gggacaaataagaagaacaaaggcagacgtggagatgatagtaggggttgccaagctttctggaaaggagcagagagtattttaggctttatgggccatayagtctccatcccaactactcaactttgctggcatagtgcaaaagtagccacagatagcttataaatgaaggtgtgtagggctgtgttccaataaaactac

SEQ ID NO: 56901 - DNA, 201 bp, Homo sapiens
gggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctaccta

SEQ ID NO: 56902 - DNA, 201 bp, Homo sapiens
ctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtacctttagttaaaaacagaaaccaatttgtaaatgtgaattaaatgcatactccaca

SEQ ID NO: 56903 - DNA, 201 bp, Homo sapiens
tgtgaagggtctacacgttcaacctcttccttgtaagttaatgagttagctaccaagttttgaggaagctagcagaaaacaggagacccaggatcagatayagaggacttcgttactcatggcagagcaaacagcatgagctttatttctgcactgattcccattgccctggcccctagtcccacagggaggatgtggaac

SEQ ID NO: 56904 - DNA, 201 bp, Homo sapiens
gtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctccca

SEQ ID NO: 56905 - DNA, 201 bp, Homo sapiens
tcccatctcggcctcccaaagtgctgggattacaggtgtgagccaccgggcccagccgtaggaacacagatattatcatcatgggacaagtcatccattcycagattccatgaccctctctggtgtccactgtggatttcagcacatgtttaactatgaaactctagtcacgctttttgatatacaggttcatggttacta

SEQ ID NO: 56906 - DNA, 201 bp, Homo sapiens
cctgggttcaagtgattctcctgcctcagcctcctgagtagctgggattacaggcatgcaccaccacaccggctaacttttgtatttttagtagagatagsgtttcaccatattgatcaaggtggtcttcaactcctgacctcgtgatcctcccatctcggcctcccaaagtgctgggattacaggtgtgagccaccgggc

SEQ ID NO: 56907 - DNA, 201 bp, Homo sapiens
ttgattcatttgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaag

SEQ ID NO: 56908 - DNA, 201 bp, Homo sapiens
ctcggctcactgcaacctccgcctcctgggttcaagtgattctcctgcctcagcctcctgagtagctgggattacaggcatgcaccaccacaccggctaayttttgtatttttagtagagatagggtttcaccatattgatcaaggtggtcttcaactcctgacctcgtgatcctcccatctcggcctcccaaagtgctgg

SEQ ID NO: 56909 - DNA, 201 bp, Homo sapiens
tgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaa

SEQ ID NO: 56910 - DNA, 201 bp, Homo sapiens
tttatgacactgaaatcagaattccatatcattttcctccttcaagaaataatattctcctctttattcttttttgcagatgattgaaaatgtaagaactrttctgagcctgcaggccatagccaaagaggtaccggctgtattttgtccatgggcaggagcttgtgactgctggtctaggtcattccaggtcaaccaggg

SEQ ID NO: 56911 - DNA, 201 bp, Homo sapiens
tcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactgtgcccggctggctttcat

SEQ ID NO: 56912 - DNA, 201 bp, Homo sapiens
aaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatg

SEQ ID NO: 56913 - DNA, 201 bp, Homo sapiens
ctgaagtgccagtccaattcatcctccagcatagcaccactgactgaccccagtcaacaccacaaggggcagaagagtcactccactgagccctaacttasagaaatcacaagataaaacaaaatggttgttgttttaagcctctaagttttggggtaatgtattatgcggctatacataaattggaacatccacgtttta

SEQ ID NO: 56914 - DNA, 201 bp, Homo sapiens
ggaccagctgaagtgccagtccaattcatcctccagcatagcaccactgactgaccccagtcaacaccacaaggggcagaagagtcactccactgagcccyaacttagagaaatcacaagataaaacaaaatggttgttgttttaagcctctaagttttggggtaatgtattatgcggctatacataaattggaacatcca

SEQ ID NO: 56915 - DNA, 201 bp, Homo sapiens
tactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcat

SEQ ID NO: 56916 - DNA, 201 bp, Homo sapiens
caataaaaaaagtgatctattctgagttccataccaccccaaaacactgatcagcttggggaaacttagaaagttcaaccacctggggataaagtttggamaactaggctagggccaattcagggtacaggtggaggctaggaagtttggcataggatatcattaaaggtcttctaaggatgaaggcaattggagctacac

SEQ ID NO: 56917 - DNA, 201 bp, Homo sapiens
gggacaggtcaaggaaggtattacctctgcatagttctaggtgtcctgcttaactcattcaggaatttcgggccagagggatatccaacaggaattctaamctgaagagtttagaaaccagtaggagaatcaggatgaattcagaaattactataatatgcattttcaagtgataaatcccatcaaaaacagaaaaagtgc

SEQ ID NO: 56918 - DNA, 201 bp, Homo sapiens
aaactgacccagaaaagggacaggtcaaggaaggtattacctctgcatagttctaggtgtcctgcttaactcattcaggaatttcgggccagagggatatycaacaggaattctaacctgaagagtttagaaaccagtaggagaatcaggatgaattcagaaattactataatatgcattttcaagtgataaatcccatca

SEQ ID NO: 56919 - DNA, 201 bp, Homo sapiens
gaaatcatgaagggcaaactgacccagaaaagggacaggtcaaggaaggtattacctctgcatagttctaggtgtcctgcttaactcattcaggaatttcrggccagagggatatccaacaggaattctaacctgaagagtttagaaaccagtaggagaatcaggatgaattcagaaattactataatatgcattttcaag

SEQ ID NO: 56920 - DNA, 201 bp, Homo sapiens
aactttcagacattaaatatcctagcccccgtccctcaccaaattgccaggtgtgggtggaaagcaacagattttatttttaatgggctaaaattttacartcttaaagcacaattcatgcaagcaactgagagatcacagctacaaacactggactttctattttctccatgcgatcccaatttcagctgcagagccaga

SEQ ID NO: 56921 - DNA, 201 bp, Homo sapiens
gagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagctt

SEQ ID NO: 56922 - DNA, 201 bp, Homo sapiens
atatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccag

SEQ ID NO: 56923 - DNA, 201 bp, Homo sapiens
ctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggt

SEQ ID NO: 56924 - DNA, 201 bp, Homo sapiens
gtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattcc

SEQ ID NO: 56925 - DNA, 201 bp, Homo sapiens
tacaaaattagccgggtgtggtggcacatgtctgtaatcccagctactcgggaggctgcggcaggagaatcgcttgaacctgggaggtagagatcacggcragccaagatcacaccactgcactccagcctgggcaacaagagcgaaactccatctcaacaacaacaaaaaaagtaatttagcacatatactgcatattac

SEQ ID NO: 56926 - DNA, 201 bp, Homo sapiens
cattgccctggcccctagtcccacagggaggatgtggaacagcccggtagatgccgtgctcatagtacgtttcagtcatggctgaggagccccaagcttasaaaccccaacctttatcaagcaaatctgccaaaccgttgtcctggaaggaggcactgtctttattatactggaaagaaagccatcctgtcctctgctcct

SEQ ID NO: 56927 - DNA, 201 bp, Homo sapiens
tcttccttgtaagttaatgagttagctaccaagttttgaggaagctagcagaaaacaggagacccaggatcagatacagaggacttcgttactcatggcasagcaaacagcatgagctttatttctgcactgattcccattgccctggcccctagtcccacagggaggatgtggaacagcccggtagatgccgtgctcata

SEQ ID NO: 56928 - DNA, 201 bp, Homo sapiens
ggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatata

SEQ ID NO: 56929 - DNA, 201 bp, Homo sapiens
agccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagcaacaggaggaagcagaccaaggagggagagaaaggaaggcagaga

SEQ ID NO: 56930 - DNA, 201 bp, Homo sapiens
tgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatgg

SEQ ID NO: 56931 - DNA, 201 bp, Homo sapiens
gacagataataaatacccctcatcagctgatcaattgctcgcacttccaggcaagcacccatcactccccaccaaacacaccgccccacgccacctgaacraggttaaaagaacggactcatgactgatggtcggggggaactggcttcagaagaggaagttgaaaatattaagaaatcaacacgggcatttaaaagcaaa

SEQ ID NO: 56932 - DNA, 201 bp, Homo sapiens
cctcaaaccctggttccacgtctccctcactcaaggatttatgtctcattttcaatggaatgttacatttggtcagaccacgaagaaaactcctcattatraactaggaaatgtgtggagagagaattatttacccaaggcagtgctcaatcagtgttgcccgaatatttatttagcccacacacggagaagttgtgttaa

SEQ ID NO: 56933 - DNA, 201 bp, Homo sapiens
acccagtctgctgggatcctgatatagtttggatatttgtccccgctcaaatctcatgttgaaacatgtccgtaatgggaggtatttgaatcactggggcrgagccctcatggcttggcgctgtcttcaccatagtgagtgagatctctggagatctggtcattttaacccttttcccatttgccccaagaatacttactg

SEQ ID NO: 56934 - DNA, 201 bp, Homo sapiens
ctggggtccaaggatttatttcctctctcgggagtcagggacagataataaatacccctcatcagctgatcaattgctcgcacttccaggcaagcacccakcactccccaccaaacacaccgccccacgccacctgaacaaggttaaaagaacggactcatgactgatggtcggggggaactggcttcagaagaggaagtt

SEQ ID NO: 56935 - DNA, 201 bp, Homo sapiens
aacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctgagccgcagtgaagggctttcagaggggc

SEQ ID NO: 56936 - DNA, 201 bp, Homo sapiens
tggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatacagaggacttcgttactcatgg

SEQ ID NO: 56937 - DNA, 201 bp, Homo sapiens
aatcagtcagactttgaatcattcctgcagcctctgaacatttaccatggagctcaataagccaggcaagaacacagatttttttttttttttttttttttgagacggagtctcactctgtcacccaggctggagtgcaatggcgtgatctcggctcactgcaacctccgcctcctgggttcaagtgattctcctgcctca

SEQ ID NO: 56938 - DNA, 201 bp, Homo sapiens
gagcaaacagcatgagctttatttctgcactgattcccattgccctggcccctagtcccacagggaggatgtggaacagcccggtagatgccgtgctcatrgtacgtttcagtcatggctgaggagccccaagcttacaaaccccaacctttatcaagcaaatctgccaaaccgttgtcctggaaggaggcactgtcttta

SEQ ID NO: 56939 - DNA, 201 bp, Homo sapiens
actaaaagaaaaagctattcttagtccttcccagatatccctgaacctccacccacccagtctgctgggatcctgatatagtttggatatttgtccccgcycaaatctcatgttgaaacatgtccgtaatgggaggtatttgaatcactggggcggagccctcatggcttggcgctgtcttcaccatagtgagtgagatct

SEQ ID NO: 56940 - DNA, 201 bp, Homo sapiens
aacctccacctcccgggttcgagtgattctcctgcctcagcctccccaatagctgggattacaggcacgccaccacacccagctaatttttgtatgtttgstacagacggggtttcaccatgttgcccaggctaggttcaaactcctgacctcaagtgatccacctgcctcagcctcccaaagggcagagataactaattt

SEQ ID NO: 56941 - DNA, 201 bp, Homo sapiens
tctactaaaagaaaaagctattcttagtccttcccagatatccctgaacctccacccacccagtctgctgggatcctgatatagtttggatatttgtcccygctcaaatctcatgttgaaacatgtccgtaatgggaggtatttgaatcactggggcggagccctcatggcttggcgctgtcttcaccatagtgagtgaga

SEQ ID NO: 56942 - DNA, 201 bp, Homo sapiens
aatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttg

SEQ ID NO: 56943 - DNA, 201 bp, Homo sapiens
gtgacacatgaaaatgtatatgaaattcaaattccagtatccataaataaagtttctcgcagccatgcctgctcctttacatatcgtttatgcctgttttygcactatgagggcagagttgagtagttggcaacaaacactacaaggccccaaaatatttattaaatatcccatcacagagaaactttgctgactcttgca

SEQ ID NO: 56944 - DNA, 201 bp, Homo sapiens
ttctgcactgattcccattgccctggcccctagtcccacagggaggatgtggaacagcccggtagatgccgtgctcatagtacgtttcagtcatggctgargagccccaagcttacaaaccccaacctttatcaagcaaatctgccaaaccgttgtcctggaaggaggcactgtctttattatactggaaagaaagccatc

SEQ ID NO: 56945 - DNA, 201 bp, Homo sapiens
ctccttctctcttaaaaaagaaggaacatgatatgccacttgcaagattaggatattctgtttaaaaagaggggataatttaagcagggctggcggtgggrgcggggagacaatggaaaaggctgacatctcctgagcatggctcaagaaggcataattcttccgcatgtataagaataaaacctcttaactcatctccca

SEQ ID NO: 56946 - DNA, 201 bp, Homo sapiens
gggaaagaataatattttgtgacacatgaaaatgtatatgaaattcaaattccagtatccataaataaagtttctcgcagccatgcctgctcctttacatrtcgtttatgcctgtttttgcactatgagggcagagttgagtagttggcaacaaacactacaaggccccaaaatatttattaaatatcccatcacagagaa

SEQ ID NO: 56947 - DNA, 201 bp, Homo sapiens
aaagtttcagttagcctcagtccctgatgatctgcaggaatttctccttctctcttaaaaaagaaggaacatgatatgccacttgcaagattaggatattytgtttaaaaagaggggataatttaagcagggctggcggtgggggcggggagacaatggaaaaggctgacatctcctgagcatggctcaagaaggcataat

SEQ ID NO: 56948 - DNA, 201 bp, Homo sapiens
tatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgt

SEQ ID NO: 56949 - DNA, 201 bp, Homo sapiens
gccaagatgggacagtgctcgtctgccagtggcagccccattcggagagaattttccctttgaagaatataacccataaaagatcatcaaaactaagggawtaaataaagaggggacctcgatgacatatttaagctctgaataaagctagactctaagcaggggttggcaaactataaccgctgggccaaacacggctgt

SEQ ID NO: 56950 - DNA, 201 bp, Homo sapiens
ctgtggcttttgggccaagggtagtggggaaaacagcttcttgtcactgggggaacaagccaagatgggacagtgctcgtctgccagtggcagccccattyggagagaattttccctttgaagaatataacccataaaagatcatcaaaactaagggaataaataaagaggggacctcgatgacatatttaagctctgaat

SEQ ID NO: 56951 - DNA, 201 bp, Homo sapiens
caagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatcct

SEQ ID NO: 56952 - DNA, 201 bp, Homo sapiens
ctaggccaatcctggttctccctgtggcttttgggccaagggtagtggggaaaacagcttcttgtcactgggggaacaagccaagatgggacagtgctcgyctgccagtggcagccccattcggagagaattttccctttgaagaatataacccataaaagatcatcaaaactaagggaataaataaagaggggacctcga

SEQ ID NO: 56953 - DNA, 201 bp, Homo sapiens
tagaagctatagatttgtgtgtccagaatgtttccccaggtgcctccttttgcaaaattggacctcatttttccattagggaacggggcctctcagactcygtggagaagcagagaattatctccagccttgactgcccaggctgcagagaaccgcatcatccggggacatgactgattcagggataggtgtctgcctaaa

SEQ ID NO: 56954 - DNA, 201 bp, Homo sapiens
accataaaaggatcatagcagattgacggtagaagctatagatttgtgtgtccagaatgtttccccaggtgcctccttttgcaaaattggacctcattttwccattagggaacggggcctctcagactctgtggagaagcagagaattatctccagccttgactgcccaggctgcagagaaccgcatcatccggggacatg

SEQ ID NO: 56955 - DNA, 201 bp, Homo sapiens
ttgctgaccactagtaagagaccatccaacaggctcctttctgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaatt

SEQ ID NO: 56956 - DNA, 201 bp, Homo sapiens
tccctccaggtgaaggtaatgattaagaacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccccttccaggccccc

SEQ ID NO: 56957 - DNA, 201 bp, Homo sapiens
atgtacccaataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaag

SEQ ID NO: 56958 - DNA, 201 bp, Homo sapiens
tgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagaga

SEQ ID NO: 56959 - DNA, 201 bp, Homo sapiens
tctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagc

SEQ ID NO: 56960 - DNA, 201 bp, Homo sapiens
cttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggcacatgccaccatgcccgactaatttatgtatttttaatagagatggggt

SEQ ID NO: 56961 - DNA, 201 bp, Homo sapiens
ttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctca

SEQ ID NO: 56962 - DNA, 201 bp, Homo sapiens
gtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaa

SEQ ID NO: 56963 - DNA, 201 bp, Homo sapiens
ctcagccctctgattactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggct

SEQ ID NO: 56964 - DNA, 201 bp, Homo sapiens
agtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttggggaaacttagaaagttcaaccacctggggataaagtttggaaaactaggcta

SEQ ID NO: 56965 - DNA, 201 bp, Homo sapiens
tatttttaccccctcttaaattggaatcatggtatagcaggcaggatacaaacttctcatttccattacacattttcagtgccatcattaatctgaatgayatcaacaaaatgcccaatgcacataaatcagtcagactttgaatcattcctgcagcctctgaacatttaccatggagctcaataagccaggcaagaacac

SEQ ID NO: 56966 - DNA, 201 bp, Homo sapiens
agtctctttcaaaaaacaatagattaaaaagtgcaatatttttaccccctcttaaattggaatcatggtatagcaggcaggatacaaacttctcatttccrttacacattttcagtgccatcattaatctgaatgacatcaacaaaatgcccaatgcacataaatcagtcagactttgaatcattcctgcagcctctgaac

SEQ ID NO: 56967 - DNA, 201 bp, Homo sapiens
aaaactttatgacactgaaatcagaattccatatcattttcctccttcaagaaataatattctcctctttattcttttttgcagatgattgaaaatgtaaraactattctgagcctgcaggccatagccaaagaggtaccggctgtattttgtccatgggcaggagcttgtgactgctggtctaggtcattccaggtcaac

SEQ ID NO: 56968 - DNA, 201 bp, Homo sapiens
ggagacccaggatcagatacagaggacttcgttactcatggcagagcaaacagcatgagctttatttctgcactgattcccattgccctggcccctagtcmcacagggaggatgtggaacagcccggtagatgccgtgctcatagtacgtttcagtcatggctgaggagccccaagcttacaaaccccaacctttatcaag

SEQ ID NO: 56969 - DNA, 201 bp, Homo sapiens
taaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctct

SEQ ID NO: 56970 - DNA, 201 bp, Homo sapiens
atagcttaccatacattaaaagtatcctcttacctaattttatatgtatgtatgtatgtatgtatgtatgtatgtatgtatctatctatctaccttaccayacattaaaatcttacatttctacacgtgcaggactagaatgaacacacataaagcatgataccaatctgcttttttggccaccatataaacattctatgc

SEQ ID NO: 56971 - DNA, 201 bp, Homo sapiens
ggctagaatgcagtggtgcaatcatagcttaccatacattaaaagtatcctcttacctaattttatatgtatgtatgtatgtatgtatgtatgtatgtatstatctatctatctaccttaccatacattaaaatcttacatttctacacgtgcaggactagaatgaacacacataaagcatgataccaatctgcttttttg

SEQ ID NO: 56972 - DNA, 201 bp, Homo sapiens
ctcaactttgctggcatagtgcaaaagtagccacagatagcttataaatgaaggtgtgtagggctgtgttccaataaaactacttcagatctctctggaayttcaataaaagtttttaaaatttagttatgaacactgaaatttgaatttcatacaatttttacatgtaataaaacattattctattggttttttccccca

SEQ ID NO: 56973 - DNA, 201 bp, Homo sapiens
tcttcttaccatgcctgaggcagacaatttaaggcttgattcctcaccctttcccttcatctgctgaaatcccatttagttttagtgcaccaggcatgcastggtatttcatcctatgcattccttccacagcctgacctataaagggctgacactgagtcctggcttgttcagatcagagagaattaacacttttatttc

SEQ ID NO: 56974 - DNA, 201 bp, Homo sapiens
gtaaatggatgatacaaattaatacaaccaattcattttatttggtttggttttggtttttgaatgggtttatgggtttaagagacattgctctctgttgwttatgtgtattcagtgtcagaaaggaaaagtgagcagtgtgaagtcttattagatggaagacaggtctaaggcacatggaaaactgatattcgtgatgga

SEQ ID NO: 56975 - DNA, 201 bp, Homo sapiens
tatttcatcctatgcattccttccacagcctgacctataaagggctgacactgagtcctggcttgttcagatcagagagaattaacacttttatttctttratttcaaaagcttctgaggtaacttttgagctcgtaaatgtcaataatttgttgtcaagacaattatattcttaacccagctgctacatacagggaacat

SEQ ID NO: 56976 - DNA, 201 bp, Homo sapiens
tgactatgcttctcaaaatgtaaatggatgatacaaattaatacaaccaattcattttatttggtttggttttggtttttgaatgggtttatgggtttaasagacattgctctctgttgtttatgtgtattcagtgtcagaaaggaaaagtgagcagtgtgaagtcttattagatggaagacaggtctaaggcacatggaa

SEQ ID NO: 56977 - DNA, 201 bp, Homo sapiens
tatttctttgatttcaaaagcttctgaggtaacttttgagctcgtaaatgtcaataatttgttgtcaagacaattatattcttaacccagctgctacatayagggaacatagagactgacagaaagtcagtgaatttagaattaaaacagtaagtttatctgattgactatgcttctcaaaatgtaaatggatgatacaaa

SEQ ID NO: 56978 - DNA, 201 bp, Homo sapiens
agtttcttgcctaaatttgtgatctccctttggcttcataaataacggtacatttcatgaagagctggtctcagtctacacaagcctaactgaatggggtrcataggaagggttgcattgtgtgacaaggtttaaatctaattgttttaagtctttgagttatttgctcaccaggctgtgcttgatggttttactttttgt

SEQ ID NO: 56979 - DNA, 201 bp, Homo sapiens
agggaggccaggcatggtggctcatgcctgtaatcccagcactttgggaggtcgaagtgggtggatcctgaggtcaagagatcgagaccattctggccaayatggtgaaactccgtctctactaaaaatataaaaatgagctgggtgtggtggcacgtgcctgtggtccctgctactcgggagggtaaggcgggagaatca

SEQ ID NO: 56980 - DNA, 201 bp, Homo sapiens
atgagcgttttgcttcgtgtactcatttatttctgaaaataatgcagccccttgtagggctttctggctaattgagtggtgccatcattcatgcaattgcrcaattcacacaccaggctgccactttggcccctgcgtcaccttcaccaccacccaatgtgtcctgctcatcactgaggtttgtcatttttactctgagtc

SEQ ID NO: 56981 - DNA, 201 bp, Homo sapiens
ggtggatgagcgttttgcttcgtgtactcatttatttctgaaaataatgcagccccttgtagggctttctggctaattgagtggtgccatcattcatgcarttgcacaattcacacaccaggctgccactttggcccctgcgtcaccttcaccaccacccaatgtgtcctgctcatcactgaggtttgtcatttttactct

SEQ ID NO: 56982 - DNA, 201 bp, Homo sapiens
agggtgcttatgaggaaggtttcctactcctaaaagagatacacaggaagagagaccttctgcttcctctggacactggcgcagcctggactagcagttgscagcttgggtttggacaacctccgaccttagttgaaaatgaccctgtgtaggacagaggagcaagtggaaagaacctgggtgcattgtggcattttagag

SEQ ID NO: 56983 - DNA, 201 bp, Homo sapiens
tccctagtgttggatagctaggccatttataatttggacactattttaaaaaataactcaggcttattttactatttatttttgccttacactttttgtamaagtaatcagagcagtaataatagatgactccccaaaatccttttgcctctaatgattagtctaagcccataatgctgtgttccttgccagtgattggtt

SEQ ID NO: 56984 - DNA, 201 bp, Homo sapiens
gagaatcacttgaacccgagaggcaggggttacagtgagtgcggtggcagctgggacattaaccaagttgtgaaaggagccatgatgttattagctgagtyatgtcactgcacctccagcctgggcaacagagtcagactctgtctcaaaaaaaaaaaaaagtgtactttttgaggaaagttctatttttcattattttcc

SEQ ID NO: 56985 - DNA, 201 bp, Homo sapiens
aagattacaccatgtaaatgaattgtattttatgtaaccattccctagtgttggatagctaggccatttataatttggacactattttaaaaaataactcrggcttattttactatttatttttgccttacactttttgtaaaagtaatcagagcagtaataatagatgactccccaaaatccttttgcctctaatgatta

SEQ ID NO: 56986 - DNA, 201 bp, Homo sapiens
aaaatacaaaaatcagccaggcatggtggcgcatgcttgtagtcccagcgacttgagaggctgagggatgagaatcacttgaacccgagaggcaggggttrcagtgagtgcggtggcagctgggacattaaccaagttgtgaaaggagccatgatgttattagctgagtcatgtcactgcacctccagcctgggcaacaga

SEQ ID NO: 56987 - DNA, 201 bp, Homo sapiens
tcgtaatatataggcacatagatatataattaaaaaaacaagaatttctcatgtcattaaacattgcttgaaaaaacatactagtaatttcctaagattayaccatgtaaatgaattgtattttatgtaaccattccctagtgttggatagctaggccatttataatttggacactattttaaaaaataactcaggcttat

SEQ ID NO: 56988 - DNA, 201 bp, Homo sapiens
cagttcctcctagtgggcagtttgctgctgctgtcttacctcctcatcctcacccctttcacctctcccctggtaactgatttatttttccctcttggagktgcttattcttttcttcttccagttgcatctctccctctacttagatacacatttccattttacttctatttggtagtctcagaacttggcttttattgg

SEQ ID NO: 56989 - DNA, 201 bp, Homo sapiens
acttggtaaagaagcagatatttctttaatacgtgtatatattagactgtgaatttattcatcttccttattcatcatataagtaaattatatgattggayccaggcataaaacgtgatttgactcccccttgcccatcacagttctggagttcacatatcatttgttactttgaaaaatgaacttttgttatttgattat

SEQ ID NO: 56990 - DNA, 201 bp, Homo sapiens
atagtgatagtaaaaagaaccatgtgaactgggcgtggtggctcatgtctgtaaagccagcacttcgggagtccaaggtaggagggtcacttgagcccagsaattggagaccagcctgggcaacatcatgagaccccatctgtatccaaataaaagcaacaaaaaaatgagacatgggggtgcatgtctgtggtcccagct

SEQ ID NO: 56991 - DNA, 201 bp, Homo sapiens
aggttcttctgtgataaaaatagacttggtaaagaagcagatatttctttaatacgtgtatatattagactgtgaatttattcatcttccttattcatcayataagtaaattatatgattggacccaggcataaaacgtgatttgactcccccttgcccatcacagttctggagttcacatatcatttgttactttgaaaa

SEQ ID NO: 56992 - DNA, 201 bp, Homo sapiens
ggtgcagcacctcacacctgtaatttcaacacgtagggaggctgaggcaggaggatctcctgaagcccagaattcaagaccaggctgggcagcatagcackacccatctctactataaatttaaaaattaactgggtgtggtggtgcacatctctagtctcagctgcttgggactactagaaaggtaaggcaagagaatcc

SEQ ID NO: 56993 - DNA, 201 bp, Homo sapiens
agctccctccctaatcttgctagaaggtagggctaatgcattgtcaattcagaaatagggggtgttcctgagtctggggacactctagtgaaattctatgkgtaaaataatttgtacaagtttatatttttagctaaattaaaatactcacattcccattattttttagaggttgtaagctaagtaataacattctagaaa

SEQ ID NO: 56994 - DNA, 201 bp, Homo sapiens
taaatagatgcacaaagcagagggaatcaagtagaataacatggtttatttgtgtgtgtattgttctgtttttggtaaaatcatgcttatcatatcttcartgcatcatttattctgagtccacattgctgcctttgagccggggccctgaggtatctcctatactctggctggggtgagggcggcaggtcctctgggcca

SEQ ID NO: 56995 - DNA, 201 bp, Homo sapiens
ctgcttttgccatcaaatggttattgaaagaactatctgtgttgacagccttttgggtttcatacagtcctttccagcttgggcagtatagataaatagaygcacaaagcagagggaatcaagtagaataacatggtttatttgtgtgtgtattgttctgtttttggtaaaatcatgcttatcatatcttcaatgcatcat

SEQ ID NO: 56996 - DNA, 201 bp, Homo sapiens
ctacgttggcagagctcagtagtcatgacagtaaccatatgcccacaaagcctaaaatatttactatctggctctttgcagaaaatgcgctgaaccttgcrtgttgtgtcacccctggaggtagcaccttgtaattaagcacatgaatatctcacatcagaatgaatgaatattcacactcagtgggacaaacaacttctg

SEQ ID NO: 56997 - DNA, 201 bp, Homo sapiens
gtctcccgtctgcagaagcattggctgacatggaagattttttttttttttaatacttttctttttgccggcatctgcgtagaatttttttttttttttttggtagtttcttaatggtctttagcaaaggaagtaagtgacactgatcggtgaaggcagacagtaagatttataatgtatttgtgctagctgattgccaac

SEQ ID NO: 56998 - DNA, 201 bp, Homo sapiens
gtatgttggtacgttattgaaggtgatgctagctgctataacaaataagcacgcctgtgcacagttgctcaaagatagtagaagtttatttcttgtttatrtaagatccataatgactcttgccaattagcaggctgctctcttccaagtggtaacccagggactcaagctcttttcatcttgtggctcagccgtctgaca

SEQ ID NO: 56999 - DNA, 201 bp, Homo sapiens
cccagcctgggggagggtttgttaaagaactgtctgttttatcacatgaccacaagttaaaatgttgggcaatgtccctgaatgataccttttcattagtractcacatggacccataatctctgaatttaacatgcttttcaggaatgtgttcatattttccacctataaaacctgttttagtaatttactcccttgtaa

SEQ ID NO: 57000 - DNA, 201 bp, Homo sapiens
gatctcatgagatttattcactatcaagggaacagcacaggcagatcccatggctttgactcagttacctcccactgggtccctaccatgacacatgggarttctgggaactacagttcaagatgagatttgggtggggacacagacaaattgtatcatagaatcataaaaattgctatttctaaggcagatgaataatcc

SEQ ID NO: 57001 - DNA, 201 bp, Homo sapiens
aagagaccaatttaaaacattctaatgagcatcatctcataatttggtaatctcatgtaaaatgcttataataggggtgtgtgtatgttatatatattttwaaaataaatttgtaatcatgtatacagtagtccccccttatccgtggtgtttcagtttttttttttttgagtcagagtattactctgttgcccaggctgg

SEQ ID NO: 57002 - DNA, 201 bp, Homo sapiens
gagaccatcctggctaacaaggtgaaaccccgtctctactaaaaatacaaaaaattagccaggcgcagtggcgggcgcctgtagtcccagctactcgggargctgaggcaggagaatggcgtgaacccgggaagtggagcttgcagtgagctgagattgcgccactgcagtccgcagtccggcctgggcgacagagcgaga

SEQ ID NO: 57003 - DNA, 201 bp, Homo sapiens
actgagcaggaagggccaggtgttttacgactctttggagttagcagcttgttggctctgatttggtaaaagcaacggaaatgccttcagcacggtgaacrttacatgcaaatgttgggaagtgttaggaaagggaatttttttaggcgagggaatttcgcattgaggaaggtccctgcttcgtttttagacacagcctat

SEQ ID NO: 57004 - DNA, 201 bp, Homo sapiens
agatcaagaggcccggaaccccgcagtcctgaatgctaaccagtagagacaagggaggaattcatttctgtttgtgttcaacatagactgagcaggaaggrccaggtgttttacgactctttggagttagcagcttgttggctctgatttggtaaaagcaacggaaatgccttcagcacggtgaacgttacatgcaaatgt

SEQ ID NO: 57005 - DNA, 201 bp, Homo sapiens
agaaagtgagagctttcgaagaatctgtggttagaactaagaggatttttctttctcctttttctgctgttattatctcaaggagagagggaaaaaaaaaatcagagcaggacatgaacagtgcttgcaaattttattacctcattataattgatacctgctctctgagccaataaaagaagctatattcagcactggctg

SEQ ID NO: 57006 - DNA, 201 bp, Homo sapiens
agctggtgacaaaactcaaagaagatgtaactagagaaaaggtactcagtgcagcctctgtgagctaccaccactgcctctagttttccagaaaaccaccmctgaccactctctgtacagatgcgctcaagcgaccataaccaccagtgttcctaacaatgcgcctattgacttcttatttcaatagatatccagatttat

SEQ ID NO: 57007 - DNA, 201 bp, Homo sapiens
caccttccgcaggaatggcctttaacactgtcacctcaccccattcccctccactcttgggaagcatacgtctaggtgagtggtgaagatttttattctgmatttttgaaataatatcgtactgcaagttccaggcaatcaaaaactcacaaatcacttgcactctgcagcagtggtatcaggtctgaagaaaggaagagg

SEQ ID NO: 57008 - DNA, 201 bp, Homo sapiens
ggaggcacaggaggtaaaaatacattgttcaagggtcaattattgtgttgtacaaggtgtgaaatctaccaggttgccatccgagtggagaatttttttastgtacttgcctatgaaggtaaagaagcaaatggaaatttttttttaagaattgaaaggattttatttcaaatcaactctcatacctcatcctgggctcca

SEQ ID NO: 57009 - DNA, 201 bp, Homo sapiens
aaatagtcacatcatggagaatggggtatccatcccctcaagaatttatcctttgagtgataaacaattcagttatacccttttagatattttacaatgtrcaattaagttattattaactataatcaacttgttgtgctatcaaatagtaggtcttattctttctttctatcttttttgtacccattaaccatctgcact

SEQ ID NO: 57010 - DNA, 201 bp, Homo sapiens
cccctgtttcaaatgaatacagattcattttgtcacctgtgtgaaattggtgtccgtgtgccttgcttcctaggctgtccaccatgacatcagcctgcccrtgcaatgcttgagatttgccctgtgactcaacccaaatctaaagcccgagtcgtatgaatccaggacacctgcctgcaaatgcatttttcatgtataggt

SEQ ID NO: 57011 - DNA, 201 bp, Homo sapiens
aatacagataatttctctcttaaattccataagctggagacactgcccctgtttcaaatgaatacagattcattttgtcacctgtgtgaaattggtgtccrtgtgccttgcttcctaggctgtccaccatgacatcagcctgcccatgcaatgcttgagatttgccctgtgactcaacccaaatctaaagcccgagtcgta

SEQ ID NO: 57012 - DNA, 201 bp, Homo sapiens
gggtattactctgttgcccaggctggtgttgaactcctggcctcaagcgatcctcctgcctcggcctcccaaagtgctgggattacaggcttgagctactkccccaggctcttcccccgtttgttaatacataccatgaccttggcctttcccacctcttaggttttgcttactttcccttctgtcctttacttatgactc

SEQ ID NO: 57013 - DNA, 201 bp, Homo sapiens
acactgtttaccagattggagtgcagtggtgcaatcctagcttactgcagcctgtaggtcccgggctcaagcgatcttcccacctctgccacttgaatagstgggactacaggtgggtaccaccatacccagctgttgaaaaaaaaatggtggggtattactctgttgcccaggctggtgttgaactcctggcctcaagcg

SEQ ID NO: 57014 - DNA, 201 bp, Homo sapiens
atgccgacccacaagctctggagcagtcaactcagaatggtcaggacttggtcagtaatgcccatttttgctaaattttgtccccacttccaacgcaggaycaaccagagaaagccacatatgctccccaaaccaatcatacaggatgtcctggtctagggagcccacctccggcttccccatgtccacagcctccaatcg

SEQ ID NO: 57015 - DNA, 201 bp, Homo sapiens
cccacacttactcttattcacccagaacaggtgtgtgccaccttggagaagatgaagccagagagaaaatcagtcagacaggaattatgttgaaaggtgamtgaatacattaccacctcccaggagttgaatgaaaaacggctatttctttaggacgtcaaaccacctttttcctctctaattcatgcatatccctataca

SEQ ID NO: 57016 - DNA, 201 bp, Homo sapiens
cactcagtgatgggagtcttccttatgaagctgtcccagctccatctctcaggactgaaatgtgggtaagaccatcacatttttcatcccccgccccccgsccccaacattgactgggcagatattcatacaatggcgattgttttgtctgcctggatggctttaacataataccatagactgggcaggttaaacagcaga

SEQ ID NO: 57017 - DNA, 201 bp, Homo sapiens
tggatgtctgaggtatgctaagcctaatctccatcttctcaaagctccactgccactgtcccgtaagggtgggcagattcctccccattctataaaataayagctaccatttcctgagggcatactgagtgctgacaggcacatcaacatcagaccatcaccttcttatacctcaaaatagtctgcagggtgactcagaag

SEQ ID NO: 57018 - DNA, 201 bp, Homo sapiens
gcagaccattgtttagccctccttccacctgggagactggctgctggttctcattgcttctgtgggtctccaggtttctatcattacacagattagcacayggttccatgatcatggacccgttcagtacacaatgaaatcatttgcaaagcaccttggggtctgttagagaagggaatggatgtctgaggtatgctaagc

SEQ ID NO: 57019 - DNA, 201 bp, Homo sapiens
atttggaaacacggcacaagcaaaggcttgaaacgtgcttttatgttggtgcttgcccacttgctgtgctacgaacccttttacttctgggtgcgaacaarcccaggctagccttctgggcgatgagagacacaagaccatgtttccatattgccccagccaagagccaacctacagacgcaactgccttgctgacagcag

SEQ ID NO: 57020 - DNA, 201 bp, Homo sapiens
ttgaccaatgaggcatttggaaacacggcacaagcaaaggcttgaaacgtgcttttatgttggtgcttgcccacttgctgtgctacgaacccttttacttytgggtgcgaacaagcccaggctagccttctgggcgatgagagacacaagaccatgtttccatattgccccagccaagagccaacctacagacgcaactgc

SEQ ID NO: 57021 - DNA, 201 bp, Homo sapiens
tagtgatctgattcattaatatcccttgttattaagaactgtctgtatttgtgtcctggttggcagatattaagtccacagataccaataattaatatctwtggttgattgtaaaaatggccaccaattcttccctgtcccctgcatatgtacatccttgcactgtgaaattgtagatctcgccctccaaaggtgaagttc

SEQ ID NO: 57022 - DNA, 201 bp, Homo sapiens
ggagtaggaggctgcagtaagctgagatcatgccactgcactccagcctgggttaacagagcaagactctgtctcaaaaaaaaaaaaaaaaaaaaaaaaawtcaaaattgatgcaaaaaatatgataacatttcaaaatttaaatcaagacaaattcaatattatagcaaaggttcaagtaatgaacatgaatttgtaatg

SEQ ID NO: 57023 - DNA, 201 bp, Homo sapiens
cagctactctggatgctgaggcacgagaattgcttgaacctgggagtaggaggctgcagtaagctgagatcatgccactgcactccagcctgggttaacasagcaagactctgtctcaaaaaaaaaaaaaaaaaaaaaaaaaatcaaaattgatgcaaaaaatatgataacatttcaaaatttaaatcaagacaaattcaa

SEQ ID NO: 57024 - DNA, 201 bp, Homo sapiens
gtttcttgtagcaggtcatgaagaggaatgaaatactataatcacagagcttgcagaagctgcctggaggaccagttagtctattttttgtacatgaggayactgaggctcagagaaagtgaggtcattgagtcacttgagttcttgttgagtgttctttcctgctgaggtgtcctaggtgcctcttaatgcctttaacat

SEQ ID NO: 57025 - DNA, 201 bp, Homo sapiens
cctccgagttccactggctgcattctcatcagaacccagctaaaactcacgtctctcaaattccctaaataataaatccaaagttattgaagatattgggwtactaaaagttggcagtgagactggccccactcatttctttgtaacccctgtccctctttttattattgaagcttgggatgcacttggtaaggctaggca

SEQ ID NO: 57026 - DNA, 201 bp, Homo sapiens
aggcaaacatgttgacacaaacgagagaattttaggttctctttgtagctgtggctgggctgggacaaggacgatggacaaagttatgggggtgctaaaaacctcagtaatgaagataaatgatattctaatctaatattttaaaaaatcgaggctaggtgtggtggctcatgcctgtgattccagcattttgggaggcca

SEQ ID NO: 57027 - DNA, 201 bp, Homo sapiens
attgacagacccatgggtgttaagatccttcatggctactggggagaaatgacaggccttttgaaatcgtatcagtggttttccctgggatcactggaaakaatacccctgtttgacaagatatgacacatgctctgttttaattctgcatttgactaacagaaaagattggtgaagatcagactctgctttaaagttatt

SEQ ID NO: 57028 - DNA, 201 bp, Homo sapiens
aaaacctcatttctgctaaaaatacaaaaatcagctggttgtggtggtacacccctgtaatagcagctactcaggagtctgaggcaggagaatcccttgarcccaggaggcagagattgcagtgagcccagatcatgccactgcactccagcgtgggtgacagagcaagactctgtctcagaaagaggaaagaaatggaat

SEQ ID NO: 57029 - DNA, 201 bp, Homo sapiens
catcacaaaacctcatttctgctaaaaatacaaaaatcagctggttgtggtggtacacccctgtaatagcagctactcaggagtctgaggcaggagaatcycttgaacccaggaggcagagattgcagtgagcccagatcatgccactgcactccagcgtgggtgacagagcaagactctgtctcagaaagaggaaagaaa

SEQ ID NO: 57030 - DNA, 201 bp, Homo sapiens
gtggatagcttgaggtcaagagttcgagaccagcctggccaacatcacaaaacctcatttctgctaaaaatacaaaaatcagctggttgtggtggtacacycctgtaatagcagctactcaggagtctgaggcaggagaatcccttgaacccaggaggcagagattgcagtgagcccagatcatgccactgcactccagcg

SEQ ID NO: 57031 - DNA, 201 bp, Homo sapiens
aggcaagtaggggcaccgaaagctttaaagcagggagtaacaggcttgtagtgacttttatcgaagtagaagttgaatagatctagcctggcacagtggcycacgcctgtaatcgcagcactttggttggctgaggcgggtggatagcttgaggtcaagagttcgagaccagcctggccaacatcacaaaacctcatttct

SEQ ID NO: 57032 - DNA, 201 bp, Homo sapiens
gttggaatgttgcagggaggctgggctaaggtgttctgttcctgtctctggttcaaaggaaaggaatagcctagacctaaaggattctgtctggtagctgkttgctcttcgcgcctgtgctttgaatggtgaataccctcggcgggaggcaggcacctgatgccactgcccccgccccacctgcccccgccccgtttctca

SEQ ID NO: 57033 - DNA, 201 bp, Homo sapiens
aaatcagtatgattcatcataaataagtcaggactatgattgacagtctacctagaaagattaggaaagtggggaccaccccccaattattacctttgttyttacaagtgtgtttaaatctctttctgttaatttacaatttgaaaggtgggtgaggagaagagtttgaaaaatagattactgtcttcattaatacaggtt

SEQ ID NO: 57034 - DNA, 201 bp, Homo sapiens
gtgcttgctttgggagttcttgttaaccctgacaattcttgtcaaatatcttactcctgggctgtgctggggatggcagcagagtggggtggttggatggraaggcgggaaagagctagcttggagatgatacgcttttccatccttgaataacttgggaaaaagtcaggagtgtggaatgaagaattggaatataaaggc

SEQ ID NO: 57035 - DNA, 201 bp, Homo sapiens
ttatttaaaaaaatcagtatgattcatcataaataagtcaggactatgattgacagtctacctagaaagattaggaaagtggggaccaccccccaattatwacctttgttcttacaagtgtgtttaaatctctttctgttaatttacaatttgaaaggtgggtgaggagaagagtttgaaaaatagattactgtcttcatt

SEQ ID NO: 57036 - DNA, 201 bp, Homo sapiens
ctgtccttactgtttcccttgggcacgctgttcaccccttaggacatactacagtaaccttttcccaccaccgtgggaggactgtgattttgtaaatgtcytctgatctctcctctttgcaggcgcagtgacatttatgcacactggctttgaggctcattgatcttttgttttatttgcctttgctgaggcaggggcagg

SEQ ID NO: 57037 - DNA, 201 bp, Homo sapiens
ttcactgaaccaagagatgccataagcagtccttgttgtaataatttaatagcgaagccctcagcaatagatcttcaggtaaaatggatgctgactgtctrtctgtcatatgaagattcagacattgatgtaatttaaaatacttgtagtatcatggatacaaacatatgcctttttatttctgaaggaatttccagaatg

SEQ ID NO: 57038 - DNA, 201 bp, Homo sapiens
ggtgacaggcttctttcttctcatcattaaatgacatactggagatcagtcagatgaactgcaatttatatcttgcccccacccagtgttgatttgcccgrggtcatacagataattagtaatgtcttatctcagttttcttatctgcaaaatgagaatacctgatggggttagtgtgggagtttaatgtctgtaaggtgt

SEQ ID NO: 57039 - DNA, 201 bp, Homo sapiens
aatctggagtccaccatcctgggtctagctggggacatccttgaatcagcctctgggaatcactgaaccaacatgagtcacttgctactgtgagatctcaraacacatggatcaggacagagggcagggctgtttccccaaggaaatccaaatgctttacaggaaggggagtggatgctggcccggcccaggcgaggatga

SEQ ID NO: 57040 - DNA, 201 bp, Homo sapiens
taaattttatttttcagtttacttggttttgcctccttctagaactagaacataagctctctgaagtcagggaccatgcctagaatcgccttccttttatytcccatcagccgaaactaactctgctgtgtcacgctgtgttaggctgtgttggctgtgagtaagagaagtctcacccaactagctgaagcgaggtgggtt

SEQ ID NO: 57041 - DNA, 201 bp, Homo sapiens
tgattttgatttggttgtttttggtagagatgatatcttgctctattgccaggctgatctcggactcctgggctccatcaatcctcttgcttcccaaagtrctgggattataggtgtgagccagtacacttggccttttggcaccattattctgcctgccatcctgtcctaactaaagaaagtaaggtccctccatcctcc

SEQ ID NO: 57042 - DNA, 201 bp, Homo sapiens
atctgccatgccaaataacacctttgcaggtttcagggtagagcatggatgccttttgattttgatttggttgtttttggtagagatgatatcttgctctrttgccaggctgatctcggactcctgggctccatcaatcctcttgcttcccaaagtgctgggattataggtgtgagccagtacacttggccttttggcacc

SEQ ID NO: 57043 - DNA, 201 bp, Homo sapiens
ccaggttcaaatgattttcctgcctcagcctcccaagtacctgggattacaggagcctgccaccacgcctggctaattttttgtacttttagtagagatgrggttgcaccatgtttaccaggctggtctggaactcctgaactcaagtgatctgcccgcctttgcctcccaaagtgctgggattacaggcgtgagccactg

SEQ ID NO: 57044 - DNA, 201 bp, Homo sapiens
taccctggaacttaaaagttggtgaaagaaagaaggggccgggcatggtggctcacgcctgtaatcctaacattttgggaggtcgaggcaggcagattgcytgagctcaggagttgaataccagcctgggcaacacggtgaaaccccgactctactaaaatacaaaaaattagccgggcgtggcagtgtgtgcctgtaatc

SEQ ID NO: 57045 - DNA, 201 bp, Homo sapiens
cccaagaggatccgacagctctggaacttgtaatatttgcagcatgtcttgccctcttaatgtctaagaagtcaaaaaaggacacgtatgcctagaaaacrtgaataattatcatctatcaaatttttaccatgtgccaagcatagtcatatttggctaacgaaaacaacaaaatcaaccgtgacaaggttttattagtaa

SEQ ID NO: 57046 - DNA, 201 bp, Homo sapiens
ctggaatcctactgccaaattatggcactcatcctacttggtgtaaaatcctgggatgatagcttataatagtaataataagacctgcttcccggtgattmtctaaggattaaatcagttcatggagatgaaatacttaaactgtgcctggcacaaagtaaatgttagtgctactattatccctgctgctgttaaccccaa

SEQ ID NO: 57047 - DNA, 201 bp, Homo sapiens
ggtgaaagcatgcaagctaggagttaagatctttaactcagggaagaccctgtctatggaagtgctgagctcttcagtgtcatcacagaaaagcatgagcscctccctggtacggagtcatcacatcccatagctgagcgacgtcggagctccacgatggggaggtgacacatagtcagttaattacataaagagaacttg

SEQ ID NO: 57048 - DNA, 201 bp, Homo sapiens
aacatgtaaatcagctcattcattctgctggccctaaataggtagaaggaagggaaacatgaaagggagccttcatctgttttcctgcagatgcccggctygtggttaacccaagcaagaggtagttaaacggccccgcagattgccagtgactccgggaatgcctaggtttatgtatggattaacacagtgatagaccct

SEQ ID NO: 57049 - DNA, 201 bp, Homo sapiens
cttacaagttagattcacactccaggaatgtatctgttcccacatcccctgatgctgagcataccagagttaagggaggcaagcaaggcccctaacctccyaggttcatggaggtacccattctgcacttgttgaccttgagcttgaggactccataaatgtctgcccttggcattgcacgtgcctccctctgggctgacc

SEQ ID NO: 57050 - DNA, 201 bp, Homo sapiens
tacgttgatctgtacagcaaaccaccatggcacacatttacctatgtaacaaacctacacatcctgcacattgtaccctggaacttaaaagttggtgaaaraaagaaggggccgggcatggtggctcacgcctgtaatcctaacattttgggaggtcgaggcaggcagattgcctgagctcaggagttgaataccagcctg

SEQ ID NO: 57051 - DNA, 201 bp, Homo sapiens
ttttcgttgcttacaagttagattcacactccaggaatgtatctgttcccacatcccctgatgctgagcataccagagttaagggaggcaagcaaggcccytaacctcccaggttcatggaggtacccattctgcacttgttgaccttgagcttgaggactccataaatgtctgcccttggcattgcacgtgcctccctct

SEQ ID NO: 57052 - DNA, 201 bp, Homo sapiens
cattttccccagacctaacctcgatttgtgctccaggtctgagcagaaatgttattccctccagaaagccttccctggatgttgagggatgaagttgtagscccctcccgaatgcgtcctcagaactcgctggttctcgtcctcgccctcagcatacttgctcattgtttgtttccatctctatcatctctgtgagccctt

SEQ ID NO: 57053 - DNA, 201 bp, Homo sapiens
ggggttgggggagggagagcatcaggaagaatagctaatggatgttgggcttaatacctaggcgatgggttgataggtgcagcaaaccaccatggcacagrtttacctatgtaacaaacctgcacatcctgcacatgtaccctggaacttaaatttttttaaaaaatgtttttattgtgattttcacaggaaagaaggggc

SEQ ID NO: 57054 - DNA, 201 bp, Homo sapiens
aaggattattcctccccttttatcaagagccgtaagtccttggaaaatgcaaagagggggaaaaagaagaaaaacagcaacgagtttattggagagttaamacttaaatactccagtacattgagtgtgacatgcctgtgtaggagactgtctgtcccccaaataattgacaatttctctccatctaacaagaaaatatat

SEQ ID NO: 57055 - DNA, 201 bp, Homo sapiens
agcctcaaactagaacgtggcttttgaacggtgaacattccacaaacatttaatacagagatggctgtggggtgggggctgggggctgggggcctggaagrggagaaggggcaccagaaggagaaatgggaggaaagggcgagtgagatagcaaagagaactcagaaagtaataaagccctgcagtaatcagagggctgag

SEQ ID NO: 57056 - DNA, 201 bp, Homo sapiens
tttgttccctctgcatatagcactttctcaaaaagtagtttggtgacaggcttctttcttctcatcattaaatgacatactggagatcagtcagatgaacwgcaatttatatcttgcccccacccagtgttgatttgcccggggtcatacagataattagtaatgtcttatctcagttttcttatctgcaaaatgagaata

SEQ ID NO: 57057 - DNA, 201 bp, Homo sapiens
agatggcctctagtgaccctcacttcctgggttttacattgcagtatatttctcttctactctgaacaggattgtcctgtgtaacctacagggggaagtgrtagcgcatgacctctgaagctaggtgacaaaatacatttggacttctgctttgcttctcttggatcactccttgtggcagaagctagacaccatgttgcg

SEQ ID NO: 57058 - DNA, 201 bp, Homo sapiens
tctctgtgagccctttgaggatggatgtgtgtccatcttgttaacagttggctccccagtaaccagtacagtgccagatacagagtagtaaccctacattstagcgtaggcaaatattctagtatttgccaaaactagaggatgaatgagtgatgggtaagagagttctcagaaaaatggatataaacaatattgtaaatc

SEQ ID NO: 57059 - DNA, 201 bp, Homo sapiens
cccactaagagtaggtctttctgttaggtacagactctacaataaccaaattcacagaaactgatgtgtaaacccagggtcataaacaataattttcaacmggagctataattatcacatagtttgaaatgctcttgttaatctgagtaggaagagaggatgagaattttcttataggtggaactacagaaaaagagttta

SEQ ID NO: 57060 - DNA, 201 bp, Homo sapiens
tgtgtgagtgtgtgtgtgtaaaataccaaagagaaaacaataaaaaaatagagaaaataataataactagccaatgtgtcatcactccagacaacagccayggtcagtatttggttaacccattcagattttcccctatgaatgagttttttcgcctccataatattagttataatacattgatactacatcccgagtgtt

SEQ ID NO: 57061 - DNA, 201 bp, Homo sapiens
ctgcgccaccacacctgccacaaaatttctttgttatggctgaataatgtttctgtgtgagtgtgtgtgtgtctgtgtgtgtgtgtgtgtgtgtgtgtgtktttgaataatactcctatgaacattgtaccaatatctattcagatctctgctttcgattcttctgcatatatacctaggagtgaaattgctgcgtcgttt

SEQ ID NO: 57062 - DNA, 201 bp, Homo sapiens
agtaactcaacattaactgtgtacccctcctagtttggccactgttctgcccaaacatacaagagtcaatgtaagtctctgggagcactcacctttgggcrtgttgctacagagtcactcattcctagaaattgcgaagtcacgaagttgtcaaaaaacacaacgacaggccgggcgcggtggctcatgcctgtaatccca

SEQ ID NO: 57063 - DNA, 201 bp, Homo sapiens
aaccgtggaggcagaggctgcagagagctgagatcatgccactgtactctagcctgggtgacagagcgagactgtatctcaaaaaaaaaaaaaaaaaaaaatctttcagggatccaggctgacctcagcaccatctcttacatgtgcctctgttctttccctaatataagggagcatgggggattagtgtctggcttaagc

SEQ ID NO: 57064 - DNA, 201 bp, Homo sapiens
gattcccaaaatagacgggagttacacagagacctttttttttttaacctcctctgagattttttttaacctcctctgagattctgtatttccttaatgasccgaaaaatctatttagcccagtttttatccttgcagataagttagtacgcttctttttctgctggttgtgatcatatttctatttaggggtaaaggtgc

SEQ ID NO: 57065 - DNA, 201 bp, Homo sapiens
gtgttgggaggaaacagggtgcagagtgggaagggcaggagtatctaagtggccaaatttagcctaattaacagatttgcctagggctgaccctgaagcaraaagcaaagcctagatcagtctgctctcctcctaccaacagggtaatgatgaggttgaaccaccagttctcaatgccatacatgagattcccaaaataga

SEQ ID NO: 57066 - DNA, 201 bp, Homo sapiens
tgccgataaacatcatctggacggaatgaagctgagggccaatagtttagaggctcagcacccgactggagagagagagagagagagagagagagtgtgtatgtgtgtgtgtgtgtgtgtgtgtgtgtgcgcgtgcatgtgtatacgctggtgtttaggtgggcttgagaaaagtgctgactttgtgaacgaggaggaggg

SEQ ID NO: 57067 - DNA, 201 bp, Homo sapiens
caccactgctcgcattcccatgttggagttttccctttggggttcttatgccattttaaagactctgaaaacaggaagactttttctcttgggtatttttwtttttttttcctctgcaagggatggggtcataagacattggtgaggttaggccttcctttgtctcccaggagcacacttgatagcaatgtagggtgaatt

SEQ ID NO: 57068 - DNA, 201 bp, Homo sapiens
ctgccgataaacatcatctggacggaatgaagctgagggccaatagtttagaggctcagcacccgactggagagagagagagagagagagagagagtgtgwgtgtgtgtgtgtgtgtgtgtgtgtgtgtgcgcgtgcatgtgtatacgctggtgtttaggtgggcttgagaaaagtgctgactttgtgaacgaggaggagg

SEQ ID NO: 57069 - DNA, 201 bp, Homo sapiens
ttctgccgataaacatcatctggacggaatgaagctgagggccaatagtttagaggctcagcacccgactggagagagagagagagagagagagagagtgwgtgtgtgtgtgtgtgtgtgtgtgtgtgtgtgcgcgtgcatgtgtatacgctggtgtttaggtgggcttgagaaaagtgctgactttgtgaacgaggagga

SEQ ID NO: 57070 - DNA, 201 bp, Homo sapiens
gattctgccgataaacatcatctggacggaatgaagctgagggccaatagtttagaggctcagcacccgactggagagagagagagagagagagagagagwgtgtgtgtgtgtgtgtgtgtgtgtgtgtgtgtgcgcgtgcatgtgtatacgctggtgtttaggtgggcttgagaaaagtgctgactttgtgaacgaggag

SEQ ID NO: 57071 - DNA, 201 bp, Homo sapiens
tgaggcaggagaatcatttgaacccaggaggcggaggttgcagtgagccaagattgcgccactgcactccagcctgggtgacagagcaagactctgtgttwaaaaaaaaaaaaaaaaaagttctaaatcagtggattctgccgataaacatcatctggacggaatgaagctgagggccaatagtttagaggctcagcaccc

SEQ ID NO: 57072 - DNA, 201 bp, Homo sapiens
ggaatgccatagtggtgagctaagagcaggcagttagttaagtgtatgacaagtatctcattataaatggatgctgaaatgtccaagtgtggaaatgataygcttcagctcttatttttaagtcatccttatctctttcacttattccctcattcaggcaccaaaaatgctgtttgactgggagagcaagtggagctgttc

SEQ ID NO: 57073 - DNA, 201 bp, Homo sapiens
gtgtttttttttttttttttagatttctcattgctgagaacagttccagctctgctgaccaaaggctgagtgtccttttattagtctgagcccctagagaraccaaagaggcaaccctcgagccaactgacagccagctgtggggttggaccctgtttttcatacagtgagcactcttgaacccagagaaggtgcaggttg

SEQ ID NO: 57074 - DNA, 201 bp, Homo sapiens
atcgcagacacggaaaaaaggattattcctccccttttatcaagagccgtaagtccttggaaaatgcaaagagggggaaaaagaagaaaaacagcaacgartttattggagagttaacacttaaatactccagtacattgagtgtgacatgcctgtgtaggagactgtctgtcccccaaataattgacaatttctctccat

SEQ ID NO: 57075 - DNA, 201 bp, Homo sapiens
ccacttcctggaggactgtcagtgctagctaatgagactgtaaaagtggactatctgcccaggagacagtgaggaaggaaatcaggggtcacccttacagsgaagggctctttgcagagagagtgcctgatacgtagcagctggtacttctccatcttgaaactgtccttcctggttttgtctaatttgtcatcatgggat

SEQ ID NO: 57076 - DNA, 201 bp, Homo sapiens
ctgcgggggcctaggccaaagatatgcccgagtagaaaatctgacaccagcttcccagttttctcttctgctctctttggctgcaacgcttttaccatggstaaaccattaggccggctctgcagggagggcaagaccacagcagctcagtatttcctgctcagggaaaaaggccaggtcttttgttggtggaaatccact

SEQ ID NO: 57077 - DNA, 201 bp, Homo sapiens
tcccagggtaaagagtcaccgctgattaattacctcaaggacaaggggacggtgactttttctcttgtatccagcagcgccacgcggggcgggcgggagasgcaaggctaagaggtggatgaaaggctagggttaaggcatttcacaatgtcaggcatcttgttagactgcggctttccaggccttcccccgtgactgctg

SEQ ID NO: 57078 - DNA, 201 bp, Homo sapiens
cttccatttgaaaggagctttaaacacctttggtggcagctaagagtgtcaaaatggagggatgtgtaggggacctagggcctgggtaacattgtcccagsccagggcctattgtgttgtgtgtgtctccactttccagcctttgggaacgcagagggggacctctgtaattggtaccagcatcccttccttgcagggtcc

SEQ ID NO: 57079 - DNA, 201 bp, Homo sapiens
cgtccctccgcacctcactgttgggctgatcaatcccattcccactccattatgtgtgtatttctaagtggcagatttgccttaggaaatggaagaagggsatgaaatagtgaccaacacaaattactgggttggcgggagttgagagctggcaaaatcgtcttggagaaggaaatggtgcagatttcagagctggcagac

SEQ ID NO: 57080 - DNA, 201 bp, Homo sapiens
ctggagtcatgtgtttgcttctggaagggaggcaagaggcattcaacctcctgttaatttggttgctccttcagatacgctcttcatggtacagccctgasctgcatcatttaaagaccaattgttaaggaccaatctgagggcctgtgcattagttaaaactccttatctggtcatagagggtggtgtggtttggacgcg

SEQ ID NO: 57081 - DNA, 201 bp, Homo sapiens
atatgatgactagttggtgagttgatcttgtaagacttttacagatacccagaacggctctacttcttcatattccactttttagttttaaaagtttaagkagatctctgtgatccctgaagaattgtgtgcaaagcagcattaagacgaaaatcttttatatttgtgttgtagcttggaaaactagcgcgtggtctgttt

SEQ ID NO: 57082 - DNA, 201 bp, Homo sapiens
atcatctccgtccacatcaatgtcgtcatcgtccttatgaaaagccctgggcatcattttgcccttgagctggatgtccatgttggaaaaacagctagtgraaggcgtgcccaaatctcagaagttggcgtttccttgcagatatcattggtggccattggaggggaaaaagatgctttggaaaccaggacacagagaaaa

SEQ ID NO: 57083 - DNA, 201 bp, Homo sapiens
ttgccacttcctggaggactgtcagtgctagctaatgagactgtaaaagtggactatctgcccaggagacagtgaggaaggaaatcaggggtcacccttayagggaagggctctttgcagagagagtgcctgatacgtagcagctggtacttctccatcttgaaactgtccttcctggttttgtctaatttgtcatcatgg

SEQ ID NO: 57084 - DNA, 201 bp, Homo sapiens
ctcagacagataagaagctggcccacccttgccacttcctggaggactgtcagtgctagctaatgagactgtaaaagtggactatctgcccaggagacagygaggaaggaaatcaggggtcacccttacagggaagggctctttgcagagagagtgcctgatacgtagcagctggtacttctccatcttgaaactgtcctt

SEQ ID NO: 57085 - DNA, 201 bp, Homo sapiens
ctgtggaactatgagccaattaaacctcttttctttataaattacccagtctcaggtaattctttatagcaatgcaagaatggcctaatacatggtctctsagcaggattattgtagaggggactgatgttgaagaatggaaaagaaggcagtgtcagagaatgctgaagagtgtggatcttaaagtccaacctcaaggcc

SEQ ID NO: 57086 - DNA, 201 bp, Homo sapiens
gagtgtttatcagctcacaccaaggaagagagagctcaggagcgactgggcatgaggtggagtgagcactgtgaatgctggggaatggaaagtcctttatstggtgttgcctaagggtacggggaacctggcctggtgttgggaggaaacagggtgcagagtgggaagggcaggagtatctaagtggccaaatttagccta

SEQ ID NO: 57087 - DNA, 201 bp, Homo sapiens
atggaaaggatctattcctagaaaggatccattcctagaagaggaattctgtacaatatggccaactttctctctgttgaggttgaaccatttgacacatytcgctagcattgggaaaatccccattttcctcactatccatttttcttcctctctttccttcctcttttcccttcttcctcttttttttcttttctttcc

SEQ ID NO: 57088 - DNA, 201 bp, Homo sapiens
gaaaacaagtaagagtaactttgtacaccgtgggctcccaatcagtgctgcttttcgttgttgatgttgttgttaatgttgaaaaaaatcttcaagtcatrtttgcccccacagaccttcccagacagtctaactaaatgcactgtatttgctaactgttggaacttggcttttggactagaccagcacctcgagaaagaa

SEQ ID NO: 57089 - DNA, 201 bp, Homo sapiens
ttttcaaaacaataccaagaagctggtcttatttagatctagtcttatatcattgaaatatcattagaattcttatggaaaatatgttttggctgtttagrggatgctaggggctggaagtgagaaggtttcaacaccatatgggtatgtgagtatagatgcttacaagaagaagggtagacttagccaaaactaatttgg

SEQ ID NO: 57090 - DNA, 201 bp, Homo sapiens
ttctccatttatattggtatggatacgtgaatatttagtttattctgtaggtcataatacgacagtattgtgatatattttggtgctcaaattgttccggstttggcccataggaggtctttcgggcaggttcctgcacccttttgacatgccccgttcttttttgagcactttcttattttttggcactgtaagaggctt

SEQ ID NO: 57091 - DNA, 201 bp, Homo sapiens
ggttaacgtggtatctgccagatttctccactgtaaaggatcatttttttcctttgtaattaataaatatattgggggaggtactttgggactacttctcwaattttcatccattaattttagcatccctctggggatcttgcctgcaatgattaatactgtggtattctcatgactgatattgtctttctgtcatgcctt

SEQ ID NO: 57092 - DNA, 201 bp, Homo sapiens
agatgggtttatgcctaattgtgccaccagtttttcccataaaataattcatttggaaggggtggcctaatccagtctgaaccaattctaagatggtagcrtggatgcgggaggcactgcacaggatggaaagcatggagtttggaatctggcacaagtggatttgaattcagacttagtcatcaggagctgtgggacctt

SEQ ID NO: 57093 - DNA, 201 bp, Homo sapiens
aagacatggagctgagagtgaatatgagagtgaatattctgcacgtccattttaatgaccttgtgcctcattttccccatttaaggtagatgggtttatgyctaattgtgccaccagtttttcccataaaataattcatttggaaggggtggcctaatccagtctgaaccaattctaagatggtagcgtggatgcgggagg

SEQ ID NO: 57094 - DNA, 201 bp, Homo sapiens
tgaaaggctgtctccaaccatgcggacacagcgcagtgaagcggttggaaaagctacagacaaatggaaaaccttcattccaaagggtcgttgtctcctcytatttaatagccctgcattcatgcacttttttttatcttgctgtctttttttttttttttaatcaaataccaaagtacttctatggactggtcttaaaaa

SEQ ID NO: 57095 - DNA, 201 bp, Homo sapiens
ttactttttgggctggtaaagccacctaggtcagtgccatgtccaacccaatctggaaaacgattattgtggtgcctgttttgttgacttaacaaagccartcgcccattcctatgctgctaagatgcgaatgcccagctcaggggatgagattactgtcagctttgcctaagctttgggcattagcaccctccatatgca

SEQ ID NO: 57096 - DNA, 201 bp, Homo sapiens
cgacttctgattttcacgtgactcactgcttagttgtctgggtttgttttaattcctttccccctgctgacagttctttaagtggatgtctataaaggttggggcattcgctcttacaacaataggaaaagaaaggaggaaggaataaaaaagagagaaaaggaataaaaaaaagtttggtttagatgtctgatttctctg

SEQ ID NO: 57097 - DNA, 201 bp, Homo sapiens
aattccagttctctcatattaagtgacaagttgcagaatgcccctgtctttctgagctgtttttatatctgtacaatggggttaatactactagtatttgmttccagggattgttttggaggggagtgaggaataaatgatataattcactaaaacacgtagaatagtatttgacacagagtaggtcagcatgcccaaagt

SEQ ID NO: 57098 - DNA, 201 bp, Homo sapiens
ctgaaccacacttgttatctttcattttatgatgagaaccaccttaagaggtgtgaggtgacatctcactgtggtttcaatttgcattttcctgagaattwgtgacagtgagccccttttcatacacttggctatttgtatgttttctttggagaattgtctatttggttcctttgcttgtttttaaaatctgtggttttt

SEQ ID NO: 57099 - DNA, 201 bp, Homo sapiens
caaaccaccaaacctgggttggcgtttcagtgcctgacacagttgtattcctaagacatagttgggaccagacctcaagaaaatagccaacaaatactggstgaatgaacgaaagaggccatatgcagtcagcccccctctctctgggttctacatatgtagatttaactaatgacagattaaaagcattcgaacaaacgg

SEQ ID NO: 57100 - DNA, 201 bp, Homo sapiens
ctcatttctgggggactaattaaatgcatcctgtgtgaccccactggaagaggacatttggaatcttgtacctggttttctccagacttcgcctcattcascatttccctgtgctcattttgccttgcatccttttgctgtgataaatctcagccatgagtgtgaccgtatgctgagtcttatgagtcttccttgcaaacc

SEQ ID NO: 57101 - DNA, 201 bp, Homo sapiens
agaaatagaaaattaattgagttttagtttttagaaaattatctaagaagtagatttttagaaatagaaaattaacgtagatcacagaaaattatccaaastcagttaattttcccttttccagcaactgtatttgtcctccccacttctcttccctgccttctttttttctccttagcacttacaatgtctcactcatgt

SEQ ID NO: 57102 - DNA, 201 bp, Homo sapiens
aactatattttcttcctttttttgtatgcctccccatgcaaggataattacacagaataagcactgagatgcctgttgatggatttattccagcaattttwtttttttagctctctttgtctggaactttgcaaaataaacaccatggtcactccgtgctttgtgagtgacgtgctagaatggaatttcactgttttaaat

SEQ ID NO: 57103 - DNA, 201 bp, Homo sapiens
agacagtgttagtcaacatcaaatgtctggatcaagagaggcaagaatcccgtggatttggcgttggccagaacttgtctggaatcttgttttctgccttsagtgtcacctgttgagagctctgttgacaaactggcatttgtccttgggagagtagcctcaggaccaggggtgaagagttcagtaaactgtgtttaaccc

SEQ ID NO: 57104 - DNA, 201 bp, Homo sapiens
tttgttttaaataaaaatcatactagagcagtaggcagtgtgggtgagttctcccactttacattttactttgcataatttaggcccctttcaggccactyttccccctgtgccccaggtgtgtttgctaccatacctccccaggggatagccctccaaacctgattggccacctagtctggtcttaaagtcccaaaggga

SEQ ID NO: 57105 - DNA, 201 bp, Homo sapiens
atgttagttattattttaatattacagcatctgtggaaacagtgggtttatatttcagcgtcctgagaaacactcatcctgaacaacgggaacattggccrcatccgccattgtcaattttaaataaaagatatgatgactagttggtgagttgatcttgtaagacttttacagatacccagaacggctctacttcttcat

SEQ ID NO: 57106 - DNA, 201 bp, Homo sapiens
tgtgtcttctcccccatttatttatttaatcatttatttatatcacggtacactcatggacatttattttatgctttatgttataatcctatactactttrtttattttgttgcttaaatttttccagatggaacaatttggtcttcaaaagttgctgctgttggctcctgtgttcttgtgatgtacacacatcatggtgt

SEQ ID NO: 57107 - DNA, 201 bp, Homo sapiens
aaaatagagtcagcagcatctaaagagttgttttactacctctggagctgagaggtgaacatagtcgtttttcaggaagccgtttctggctcagacagatmagaagctggcccacccttgccacttcctggaggactgtcagtgctagctaatgagactgtaaaagtggactatctgcccaggagacagtgaggaaggaaa

SEQ ID NO: 57108 - DNA, 201 bp, Homo sapiens
aatgtcaatattttaatgtactagtaagggaaaattctattaagacataattgtttggctttgtcagtttgtcaacttgaaaatagagtcagcagcatctraagagttgttttactacctctggagctgagaggtgaacatagtcgtttttcaggaagccgtttctggctcagacagataagaagctggcccacccttgcc

SEQ ID NO: 57109 - DNA, 201 bp, Homo sapiens
cgggtggggagggcagacaagttgctcatcctctctgcgcctcagtttcttcatctacaaaatgaagatgttggttatttctttattcaagggttgttgaraggatgaagtgctaaaaatgcttgaccagcattcacacaggcactaagacggtgagtactcactacttagcgctgtcaacatcatctccgtccacatcaa

SEQ ID NO: 57110 - DNA, 201 bp, Homo sapiens
ctgcagctgtcgcagttggaacatgtgacgaaagccagttgatgtgacaactgctgggtgggagggacaggcttgggggcggggctgggagggctccttcycttcctgacccagggatggtctttacttctccctggcacctgtagacctgtctttcttgtgtttcagatttgccatacggatgggaacaagaaactgatg

SEQ ID NO: 57111 - DNA, 201 bp, Homo sapiens
agtgcactccagcctgggtgacagagcaagaccctgtttcagaaaacaaaaacccaaaaagcaaaacccccacagtatatatagaaatacaagatttgtgrggggcgggggtccccctacaaagcaagtgttactgtccacagagcaaatgtcaatattttaatgtactagtaagggaaaattctattaagacataattgt

SEQ ID NO: 57112 - DNA, 201 bp, Homo sapiens
tgggcaagaagggaaggagaattgtgaaacatgcacaattagaagtcgtgcacctgggttcatatcctggctgggccacttactttctggcgggtggggarggcagacaagttgctcatcctctctgcgcctcagtttcttcatctacaaaatgaagatgttggttatttctttattcaagggttgttgagaggatgaagt

SEQ ID NO: 57113 - DNA, 201 bp, Homo sapiens
ttgggcgattcagttttacctgtgtcctctctataccatagtttatgacaaggggttttctgtggctggtctccaaggcctcttccaatcttgacattctrtgatcctgtaagtctttgaataatggcccaggatgccaacaagaagtcaccaatgagagttcaggtgttctgttggaaatctttgtaaaatcacagagaa

SEQ ID NO: 57114 - DNA, 201 bp, Homo sapiens
tgtgtatctgtaatcttagcagaagtgactacttttaacatcgctggaacttttaacatcgctagatttattcttctattttccccgcacacgcatccttaaaaaaaaaaagtagggaggccaggcatggtggctcatgcctgtaatcccagcactttgggaggtcgaagtgggtggatcctgaggtcaagagatcgagac

SEQ ID NO: 57115 - DNA, 201 bp, Homo sapiens
gaatacaaggggggataaagatagacttaaaatacgctctctagaaaaaagtaagaaatatggaaagaaatctaatttagaaaaatgcacgcacccacagrcacgcttcacaggactggcaggtggagaggatgtttgttaacagggctggctattttactttaagtgctgcaaacattgcactaatgtttgggtctttgc

SEQ ID NO: 57116 - DNA, 201 bp, Homo sapiens
gagtgagaccctatctcaaataaaaataaaaatagaatacaaggggggataaagatagacttaaaatacgctctctagaaaaaagtaagaaatatggaaakaaatctaatttagaaaaatgcacgcacccacaggcacgcttcacaggactggcaggtggagaggatgtttgttaacagggctggctattttactttaagt

SEQ ID NO: 57117 - DNA, 201 bp, Homo sapiens
gtaaaaaaaatcatctcacacctgtagccgcagctactcaggaggctgaggcagtagattcatttgagcccaggaggcggaggttgcagtcaaccaagatyacgccactgcacaccagccgggggtgacagagtgagaccctatctcaaataaaaataaaaatagaatacaaggggggataaagatagacttaaaatacgc

SEQ ID NO: 57118 - DNA, 201 bp, Homo sapiens
aaacaaacagcttgtttgtggttcgtcctgaaatcctccctgctcacaaaacagccagctacttggttttctaaaagacgtaattttgcaggcagacttcrtagagccattctgtgcagaagaagggaagggagaagctgtttgttttacctgtagtatgaagatattctttgcgctgttagaactgagctcattaattct

SEQ ID NO: 57119 - DNA, 201 bp, Homo sapiens
tttgggaggtcaaggcggatggattgctggagctcaggagtttgagaacatccagggaaacatagtgtgaccccatttctacaagaagtaaaaaaaatcawctcacacctgtagccgcagctactcaggaggctgaggcagtagattcatttgagcccaggaggcggaggttgcagtcaaccaagatcacgccactgcaca

SEQ ID NO: 57120 - DNA, 201 bp, Homo sapiens
ggaaaggatctaagatgattggaaacagtgtacatagaatacaagaggagttgggcatgctggctcatgcctgtaatcccagcactttgggaggtcaaggyggatggattgctggagctcaggagtttgagaacatccagggaaacatagtgtgaccccatttctacaagaagtaaaaaaaatcatctcacacctgtagcc

SEQ ID NO: 57121 - DNA, 201 bp, Homo sapiens
gaatggaaggagtgtgtttaaaatgtgggtggttttgtcaattcctattgggaatgcttgtatttgaatgtatatacatatgcatatttatgtgtaatgtctatttcatgctaaatagggagtgatcaagttgaaaaataagaaatgctgtttgaatttttaaaataggttataaattataacatgaaaatcaaatacaat

SEQ ID NO: 57122 - DNA, 201 bp, Homo sapiens
gcttgaggccaagaatttgagaccagtctgggcaacataggcagaccccatctctaaaaaaaaaaaaaaaaaaattaaattagctgggcttggtggtgcayacctgtaggctgagctgctcgggaggccaagatgggagaattgcttgaggctggatgtgtgtggctatggtgagctaggatcacgctactttacttcaac

SEQ ID NO: 57123 - DNA, 201 bp, Homo sapiens
ctgggtgggtggaggttcagggatatctgggaaggactaagaatagctttttcttttagtagatcaggagtttcctcttacacacaaaaagctccaaattyaaactagcttaagaggaaagggtcattactggctgacaaaatgcgaagttttgtgcaagagtcagcaaagtttctctgtgatgggatatttaataaatat

SEQ ID NO: 57124 - DNA, 201 bp, Homo sapiens
attttatttcaggaccttggtaaggggttatacaatatttcttttgaaacgagggtctcgattattgggcttgagtatcctgatctaattaatgcactggrcagagctggcagacgtgtgggacacccagctattctctggaagggaagggggatataagagacacactataaaggtgaatggtaatcggcatctcccctt

SEQ ID NO: 57125 - DNA, 201 bp, Homo sapiens
atgctggaaggcaaagtaaaagccaacctcttgagaaagacatggaacacaggatggaacttgaactgcttaaaatggcttttctcaggccagctgcactggagtgtgctgctgtaacaaacacgcccggatctcagtggcttagcatggtgaattcatttcccattcgtgatatctgaccacagatgggaggtaaggggc

SEQ ID NO: 57126 - DNA, 201 bp, Homo sapiens
aagaacatcatggcccccttcatatcctggttaatgtccccgctgaccctgagttctgcctccatcactggaacaagagcctgtctttgggaagaggtgtsttccctggcactcgtttgatttgtagccgccacacatggcaggtcccaagctgtctgaagtcttggctgccattcctaagctactaaaactttgctggag

SEQ ID NO: 57127 - DNA, 201 bp, Homo sapiens
gatttggacggtttgctttagagtgcattaacttctttatcacattaatactgactcatatcttatttcccacttgcaataagaaaaccattcaaatcttkccctcacaggacaatatctttaatagcttctgtgtgtttcctatttttggctgtttctgtataaacagactaatctaatagcatactgaacccatctaac

SEQ ID NO: 57128 - DNA, 201 bp, Homo sapiens
tttagtgagctctgctggcaagtgtgtcaaatttataaatatcactactataaagacatacttttggatatggatttcttcctcagtttatttcttctttsattttttcatgtccaggtcactacgtattgcgtatatttggttggaattttatttttgagcaattcatttacccagattgtgtttctggagattaaagca

SEQ ID NO: 57129 - DNA, 201 bp, Homo sapiens
cagtaagtattcttggggcaaatgggaaaagggttaaaatgaccagatctccagagatctcactcactatggtgaagacagcgccaagccatgagggctcygccccagtgattcaaatacctcccattacggacatgtttcaacatgagatttgagcggggacaaatatccaaactatatcaggatcccagcagactgggt

SEQ ID NO: 57130 - DNA, 201 bp, Homo sapiens
tacctgaactgtctcttaaaaggctctgtctccaaacacagtcacattgtgaggtactgggggtttgggcttccacatacaaagtctgggacacagtacgytctcataagagacctcttctcaacaggatccatgtttgatccgggggaataaagctagagttgctttcttccttgtaatatgtataatgactcatgagag

SEQ ID NO: 57131 - DNA, 201 bp, Homo sapiens
aggaatgtagttcctcacagttctggaggttgggagtcctagatcaaggtgtcagcagggttggtttctctctgtaccattgtccctggcttggagatgaycatcttctctgtcttcacatggtcttccctctgtgtgcgtttgcatccttatggcctcttcttgtgagggcactggtcatattggattagggtccaccat

SEQ ID NO: 57132 - DNA, 201 bp, Homo sapiens
atgttgcctccagcatcccaggaactccgttaatgtttatttgaatgatggaatgaaggtgtcttgctatattttgacatttctgtcaaaatatgaatctrtctttgcctagcatcttttcatgtgcacattgcccatctttataacaaagtgtgagtgggaaaggacttttaatcttcattatattatcattcatatgaa

SEQ ID NO: 57133 - DNA, 201 bp, Homo sapiens
tattccagtgggccccgctgcattcttcccagtcccaggaaatctttgtgcatggctgtcttttctgtgccatcttgggcatctcacgcattggccctatmcacatgttgcctccagcatcccaggaactccgttaatgtttatttgaatgatggaatgaaggtgtcttgctatattttgacatttctgtcaaaatatgaa

SEQ ID NO: 57134 - DNA, 201 bp, Homo sapiens
tttaacaagagacacatgtcagatagtagacatgatctgagaagacacaaaacccagcgtggtgattttggcagccttgccatgcatctctaacatgcacrtggccagaaaaatagcttggacattctgttcaaccctccacatcaactggtcagtttagtctttaaaaggtgataggcctgttgtggtggctcacgcctg

SEQ ID NO: 57135 - DNA, 201 bp, Homo sapiens
aaagtccgcacttcctaatgttaccactctggaggttagaatttcaacatataaattttggggggacacattcagaccacaataatgttttataatgttcmttttgctttaacaagagacacatgtcagatagtagacatgatctgagaagacacaaaacccagcgtggtgattttggcagccttgccatgcatctctaac

SEQ ID NO: 57136 - DNA, 201 bp, Homo sapiens
tatttgttaaaaggctttttgcctaacttgtgaaagttttttttcctcaactaattaagggtatcaacgcattggttgtatgttgaaaatgttgaaaatgttttttttttttttccaagttttctttctttttttttttttatactgggtcttgctcttcttatccagggctgaggtgcagtgacacagtcacagctcgct

SEQ ID NO: 57137 - DNA, 201 bp, Homo sapiens
gcataatttaggcccctttcaggccactcttccccctgtgccccaggtgtgtttgctaccatacctccccaggggatagccctccaaacctgattggccamctagtctggtcttaaagtcccaaagggaggccatcacaaactactcagtatggagaagacctgaatcctaattttggcttaaccccaaacttgggcgatt

SEQ ID NO: 57138 - DNA, 201 bp, Homo sapiens
tagaggatggatgggagcatgaagtgtcctccgtcatgttgctaatgttctgttgcttgttcaagctactgggtgtgttcagtttatgaaaattcatttartgacacatgtatgttttgtgaatttttttgcatgtatattttactctaacaaaaagttcatggacaaatacaaaatcatatctgacagttgttgagagaa

SEQ ID NO: 57139 - DNA, 201 bp, Homo sapiens
cattttactttgcataatttaggcccctttcaggccactcttccccctgtgccccaggtgtgtttgctaccatacctccccaggggatagccctccaaacytgattggccacctagtctggtcttaaagtcccaaagggaggccatcacaaactactcagtatggagaagacctgaatcctaattttggcttaaccccaaa

SEQ ID NO: 57140 - DNA, 201 bp, Homo sapiens
tgcaacttgtcaaacacttacatttgtgaataagaaaactggggtctatttggtggtttatttcagagatgttggatcaaatcagacatcagaaaagacamcagtaccaaacgaagatatctttgctgtatttgcagttttctctcttattaacatgaaaacaccttacatagatggaaacatctaaaggctattttttat

SEQ ID NO: 57141 - DNA, 201 bp, Homo sapiens
taggtgagtggtgaagatttttattctgaatttttgaaataatatcgtactgcaagttccaggcaatcaaaaactcacaaatcacttgcactctgcagcagtggtatcaggtctgaagaaaggaagaggctgcagataggcacatggctttgctaagttagcttttatatcctgcgtggctgccttagaaagtgtccttgc

SEQ ID NO: 57142 - DNA, 201 bp, Homo sapiens
caataaaaacatagatatctaatttgccttacaaaggccgatttgcaaatctagtatttccagtggttctttctttctttctttctttctttttttttttaaatgccccatatgacgctgctttgttggaattgccattggtgaggatctcactgataaagaaggggacatccctcccttgatagactttagggttgcact

SEQ ID NO: 57143 - DNA, 201 bp, Homo sapiens
acagcttagatgaaatttaggcaaatggaacgccccaggccccaggaagactgtggcagcacattgtatgtaactgttggggatgttgcctgaaacccccsccttttttttaggcagctgcaaggattagaatgttgcctcctcagaaactaacactcttctctccttgacctttgtttaaccagctttctgaacctgaag

SEQ ID NO: 57144 - DNA, 201 bp, Homo sapiens
taaaaacagaaacagagcagtccctttgcttccgaatgcagccctcccattggaatcactttggaagaatctggatctgcgtgttacccagtcttactttkcaggcagtcccaggcaggaaggcccattagtgaaaagagccctgcatatgctgtgggtcatcacagctgctgctttgcacatttaggagatatttgtgga

SEQ ID NO: 57145 - DNA, 201 bp, Homo sapiens
ttctttaaaaaaaatttatgacatattacttttgctaattatgtgtgtgggtagattatgttattcatgaattttatttcaggaccttggtaaggggttayacaatatttcttttgaaacgagggtctcgattattgggcttgagtatcctgatctaattaatgcactggacagagctggcagacgtgtgggacacccagc

SEQ ID NO: 57146 - DNA, 201 bp, Homo sapiens
ttttcagagttggtttaccaatatgatgtctgtattaaaatatatgtaatgctgctttcaaaatgttaagtattatgagaatacattaacaaaactctggygaattttttgtcttatgtttcttgaatccaaacctataagtaggtgcaaacattagacgatttcattttgggcttctgatacactcctgtccgagaagtt

SEQ ID NO: 57147 - DNA, 201 bp, Homo sapiens
atgagagcagattttgcctgtttcttccaaaatctggattcagtgacatcgtgttggtagcttgaaactgaccgtggtgagaatatttacaccatggaaaktggcaaatgctactaataaggatgattgttttagttttcattttgtaattttcagagttggtttaccaatatgatgtctgtattaaaatatatgtaatgc

SEQ ID NO: 57148 - DNA, 201 bp, Homo sapiens
cggtaaaaaacttgtttccattgatctgaccccagaattccctgtgcttatacagatacacaacgtgcactgggtcttccagaaatgcaggggccttctamatcaagggaagattgtgtggtgttttgttccagtcttttaccaaggtctcaataccatcttgaaacatcatgcagcactgctcataatatttgagtcacc

SEQ ID NO: 57149 - DNA, 201 bp, Homo sapiens
gggcattttggaaatttggaaaggcattttggtggcctttggcacttagcaggtggggtccacgggtccatcctgtgatgccataggcagtccaatataasaaagaactgccctcgtcccggtaacatacacctgtgcccccagacattcatttcggtaaaaaacttgtttccattgatctgaccccagaattccctgtgc

SEQ ID NO: 57150 - DNA, 201 bp, Homo sapiens
agaatctaattttactgtgcattttcttgattattagtgaagctaaacattattttttattgatgtgttaacaatttctttcttttgcaaatgatctattmatgttctgtgactgatttctatcttggtgtctttacgtttgtgaatggtaagaatttttatgtgttcaggaactatttaaatgttcaagacattaacctg

SEQ ID NO: 57151 - DNA, 201 bp, Homo sapiens
tattttgcattgtttatgtcagcattaagcagtattcttacacagtttgtaagtcttaaaactcagtatctactctagtagttgctccaaatgtgatgtcstcataaatcaccgagggatcttgttaaatttggattctgattcagtaggtctaggtggggcccgagcttctttgtttccttttcttatttaatttttgtg

SEQ ID NO: 57152 - DNA, 201 bp, Homo sapiens
acttgtggaataattttttaatataaaataattaccatcactaatcctaactgtgcacattcttgactctgtgacactgagcaaaatcctgaacctctctrtgccttgatttctttcacgtcttgttctagttttgaagagcgattcttgtgtgaattcagggagaggaggcatgaggcatggtaaggccaccgtacgtct

SEQ ID NO: 57153 - DNA, 201 bp, Homo sapiens
ggaagccttcactctaatgacataattacctcccaaagtccgcacttcctaatgttaccactctggaggttagaatttcaacatataaattttggggggasacattcagaccacaataatgttttataatgttccttttgctttaacaagagacacatgtcagatagtagacatgatctgagaagacacaaaacccagcgt

SEQ ID NO: 57154 - DNA, 201 bp, Homo sapiens
tggtgcccatcaccccgatcacatgaacgtctatgcccaggtcccatttcctgacattcccaacatctctaccttctccgggcctagggcagggatcactstttcagaaacatgagcgtatggaagccccagtgtgttccttgaagtcccgatgcgtgatttgtccccatgctgtgtcgcacttggtcatctggaccctgg

SEQ ID NO: 57155 - DNA, 201 bp, Homo sapiens
aaagaggtgtaaatggacaagaatgaaaagcaattgcaagggcccttgaaggtttgtgaaggatggcaaagtgacttggatgttgatttctaaaggaggtraaacttgaaggtagacaagctctttgtgtccatacatttgatgggtcatcctatgaaggagggcccatctcttacggcaggcagcgtggcgtaggcctca

SEQ ID NO: 57156 - DNA, 201 bp, Homo sapiens
cagcacagtgaggaggtattctttggagagcactgtttcccaagagtgattctaacaaagaggtgtaaatggacaagaatgaaaagcaattgcaagggccyttgaaggtttgtgaaggatggcaaagtgacttggatgttgatttctaaaggaggtaaaacttgaaggtagacaagctctttgtgtccatacatttgatgg

SEQ ID NO: 57157 - DNA, 201 bp, Homo sapiens
actctacttaaaattaaggcataaagtaggaaaatgtgtttcctctgtatagtcttattactttgcctgttaagttaactggttcctatttctgctggttygaagaggtccaggacatttaaatagctcttctagaaacaaattcttttccttacaagccctgccaggtcagtgggttcagtaaggaagaaggttttgtat

SEQ ID NO: 57158 - DNA, 201 bp, Homo sapiens
acccagtggaacgctctttctagtttggggcataaaataagataacactctgaattcctacaggaaatcttgtaactctacttaaaattaaggcataaagyaggaaaatgtgtttcctctgtatagtcttattactttgcctgttaagttaactggttcctatttctgctggttcgaagaggtccaggacatttaaatagc

SEQ ID NO: 57159 - DNA, 201 bp, Homo sapiens
gcttagatgaaatttaggcaaatggaacgccccaggccccaggaagactgtggcagcacattgtatgtaactgttggggatgttgcctgaaaccccccccytttttttaggcagctgcaaggattagaatgttgcctcctcagaaactaacactcttctctccttgacctttgtttaaccagctttctgaacctgaagaac

SEQ ID NO: 57160 - DNA, 201 bp, Homo sapiens
tctgccctcctcggcctcccaaagtgctgggattagaggcctgagccaccgcgccagctctatttgctgatttttgaacagcagcttttttttttttttttaacaaaactttaaaatgggttatgtgttttattttcttagtgaagtaatggcttctcaaatttacactccattattttatttaaaaaaatcagtatgatt

SEQ ID NO: 57161 - DNA, 201 bp, Homo sapiens
ggtcaaggtagtgttcattaggtttctccactgcacacttagtctttccctctactttccacactgctgcctttggaggagtgttgctgtgcccagctcaygcttgtggagtggggatttaatgttctcactcttcgagggtagagtatctgcataaactacttggaattctacatggaatatttgtgtcttctcccccat

SEQ ID NO: 57162 - DNA, 201 bp, Homo sapiens
gtctccttagcatcttcttggctgtgacagtttctcagaattgtctttgtgatgaccttgacagctttgaggagtgctggttgggtattctgtaggatgcycctgtgttgggatttttatgatgtttttctcatgagtttactggagttaatgaatttcagggaggaagaccccagaggtctgttttcatcacatcgtatc

SEQ ID NO: 57163 - DNA, 201 bp, Homo sapiens
ttttttttttttttggctgactgtcatgacttagtaaggccatcacaggttgccagaacatctactcaactgttccaagcataacctcctacacaggcctkctacataggagtatatttggccaagactcaccactagaagtgatttccactggactttcctacagcaagtggtaaatgatccctcagataggcccaagag

SEQ ID NO: 57164 - DNA, 201 bp, Homo sapiens
gagatcgtgccactgtactccagcctgggtgacaagagtgaaactccatcttaaaaaaaaaaaaagtgaacccttgtagtttcttcctctgtttgacagayggaccctaagacggccccagtgataccccacctcctggtgtccaaggcctgatgtgatcacccttcccccaccttgaatgtaggtgggacatgggactta

SEQ ID NO: 57165 - DNA, 201 bp, Homo sapiens
gtttcaccacttttggccaggctggtgttgaacccccgacctcaggtgatctgccctcctcggcctcccaaagtgctgggattagaggcctgagccaccgygccagctctatttgctgatttttgaacagcagcttttttttttttttttaacaaaactttaaaatgggttatgtgttttattttcttagtgaagtaatgg

SEQ ID NO: 57166 - DNA, 201 bp, Homo sapiens
gaaaaggaaagacaacagataagtgattgccagggactggagaggagtggggggtgagtgggaaccagagtggatataaaacagcaactggaggatcctgrtatagatggaaatgttctgcatcttgactgtctcaatgtcaatttcctggttgtgaaatcgtactagagttttgtgagatatcacctatgggggaaactg

SEQ ID NO: 57167 - DNA, 201 bp, Homo sapiens
catctcaaaagagaagaaaagagaagaaaaggaaagacaacagataagtgattgccagggactggagaggagtggggggtgagtgggaaccagagtggatwtaaaacagcaactggaggatcctggtatagatggaaatgttctgcatcttgactgtctcaatgtcaatttcctggttgtgaaatcgtactagagttttgt

SEQ ID NO: 57168 - DNA, 201 bp, Homo sapiens
catcctgtgtagaaatatcaataaatataaaggtaagtattattgtccccattttacagatgagaaaatggagtcccagggacctacctgctcaagggcasagaaagcttgaatgagtaaatttactttgtgttgttccaaaggtttctccaaaggtctttgcacctcccaaggctattctcattttgagaaagactggca

SEQ ID NO: 57169 - DNA, 201 bp, Homo sapiens
tgtttagtaagtcatctatgttgtttgggaggaaagagaatgagcattcctcagttcctgcactgcaccaggccttgccaatacagtacctcatttaattmttgctaccatccttgaggtggctggcattaggccatttgcggggtgtagaaaatgacatgcagaaatactgtagcagctcacttaatatcaggcagatgg

SEQ ID NO: 57170 - DNA, 201 bp, Homo sapiens
tgaggtctcctgaaacttattcccgcaaggacatactactgtggacccacctgaagggtggcatccactcttctagtaggatctcacattggtattttcasacacttctgccccttgccatgtttagtaagtcatctatgttgtttgggaggaaagagaatgagcattcctcagttcctgcactgcaccaggccttgccaa

SEQ ID NO: 57171 - DNA, 201 bp, Homo sapiens
ccagggacggctccttggcaagttgtactgctgtggcctagggagggacaactggcagggccacacaaggaggtaaaaccttatgctccatttgcaaagcyagtggccccagcagagataggaggccctctctgtgatttcggcagtggtttccctgggattgaggtctcctgaaacttattcccgcaaggacatactact

SEQ ID NO: 57172 - DNA, 201 bp, Homo sapiens
tttttttaacagttagatttactcttcctttgcacagactaatagcacactgaggtaggatccagggacggctccttggcaagttgtactgctgtggcctrgggagggacaactggcagggccacacaaggaggtaaaaccttatgctccatttgcaaagccagtggccccagcagagataggaggccctctctgtgattt

SEQ ID NO: 57173 - DNA, 201 bp, Homo sapiens
agtgtgcccattttacagaggtggaggaggaagctccaaaaatgaagcccaaggatcttaaggtaatatatgggcttgaatccagtgtatcttgctccgamagccttgcttttgtcattatccaacattagctgtctttattatagtggccttcttaccacctacaaaacaagtgccagcattctagtaaaatttattcac

SEQ ID NO: 57174 - DNA, 201 bp, Homo sapiens
acattgtaccctggaacttaaaagttggtgaaagaaagaaggggccgggcatggtggctcacgcctgtaatcctaacattttgggaggtcgaggcaggcarattgcctgagctcaggagttgaataccagcctgggcaacacggtgaaaccccgactctactaaaatacaaaaaattagccgggcgtggcagtgtgtgcct

SEQ ID NO: 57175 - DNA, 201 bp, Homo sapiens
agggagtaaatatttattaatttttaagatgcttcattttggagtaatttgctacacaccaatattaatacagagcccatatgcgctgcctacaggataaataatgtaatagcttaataacaattaaaatggaagaaaatgtaggagttcctcaatggttccacctgtttcttgaggttaaaaatgtacacatttgtgggc

SEQ ID NO: 57176 - DNA, 201 bp, Homo sapiens
ttttagacaactggacacaggtttgtctttgaaattgtcctggtttttcttgatgttttagtgctcctggatgtccaatgtcattcttgggctagttgaargaaagttttggctacccagttgttagctgctgaagtttaactgtgcattctaagcacaccagtattttattacatcatacctgggcagcagataatttta

SEQ ID NO: 57177 - DNA, 201 bp, Homo sapiens
aatcacttgaacccgggaggtggaggttgcagcgagtcaaggtcacgccagtgtactccagcctgggtgacagagcgagactccgtctcaaaaaaaaaaaraaaaagaaaaagaaaaagaaaaaggtgtttggaagccatgtcccatgaattccaaatacaattgaggactctataaaggactataaaaaaagttgtaata

SEQ ID NO: 57178 - DNA, 201 bp, Homo sapiens
ttcaagatgacttttcattctctcatctcattcattttgaggtcattttgttgttgaaatgttagagttcaaccttaaatacttaagagcatggcactgtstagagaaagggagatgagcttctgtggtagccagaggtcaagatggcctctagtgaccctcacttcctgggttttacattgcagtatatttctcttctac

SEQ ID NO: 57179 - DNA, 201 bp, Homo sapiens
agggattcgtaagcttaggactgatagagatttggcttttctgctgttggattgatagctccttgactgctgaagccattgcccatctgttcaactgttgkattcacgaggaggttagacccctgacccaaggcccaggtacctggctttcctcagttgggatcagaaggccacaaagttttcttatattttaagcatcaa

SEQ ID NO: 57180 - DNA, 201 bp, Homo sapiens
tatggagcctgttaagaccagtgatgctgtggcctgaataacaacaggataggaacattcccttcttctcataaatcttgtaaatttgcattgtttgtgcygaacagggcccgtgtgttctgatagcaaacatggagaggcccaaaaggctgatctgggaccatgtccccattgaacactgctctgtgctgagtctgcaga

SEQ ID NO: 57181 - DNA, 201 bp, Homo sapiens
tcatgcactgtcaagcaccgtaactttagctacattctattgattagaagaatactagtaaagaccatagttaggagaggggaacctggctccaccattgsaagggaggtctatcaaagaacttgtgggcatattctaagaccaccacactctgccactccacacaccctgactctcctaacacctgctcgcttcactggt

SEQ ID NO: 57182 - DNA, 201 bp, Homo sapiens
aaaataatgattataactatgacctccagaagcttttgctgagcatctatctgtagcactgcatgtcaagccaagctagagtacagtctcttaggagacayaggggaggaaaacatccttggcaggttcgcatattggtgatctcgtcgtaattttctcaaatacccttcctctttcctcacttttggtgataactacctg

SEQ ID NO: 57183 - DNA, 201 bp, Homo sapiens
taatttatgtaaagcacaaagcataatccctggtattcaataagtactcagtaaatactagtgaaaataatgattataactatgacctccagaagcttttrctgagcatctatctgtagcactgcatgtcaagccaagctagagtacagtctcttaggagacacaggggaggaaaacatccttggcaggttcgcatattgg

SEQ ID NO: 57184 - DNA, 201 bp, Homo sapiens
gttctgtgccaaggattttagaaagtcatgtctcattcagttcccctaacaggtctaggagtcattatcctccccaacctaaggaaactgagacccagagrttcagagtatcccaagatcctacaggaattgcagattgtagccaaaattggaactcctaattccagagctcctccctcctgctagcatttttctttgagt

SEQ ID NO: 57185 - DNA, 201 bp, Homo sapiens
atcatcacacctttcccttagcctgtactaggttctgtgccaaggattttagaaagtcatgtctcattcagttcccctaacaggtctaggagtcattatcytccccaacctaaggaaactgagacccagaggttcagagtatcccaagatcctacaggaattgcagattgtagccaaaattggaactcctaattccagagc

SEQ ID NO: 57186 - DNA, 201 bp, Homo sapiens
ttatatataataataatttaatttataactatatcatttattaaggtcctactatataccaaattctattggacacatgtcctaataataaacgtgatatmatctatcattatttacaaaacttcacactctgacctttattaattatgtgtgtgccaattatgtgcagggaactgtattaatcgtagttagcaatatcgt

SEQ ID NO: 57187 - DNA, 201 bp, Homo sapiens
tgggcatttttaaattatcattagtatataattatatataataataatttaatttataactatatcatttattaaggtcctactatataccaaattctatyggacacatgtcctaataataaacgtgatataatctatcattatttacaaaacttcacactctgacctttattaattatgtgtgtgccaattatgtgcagg

SEQ ID NO: 57188 - DNA, 201 bp, Homo sapiens
gagatggcgccactgcactctagcctgggcggcaagcaagacaccatttcagagaaaaacaacaacaacaaaacatatggccagcagccagtgttgttatytcaggatgggaaccaggcactgcacctcctcattaggagtcagagtaagggggctaagctggttgacatgactggggacagagttgctgttgaaattgtc

SEQ ID NO: 57189 - DNA, 201 bp, Homo sapiens
ctctactaaaaataaaaaaaaaaaaaaaattagccaggcatggtggtgcatgtctgttatcccagctacttgggaggctaaggcaggagaatcacttgaayctgggaggcagcggttgcagtgagccgagatggcgccactgcactctagcctgggcggcaagcaagacaccatttcagagaaaaacaacaacaacaaaac

SEQ ID NO: 57190 - DNA, 201 bp, Homo sapiens
gcggaggttgcagtgagctgagatcgtgccactgccctccagtctgggtgacagagtgaaacccatcccccaaaaaaataaataaataaaaattaaaaaayctaacactggtacgagaagaaattatgctctaaatccttctttgagcagtggcttacagacctaaatttatcaaaggtggtggcagtaatagtaataatt

SEQ ID NO: 57191 - DNA, 201 bp, Homo sapiens
gtaatatttaagtattaatacctctgtttaaggttcattttgaacgccttggtgaccctatgtttttttctttgttttttgttttgttttttttttttttkttttttttttttgtttttttgagatgaagtcttcctctgttgcccaggctggagtgcagtggcgcattcttggctcactgcaaccttcgcctcccaggtt

SEQ ID NO: 57192 - DNA, 201 bp, Homo sapiens
attaatacctctgtttaaggttcattttgaacgccttggtgaccctatgtttttttctttgttttttgttttgttttttttttttttgttttttttttttktttttttgagatgaagtcttcctctgttgcccaggctggagtgcagtggcgcattcttggctcactgcaaccttcgcctcccaggttgaagcaattcttc

SEQ ID NO: 57193 - DNA, 201 bp, Homo sapiens
gacttcataataaataagatgctgacagttgaaacccccttgaccgttgcctgtttggtatgacacagaccttcttggacttttgtagcctatacatgagyagatatgaatcctcagccttctccaaaataaggttggggtcactaggaggccttcttggaaagatgtcttaaattaaggcaccagtagatggatcaaaaa

SEQ ID NO: 57194 - DNA, 201 bp, Homo sapiens
aaaaaaaatgttttctggtcaagtcacatgcctctgaggtttttttttttctttctttcttttctttttttttctttttcccagactcctcatacccctcytaggagacagtgattccctggcttcaccaggcaggctcttgggggcttcctggtccctgtcactcttaaaatgcagcctgtctttggacatctactccaa

SEQ ID NO: 57195 - DNA, 201 bp, Homo sapiens
ggcggagcttgcagtgagcggagatcgtgacactgcactccggcctgggtgacagagcctgaatccctctcaaaaaaaaaaaaaaaagaaagaaaacaacyacaaccacattttgagataggccttccttggcaaactttgatttcgtttctgtatttgaggacaaaacacagtatggttgtttccctccctagactagat

SEQ ID NO: 57196 - DNA, 201 bp, Homo sapiens
cgtgaacccgggaggcggagcttgcagtgagcggagatcgtgacactgcactccggcctgggtgacagagcctgaatccctctcaaaaaaaaaaaaaaaaraaagaaaacaaccacaaccacattttgagataggccttccttggcaaactttgatttcgtttctgtatttgaggacaaaacacagtatggttgtttccct

SEQ ID NO: 57197 - DNA, 201 bp, Homo sapiens
cggggaggacgcgcactccagcgcagcgcgtgcggtgcaaagtgaaagtaactgttaaggagcttcagggaaaagggtccagggttcccagtaggggccgscccccttggtgggcctcgggtccagcgggggtcacctggtggcttcccggcgcgccctctgctgttcaggatgcagcactgcgcggcgcggcgagggcaa

SEQ ID NO: 57198 - DNA, 201 bp, Homo sapiens
cagagggattcgtaagcttaggactgatagagatttggcttttctgctgttggattgatagctccttgactgctgaagccattgcccatctgttcaactgktgtattcacgaggaggttagacccctgacccaaggcccaggtacctggctttcctcagttgggatcagaaggccacaaagttttcttatattttaagcat

SEQ ID NO: 57199 - DNA, 201 bp, Homo sapiens
ggaatagagaaaaggtggcttggctgtttggtttatgtcctaaaaccttatcgtaatgtgattctccttaacagagggattcgtaagcttaggactgataragatttggcttttctgctgttggattgatagctccttgactgctgaagccattgcccatctgttcaactgttgtattcacgaggaggttagacccctgac

SEQ ID NO: 57200 - DNA, 201 bp, Homo sapiens
ggaaatggaatagagaaaaggtggcttggctgtttggtttatgtcctaaaaccttatcgtaatgtgattctccttaacagagggattcgtaagcttaggamtgatagagatttggcttttctgctgttggattgatagctccttgactgctgaagccattgcccatctgttcaactgttgtattcacgaggaggttagacc

SEQ ID NO: 57201 - DNA, 201 bp, Homo sapiens
gagttgacatacggaaaacaagtaagagtaactttgtacaccgtgggctcccaatcagtgctgcttttcgttgttgatgttgttgttaatgttgaaaaaaatcttcaagtcatgtttgcccccacagaccttcccagacagtctaactaaatgcactgtatttgctaactgttggaacttggcttttggactagaccagca

SEQ ID NO: 57202 - DNA, 201 bp, Homo sapiens
ttcccagtaggggccggcccccttggtgggcctcgggtccagcgggggtcacctggtggcttcccggcgcgccctctgctgttcaggatgcagcactgcgyggcgcggcgagggcaaagcggcctcatccccgccaaaaaataaagatgttttaaaaagcgcacatgctcagctccctcctgcaggctctgggttgcaggg

SEQ ID NO: 57203 - DNA, 201 bp, Homo sapiens
ctacttccttcttatatctggctatctgggagagaaaaaatttaatacaattgattactttttagaagagttaatttttacttattactgtggattttttkttttttaacagtcacaccgaggagaagactcagtgggaacatccaaaaactggaaaaagaaaacgagtggcaggaggtttgtatgttgttgtctaaggat

SEQ ID NO: 57204 - DNA, 201 bp, Homo sapiens
tcatatggtcctctgcagccttgcaaagtcgattcctgacatttccgtagactgttttttttgttttcagcaatactctccagcagcaaaacccaatccgytcatattcttgcatttgctgcagcaaaacctgacctctctttgtgttacctgagtcttgacgaagaagactgaggaaaggcccccccccccccccaccaa

SEQ ID NO: 57205 - DNA, 201 bp, Homo sapiens
tggtagctcatgcctgtaatcccagcactttgggaggccaaggtgggtgggtcacctgaggtcaggacttcgagaccagcctggccaacatggtgaaaccscatctctactaaaaataaaaaaaaaaaaaaaattagccaggcatggtggtgcatgtctgttatcccagctacttgggaggctaaggcaggagaatcactt

SEQ ID NO: 57206 - DNA, 201 bp, Homo sapiens
cacagaggaagtggagctggagtctctgtggctccagggtcaggtgtgtagtctcgaaggctgttttctgttctgcaagtttctccttaacacatttccarccccattttctggcagggagaccccaggactgaaaggagctggaagagtgaggtctaagagaaaaaggggctgggtgtggtagctcatgcctgtaatccc

SEQ ID NO: 57207 - DNA, 201 bp, Homo sapiens
tctgtatttctcagggcagcgtgggacctcagggtttgtcatggaccacacctttctcctttgtccctttttataactcataggctacctccaacttgacrcttatttaagtttttatttattttatttagcattcagaaaactctatagcctcagtctctcgggatgtaaattaaagcaatttcattttcatagtttctc

SEQ ID NO: 57208 - DNA, 201 bp, Homo sapiens
attacattttttgaatatgtttcttctttgcctcttgaggactaaccagccgggtttagattatttcctccccgtgtcgctttcctgcccccacatgttawagatggtgcaagggaaccagagagctttgatccctggtttctctggtcacaaacctgctctcctctccagaactccaggctgcctttctgtgggggctaa

SEQ ID NO: 57209 - DNA, 201 bp, Homo sapiens
ctgcctccatctccctttctctgtaagtggaagtggtattcattgatcacacactacatgccggacaccaagctattacattttttgaatatgtttcttcyttgcctcttgaggactaaccagccgggtttagattatttcctccccgtgtcgctttcctgcccccacatgttaaagatggtgcaagggaaccagagagct

SEQ ID NO: 57210 - DNA, 201 bp, Homo sapiens
tttgaggggtggtatgaggtcacagtcacagccacccctctcaccagctgtgtgacaattctggatttccttagctgtcctctgcctccatctccctttcyctgtaagtggaagtggtattcattgatcacacactacatgccggacaccaagctattacattttttgaatatgtttcttctttgcctcttgaggactaac

SEQ ID NO: 57211 - DNA, 201 bp, Homo sapiens; identical to SEQ ID NO: 55164

SEQ ID NO: 57212 - DNA, 201 bp, Homo sapiens
gctacaaaacctggcattttacttctctcattttccccaaatgatctaggtgtcttttgctcactggtgataaggggtgacattggtatcacaggtaaaartgagtaaatttgagattattgtcgtcttgctttaaaggttggagatacagcttcaaaaaccttttactacccacacacccaaggggagtcaaatggattt

SEQ ID NO: 57213 - DNA, 201 bp, Homo sapiens; identical to SEQ ID NO: 55165

SEQ ID NO: 57214 - DNA, 201 bp, Homo sapiens
cattcagccctcgggttaccattggtagcacatctaggagcaagttttaattttttagtcatagtgactgtgctggatttggtaggtcgtacgaattgggkaagaggcataggacaccaaggattttgcaaaaagcaggcaactaacatttgttttccacctactatgattatgttaggctctcaatatatgtttaccact

SEQ ID NO: 57215 - DNA, 201 bp, Homo sapiens; identical to SEQ ID NO: 55166

SEQ ID NO: 57216 - DNA, 201 bp, Homo sapiens
ctgggactacaggtgggtaccaccatacccagctgttgaaaaaaaaatggtggggtattactctgttgcccaggctggtgttgaactcctggcctcaagcratcctcctgcctcggcctcccaaagtgctgggattacaggcttgagctactgccccaggctcttcccccgtttgttaatacataccatgaccttggcctt

SEQ ID NO: 57217 - DNA, 201 bp, Homo sapiens
aaaagagtgtttggctaacttgcataaaaaggatctcatttttctttgtaacacattactacatacagtgaccatagtgtttctctaatttcttcaggacktactttgaagatgaagaagtatgtgtatccgctttttgtctttcagaataacatactgctgtctgtaaaaatacagataatttctctcttaaattccata

SEQ ID NO: 57218 - DNA, 201 bp, Homo sapiens
caccactgtacagcatctttacttaatctgccctctttcacgtgtgtgcatccctggcatgcttaaacaagaaaggcaaatgagagagagcgagtgagtgygagcgagagagccctgaggtgccagaaggctgtggttcctttgtgtctacagaaaagatataacgattgaattagactcttaaatatctgtggatgtcag

SEQ ID NO: 57219 - DNA, 201 bp, Homo sapiens
tgtttacctgtttatgataaaggatattacaaagagtacagatgaagcggtacatagggccaggcatgcggaggggatgtggagcttccataccccctccyggcatgcccctctccaggcaccacatgctcagcaatctggaagctctccaaaccctatcgtttaggtttttgttgttgttgttttgagatagggtctcgc

SEQ ID NO: 57220 - DNA, 201 bp, Homo sapiens
atataattcaagttgagatttcggtggggcgcagccaaaccatatcagacacaaacattcaattcacagcattctaccccagccctccaaaattcatgttyttctgacatgctaaatacatttattacatccaaatatccccaaaatcttaactcattccggcatcagctgtaaagtctatgtctttttaatttttttaaa

SEQ ID NO: 57221 - DNA, 201 bp, Homo sapiens
gcagaaaggtgcctatcatgtcttcagtgtcagtgccctggtatggagctagctggccttccacaggttctggagttaatgctggagagaagtaggggtgkcagagcctaccctgtgttcctaggggggttcatctggagctagtccctgacccttaggtggaagatgcagctatgcccaaggttctgaagaccctgtaaa

SEQ ID NO: 57222 - DNA, 201 bp, Homo sapiens
ttaaggaaactcggctcaaactagcttcggggactcgctgtggccataggtgccctaggctgcagtctgagagtgaaactgaggtctcactcccttcatastctgctctccgtctctgcctcatctggcttctcagggtggtggggcgtgggcactaatttgatttgatcacttagagacaacagcttacaaaatgctacc

SEQ ID NO: 57223 - DNA, 201 bp, Homo sapiens
atgtttacatggggctgtggaccattttgtatcattggaggagaagccagggcacttggcaggggtgttcatgatgataatcaggtggctgggtggagtcrccatttgtggcatcctcaaagacttgccaacatagacatttttggggagacagaaacacagaaataattctgcagtgctttaaagaatctgttaaaaatc

SEQ ID NO: 57224 - DNA, 201 bp, Homo sapiens
ttgatgtaaaggactacctgaggctggctaatgtataaagaaaagaggtttaattggctcatggttccgcaggccatacaggaagcccagttagggaggcstaaggaaacttaaaatcatggcagaagatgaaagggaagcaggcatgttctgcatggctggagtaggaggcaaggagcgaaggaggaggtactacccact

SEQ ID NO: 57225 - DNA, 201 bp, Homo sapiens
caccgctcccgacggcctctagatattttgagtgattcagcaaacctcctaaagttgaccccgtagctggggtcacagtcctctttctccttcttcccccyacttccttcttatatctggctatctgggagagaaaaaatttaatacaattgattactttttagaagagttaatttttacttattactgtggattttttgt

SEQ ID NO: 57226 - DNA, 201 bp, Homo sapiens
attggaaatggaatagagaaaaggtggcttggctgtttggtttatgtcctaaaaccttatcgtaatgtgattctccttaacagagggattcgtaagcttargactgatagagatttggcttttctgctgttggattgatagctccttgactgctgaagccattgcccatctgttcaactgttgtattcacgaggaggttag

SEQ ID NO: 57227 - DNA, 201 bp, Homo sapiens
tttcggatttatattattgcttacttggcacatcttccattggaaatggaatagagaaaaggtggcttggctgtttggtttatgtcctaaaaccttatcgkaatgtgattctccttaacagagggattcgtaagcttaggactgatagagatttggcttttctgctgttggattgatagctccttgactgctgaagccatt

SEQ ID NO: 57228 - DNA, 201 bp, Homo sapiens
tccacctcctttgagcctctgccaaacacaactgatggtggctgactgcctggctgcaggaagttctgaataagtgacctctatttgttattatttgggtyccctttgtttatttttacactagctttgcactaggttaattttttcccacatggcttttcctgtttgtttctttgattgtttttaattaataattagttt

SEQ ID NO: 57229 - DNA, 201 bp, Homo sapiens
ttattttcaaatgcatgtctttagaaccagaatgtgtgtagctgttttctggcctgaatttgggctgagatgatgagaagtttagttgccactttcagctwagtggaagtgttttccccatttggactccgggtcattgacaaacgtcatcactgtttttagttgaaatgtgcttccatgtggctgttcatcagcacaccc

SEQ ID NO: 57230 - DNA, 201 bp, Homo sapiens
tttatactcctctttgcacgttgcagaagatcaggaatttgcacattatagccacaaccatacccagaaccagattgtctaacactgaatctcgaatccamattcctggatttggatggactcaatctggacccagtatctacatttggtccagtcatctgtatccggcatcggggtcttgttgaaaaaccatggcttagc

SEQ ID NO: 57231 - DNA, 201 bp, Homo sapiens
agatccagtggagtgtggggtgctgagagaacaagtctatgttttcttgagacaaagtcttgatctgttgcccaggctcgagtgcagtggcagcatcttgrctcactgcaacttctgcctcccgtgttcaagtgattctcctgtctcagcctcctagggagctgggattacaggtgtgcaccactatgcccagctaatttt

SEQ ID NO: 57232 - DNA, 201 bp, Homo sapiens
caaatggaaaaccttcattccaaagggtcgttgtctcctcctatttaatagccctgcattcatgcacttttttttatcttgctgtctttttttttttttttaatcaaataccaaagtacttctatggactggtcttaaaaaaaaaaaagaatccattcataactgtgaaaaaatactgcctattagtctgctattgtggct

SEQ ID NO: 57233 - DNA, 201 bp, Homo sapiens
cctacttggacccaagactggcgtttactgtggatgataatccgaccaagccaaccacccggcaaagatacgacggcagcaccactgccatggaaattctscagggccgggatttcactggcaaagtggttgtggtcactggagctaattcaggaataggtaggctcttcacttagttatttatctttgggactgctataa

SEQ ID NO: 57234 - DNA, 201 bp, Homo sapiens
aatatagtttgctgtgtgctgggtgggtgggagggagcgtccacattagtgaacagccaggcagtcgctgcctcaaatttctttagggttatcctttcatkccagcaattgaatttgatttgcactgtttcacttctctacaagggtgtaaaaagtagaggttcctcttgaaagaatttcctccccatctaattaggaata

SEQ ID NO: 57235 - DNA, 201 bp, Homo sapiens
ttcattgctgtgggttcactgctttctcttttgggcagccatataaataaaagaaccacctacttggacccaagactggcgtttactgtggatgataatcygaccaagccaaccacccggcaaagatacgacggcagcaccactgccatggaaattctccagggccgggatttcactggcaaagtggttgtggtcactgga

SEQ ID NO: 57236 - DNA, 201 bp, Homo sapiens
taagcatatttatatatatatacacataaaacatatatgtacatattatcataatgcctacctgctcttgagaaagtagtgccgtatggctgggggtttckctcactggtttctatggctctcccctcccccactttttctaagaagtggtagtacctatctgactattttcttggctgcctgaagaggcctcaaaattag

SEQ ID NO: 57237 - DNA, 201 bp, Homo sapiens
cacagggcagctgtattccaggtacttggtgactcttggttgcgatctgatgactggctcacagtaggaccatgacgtgagcagatttgtagtcctgcatraatgaaggaaagaaagaaatctgacaactcattgattcagattcacagactctgcattttgaaccagaatacacccgagcaattacctagcacaaaatct

SEQ ID NO: 57238 - DNA, 201 bp, Homo sapiens
tcaagagtctttctcttccttttgagcccagctctccctttgtgacccagcaacttccttccccgatgatggccaagccttgaggatgtgaaactgcccartgccccaatctggagtccaccatcctgggtctagctggggacatccttgaatcagcctctgggaatcactgaaccaacatgagtcacttgctactgtgag

SEQ ID NO: 57239 - DNA, 201 bp, Homo sapiens
tgaaaaaaaataaacaaaatacttctgcaacagcagcagcaagagctgccgcaatgaaagaagaaagaaaaggagggacaggatgaaggaaagaagcagtrttaacattctagtaatatttgcatctgaatgatatttatatggggttattgtcctccctttgtgtatgtttaaaattttcataataagcatatttatata

SEQ ID NO: 57240 - DNA, 201 bp, Homo sapiens
agtcatgtccctagtccctgtctccgtatattttctccttctcttattagtttatcttttccaaaatgggctgtttcgtctctgatcctgatttatttttrttttaattaaataatttatttttctgagacagactgtcgctctgtcgccaaggtggagtgcagcggtgtgatcttggctcactgcaacccccgcctcccg

SEQ ID NO: 57241 - DNA, 201 bp, Homo sapiens
ctgaaggaaaggattcgatgactatctttttttggcacaaatgtgatccttctggaggccagaagatagattcagtgggccccagttctttcaggtttaakgaataagcattttggtctatgaaaaatggggttttcctaaagtataagattgtcttatatttataaatgcctgtgttcattgctgtgggttcactgcttt

SEQ ID NO: 57242 - DNA, 201 bp, Homo sapiens
aaggtcatagagcaaccaagtggcagggctgactcccacccaggtgtgttccatgggcagcgtcttcttactgcactgtcctgacttgctctagtgagatmtaagagaggcacaatctgctttccttttgatggtgtgcagcagcatgatggccgcgcgaatttccaagaagaggatgttggtcgctgatggcatcttcaa

SEQ ID NO: 57243 - DNA, 201 bp, Homo sapiens
ttattcactatcacgaggatagcgcaggaaagaccggcccacatgattgagttacctcgccctgggtccctcccacaacatgtgggaattctgggagatayaattcaagttgagatttgggtggagacacacccaaagcatatcagggtcctaggcaactttgtgtgagaacagaacagagaggaagcgacacacctttcc

SEQ ID NO: 57244 - DNA, 201 bp, Homo sapiens
gcaaagtacttcagggcctgtattagtttgtttttcacgctgctgataaagacacacccgagactgggaagaaaaagaggtttaattggacttacagttcygcacggctggggaggcctcagaatcatggcaggaggtgaaaggcacttcttacacggcagcggcaagagaaaatgaggaagaagcgaacgtgagaacccc

SEQ ID NO: 57245 - DNA, 201 bp, Homo sapiens
gaagagaggagttgatgatcacattattgtgtcagccgcctgtgtgaataaggaaggacagactcccaccccatcccatcattccaggttcaataagaggyaggtgcttcctaaagcagaaaaatgtaagggaagtcatcatcgcttatcatcacctgaatgttcaccatggtgacccacatctcaggatgctgcaaaacg

SEQ ID NO: 57246 - DNA, 201 bp, Homo sapiens
ttttattgcatgctttgaagtttgaatacactttcagtagctcttcgttatctcaaattaaatcttaaattgagcttgtggttctgtgaattaatactccrgcctttcagccctgctgctgaggtcattcaaatctaatggtggaaacggtcacagggtcaggccttggatggtgctgtatagaaatgccttaatgatgct

SEQ ID NO: 57247 - DNA, 201 bp, Homo sapiens
tatttaggttggaatgcaagggaactaaaggtaggggagattcttaaggaagtctactttctcttcaagaatgctatcaaattgaaaggtaattcctaaasaagagtcatttgtaaattagggaggaagagctaaaaaagattcctagcaagaaacatcataaaggggcttgataaagccaaaaaactaaaagaaaaaaaa

SEQ ID NO: 57248 - DNA, 201 bp, Homo sapiens
ccaagcgccccccagcccccaccccacaacaggtgtatgtggcctctggtttatccttctttccccctgctcaccacatggcttctcattttgaaaacccrgtggctaataaagtagatgagtttcaggattgcaaaatattgtgatcctggcctttgtccattgtgtaatcttcacagtgaccagagtgtttgcagttcc

SEQ ID NO: 57249 - DNA, 201 bp, Homo sapiens
gccacaggactatagcctgggcagttttgagtgctgcctctaccatgtaactagcttgccagtcaagtcattaactattcggggccttagtttcgtctttyctgaattggagccagtatacgtaattccaaaggttgcttttaagcgtaagtgagaatattggcagaaattcgttagcactgagagagggaatgtaaagtg

SEQ ID NO: 57250 - DNA, 201 bp, Homo sapiens
gcagtgaactaagatgccacaggactatagcctgggcagttttgagtgctgcctctaccatgtaactagcttgccagtcaagtcattaactattcggggcmttagtttcgtcttttctgaattggagccagtatacgtaattccaaaggttgcttttaagcgtaagtgagaatattggcagaaattcgttagcactgagag

SEQ ID NO: 57251 - DNA, 201 bp, Homo sapiens
gaaaagaggtttaattggctcatggttccgcaggccatacaggaagcccagttagggaggcctaaggaaacttaaaatcatggcagaagatgaaagggaarcaggcatgttctgcatggctggagtaggaggcaaggagcgaaggaggaggtactacccacttttaaacaaccagatctggtgagaactcactcactgtca

SEQ ID NO: 57252 - DNA, 201 bp, Homo sapiens
agtgcaagtttgttgtgaagaacacgtgccttggaattaacacctatggaagggaagaaaacgaagatggagtgggcagagggagaagctgactgagatgsagtccagcaagggtctcagtcaaccttatgaagctaaaagggcccatcagagctaatccctattgggctaatgtggccaggcttttataaacctgccttg

SEQ ID NO: 57253 - DNA, 201 bp, Homo sapiens
aattgcacaattcacacaccaggctgccactttggcccctgcgtcaccttcaccaccacccaatgtgtcctgctcatcactgaggtttgtcatttttactytgagtctgtccattgtcatcatctccaccatcaccccttttgttttcattgccacccttgcctggggtgagtgaagacgctcttctctggcttccaccct

SEQ ID NO: 57254 - DNA, 201 bp, Homo sapiens
agaagtggtggaacaaaggcactgtgtacacctttgaaacaattaacttcaccaaaattactaaactgtcctctagaatggttaaaccaatttcctctctwccattcacacgtgagaatgcctgtggccccccagaaattatctccagcagcagcaacagagaggactggaatgccattgacaggtcccacaagtcagcaa

SEQ ID NO: 57255 - DNA, 201 bp, Homo sapiens
cacgcccggctcaaatccttcttacttttcctcaagaactcacttcccacccaaacctttcctattgtggcagctgttatcttgtccagcacatgtgtccrcacttggtattaatagctccatcttaggaactatgaaagtgaggggggtggtggtaatttgcatgaactggtttgggccagttatggtctgttacatcct

SEQ ID NO: 57256 - DNA, 201 bp, Homo sapiens
tggtagtagtagtagtgaatgccctgactttggggtttgcagtaagctaggattaagtgcttcacagtgaggcacagtggggagctactctgaggatgaawtgcctagtaaataagtgaggtttgtataaccgaggccagatcttagaacctcctgctatctgtacatagaagaatgttttagtcagaggcaaggcaaggt

SEQ ID NO: 57257 - DNA, 201 bp, Homo sapiens
agacagtaagaaaggtgacgtcaatctgagatgagagagagagcaaaacagttcttttgaccaccttgaccccgaccttgaaataaggtggaactaataamtcccgctttgtgctggagcaagttttggctgagtttctgtcacttgcaaccaaatcagtcctatccagtatacctagtgactctctggtctccaaaggct

SEQ ID NO: 57258 - DNA, 201 bp, Homo sapiens
tgaatgccctgactttggggtttgcagtaagctaggattaagtgcttcacagtgaggcacagtggggagctactctgaggatgaattgcctagtaaataartgaggtttgtataaccgaggccagatcttagaacctcctgctatctgtacatagaagaatgttttagtcagaggcaaggcaaggtcaccaggattcactg

SEQ ID NO: 57259 - DNA, 201 bp, Homo sapiens
gaatgccctgactttggggtttgcagtaagctaggattaagtgcttcacagtgaggcacagtggggagctactctgaggatgaattgcctagtaaataagkgaggtttgtataaccgaggccagatcttagaacctcctgctatctgtacatagaagaatgttttagtcagaggcaaggcaaggtcaccaggattcactga

SEQ ID NO: 57260 - DNA, 201 bp, Homo sapiens
aagaatgttttagtcagaggcaaggcaaggtcaccaggattcactgagagtgttggtcagcatttcatctgcatatacaggactggaaaataagagagcgyaatgagacatctagtttttttctctttcgtttgttctgtttcccactgagagaattttctagctttatgtggagaaaacagtattggaaattattactca

SEQ ID NO: 57261 - DNA, 201 bp, Homo sapiens
gtaagaaaggtgacgtcaatctgagatgagagagagagcaaaacagttcttttgaccaccttgaccccgaccttgaaataaggtggaactaataaatcccsctttgtgctggagcaagttttggctgagtttctgtcacttgcaaccaaatcagtcctatccagtatacctagtgactctctggtctccaaaggctatgcc

SEQ ID NO: 57262 - DNA, 201 bp, Homo sapiens
attatagtgtctggcatacaataaatactttgtaatgttactggtgttttcttaccgttattgtctcactggtgaccgtttgaaatgttgaagctttattrttacagataatggtggatatagtctcttccttgtttattttttgacagaatctttttttaaaaaagtttttatttgtttggtgagaatttacttgttaca

SEQ ID NO: 57263 - DNA, 201 bp, Homo sapiens
aaagggggttaaaagggtttaggggaagtttagttgtcttccttttatctctaactctaaaacccaactgctggctgaattaaaagtctcttacataatgrtcagaggagttttgagtatcggatctttgtgtacttgctttttaaattcagtcacgtcttaaatagtacttttcactctcctcctctccacaccacttta

SEQ ID NO: 57264 - DNA, 201 bp, Homo sapiens
ctctctagaaaaaagtaagaaatatggaaagaaatctaatttagaaaaatgcacgcacccacaggcacgcttcacaggactggcaggtggagaggatgtttgttaacagggctggctattttactttaagtgctgcaaacattgcactaatgtttgggtctttgcttttggcaatcacttctcttgttaatttttttttgg

SEQ ID NO: 57265 - DNA, 201 bp, Homo sapiens
ctccttctagaactagaacataagctctctgaagtcagggaccatgcctagaatcgccttccttttatctcccatcagccgaaactaactctgctgtgtcrcgctgtgttaggctgtgttggctgtgagtaagagaagtctcacccaactagctgaagcgaggtgggttggaggggggatgccttgtggaagtgacaactc

SEQ ID NO: 57266 - DNA, 201 bp, Homo sapiens
tttgcctccttctagaactagaacataagctctctgaagtcagggaccatgcctagaatcgccttccttttatctcccatcagccgaaactaactctgctrtgtcacgctgtgttaggctgtgttggctgtgagtaagagaagtctcacccaactagctgaagcgaggtgggttggaggggggatgccttgtggaagtgac

SEQ ID NO: 57267 - DNA, 201 bp, Homo sapiens
caggcagcttctactcatggtggaaagtgaaggggagccagcatgttcagagaacatatagggagaaagggagcaagagaggggaggggaggtgccagagmctttaaaagaaccaactctctgggaacaaatagagggagaacattaatctagccatgagggatccacccccgtaacctagactcctgtcatcagccacgg

SEQ ID NO: 57268 - DNA, 201 bp, Homo sapiens
ctccgagctagagtacaatggtatgatcatagctcactacaacctccaatgcctgggtttaagtgatcctgccacctcagcctcccaagtagctaggactrcaggcgagagccaccatactgggctaatttttgttttttattgagatggggtcttcctatgttgcccagcctggtctcaaacttctggcctcaaagcaat

SEQ ID NO: 57269 - DNA, 201 bp, Homo sapiens
ttgcattgcatagttaaagttctttaaattcttctctaaaccccaaggctaagcaatatacaatctagttacaatggtctgcttgctgttaccagaatctrtcaagctctttcctatctaagggttttttccatgtactggtttctctcctgcgtggtcttgttctacccttgaggagggtaccacttcctcattgcttag

SEQ ID NO: 57270 - DNA, 201 bp, Homo sapiens
ttagttatttatctttgggactgctataatgagatccacttagatctagctataatggaattttgtttagtggttctctgatttaaacatgacttttatcyttttcagatatcgtttcattaacatcactacctctttttaaatcctaatgttgtcatggaagcctgtgtaggggctgaccttgaagtctctgaaagctga

SEQ ID NO: 57271 - DNA, 201 bp, Homo sapiens
tacaaaattagccagacatggtggtgcatgcctgtaatcccagctactcagaaggctgaggcgggagaatcatttgaacctgggaggtggaggttgtggtragctgagatcacgccattgcactccagcctgggcaacgagcgaaactctgtctcaaaaatgaatgaatgaatgaatgaatgaatgaaatactacttctcc

SEQ ID NO: 57272 - DNA, 201 bp, Homo sapiens
gaagcagtgtcacgcattttagaagaatgggtaagcgcttgactgttgttgttttttttaattgtcaaatacacatgccgggctaaccatatggagatttyagtggagtgtgtaaagtttattgctcttggaatcatgtctttatttttaaagtcatcttcactttgtttgtcttatgaatgaaagcatgagcaagtccat

SEQ ID NO: 57273 - DNA, 201 bp, Homo sapiens
atggattatccttggttgtagtgtttatgtccacatcacatgggatattttatttttcaggcctcttcatgtgcttgtgtgcaacgcagcaacttttgctstaccctggagtctcaccaaagatggcctggagaccacctttcaagtgaatcatctggggcacttctaccttgtccagctcctccaggatgttttgtgccg

SEQ ID NO: 57274 - DNA, 201 bp, Homo sapiens
ccacaggacactactgtgcatttgcctgtgatttgccattgggttggagtacttctcctgagtttctgcagtgttctaggtatggtcttaggccctggaawaagacagtgtaggaaacacagaaggtgcctgatttcctgggcctagctaaggggaaaaagcgagacaatggggtcagaggaagctcagctgaacagatga

SEQ ID NO: 57275 - DNA, 201 bp, Homo sapiens
gggtattggggatgagtctttgtgtggtggcaaacgggccctgtcttcgcttggcttcctcctaaaattcccaggacctcttcgggtcccagccctttctsttcccctgagattgcgcctcctcaccctctgtcttggatggaaagagttccaaggcagtccagtcaccccagtgaaaagttttctgatgaggtcaagcct

SEQ ID NO: 57276 - DNA, 201 bp, Homo sapiens
caagtgtgtttaatgtgaaaatagaaatggagggcttttaaaagagcttactcaaaatcctgccaattactgaaatctaccagacaagaaggagccactcyttttttttttttttttttttttttttttgatacaatgaggggaaatgtttcttccacaaaagcctggccgtttgtctttaaaaattttcatcttttgggt

SEQ ID NO: 57277 - DNA, 201 bp, Homo sapiens
cagtgcaggacagtgtgtcattgcaggagaagacagaacccggccagatcctcccgctgccggcaagcggagtcagttactgggaagccataataattctktcttctagagaattttggcaaaaatgtgcctccatcttacatcaacaatttttcatctttctggaatttttatttccccttcccctcttgttccttttta

SEQ ID NO: 57278 - DNA, 201 bp, Homo sapiens
agatatataatgatgcctatctgattctgtggtggtctggctttgatgtatgtatatgtgggcaggaatgtgtgtgcgtgtgtgtgtgcatgtgtgagctyctgtgtgtgtgttcatcacgtatccattgtgtctccaaggtcttatcaacagcaacaaaaggcctcctttgagatcaatcacattcattcgatgtttgtt

SEQ ID NO: 57279 - DNA, 201 bp, Homo sapiens
ctaatttctggggacacatattttgtcctggttagagagatatataatgatgcctatctgattctgtggtggtctggctttgatgtatgtatatgtgggcrggaatgtgtgtgcgtgtgtgtgtgcatgtgtgagctcctgtgtgtgtgttcatcacgtatccattgtgtctccaaggtcttatcaacagcaacaaaaggc

SEQ ID NO: 57280 - DNA, 201 bp, Homo sapiens
cgtctagttataggaaaatactgagatacttgtgagatgttttctttttttttttttccaacttgtatacacgttgttctataagtggttgattgtttttyaggaaaaaaaaattcagcatctcaaatgtacctttaatattgcttctgatttttgttgttttgctatcatagcgttacctacctcacagagatgttttag

SEQ ID NO: 57281 - DNA, 201 bp, Homo sapiens
acatatgaatgaggggtagagggacacaaacattcagtccctaacacttggtcaagttacttaagcttggtaagcctctctcttcttactgagtcatgagsataataagatatacctgttagggttcttttgaggaataaatggaatttttaaagaattgtgccagacatgtaataattacttgataaactatagctatta

SEQ ID NO: 57282 - DNA, 201 bp, Homo sapiens
ttttgtgacattcttagttgtgatctaccttatgttgtatacacatggtcactcacatacataggtatattattctgcaattgctgagtaattgatgatcsttcattctctctgtgattcataggctctctgggttggataaatcacttcggggaattatatctactagtatatttatgtcactagaattcctttgagaag

SEQ ID NO: 57283 - DNA, 201 bp, Homo sapiens
ttccttttatctctaactctaaaacccaactgctggctgaattaaaagtctcttacataatggtcagaggagttttgagtatcggatctttgtgtacttgytttttaaattcagtcacgtcttaaatagtacttttcactctcctcctctccacaccactttatgtgtttgctagtagcttccatgaaactctatgggtga

SEQ ID NO: 57284 - DNA, 201 bp, Homo sapiens
ctttggtaattcagtatccgaaaaacaatcagtgttttgtgacattcttagttgtgatctaccttatgttgtatacacatggtcactcacatacataggtrtattattctgcaattgctgagtaattgatgatccttcattctctctgtgattcataggctctctgggttggataaatcacttcggggaattatatctact

SEQ ID NO: 57285 - DNA, 201 bp, Homo sapiens
atcagtggttaccaggcagtgttgcattttttccatcccatacctctgtgtgtgttccttatctgtttctaggatgtgccctctgccccgtcacatcacaytctgtgctgctctcagccaaagctcttcttaaatacactagccatcaaaaccatacaacttggctgggtgcggtggctcacacctgtaatcttagcattt

SEQ ID NO: 57286 - DNA, 201 bp, Homo sapiens
atatgaaaacaggaaaacacatggagtcttggagggtagggaagtcttgatgagtaagattgggtctgagataaacctaaaagagggtcaagattttgacrgagggctggaagggaggaacgataggaaactgaccttttttcagatctcttcttgtgcgtggcctggggttaagtgctttacatgcatcccctcattgac

SEQ ID NO: 57287 - DNA, 201 bp, Homo sapiens
tttgtaagagcctttttctgggccccacttccagagggtttttcttttttttttttcttttgagacggagtcttgctctgtcgcccaggctggagtgcagyggcgcgatctcggctcactgcaacctccgcctcccgggttcacgccattctcctgcctcagcctcccgagtagctgggactacaggcgcccgccaccacg

SEQ ID NO: 57288 - DNA, 201 bp, Homo sapiens
gaggctgaggcaggagaatggcgtgaacctgggaggcggagcttgcagtgagccgagattgcgccactgcactccagcctgggcgacagagcaagactccrtctcaaaaaaaaaaaaaaaaaaaaaaaaaaagtgccatgtatattttgattacaaaaaatttcatgcggtgttactttctttttattggtagagggtctt

SEQ ID NO: 57289 - DNA, 201 bp, Homo sapiens
aacacggtgaaaccccgtctctactaaaaatacaaaaaattagccgggtgtggtggcgggcgcctgtagtcccagctactcgggaggctgaggcaggagartggcgtgaacccgggaggcggagcttgaagtgagccgagatcgcgccactgcactccagcctgggcgacagagcgagactccgtctcaagagaaaaaaaa

SEQ ID NO: 57290 - DNA, 201 bp, Homo sapiens
gaaactgttttctctggccaggagacaggcttcgttttcgaaactcacccaggaaggcagtgttcttcttttcaaaaggcatttttctgttgactgtgcaygaagccacatagtaataaacagtttccatatccaagcagctaaggcttgtgccttgcaagttaagtggaacatcacgatctatatctcagttttccttat

SEQ ID NO: 57291 - DNA, 201 bp, Homo sapiens
aaaacttaacaattgtggaagcaatgaattgaaggactagggtcaccagtggagtcccataaataggttgtttatgatccctgtgaaacaagaagaccctyttaatttcatgcttcttaaactggggtatgagtggccccaggtttccctgttgggggtactgataccagagttcatttgaagtcattggaaaccaaggca

SEQ ID NO: 57292 - DNA, 201 bp, Homo sapiens
gccacaggacactactgtgcatttgcctgtgatttgccattgggttggagtacttctcctgagtttctgcagtgttctaggtatggtcttaggccctggartaagacagtgtaggaaacacagaaggtgcctgatttcctgggcctagctaaggggaaaaagcgagacaatggggtcagaggaagctcagctgaacagatg

SEQ ID NO: 57293 - DNA, 201 bp, Homo sapiens
ccttttagaagctgaggcaggaggattgcttgaggccaagaatttgagaccagtctgggcaacataggcagaccccatctctaaaaaaaaaaaaaaaaaaattaaattagctgggcttggtggtgcacacctgtaggctgagctgctcgggaggccaagatgggagaattgcttgaggctggatgtgtgtggctatggtga

SEQ ID NO: 57294 - DNA, 201 bp, Homo sapiens
tcagttggcatgcgatatgcttctcaggcagtaatttagagactgtcaattcctgagagccgctggggaactgagcaatcgtctgcatttcgtcgctttarcccgagctgggtctttgagctggcagagaccaagatctttttctgggaagggatggtcctatttaaggaaggccctggattttgtcaagtttgaaaggtt

SEQ ID NO: 57295 - DNA, 201 bp, Homo sapiens
ggagttcattttcaaccgattcagcagtggaacacttgaagaggaggaagtcaaaattcaaaatgggttgggtgcagtggctctctcctgtaatctcagcscttttagaagctgaggcaggaggattgcttgaggccaagaatttgagaccagtctgggcaacataggcagaccccatctctaaaaaaaaaaaaaaaaaaa

SEQ ID NO: 57296 - DNA, 201 bp, Homo sapiens
aaaatatttgtatctccccacaataaaagtctgtaccaattaagcagctactacccattcctcttccctaccattctaccttctgtctcagtaggtttgcytatttgggatattttatttaagtgggatcatacaatagcatcatgtgttcaaggttgacccacattgtggcatgtatcagtacttcattcccttttatca

SEQ ID NO: 57297 - DNA, 201 bp, Homo sapiens
atattgcttctgatttttgttgttttgctatcatagcgttacctacctcacagagatgttttaggtcataagtatttttcatttaattttttttccccttmatttcctttttttccctcctaagctataaatatacagccttaaaaaaaacactcagaaatttaagtccaagaagcctgcttttcttgatacctttcaagt

SEQ ID NO: 57298 - DNA, 201 bp, Homo sapiens
aaattcagcatctcaaatgtacctttaatattgcttctgatttttgttgttttgctatcatagcgttacctacctcacagagatgttttaggtcataagtrtttttcatttaattttttttccccttaatttcctttttttccctcctaagctataaatatacagccttaaaaaaaacactcagaaatttaagtccaagaa

SEQ ID NO: 57299 - DNA, 201 bp, Homo sapiens
atggattatccttggttgtagtgtttatgtccacatcacgtggattcccgaaggagcatggattatccttggttgtagtgtttatgtccacatcacatggratattttatttttcaggcctcttcatgtgcttgtgtgcaacgcagcaacttttgctctaccctggagtctcaccaaagatggcctggagaccacctttca

SEQ ID NO: 57300 - DNA, 201 bp, Homo sapiens
gaggagagtcaaatgggagtttctaccgatgctcttgaaaggatcttgttactcagatgtctctaagacaatgatcagtacccatctctcagagcctgtgyagccgtccatgcttgaggcatgagatgctgaagataaaggtccccagtggtccaggtttttccttctcagcttggaaagcagcaggaaaactgcactgca

SEQ ID NO: 57301 - DNA, 201 bp, Homo sapiens
catggtgggaatctagaagacggagaaagaatttctcattcccgaaggagcatggattatccttggttgtagtgtttatgtccacatcacgtggattcccraaggagcatggattatccttggttgtagtgtttatgtccacatcacatgggatattttatttttcaggcctcttcatgtgcttgtgtgcaacgcagcaac

SEQ ID NO: 57302 - DNA, 201 bp, Homo sapiens
gaagctgaggcaggagaatcacttgaactcagaaggccaaggttgtagtaagctgagattgcaccactgcactgcagccttggcaacagagcgagactccmtctcaaatcaatcaaccagtcaatgtgtgcccccttttcctccaactcccaccccaaatccttgctgaatcatacctatccttcacctttataagcatct

SEQ ID NO: 57303 - DNA, 201 bp, Homo sapiens
tggagtacagtggcgcgatctgagctcactgcaacctctgcctcccaggttcaagcaattctcctgcctcagcctcccaatagctgggattacaggtgcaygctaccatgcccggctgatttttgtatttttagtagaggtggggttttgctgtattggccaggccagtctcaaactcctgacctcaagaaatccgcccac

SEQ ID NO: 57304 - DNA, 201 bp, Homo sapiens
tcctaataagcctctcatcctcagcaacggaggacagttgcccactcaaagccttgtgacattctagggtatcctatttctacatggtgggaatctagaaracggagaaagaatttctcattcccgaaggagcatggattatccttggttgtagtgtttatgtccacatcacgtggattcccgaaggagcatggattatcc

SEQ ID NO: 57305 - DNA, 201 bp, Homo sapiens
ctgagtttcttgtggaagtgggcttgtgttttgcttttgtagactgacactgagaatagcatccaaacatctttttcccaccaaggcatcaaactccatcrttaggaattccttcatagaatcaaagaatcagaaagagctgaaacatagaccacggacactcaaattgtttatcctgaaatgaatgggaaaacctaagct

SEQ ID NO: 57306 - DNA, 201 bp, Homo sapiens
aacacacacaagccactgttagattttacaaaactttaaaaagtaattatcttaaagatatctaagatagtgatctggttacatagattatcagagatacttttttttttgattatcagagatacttttaaaaaagcaactacaaggtaaggattatccgttaatttagtgtttttctattaaactcaatttgctttaaag

SEQ ID NO: 57307 - DNA, 201 bp, Homo sapiens
tttatgcatttagagctcccctcttgtgtttcagaaaggaggagttgttgttttcttttcacttgagtttaataaatgaaaaaggggaagggagagggaargaagaggaaaaagcacaaatgtgcttgtttttggatcagcccctgtactgggcacatggatgcagtcagtcctcagtgtaccccaggaaagaggaaactg

SEQ ID NO: 57308 - DNA, 201 bp, Homo sapiens
cccaacctctgctttggaaggcctaactcagttaaacattacaagttcatgcagcacggtgtgatggctcacgcctgtgatcctagcacttttggaggctyatgtgggtggatcgcttgagctgaggagtttgagactgggcaacatggtgaagccgtgtttctacaaaaaatacaaaaaaaaaaaaaaattagccaggcg

SEQ ID NO: 57309 - DNA, 201 bp, Homo sapiens
gagggggacatttgggaatggcatttttagtactcacaaggtaactggggcactcttggtcttggggaggggaggtggctggggacgcagagggtcctgcrgtgggtggatacttacaacatagaaatgtcctggctcttgatgctggctacaccctcagtaagagatactgtcctagggtcatttttttcaacccacact

SEQ ID NO: 57310 - DNA, 201 bp, Homo sapiens
ggactgtcttagtcagtccaggctgctataacagaataccgttgactgggtggcttgatttttttttttttctcccagttctggaggctggaagtcagatrtcagggcaccagcatggttggtttctggtgagtgctcttttctgcatttgtggacagctgccttcttgctgtgtcctcacttagtagacagagagagaga

SEQ ID NO: 57311 - DNA, 201 bp, Homo sapiens
gcaacagagtgagatgctgttttgtttttgtttttttttgtttgtttgtttggttttttttggaaaaagaaagaatcaccataaaaaagatgggtaactcrgaaatttcaaatgcttgaatttcttgggttgggaagaatatcccaaaatgtgtttccaactacctcactgattttgacttcacagggagaatattttgat

SEQ ID NO: 57312 - DNA, 201 bp, Homo sapiens
ccaacacccgacaggcatcttagaaagtggagggtgtaagttataaagagagattacttccaacacgtttctttaaagcctgctggctaaattaggtgggrccttctttgtgtcctctctgttcttgctagtctggcctttgtataatagggaagcagatatatctggaagcctctaagtgtgcatcatggaaattgtttg

SEQ ID NO: 57313 - DNA, 201 bp, Homo sapiens
acccgacaggcatcttagaaagtggagggtgtaagttataaagagagattacttccaacacgtttctttaaagcctgctggctaaattaggtgggaccttmtttgtgtcctctctgttcttgctagtctggcctttgtataatagggaagcagatatatctggaagcctctaagtgtgcatcatggaaattgtttgaaatg

SEQ ID NO: 57314 - DNA, 201 bp, Homo sapiens
ctacctgtggtcccagctgcttgggaggttgaggcaggaggattgcctgagcctggtagaggtggaggctgcagtgagctgtgattgtgccactgcacttyagcctgggtgacaaagtgagactctgtctcaaaaaaaaaaaaaaaaaaaaaaaaaaaagctagtagcacaccccaaaacttctagacagggcatggtgtg

SEQ ID NO: 57315 - DNA, 201 bp, Homo sapiens
gtgacaaagtgagactctgtctcaaaaaaaaaaaaaaaaaaaaaaaaaaaagctagtagcacaccccaaaacttctagacagggcatggtgtgagctggartagacaactagttcatggtaacaggaccagcagagctccgtcttgatgctgttattatttggtatctgttaggagctgaattatgtgtccccaaaattca

SEQ ID NO: 57316 - DNA, 201 bp, Homo sapiens
tatttggtatctgttaggagctgaattatgtgtccccaaaattcatgtgatgaagccctaattcacagtacctcataatgttactctatttggagatacarccttttaaaggatggttaagttaaaatgaggttgcttggatggtccctaattcagtttaatttgggtccttataaaaagaggaaatttggatgcacagag

SEQ ID NO: 57317 - DNA, 201 bp, Homo sapiens
cctccggagaagccaaacctgctgacaccttgaccttgaatgtgcagccttcagaactgtgagaaaatcaatttctgttgtttaagccacctagtctgtcrcattttcttatggcaacccctgtagataatacagtcccattctctggggaaacagatacctccgccagggtcctgatctgaatatgatttggggtgatgg

SEQ ID NO: 57318 - DNA, 201 bp, Homo sapiens
caacgctttgggaggctgaagcaggaggatcacttgagcctaggagttcgagacctgggcaacatggtgagacccccatctctacaaacaacaacaacaamaaaaaaaattagccaggcgtgggggtgcatgcctgtgctcccagccactcaggaggctgaggtgggaggatggctcgagcccaggaggccaaggctgcag

SEQ ID NO: 57319 - DNA, 201 bp, Homo sapiens
tcattttgggcttctgatacactcctgtccgagaagttacctttgaaaatgtgtactattttattgtcaattatgttttctttaaaaaaaatttatgacakattacttttgctaattatgtgtgtgggtagattatgttattcatgaattttatttcaggaccttggtaaggggttatacaatatttcttttgaaacgagg

SEQ ID NO: 57320 - DNA, 201 bp, Homo sapiens
cagggacagcaaaagcacacacaatgatggccagagacactgctcagtgtactgtcttccaccgggacagcccactcaccaagggttaggtcctgtgctgmctgggtcccgggtctcctcggaggtcggtttgcatcacgtggatacactaatctacccaagttgacttggagaaccaatctgaaatcagatgggagctcc

SEQ ID NO: 57321 - DNA, 201 bp, Homo sapiens
aagactttagtcttttcaagaggcaaagtaatataccacttttcgcttttttaatggtgagagccaaggtcaatctgaatttttctttttctttcttcctttttttttttttttttttttttaaaaaaaaaaaggtgcttgaattagaaaggtagcacattgtccacatggacagtgcaggatggggctggctttttcatt

SEQ ID NO: 57322 - DNA, 201 bp, Homo sapiens
atctgccagcaggctgtgctggggagtggtgagtagtacagggatgtgtctgaccccaggagaactgccccgatccctatcttgtctctgctcagttctgrtaactcttttatcttccctggagttatttttttcccttctttctttctctttttctgtgtgctcttctaagagtaaaacgcatgtccccccatgaagtca

SEQ ID NO: 57323 - DNA, 201 bp, Homo sapiens
tgtggcacatacccctgtacatgtttgccaagactgctatatggtagagcttggaattcttaggagctttatcaggtaattgcaagtcccccacctccaasaaagcactctctaggtcaagaatcagcaaatgttttctatagaggcccgtaaaattaatattttatactttgtgggtcatatagtctctgtttcaattac

SEQ ID NO: 57324 - DNA, 201 bp, Homo sapiens
ttgatcttggacttcccagcttccagaaccatgagcaataaatttctttttttcaaagctccccaggagtctctctcggtctgttctggctcaggaagctkccttatttgtaacaaacaaataaacaaaaaacaaaataaataaaagctacccagcttagattattttgtcataaaagccccaaaagactatgacaaatcc

SEQ ID NO: 57325 - DNA, 201 bp, Homo sapiens
aagttagtttcttcccagagagaaagaccggtggctgtagtctgtgccccactcccagcctgtcctttctcagccgtggcttgtgtgcatccctggggccrgcatgttgctgcgagccccaatcgatcagtggagaaacgagctctggtgggcagtcaggcaaagcagatacacgtgcttcttttcagctttgttggaagg

SEQ ID NO: 57326 - DNA, 201 bp, Homo sapiens
aagaagaatatccatgaatctatgaggaggcgggactctggccagacattgaatttgctgcttccttgatcttggacttcccagcttccagaaccatgagmaataaatttctttttttcaaagctccccaggagtctctctcggtctgttctggctcaggaagctgccttatttgtaacaaacaaataaacaaaaaacaaa

SEQ ID NO: 57327 - DNA, 201 bp, Homo sapiens
ttcactgagggactaagagaaatagaaacagaggggattggccacacctgaagtcattctgtgttcaaatcttggctctaccacctatgatctgggagctsttagaggagttaatcgatgtagttaagactcaatttcttagtatatacaataggtgtaatagtaaaaattagatgactttgatgtgtgtaggtaagcggc

SEQ ID NO: 57328 - DNA, 201 bp, Homo sapiens
catagctcactgcagcctccaacttctgggctcaagtgatcctcccacctcagcctcttgagtaactgggactgcaggtgcatggcactgtgctccacaattttttttttttttttagagatgggatctcactgtgttgtccaggctggtctcaaacccttgggtttaagtgatcctcttgcctcagcttcccaatgtgct

SEQ ID NO: 57329 - DNA, 201 bp, Homo sapiens
agaagaggatgtagggcaggtagggctcagaaggacccatgccatatagcaaagttcttagtaacacaggctttgggttacagcaggctagattcaaatcytgctgtggtcagaatgtctgtgtcaccccagcattcatttgttaggagatggggtcttttgggagatgatttggacatgaagacagagcctgcataattg

SEQ ID NO: 57330 - DNA, 201 bp, Homo sapiens
gagttcaagacctcctcatctctacaaaaaataaaatatttgaaaaaaaaaagtgaaatttttgatatagaagaggatgtagggcaggtagggctcagaargacccatgccatatagcaaagttcttagtaacacaggctttgggttacagcaggctagattcaaatcctgctgtggtcagaatgtctgtgtcaccccagc

SEQ ID NO: 57331 - DNA, 201 bp, Homo sapiens
ttttttttttttgccaagcaccctgcctttttgcttgtctgtttcgtctttatctctccttccagtaaagttcttggcccagaggttctgctgccactcartgacatttgtgaaatgcaagggagcttgcaccatgggttcaagctcctgcagatccctgagcctgctacccttgtgcttctctgtccacgcaaagccaag

SEQ ID NO: 57332 - DNA, 201 bp, Homo sapiens
tttagtaaaacgcagtatcttcttccccagctgaaatagcgaaagggtctcttcaggctcctgggataaaaaccaggatccttcatgtgtctgagcaggcytcccaccatttgactgctgctcctttgtccagacacatttaacaccatctccctgcaccccttcactgggctccgaagctgcgttcacacggcacgtcat

SEQ ID NO: 57333 - DNA, 201 bp, Homo sapiens
tctagaataagtccgtctcacgttacagtgcttaggaagtgttagatgtactgtcatttcttcaacatatatgtcctatattagtctattctcacactgcwagtgaagacatacctgagatggggtaatttgtaaaagaaagaagtttaacggactcatagttgcacatggctggggaggccacacgatcatggcggaagg

SEQ ID NO: 57334 - DNA, 201 bp, Homo sapiens
tttaatttttgtgggtacctagtaggtgtgtatgtacatatatatgtatatatatatgtggttttttcaaaaaaattgtgggcacttagtaggtatatatttttgtggtctgtgtttcttataaattggtgatcccccaggggatgcctgccttgttggtccaggtaacacacttggagtagcaaacatctagacgtagtt

SEQ ID NO: 57335 - DNA, 201 bp, Homo sapiens
cacggcacgtcattggcagctcatctcagaaggttccagctttgcctggcaaattctcctccttcctttagatcccatctctggtagacagagtaatgagycccgaagatgtccaggccctactcctaattccatggaacctataaatatgggaggttacatggcagatggggaattaaggttgcagatggagttaaggtt

SEQ ID NO: 57336 - DNA, 201 bp, Homo sapiens
ttagatcccatctctggtagacagagtaatgagccccgaagatgtccaggccctactcctaattccatggaacctataaatatgggaggttacatggcagwtggggaattaaggttgcagatggagttaaggttgctattcactcatcttcagattgaaagatcatcctggattatctgggtaggcccagtcgaatcagag

SEQ ID NO: 57337 - DNA, 201 bp, Homo sapiens
tacagatacacactcacatatatatttctgtttgcggctcacacagacataaatatatatatatatatacaaacgtacatttctgcttgtagcttgcacayatatatatacacacacacacatacatgtagacacacacatttatacatatacatgtcaacacatacacatacatatttctgcttatggctcaggatactt

SEQ ID NO: 57338 - DNA, 201 bp, Homo sapiens
cactcacatatatatttctgtttgcggctcacacagacataaatatatatatatatatacaaacgtacatttctgcttgtagcttgcacatatatatatayacacacacacatacatgtagacacacacatttatacatatacatgtcaacacatacacatacatatttctgcttatggctcaggatacttctttttttgg

SEQ ID NO: 57339 - DNA, 201 bp, Homo sapiens
tcttacacagtttgtaagtcttaaaactcagtatctactctagtagttgctccaaatgtgatgtcctcataaatcaccgagggatcttgttaaatttggaytctgattcagtaggtctaggtggggcccgagcttctttgtttccttttcttatttaatttttgtgggtacctagtaggtgtgtatgtacatatatatgta

SEQ ID NO: 57340 - DNA, 201 bp, Homo sapiens
gttacatggcagatggggaattaaggttgcagatggagttaaggttgctattcactcatcttcagattgaaagatcatcctggattatctgggtaggcccmgtcgaatcagagatggggaaaagagaggcagatgggtcataatcagagaggtggctgagtaaagaggacttggcctgatgttaccagctttaaagaggga

SEQ ID NO: 57341 - DNA, 201 bp, Homo sapiens
cacatatcccacatccaggtgccagtcagggagctgcgatttaatttgctgctgaatgcacttttgaataaagggcctagaagatgcagtctcgaggaacsgaggccggttagagacaggctggcagctttgcctcctctcccaagacaaaggcctccccgcccccctaaatccagcacacaatcagctgctctccctccc

SEQ ID NO: 57342 - DNA, 201 bp, Homo sapiens
tgccccttatacattaaggtgcatgcaataaatcacttatgtaataaactactctatattatgtgggaaaaaaaaaaggagctggtggcagggggagagayttcaaattgagccagacctcaggcatgaagggaggggagagagggggaaatgtggaggaagggggcgtttgtgcagtgggaagttggagaaagtacaaat

SEQ ID NO: 57343 - DNA, 201 bp, Homo sapiens
tggaaagttactctctaagtcagggcttcttttcttcaactttggtgtgagactccgctggagagctggttagaaaaacacaagtctcgggccccaccccscagagcccctcattctctagttctgggttggggcccaggagtctgcttttctagcaagcgcccagatgtcactgatgcttacagctctcagaccacagtt

SEQ ID NO: 57344 - DNA, 201 bp, Homo sapiens
tccatgctccaaatgactgtgacgactgagaaaatgcatgtatgtaaagtctgcagctggtgacattgtagacactcagcaaatggcctttggtgttactrttattttatttttactaattattttttacacctacaaatcaggatctgctacaatcgcttgatatttgaaaattgggcctaacccactatgccactcttc

SEQ ID NO: 57345 - DNA, 201 bp, Homo sapiens
agtggggcactcgattccggcaagagaaggcaaacaaaagaagccacaacagtctaggaagaaatctttaatttctattcagctttaaagagtttgagagmgttttttcccctctgttaacaaacgagttcaagtacatgccttcatattataaaagtacctgaaattgcctagaatagcagcatgcatagcttgttagta

SEQ ID NO: 57346 - DNA, 201 bp, Homo sapiens
gtctgcgtggttcttacctagaaactgtttattggtgaaccaaatattttgtatcttataccaagaaagaggggctgacaaagattgagtgattagaaatycaagtgaatttctatttattattttgacttggtaatttgtaataacaatagccaccatctatctatacttcctagatttgggcatggtgttaggagtctt

SEQ ID NO: 57347 - DNA, 201 bp, Homo sapiens
ttaaggtgcatgcaataaatcacttatgtaataaactactctatattatgtgggaaaaaaaaaaggagctggtggcagggggagagacttcaaattgagcyagacctcaggcatgaagggaggggagagagggggaaatgtggaggaagggggcgtttgtgcagtgggaagttggagaaagtacaaatgaaagcctctctg

SEQ ID NO: 57348 - DNA, 201 bp, Homo sapiens
aaggcagagggtgtcacttccactgcatctttggggaaggcagtcaccactgtatagtcctgagctcactgggattaaggggaagggacacagactccacytctcgatgagaggagaagcgaattgatgggcagattttatcactgtcctggggcctttgctctttgcccttccctttgccaagaaagttccctgtactct

SEQ ID NO: 57349 - DNA, 201 bp, Homo sapiens
cctggggcctttgctctttgcccttccctttgccaagaaagttccctgtactctgcaatgctgagtacttctcatccttcaggtctactgcaagtgtcacytggccaacacaccatgccttcccagtctctggtgttactgtctgcatactgtagaccatcatcttgtttgcatacttgtctgttatctctttatcatccg

SEQ ID NO: 57350 - DNA, 201 bp, Homo sapiens
ctggccaacacaccatgccttcccagtctctggtgttactgtctgcatactgtagaccatcatcttgtttgcatacttgtctgttatctctttatcatccktctacccacatcaggcaattccaagagagaagaccactggttttgtttgatctagtccctgttgagtccctgtgcaccttcagaaccacatctagcaata

SEQ ID NO: 57351 - DNA, 201 bp, Homo sapiens
tattcacagttgccgcccacactcaagagaggggattctataggaaatggaagtcttgggggccatcttgaatcctgactaccatagtctgtgaaatcccyatttcacagatgttgaaactgagacttagaagcattatgcaccatgccaaaggccatggaaggacagagcttgggcatgctcccgacaccaggtcatact

SEQ ID NO: 57352 - DNA, 201 bp, Homo sapiens
ccatagtctgtgaaatccccatttcacagatgttgaaactgagacttagaagcattatgcaccatgccaaaggccatggaaggacagagcttgggcatgcycccgacaccaggtcatactgatgtcactctccctactcccttcactccctccagcacctggccttcacctgaaggtgctgaccttgctgtttgttggttt

SEQ ID NO: 57353 - DNA, 201 bp, Homo sapiens
gttttgtttgtaagaatcagttgaggacagatgggactatttgcatggattggtgtcatgtttgaagtcagttaccagagggtttctttcaacagagtatmccaaaaaaaaaaaaaaaaaaaaaaaaaaaaaagtaaattgcacagaccccagcttaggacctggacttaatcttcatgatgtttgtaaagtaatacttct

SEQ ID NO: 57354 - DNA, 201 bp, Homo sapiens
agagaataaaacgttagttaatccctttgtctgtcaatcacagtctcagttctcttgctttcacattgtacttaaacctcctgctgtgcctcgcatcctaygcttaataaaagaacatgcttgaatatcatcacctgaagtttgtattgtttctttaaatgtttgtttcagtttgtttttgtttttcattttttagaaaag

SEQ ID NO: 57355 - DNA, 201 bp, Homo sapiens
acacccgccctgtgtgtgtcccctcacgcaagtgccagggctgggccccttccaaatgtccctccaacacagatccgcaagagtaaaggaaataagagcaktcacaacagagtgaaaaatcttaagtaccaatgggaagcagggaattcctggggtaaagtatcacttttctggggctgggctaggcataggtctctttgc

SEQ ID NO: 57356 - DNA, 201 bp, Homo sapiens
cagtaccctttgctatgccaagatccagctgaaactgaaccaggtgggggaggcctgctaatgcccaggcagtcgaaatgacgccatctcatcactccttytcttaaaatttttttttgtctttcttcttggatttccagcaacagggagctgccaccaccgtgtactgtgctgctgtcccagaactggagggtctgggag

SEQ ID NO: 57357 - DNA, 201 bp, Homo sapiens
atgttataggcagttctgaaggaaaggattcgatgactatctttttttggcacaaatgtgatccttctggaggccagaagatagattcagtgggccccagwtctttcaggtttaaggaataagcattttggtctatgaaaaatggggttttcctaaagtataagattgtcttatatttataaatgcctgtgttcattgctg

SEQ ID NO: 57358 - DNA, 201 bp, Homo sapiens
gggttttctacctgatggaccacaattaagagtggttggtttgtcagacagaaggttctacaaacgatttggtatcgaattacattatacatggagaagtygaggggttggatgaatttgttcttgcacgttcagaaggataccatctttttctctgtgtggaagaggcgcctgccacgacgtattgatatgtgtatttat

SEQ ID NO: 57359 - DNA, 201 bp, Homo sapiens
agcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtc

SEQ ID NO: 57360 - DNA, 201 bp, Homo sapiens
accttgtatgcacacatgagaatttagagatctatatataccgcctggcctcttctttgtaagggtataacagcagtggttaacatgcattttttttttttaacagttagatttactcttcctttgcacagactaatagcacactgaggtaggatccagggacggctccttggcaagttgtactgctgtggcctagggagg

SEQ ID NO: 57361 - DNA, 201 bp, Homo sapiens
gttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaattt

SEQ ID NO: 57362 - DNA, 201 bp, Homo sapiens
aacaacaaaaaatgtattgccaaaaaattgctagcagacatctagaaaaatgtcttcaacttcttttggtaggaaaagaggaaaaattcaaatctgaattyaacatatttatttttttgtttctgactttttacgtaaacagagctctgagttgtatcctcagatatatttgagactaacaacaaggaaatataaaattat

SEQ ID NO: 57363 - DNA, 201 bp, Homo sapiens
ttttataacggagttgttaacattatttcctttagatggctccttcatcttttctgcattatgaactgatgccccaaaaggtggtatgaatgaaagtcatstgatggtgattaaagtgctctttaaatttttttttttaatcagtttaagaatgctttctcttttattggcagtacctgcttgtttactattgagatttca

SEQ ID NO: 57364 - DNA, 201 bp, Homo sapiens
caaattttcaaaggaagaaatggaatggtgcaaccatggtacatgggaaggaggagggggacacacaagactgtacctatcatgggggcttcgacctcatstgggaaggtggttggagagagtgagtcctgacctgagctttggaacttatcaagttgagagagaaatttgataatttgtctattaacgtgtgaccttggg

SEQ ID NO: 57365 - DNA, 201 bp, Homo sapiens
atttatcacaatggatcagtaagcattgatgacaactggcaaggtattgcttcagatattttataacggagttgttaacattatttcctttagatggctcyttcatcttttctgcattatgaactgatgccccaaaaggtggtatgaatgaaagtcatctgatggtgattaaagtgctctttaaatttttttttttaatca

SEQ ID NO: 57366 - DNA, 201 bp, Homo sapiens
caagtcattgaccttctctgaacctcagtatcctaggacttcagaagcgaaaggaagaataatgggtcttgagtatgcctagaattgagcaagctgctatscttgcaaaggccttggccagctgctcacccaccatgtccctctgttcccactccaccttactcatgcctagacttcttgctttttaaaaataatccaccc

SEQ ID NO: 57367 - DNA, 201 bp, Homo sapiens
gttttgttttgttttgcttgttgagcaagggaatgcggttcccctgtgtcggacttgtttcagaaagacaatgtcactgaggctggggcagggagattagstgagaggctcttgcagttatctgggaaggagctgtccataaaggcctgagttaagacagtagccctttgggttcgatttagtggtggctccccaaaagat

SEQ ID NO: 57368 - DNA, 201 bp, Homo sapiens
tgtggactgtagtttgctgacatccaggctagatccttaatatacaatgaagtagtaaaacacatgtaaaagtaaaaagcaggcgaaatagaataaaatasacatttgcacaccacagtatccaaaaaggttatgtactggggctaaagatttggcttggagtttcctggtagtcaaggcaaaaaagggaaacaaaactag

SEQ ID NO: 57369 - DNA, 201 bp, Homo sapiens
atagccttaaagtttctcctgctctttgcagatgaatgaaggggcgctttctggaatctttgtggctggggctgctgctctgcactgctgtggctcttttycacaaatgcttatggagctctaactgggggcaaggaactgtgctacggttgggaagagaggagtgggcaaaaggagacactggggcttctgtgactttag

SEQ ID NO: 57370 - DNA, 201 bp, Homo sapiens
aaatcagccatcagccttattagagtggttgattttttttttaatctaagagctttcttggttattttctgttcttaatcattgttgtatatccttaatgygcaggacatgacaccgtataacaagtgttttaaaaatatttacaattctgatcttataaaggaaaaagttacatatggtcctttgaactaattgctaaaa

SEQ ID NO: 57371 - DNA, 201 bp, Homo sapiens
ccatctcattgtctttatagtttaaccctttgaagttgtgactgccaacgtgctagtcttgtcgtcttacacgttaatggtaatgatctttttagatttaytgtgaacctctaggaatgttttttttaaccagtaaatgcactgaaacatggaatcaaagtctctttcccgtgggccccttttcattgggaataaatgcta

SEQ ID NO: 57372 - DNA, 201 bp, Homo sapiens
gaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttct

SEQ ID NO: 57373 - DNA, 201 bp, Homo sapiens
actcatgtcttttgtcagggagaatggcatggcctttgtatgacacttccttctagccagactcggatttgggggcatcatatttgggatggctgcaccgyaaacaggaaaggccacaggacagctcacaggttctctctgaacagaagcctgtgagcacgtgcctgtcatttaaaagctgcatggcactcttccccctgc

SEQ ID NO: 57374 - DNA, 201 bp, Homo sapiens
gaattctttccagctttccatcctgaacctgctggtctccaggctcgttcctgcaaatatttcacagaggagtaagagccacattcttgctggctttccarttcattctcctctcttcgagtccacctcttaaaacttcttagtgctcttgcaagaaactcatgtcttttgtcagggagaatggcatggcctttgtatgac

SEQ ID NO: 57375 - DNA, 201 bp, Homo sapiens
tgcatgatagaatgcaaactttgaaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaa

SEQ ID NO: 57376 - DNA, 201 bp, Homo sapiens
ggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatgggcatcaagtgctttaaaatgc

SEQ ID NO: 57377 - DNA, 201 bp, Homo sapiens
aaaggcattaatctttttggtatccaacatcttgaatgcttctgtgtcattttcctttctttttttttttcaaagcacttaattatttaaaaacaaaaatmcttctctgatcagagcatacctgccgtgctcaaagcacttgcttacttggaatgccataaattacatgaaggaattattcattgtatcacgaaacatacc

SEQ ID NO: 57378 - DNA, 201 bp, Homo sapiens
ttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtaga

SEQ ID NO: 57379 - DNA, 201 bp, Homo sapiens
atgagcagttgggagagtgcaggatccagttcaaaaggatctgtccccccgtgaaccccaggacagggtgagaggccacctgcacactttttttttgtcasctcacaccctgttggccctttgcaaatatttgtctttcctcatgcacgtggttattcccagaaagatccagtgaattgtctcctgaagataaaatacata

SEQ ID NO: 57380 - DNA, 201 bp, Homo sapiens
ccttccaagaaccacatgaaggttatattattatgtcgactttccagatgaggagactgaggctcagtggcttgtcataggtgtcaaagacaggagtccartgtaaggacttctggcttcagcacaggggattttcctaccatcccatattgccaccccatctgcaaaaatacctggatctatcttcctcctgctgattct

SEQ ID NO: 57381 - DNA, 201 bp, Homo sapiens
tgaaccccaggacagggtgagaggccacctgcacactttttttttgtcagctcacaccctgttggccctttgcaaatatttgtctttcctcatgcacgtgkttattcccagaaagatccagtgaattgtctcctgaagataaaatacataaaagggcgtttcaaagtataaacagtgattttaatgaaaaataagaagaaa

SEQ ID NO: 57382 - DNA, 201 bp, Homo sapiens
cccaggaaatggccaaatgttatcactcatccttccaagaaccacatgaaggttatattattatgtcgactttccagatgaggagactgaggctcagtggyttgtcataggtgtcaaagacaggagtccagtgtaaggacttctggcttcagcacaggggattttcctaccatcccatattgccaccccatctgcaaaaat

SEQ ID NO: 57383 - DNA, 201 bp, Homo sapiens
tttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcac

SEQ ID NO: 57384 - DNA, 201 bp, Homo sapiens
tgttaagatatttaacgggtgtttcattttcccagcaatgctataggacacagaaaggaacataaattgttacagagagaaagagggtaggtctgtgaatrgaattgaacaggtaggttgaacaagataaatgccgaggaagcaagtgtatttaaataaacagtagtttatggaaggctttggaaatccactatattaatc

SEQ ID NO: 57385 - DNA, 201 bp, Homo sapiens
ttttttgtcagctcacaccctgttggccctttgcaaatatttgtctttcctcatgcacgtggttattcccagaaagatccagtgaattgtctcctgaagawaaaatacataaaagggcgtttcaaagtataaacagtgattttaatgaaaaataagaagaaaatgcttatgatacaacattaggtggaaaacgaaggaaga

SEQ ID NO: 57386 - DNA, 201 bp, Homo sapiens
aacatggataaactgaacttgatttcctgcattaaaaaaaattaaagaaatgaaagttctgactgttttattgtagctggggaattctttttgcaggtgaygctcatgttacggttttgaacccaggactttgcgttgcagttttgttcaggggttgcagaataccgatctgactttgcaggaatgactgtcttggtgcat

SEQ ID NO: 57387 - DNA, 201 bp, Homo sapiens
aggcccaagcgatcctcctgcctcagcctcatgagcagctgggaccacaggatgcaccaccatggccagataattgttttgcatctttggtagagacaagscttcactatgttgcccaggctggtctcgaactcctgagctcaggtgatctacctaccttggccccacaaagtgctgggcttacaggtatcagccactggg

SEQ ID NO: 57388 - DNA, 201 bp, Homo sapiens
cttggtaatgtagattttggaggacttgaaaggttcctgctacctttggctggggatggagggaacatggaagatgggtctttgtttagaggaagctcttyatcctggtacgctggaagttggcatagtcttagcagttagtccagatgtgaatttcaggattattctgtgagtcttccaagtcctgtctcagcagtgaaa

SEQ ID NO: 57389 - DNA, 201 bp, Homo sapiens
agaaatggggcttctaaaataagtggaactgggacctcttctctctcaggctgttacttgttgtggttccagcctattttctgagctgtggagcagggagrgatctcacaggaaacttggtaatgtagattttggaggacttgaaaggttcctgctacctttggctggggatggagggaacatggaagatgggtctttgtt

SEQ ID NO: 57390 - DNA, 201 bp, Homo sapiens
agaggcatggctcccctgttatgtatttgggacttactgcagatgcttcctctggttcagggtgttgaggcttcgtgctgttaatattggaaggtgggtcrtttgtactgggcatctgtcctgtatcttggagatgtttagtaacatccctgacctctagccattagataccatctctcccagtagggataataaaaacat

SEQ ID NO: 57391 - DNA, 201 bp, Homo sapiens
agctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatggg

SEQ ID NO: 57392 - DNA, 201 bp, Homo sapiens
gagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggccaggggagctacctgagtggagtcaacttttaggttata

SEQ ID NO: 57393 - DNA, 201 bp, Homo sapiens
tgcgtcactgtttttcttatttggagatgctgttcctctcaagtgggaaaaatttggttatctcaggtggtaaagatgcctttgtttaaaatattcttctsttagtggggacaataatactactaatttctagtactgacgcttctcatgcaatttaatcagtaggaacctgtttgcatgttcatttgaggaagtaccaaa

SEQ ID NO: 57394 - DNA, 201 bp, Homo sapiens
tgttgtaggttgggtaccccaggaagtagattctgcaactgagattggcatgtaggaagattactggggagtgttctaggatccacacctgtaggggaacrtagcaagcaggatggggtggagggaggattgagctgtgctgtgggagatgcgaatgctccagtcaatcccaaggaaactctgaagctggattattcttca

SEQ ID NO: 57395 - DNA, 201 bp, Homo sapiens
actgagttggattgatatatttttcctttggccttcaaaggaaatttgagcattcattcattcatccttttagagaaatattctctaagcacctaccgtgygccaagctttgggttggatacctggaacccctctcagtgagatcacagtctaacagcacacacccaactatgaaatatagatggactgtgaagatgaaga

SEQ ID NO: 57396 - DNA, 201 bp, Homo sapiens
cagtgctttctgaagacagaggtgggacctggtgctggagacaatccattcctttcacaaagactgtaagccttacccaagcattaattttgctgcatagrcggcctgttctcccacaaagcactgagtaagaagaaaaggggcccggataaaccagcagggcctggcagacaacttctggctcccttgccatttaaggtc

SEQ ID NO: 57397 - DNA, 201 bp, Homo sapiens
ttatgaagattctgtgtgtgtgtgtctgtgtgtgtgtatgtgtacaaagaaagtttagagcagcgtgtggcacgtaatgcatattatgtaagtgtagctcyaatgtgagttgttacttgtagagaacagctatgtcaaaaccacaccaaaaacgatttggaaaggaaataatttgactggtcattttgtttatccatcaac

SEQ ID NO: 57398 - DNA, 201 bp, Homo sapiens
caccccttccctcttatcagcttcttgctaccatgcagaaaagtgctgaaggtggcctgccctaaggcagtagcactagagcagggatggggaggacttgstggccagatgcatgtggacatgatggaaagggaagagaagaactgtcaagattttcactatcagtggtataagccccgtagtaatatgcctagtgttcca

SEQ ID NO: 57399 - DNA, 201 bp, Homo sapiens
gctctgccacttagtaattgtgtagatttgcacatgttgctggacctctctttgtctcagttttctgtaaactggggaaaatcttagtaaatctagctaaygtggttgttatgaagattctgtgtgtgtgtgtctgtgtgtgtgtatgtgtacaaagaaagtttagagcagcgtgtggcacgtaatgcatattatgtaagt

SEQ ID NO: 57400 - DNA, 201 bp, Homo sapiens
tagagacaaggcttcactatgttgcccaggctggtctcgaactcctgagctcaggtgatctacctaccttggccccacaaagtgctgggcttacaggtatsagccactgggcctggcctgagttgataatttttgtcatttctttctcacttttctcaggaaaatcatgactgtaaaacagatcagttttgctttagttcc

SEQ ID NO: 57401 - DNA, 201 bp, Homo sapiens
ggtgagatcccactggtttggaggaaggagaggaaagtccccacttgggcaaaaacaatttaggatacctgaagattgcaaagcccagctcctcacaaagrgggtggcagctggggagaagctgaatcagtagacagacaagattgtggtttaacgagttcagggacaagagaaggccccagtaacctacagaagcaacta

SEQ ID NO: 57402 - DNA, 201 bp, Homo sapiens
tctcgaactcctgagctcaggtgatctacctaccttggccccacaaagtgctgggcttacaggtatcagccactgggcctggcctgagttgataatttttrtcatttctttctcacttttctcaggaaaatcatgactgtaaaacagatcagttttgctttagttcccaccctcatcatcaacccctccccagctaccctg

SEQ ID NO: 57403 - DNA, 201 bp, Homo sapiens
caaaaagcggctggaggaaaaagagctttgccaccgggcagtactgctgggtcttgcgtcacagagatgccttctgctcccttcttcagggagacctcagrgtatgaaagtgctgcttacccagcagatgagatttagtccagtcatccatctgcgtggtctctgtggataaagtaagcgtttcattcaacttttaaaaat

SEQ ID NO: 57404 - DNA, 201 bp, Homo sapiens
ctcctgagctcaggtgatctacctaccttggccccacaaagtgctgggcttacaggtatcagccactgggcctggcctgagttgataatttttgtcatttmtttctcacttttctcaggaaaatcatgactgtaaaacagatcagttttgctttagttcccaccctcatcatcaacccctccccagctaccctgcaaaaga

SEQ ID NO: 57405 - DNA, 201 bp, Homo sapiens
agctcaggtgatctacctaccttggccccacaaagtgctgggcttacaggtatcagccactgggcctggcctgagttgataatttttgtcatttctttctyacttttctcaggaaaatcatgactgtaaaacagatcagttttgctttagttcccaccctcatcatcaacccctccccagctaccctgcaaaagagtcaca

SEQ ID NO: 57406 - DNA, 201 bp, Homo sapiens
gaaactggaggagcccgggaactgctttctcctctctaagagtcttggtggtttcttgtgtggaaatgaatgggaagttcaccctggttctgcaaaatggktgcgaaatgtaaaatgtatataccttctatcctactctttatgttccacaaattttggagggaaactgattaactctctagctaccatgttccaggtgcc

SEQ ID NO: 57407 - DNA, 201 bp, Homo sapiens
tgcaaatgataccatcacgaaagtgtacagatgacctacagaatgggggaaatacttacaaattaaatattaaataagggatttgtatctagaataaagamcttttacaattcaataatgaaaactcatttaaaaaatgagcataagatctaaatagatattcctccaaatatgatacacaaattgccaatgaatacataa

SEQ ID NO: 57408 - DNA, 201 bp, Homo sapiens
ctgggtttaaggaattctctgccttagcctcccgcgtagctgggattacaggtgcatgccaccatgcccagctgatttttgtattttcagttgagataagsgtttactgtcttggccaggctggtcttgaactcctgacttcgtgatccactcgcctcggcctcccaaagtgctgggattacaggcatgagccaccgcccc

SEQ ID NO: 57409 - DNA, 201 bp, Homo sapiens
caaaccctgttttgtagtatttgctgattactgtggtgtaaatactcacaccttggctgatttcaagttgcagcttggaacttggagttagaaagagatgygtagtcccataccattttatgtatgtaaagtatttgcactatgccgactaatagacataaataacctcatgagcatagataatagtcacatctactaaga

SEQ ID NO: 57410 - DNA, 201 bp, Homo sapiens
aatttccttgtgaatgctgttaccatattcctggtgtctatgtgagggggtgtgtggtggtatgccggtaagtgttgaacaacctgctctgttggcgggarctaggggaaacaaaccctgttttgtagtatttgctgattactgtggtgtaaatactcacaccttggctgatttcaagttgcagcttggaacttggagtta

SEQ ID NO: 57411 - DNA, 201 bp, Homo sapiens
cctcaagtgatccgcccaccttggcctcccaaagcgctgggattacaggtgtgagcccccaggccctaccctgggcccctcctttctggcccctcaacctrttttcttccagccatgccctagggagagcttggctgtggccttgcagaccctctcagatgccactcaacaagggccaactggagagaaatctctagtcta

SEQ ID NO: 57412 - DNA, 201 bp, Homo sapiens
tatacacttgagcttggcatttttcttaacgcagggctattttaggtgcactgcgcatgttggaggtgcccttgcaggtataggtaggcattgtccatccrtggtaaaaagcaatagaagaaattcttacccgatgcttaatgaattgccaggctggttaaaaaggataacccttgaaacctagggtgtccaactgctaat

SEQ ID NO: 57413 - DNA, 201 bp, Homo sapiens
gttttccgggctgtttgtgtactacacagcctgtgtacctggcaaggcacgctctgctctgccctgccttctgatgagctgactaacaccttatagatgargttcccttagaaccaaagatgccccatgaaactccctaggatgaatgttggaagtccttccaactgggattcccagccggaaaggaaacagttcatctga

SEQ ID NO: 57414 - DNA, 201 bp, Homo sapiens
gtgtccaactgctaatttatatagactggagatatttccatgcctcgcagcaaaatttttctttaaattcacagaagcagcagctatccagcattgtccarttgtgctgagtagctgtcattattgataaacatgtaactggtcatttgtattgttttgagtaggatatggcttatcaggatgcatagtagagaaaaatga

SEQ ID NO: 57415 - DNA, 201 bp, Homo sapiens
gtgagccaccacacccagcctgggggagggtttgttaaagaactgtctgttttatcacatgaccacaagttaaaatgttgggcaatgtccctgaatgataycttttcattagtaactcacatggacccataatctctgaatttaacatgcttttcaggaatgtgttcatattttccacctataaaacctgttttagtaatt

SEQ ID NO: 57416 - DNA, 201 bp, Homo sapiens
tttttgtacttttattgaccattcacatttcttcttttctgaactgcctttccatattctcggtccagctttctataagattgctctcatttactggtgakagctctgtgtaaattaaggaaaccatcaccaccttcgaatggctgactattgtaaatattttaatgtttgtcgtttgtttgcaaccttgtaattttttcc

SEQ ID NO: 57417 - DNA, 201 bp, Homo sapiens
ggccttactcgttttcaaatactcaaatgccattgagtcagatttcagaggcaaatggtgatacctcaggtttgaagttgcaagaagtcaccacatgcttrttatggaaatcgtcagggatatttattccctctcctgagaagcataattgagcctccaaaccacccatcaagatatccacctgtaaaatatttaagaact

SEQ ID NO: 57418 - DNA, 201 bp, Homo sapiens
atttaagaactggtactatgaagacatttcccttatgcaatttgttttccatctaagagcagaacaaggaaaatatagctgactataagttacaaaggcasactcttaagctacaaaatacatctcttcacaggagcacttggagaagggctgaaggcaaaccaaaagtgagcaacaaggagactagtgttctgaaacaga

SEQ ID NO: 57419 - DNA, 201 bp, Homo sapiens
ttacacgtttatggattgaaatggttctgctgaaattttaagtgttaacattgttcaaattttcattactaacacctctcacattgttagaaaacagtttyatgtttgacattttgatcatactaacctgggacattttatgctaaagttctcatttcatgccttaggaatcccctgcttattttgatttcagcacctttc

SEQ ID NO: 57420 - DNA, 201 bp, Homo sapiens
tgtttatgtaagatccataatgactcttgccaattagcaggctgctctcttccaagtggtaacccagggactcaagctcttttcatcttgtggctcagccrtctgacacatgtggcttccagcactgccctgctgttgtctgcacaaagctggtggaagaagtaggaatttgcaggaccatgtgtggagcattttaaggat

SEQ ID NO: 57421 - DNA, 201 bp, Homo sapiens
tctaaaccgatcatcacagaagatattttgtagtgatgaagaaagcttaaatgtctcatttgtcagattggtttaggtagaaaataaggatttccaccccytcatcgtggttcccttttagattttcttgtttgcttttctttaaagctgctgttactcaaacgacagtccgtaaactgcactttattttttataacagct

SEQ ID NO: 57422 - DNA, 201 bp, Homo sapiens
aagggaaggatggaaggaagagagggagagacggagggagatggaggatgacagggagatggagggaggcaaaaagaaaaagggagaaggaaagagaggaragaggggaagggaggaaggaaagaagagagagaaggaggaagagagggaaggaggcacagaggtagagaggcagggagataatggagatcctggccaaaa

SEQ ID NO: 57423 - DNA, 201 bp, Homo sapiens
gtggattacagaattgtgctgggtcctatggagtgtcagaaatagtgaagcttctggagcttcactgtccaatatggtagccacgtgtgactattaaaatrtaaattaattaaaattaaaagttcaattgctctgaaatagcagccacatttcaaatcttcagtagccagatgtggttattggctaccatattgggtagca

SEQ ID NO: 57424 - DNA, 201 bp, Homo sapiens
gactattaaaatgtaaattaattaaaattaaaagttcaattgctctgaaatagcagccacatttcaaatcttcagtagccagatgtggttattggctaccwtattgggtagcaccgatatagaacatttctaccatagtagaatgctcttttggatacatctgctttaaagcattagtccccaaagtgtgaaggatgaacc

SEQ ID NO: 57425 - DNA, 201 bp, Homo sapiens
agtacaagttggtaatgggtaacaggctaaaccatgtggcaccccttccctcttatcagcttcttgctaccatgcagaaaagtgctgaaggtggcctgccytaaggcagtagcactagagcagggatggggaggacttggtggccagatgcatgtggacatgatggaaagggaagagaagaactgtcaagattttcactat

SEQ ID NO: 57426 - DNA, 201 bp, Homo sapiens
gtcccgtacttttcaatgtaagcatattggctctcaatttaaaaatgttattttttacagatagtacacagatgcactgacacaggtaccctctccagtcytctgatggtcaggaattgtgtgcagtatgcagtacattccaaagtcaggctggccatttccccagggagagggtccatgttggaacctttgctccttgtg

SEQ ID NO: 57427 - DNA, 201 bp, Homo sapiens
tgcctataaacataaaattaaaagcctgctgtctgcttagttcaggtattgggtcagcgtcttgtgactatggacaagaggtgtttgactctaggactcasctacctcatctgttaaatgggcaaactgggagggtgtttatctgcatgcaacatctccttccatttgaaaacttttatgaatgtatggaatattattgag

SEQ ID NO: 57428 - DNA, 201 bp, Homo sapiens
tgcttttataaaaaaagtcacagaaacaattatattgtacacagtcctatataatctgctttcttttgtttatagaatactgtgaatgtctttttgttttktttttttttgtttgcgagacagggtctcactctgtcactcaggctggagtgcagtagtgcaatcttggctcactgcaacctccatctcctggatgccagc

SEQ ID NO: 57429 - DNA, 201 bp, Homo sapiens
acttgtttcctgtgagggtgccaggaaactttacaatgaacttcgtgaattaaacctctaccagatgaatagaggtggtggcatggtagcagaaattaggrttaaaaaaatggtttttgatttatgaaaaatttttctgcaggaaattttgatttgttctttgtggattctgaggataaaattaagaccaacattgaggat

SEQ ID NO: 57430 - DNA, 201 bp, Homo sapiens
tggaagggatatttaatttccattaaaacatgaatttcattctgcccttgccatgcttttcttggtcttagcccaacctgagctgctgatattaaggaatrataggataattccataattttcattttaccttttgctttttgttttccatagcagttatctagaggattcccattatgcttcttcattacccggtgccca

SEQ ID NO: 57431 - DNA, 201 bp, Homo sapiens
tgaagttgtttagataaatgtgccaggtgctaagctcagggttattaggaataataattcagtgaaaggaaatttggatgacatgaactcatttccattakacttgagccacacaaatcaatgggaaaagaaacagctgaatccaggataatatctggctatttggagtgggcatgataatggagggagattggggaggta

SEQ ID NO: 57432 - DNA, 201 bp, Homo sapiens
ggcagtgtgcactgtggctgggagttgacacagatccttgtctcccagacccccagtttctatcgagctactgtaactttaaaaagatttaacaaagactmcctccactagctaagctgaaataagaatgtctccggagtttaatggatcaagtagcggtgataggttttatggctcttttttactttagggcatagggaa

SEQ ID NO: 57433 - DNA, 201 bp, Homo sapiens
acagcttctggcgccgcaaacaccttgggtcctagagaaacctgcacacttgtgtctccacctttttacctcttgcgggcatgagtctggtctcagtaatmacattgtccagcccatcataaagggctcttgaacacattttcatcaactttaggttaagtctgtttgggtaaatgcgtcttggagggctgggtagaagat

SEQ ID NO: 57434 - DNA, 201 bp, Homo sapiens
ttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaacc

SEQ ID NO: 57435 - DNA, 201 bp, Homo sapiens
tggagcacttgaaaactgctgttttgtgtcagtaggtaaacaacaaacattggtgactactgaattttcagcagatgtgattcctttgtttcacagaaaawctgtatcttttgttctaaatttttttcttctaatgggtataatcctctgttggagagtcctttgatagctaggagtgtgttttcttctttactttcccaa

SEQ ID NO: 57436 - DNA, 201 bp, Homo sapiens
caatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgag

SEQ ID NO: 57437 - DNA, 201 bp, Homo sapiens
tgaaaactgctgttttgtgtcagtaggtaaacaacaaacattggtgactactgaattttcagcagatgtgattcctttgtttcacagaaaaactgtatctkttgttctaaatttttttcttctaatgggtataatcctctgttggagagtcctttgatagctaggagtgtgttttcttctttactttcccaaagacaattt

SEQ ID NO: 57438 - DNA, 201 bp, Homo sapiens
cactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccaggg

SEQ ID NO: 57439 - DNA, 201 bp, Homo sapiens
ggctgttggtggcaagaaaagaagggtgatgggttgggcttatattgtttagtggagcaaaagagatgtgaaacatttgtgtcttaaagtgttttggtcargagaaactaaattggttagaaagtgtgcaattttgcaagctttataaaaatataaaccaatgagtctggactctgttccctaaaggggatgaggaatgaa

SEQ ID NO: 57440 - DNA, 201 bp, Homo sapiens
ggatcttaaagtccaacctcaaggcccagcgctgccacttaacagctctgtgaccctgtaaagtcactcagcctcattgagtcccccatcctcccctgtgyagaatgaggctaatgctagtgctcatttcatagagttgctacaataatcaatgagataatgtgcataaagatttacatacataataactgctcaataaag

SEQ ID NO: 57441 - DNA, 201 bp, Homo sapiens
gaaaactgctgttttgtgtcagtaggtaaacaacaaacattggtgactactgaattttcagcagatgtgattcctttgtttcacagaaaaactgtatcttwtgttctaaatttttttcttctaatgggtataatcctctgttggagagtcctttgatagctaggagtgtgttttcttctttactttcccaaagacaatttt

SEQ ID NO: 57442 - DNA, 201 bp, Homo sapiens
ggtaggcttctctctaaataaatggaaatactaactgtccctggctcatagagctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggc

SEQ ID NO: 57443 - DNA, 201 bp, Homo sapiens
tccctaaaggggatgaggaatgaaaatgaaggtttgcaaagacatcttgccagacccttacatattttaatttaaggtggtattactgtcctcattttcargctgaagaaccaagctctgagagagttaatgattttctccagatcattcacattcatttctgttacacagctgggattataatccatgcctgtctgactc

SEQ ID NO: 57444 - DNA, 201 bp, Homo sapiens
aagtatatgtagcaaccaaacagtttcttctttcctaaaactcaaagtgagtcagacttcttaggcttgtagatgttgaggactaagctttgctctttatmttctctttatggatttccctttggaagcagggataagaagagggaaggtctcccagatgtaaatttctcataaatatttgagctccatttcagtaattct

SEQ ID NO: 57445 - DNA, 201 bp, Homo sapiens
tactgtggttacatttggaagtgtttacaaaggtgataagatgtttttatagtttggtgttcatttatcgaccatattaagaaccttcttctatgaaatgsttttagtaggaagtattttgaatgaagaaagcgtattttccacaatatatttggtagattatttttcaaaaccaaaggacttcaaaaatgtcttcctatt

SEQ ID NO: 57446 - DNA, 201 bp, Homo sapiens
taattatctgtatggctttggacgagttgcttttgatctctgatatcaggtaggcttctctctaaataaatggaaatactaactgtccctggctcatagarctctgtgagggttaggcaacaatgcttacaaagctctccatgcagagcctggcaaatcgtaacctctcaataaatgctagtcattgatgtcacttgaata

SEQ ID NO: 57447 - DNA, 201 bp, Homo sapiens
gtagggagtcccaactttttgaatccatccgtgtggcaaatgtagctggacccttgggatgaagacccttcctgcatcctcccaaggagacaagttctggrccataactctagagcaaccccaacccccaggccatggaccaagtgtcaacaatgttgacattgtgaatccctgatctggaggaacatagctttggggcag

SEQ ID NO: 57448 - DNA, 201 bp, Homo sapiens
aaagtgagtcagacttcttaggcttgtagatgttgaggactaagctttgctctttatcttctctttatggatttccctttggaagcagggataagaagagrgaaggtctcccagatgtaaatttctcataaatatttgagctccatttcagtaattctttcattctctgatctgttgcctaatcttctatttagcaagtac

SEQ ID NO: 57449 - DNA, 201 bp, Homo sapiens
ggaagtgtttacaaaggtgataagatgtttttatagtttggtgttcatttatcgaccatattaagaaccttcttctatgaaatggttttagtaggaagtaytttgaatgaagaaagcgtattttccacaatatatttggtagattatttttcaaaaccaaaggacttcaaaaatgtcttcctattagtggacaccagtatt

SEQ ID NO: 57450 - DNA, 201 bp, Homo sapiens
tctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcc

SEQ ID NO: 57451 - DNA, 201 bp, Homo sapiens
acagagcctcccttctacctgctcttacccgggcaccacagttgatgagttattttttggaccatcagcaacacacccaatcattgtacatggaatacttyggggatgcttttttctatattgattttacttcattaaactgagctccagaggagcagaaactttggctaatacatcttggtcttagcttgtaatatctgt

SEQ ID NO: 57452 - DNA, 201 bp, Homo sapiens
gttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaaga

SEQ ID NO: 57453 - DNA, 201 bp, Homo sapiens
cctgcccttccctaactggtttcctatgctgtcatgcccacctttgagtgttgccttcactttaaccttctgtgcatgctcacaaagtaattagcatgtaycctccattctgagttaatataaggccccagacccagccacatggggcaactttactgccttcaggtaggggaaccacccccaccacattccctctccact

SEQ ID NO: 57454 - DNA, 201 bp, Homo sapiens
ctcatctctttagattagtgattctatattggtgagggagtggaagagaaatgtgggtgtgttgactatattctccacagaaactttttgaagtagcatcstcactcagcacagaacattttgacaatacacttccagggcaggtggtttcttactatgtccctccctacccccacatactttgggactcagaatgtaggg

SEQ ID NO: 57455 - DNA, 201 bp, Homo sapiens
tggcatggcctttgtatgacacttccttctagccagactcggatttgggggcatcatatttgggatggctgcaccgcaaacaggaaaggccacaggacagytcacaggttctctctgaacagaagcctgtgagcacgtgcctgtcatttaaaagctgcatggcactcttccccctgcatgcgtttctctcaaggtgtccct

SEQ ID NO: 57456 - DNA, 201 bp, Homo sapiens
ccccccatggcttcgtccttattcttataacctgtatgcactgctgaacctgctgaataaccatgtcacagtggcaggagagggactgggtgaacttgagyctcgatgcctggattaaagccttgtaatgatgtttgcaaagcaccagggtgataactgaatggttggcacaggcttcgatgaagcttgtgtccaccacag

SEQ ID NO: 57457 - DNA, 201 bp, Homo sapiens
tgacaatacacttccagggcaggtggtttcttactatgtccctccctacccccacatactttgggactcagaatgtagggagtgtactctcgagggatgcrgcccatacgtgaatgcatggaggcagcatataaggttgcaaagcactgaccttctctttttatgattcccatttattccatagactgtgaagtctgcctg

SEQ ID NO: 57458 - DNA, 201 bp, Homo sapiens
ctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaaga

SEQ ID NO: 57459 - DNA, 201 bp, Homo sapiens
gaccctcaataaggagaatcagagaaagaagaaataaaacatattactccattcccatacttctgtgaagaaatacccgagactgggtaatttataaagaraaagagatttactgaactcagtcgtttcacctggctggggaggcctcaaaattatggcagaaggcaaaggaggagcaaaggcacatcttacatggcagca

SEQ ID NO: 57460 - DNA, 201 bp, Homo sapiens
cacctcccggtttcaagcgattctcatgcctcagactcctgagtagctgggattacaggcatgcgccaccatgcccagctaattgtgtatttttagtagaracgggatttctgcatgttggtcaggctggcctcaaactcccgacctgagatgattcacttggccttggcctcccaaagtgctgggattacaggtgtgagc

SEQ ID NO: 57461 - DNA, 201 bp, Homo sapiens
gagatttactgaactcagtcgtttcacctggctggggaggcctcaaaattatggcagaaggcaaaggaggagcaaaggcacatcttacatggcagcagacmagaaagcgtgtgcaggggaactgccctttataaaatcaccagatctcatgagatttattcactatcaagggaacagcacaggcagatcccatggctttga

SEQ ID NO: 57462 - DNA, 201 bp, Homo sapiens
ttaactgattgcagcaggttagagcacagcatgaagagctgacaatattgaccgactggccctctcagacaaagtttgccaacacccaggtgagcagatayacttatctgtgagcagacgtgattcaggggagattgttgtccctcctttcctaagaaaatgtggaaagatgagaatgttgccaccagtgctgatatggag

SEQ ID NO: 57463 - DNA, 201 bp, Homo sapiens
atatgtcccacaattggcaagtgccataaatatattataggccattatactttctacagtatctttaattgatatgccccatgtctaagaaaaaaagtagyttttcatgatgaaggtgatgaactacttctttccattattctatttcccccttttcttcttcaggctttaaagatatcataataccatttacatttactg

SEQ ID NO: 57464 - DNA, 201 bp, Homo sapiens
atcaaggctgggaggaggtctttccactggttttccgggctgtttgtgtactacacagcctgtgtacctggcaaggcacgctctgctctgccctgccttcygatgagctgactaacaccttatagatgaggttcccttagaaccaaagatgccccatgaaactccctaggatgaatgttggaagtccttccaactgggatt

SEQ ID NO: 57465 - DNA, 201 bp, Homo sapiens
ccccaactccttactcatgcttcctctgtaaaatgatcactccccagtttgacaggaattgcccctggaatcccatctggtgttctaattgttaccaaatycaggcaaatcttgcctgtgatacaggtggtgaagctactggatagaactggagcatctaactggtgtgagatggtatctcattgtggttttgatttgcat

SEQ ID NO: 57466 - DNA, 201 bp, Homo sapiens
ttgtctccatttctgtcccagttacatcaaggctgggaggaggtctttccactggttttccgggctgtttgtgtactacacagcctgtgtacctggcaagrcacgctctgctctgccctgccttctgatgagctgactaacaccttatagatgaggttcccttagaaccaaagatgccccatgaaactccctaggatgaat

SEQ ID NO: 57467 - DNA, 201 bp, Homo sapiens
catgtaccctagaactgaaaatataataaaaaatacatattaaaaaaaaaagaactggagcatcgactttcgttttcatttcaagacccgtcccccatgaycacagaggatgaaaagtctgcttaaattataagctagctaattgcttcttcagttgaagacctaaatgagttttaaagtgaaatgcatatctctaagggc

SEQ ID NO: 57468 - DNA, 201 bp, Homo sapiens
tggggcagcacctttgcttgaacgctggctccagatgaaagaacagattgccgcggagccgcttttccaaggatccctctccccagcatggggcttcatayattattgagagcaaacctactttccaccgccactcctggatgcacttattttgcgagccttattcagaatgtcagcatggatcacttggcaacaaaggcc

SEQ ID NO: 57469 - DNA, 201 bp, Homo sapiens
ggttgtctcgaactcctgagcttaggcagtctgcccacctcagcttcccaaagtgctaggattataggcatgagccaccatgcccggcctaatctaatcarttcctttaaatctgaaactgtccgcctgattctggtttaccacaaccaccagagtcttaagtgtcccaatagccagggtctcatagactctgcttatggt

SEQ ID NO: 57470 - DNA, 201 bp, Homo sapiens
agtgagctgagatggcaccactgcactccagcctgggcaatggagcaagactctatctaccccccaccctgcaaaaaaagaaaagaaaggaaaaaaaatcytggtgcttgtaggagaggcatttatttcttttaggactggacggggcttggagggtttccaggaaacagcctcaacctaaaaatagtagacacagttcat

SEQ ID NO: 57471 - DNA, 201 bp, Homo sapiens
ggctccgagaagctcacccatcaccatttgctctactgcaaaacaggactcattagcaggagctcataaaatgaaactggcagtgagctcatatggaagargcatcacgggcaactcggcttggctcaccagcccctgagctgcccccgagtgaccgctccagccttctttccttccacctctccctcttggccaacttca

SEQ ID NO: 57472 - DNA, 201 bp, Homo sapiens
acctgccatcatggggataaccggaattgatacaatgtcttgattcaagattcagagctcattttttctgtgtcagattaaaaaaaaaacaaaaaaccctyactgatcttttaaatatgtaattcttcctcctcttctccccttgtctctcttctcacccctaccaatgtaatcagttctttttttcttttttggagacgg

SEQ ID NO: 57473 - DNA, 201 bp, Homo sapiens
accacaagcattatcttctttaatcatctcacaatcttatgaaggagatactaatattttgcttgcaaagatgagggaagtgagtttccgaagttgctaartgcgtaaaggaggtggtggtgtcagaatgttatcctgctcagatggttgcatgggacagtgtccagaggaaggcctctgattccttccccagcattaggc

SEQ ID NO: 57474 - DNA, 201 bp, Homo sapiens
taagtctccattccgcttgccaagattaaattgaattattcccgctgccattcagttttactctgcacaaaatacagccaacatttttgcatttctttctyccttcctccttttcttctttctttccttccttccttcctttctcccttcatctatctttgttccgcttttgtttgtttttttttagatcgctgcatgctg

SEQ ID NO: 57475 - DNA, 201 bp, Homo sapiens
gagattcacatatgtagattacattgttatgaaccaacatttataagcaagcttgatctctcagaatgcgtttgtctatctcagattttcaagaatcctcrtacaaattgtccagggtttccacctcgcagttttcttccagggttgctatggcatggaaagtacattgctattttgttatgtaaatgctcaacagactgg

SEQ ID NO: 57476 - DNA, 201 bp, Homo sapiens
gcagaatggaagggaaggatggaaggaagagagggagagacggagggagatggaggatgacagggagatggagggaggcaaaaagaaaaagggagaaggawagagaggaaagaggggaagggaggaaggaaagaagagagagaaggaggaagagagggaaggaggcacagaggtagagaggcagggagataatggagatcc

SEQ ID NO: 57477 - DNA, 201 bp, Homo sapiens
ttccagtttctcaattgcaaaagtgaggctggtcatggggcttggaaccacgccacggacgcatgaagcctccccgtttacatgccaaatccagagcttakgcatccatgctcagggctctctgtggtaggcaacagctggattatttactttctagaatatctcgagttcttaatctgagcagtttcgaaaccaagccca

SEQ ID NO: 57478 - DNA, 201 bp, Homo sapiens
atggcttaccttactttttagacataatttttgttttctgttaaagggtcagttatagataagtatgctcccttgcaatgaaatgaacccactttatcaaytttgaaggaatcaaaattaacttgaatacattgtctttttgcatatgtatgtagtgctttgtataaacatatgaatttgtaggagctgctcttaatgatt

SEQ ID NO: 57479 - DNA, 201 bp, Homo sapiens
ttatactgtgggctgcatcgcttaccaatatttcatctgtttcacttagctgctgttacttactcaataatgtgtggccaatctcacaagatactaattcwttttttcaaatgcagcatcgcttgaagctgtgataaaatatcacacctttggaaatcaaggctcttcttgtttatttatttaactcacattaattagcct

SEQ ID NO: 57480 - DNA, 201 bp, Homo sapiens
tggggcactgagatctatgcatgttgtgggcccactttaagaaaaggagtcaaacatttagtgtggaatactggaaggggtccctagacatgaagggcctyttcaacctaccttttgttggcttcaaggttatgccatattttgcaaagtcaagttggagatggctctcgatatgcatgagtgtgttagactgcttttctt

SEQ ID NO: 57481 - DNA, 201 bp, Homo sapiens
tcttttttttttctaaccactttcccagtgagacttcagttttcattctccccttagcagctttcaaatatgtacgtaacacaaatgttacatgtttgagmatttaaactgaatttggacagggcttctatttccagaaccttctaactctatttctttgtgacctgatagtcttgctctccagggtaaaagaagaggatg

SEQ ID NO: 57482 - DNA, 201 bp, Homo sapiens
ctcctaacatgtcatctgaaatctgggaccacagttccggctggaacacttgtcactaaagctgctgataagcaaagggtgtatcactggtatgggtaacwgttgtgggaggaggaggggtctgacagatagccggatgattttaatgtttatattccactggggtaagctctaacaaagacccatcatttcccagataac

SEQ ID NO: 57483 - DNA, 201 bp, Homo sapiens
ataattaaccctctggggagactaatattagtttattagagacaatttctagttctgtttatttttaacactaaacgatttgttcagattggggaaaaaawttttttttttttttttggttgtggtggcgttggcttttacttggggttgacctttccttatcaaggacatacaaggtgaatagctgggtgataatatatg

SEQ ID NO: 57484 - DNA, 201 bp, Homo sapiens
ggctctccatccttcaaaatccagctcttggcctcatatcttccacaaagccttcccagacctttactcacctgggccattaatcaccttccctctcagtyagctcctacaccatgagtgcttttgtatggtgactgtctggttacaaggtcatcttttcccctggatgagacgccccttggggaaaggaccaagttttat

SEQ ID NO: 57485 - DNA, 201 bp, Homo sapiens
tccatccttcaaaatccagctcttggcctcatatcttccacaaagccttcccagacctttactcacctgggccattaatcaccttccctctcagtcagctsctacaccatgagtgcttttgtatggtgactgtctggttacaaggtcatcttttcccctggatgagacgccccttggggaaaggaccaagttttattccct

SEQ ID NO: 57486 - DNA, 201 bp, Homo sapiens
ctgtatcatgatatcggagtgttagctgttttgggagtacgtgtgctcaggacttgggctgagtggaaaaccagagtatggggttagaaatggaggcagarggactaccatgtcggggaggatgcacaatgaattggacgaaggttgcaactcagtgagcaccgtacctgtagtgtgtcttagtaatagcagatgcccaac

SEQ ID NO: 57487 - DNA, 201 bp, Homo sapiens
ggcctcatatcttccacaaagccttcccagacctttactcacctgggccattaatcaccttccctctcagtcagctcctacaccatgagtgcttttgtatsgtgactgtctggttacaaggtcatcttttcccctggatgagacgccccttggggaaaggaccaagttttattccctgtttaaccttggcctgacaaccta

SEQ ID NO: 57488 - DNA, 201 bp, Homo sapiens
ggtggtgtttttactctaacacctctttcagtacatacatacagtaggtgcttagtagatgtttactgaatgaatggataaacatgtacaaaattatgatmccttgtgttaaatatggtagggaagcaacataatgtgccctggagtttcacagaagaaggggctttcttccagcttggggatggaggtgagctgtcattc

SEQ ID NO: 57489 - DNA, 201 bp, Homo sapiens
aagcaggaggctttgaggtctttttttccctcctgattcggagggaaaaaaaatgttgtttgtgttcatttatggaaattagatctatcacatactcttakgcaatttatgaaatgttaagcaatacccctgaatgtcctagtcccaggaaagttgagagttgagtgcaagacggggacacccaggagccagtaaatcaac

SEQ ID NO: 57490 - DNA, 201 bp, Homo sapiens
acagtggacctcacagctctcctgctaatggtgctgatggctaagctcagctcttacccttgaccactggaacaacttagacatgtcaccagctttctgascctgtctcattacgatgaaaattgtgatacaggttagtgtaaggaccgacaataatgcatataacatcaataatgatggatatagaatttctgcagttat

SEQ ID NO: 57491 - DNA, 201 bp, Homo sapiens
acatacttcttcctgccctggattaacattaccattggttttagtagtcttacgtcattatgtccaaagcttttaagtttacagtgcttgcttagtccagygaccaatggatgtaagtaagttggaaaagggcaaaggatttagaatcatgagggttgtattcaaactgcagcctctactcccttttagttacataatttt

SEQ ID NO: 57492 - DNA, 201 bp, Homo sapiens
gccacaacagcctcttcttttctcttaaatcttccagcaattcttcaactttgcctgtatatttatcatacaacataatcctagtatttagtaaatgcttrgtctttgatttcttattttcaaatgcatgtctttagaaccagaatgtgtgtagctgttttctggcctgaatttgggctgagatgatgagaagtttagttg

SEQ ID NO: 57493 - DNA, 201 bp, Homo sapiens
ccattggttttagtagtcttacgtcattatgtccaaagcttttaagtttacagtgcttgcttagtccagtgaccaatggatgtaagtaagttggaaaaggrcaaaggatttagaatcatgagggttgtattcaaactgcagcctctactcccttttagttacataattttgaaatcatttgacatttctgaggttaatttt

SEQ ID NO: 57494 - DNA, 201 bp, Homo sapiens
attctggaacacgaaggaggtatgaaaagggcttcactcgtttcatggaaaagctcagaacagtttgtcgacttggaaacacaggccctgacagcgtaccmaggtcaccctgcccttcaatcctgctgatagcccaagttaacatcctcccatgccttggccttcccagaacaaacatggctttggacgcctttgggtggt

SEQ ID NO: 57495 - DNA, 201 bp, Homo sapiens
gcaagaattctggaacacgaaggaggtatgaaaagggcttcactcgtttcatggaaaagctcagaacagtttgtcgacttggaaacacaggccctgacagygtaccaaggtcaccctgcccttcaatcctgctgatagcccaagttaacatcctcccatgccttggccttcccagaacaaacatggctttggacgcctttg

SEQ ID NO: 57496 - DNA, 201 bp, Homo sapiens
tttacagtgcttgcttagtccagtgaccaatggatgtaagtaagttggaaaagggcaaaggatttagaatcatgagggttgtattcaaactgcagcctctrctcccttttagttacataattttgaaatcatttgacatttctgaggttaattttctacatcagtttagctgctttaggccgcaagttattaacacccact

SEQ ID NO: 57497 - DNA, 201 bp, Homo sapiens
tgagagaacaagtctatgttttcttgagacaaagtcttgatctgttgcccaggctcgagtgcagtggcagcatcttggctcactgcaacttctgcctcccrtgttcaagtgattctcctgtctcagcctcctagggagctgggattacaggtgtgcaccactatgcccagctaatttttatattttcagtagagatggggt

SEQ ID NO: 57498 - DNA, 201 bp, Homo sapiens
attttttcctgtgcagcaattttaactttctatattcaaatatactctgaatgcacagtgaatttggcagaataccatttaagtcttgtattttccaaagytagtcaacgtccaactgccaatgttgcctgaacaggaaatatttatacctgaaagcgtccaggtgagagtcaggaaagccatgaaggtgcaactggcata

SEQ ID NO: 57499 - DNA, 201 bp, Homo sapiens
atggcaagaattctggaacacgaaggaggtatgaaaagggcttcactcgtttcatggaaaagctcagaacagtttgtcgacttggaaacacaggccctgasagcgtaccaaggtcaccctgcccttcaatcctgctgatagcccaagttaacatcctcccatgccttggccttcccagaacaaacatggctttggacgcct

SEQ ID NO: 57500 - DNA, 201 bp, Homo sapiens
ggatagggtaatggtgttgacacaggcactgttgaatacgtatgtacatattttaatagttttctcattaatcaaatggaaatgctatcgattttataggrtcgttgtgagaagaagtgagaattgaaatgaaaggcatctagtcttccccggtccccatccacttgacccaccatacctcaagccacttctggctccatg

SEQ ID NO: 57501 - DNA, 201 bp, Homo sapiens
aaggcccagatttagttctcattgtaggaaaaagggccagaataccttgcccatttttgccttgggaagtgagctcaatgaaatacatcttcatatgcccrttttacagaagcagcaactgagggctgttgtactgaggcttgcaatggccacctcaacttttaggtctctgaggcagcaatgggacccttgccggggcct

SEQ ID NO: 57502 - DNA, 201 bp, Homo sapiens
tgtgcagcaattttaactttctatattcaaatatactctgaatgcacagtgaatttggcagaataccatttaagtcttgtattttccaaagctagtcaacrtccaactgccaatgttgcctgaacaggaaatatttatacctgaaagcgtccaggtgagagtcaggaaagccatgaaggtgcaactggcatactgatgtca

SEQ ID NO: 57503 - DNA, 201 bp, Homo sapiens
tgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaa

SEQ ID NO: 57504 - DNA, 201 bp, Homo sapiens
ctcccaggttcaagcgattctcctgtgtcagcctcctgagtagctgagattacaggtgtgcaccaccacgcacggctgatgtttgtatttttagtagagaygggatttcaacatgttggccaagctcgtctcaaacctgcctcagcctcccaaagtgctgggattacagatgtgagccactgcacccagcctgtagtttct

SEQ ID NO: 57505 - DNA, 201 bp, Homo sapiens
ttcaaaagttgctgccttccaaggggaaaaggtctggtcttgtaatttctggtctgtgcgtgctgtataaggaagaaggtttgggtagggaagcaacagastacccactagtgagagggaggacaccgctggtctgtgctcaacagccaggccagcaccacatgaataaagcatgatggcaattgcctgactctgtcctcg

SEQ ID NO: 57506 - DNA, 201 bp, Homo sapiens
ctgtttgtaacatgatttaagcactaagctattgaattttggagtgcattaaaaaaaatatcgagtggaaaaaggaatatttcttagggaggaaaaaccckacttttgactttataatattaagttcgttcatatctctcttagattcttatataaattttattgacctaatgttctgtacagtagtccttatttacagtt

SEQ ID NO: 57507 - DNA, 201 bp, Homo sapiens
cttcagtgctttttcaggactatgttatagaatacttatggggcatacgtgtaaatgaactgtcaaccttaaaatctaaacaaacagcttgtttgtggttygtcctgaaatcctccctgctcacaaaacagccagctacttggttttctaaaagacgtaattttgcaggcagacttcgtagagccattctgtgcagaagaa

SEQ ID NO: 57508 - DNA, 201 bp, Homo sapiens
agacgggatttcaacatgttggccaagctcgtctcaaacctgcctcagcctcccaaagtgctgggattacagatgtgagccactgcacccagcctgtagtktcttatttaatgtctgtccccccttctcttgacagtggtgtttttgccttcacactactgtatccctggtccataccgtaaatgttctgtaaatgtttgt

SEQ ID NO: 57509 - DNA, 201 bp, Homo sapiens
tacagagaataggagagaaaatagagctccaaggtggaggaaaagacaactgagaggaggctattgtgatgttttattaccataaactgccaagggttagycgtagccctccatctgccagctaattccggtttcattaatatgaatattctcacgcttccagaaggaaattcttggaatgttatggatctctgtagcagg

SEQ ID NO: 57510 - DNA, 201 bp, Homo sapiens
aaaaaccctacttttgactttataatattaagttcgttcatatctctcttagattcttatataaattttattgacctaatgttctgtacagtagtccttawttacagttttggtttccaaggtttcagttatacattgtcaactgtggtacaaatatattacttacaatacgatattttgagagagagagaccacatttat

SEQ ID NO: 57511 - DNA, 201 bp, Homo sapiens
ttttttttttttttttcttcagtgctttttcaggactatgttatagaatacttatggggcatacgtgtaaatgaactgtcaaccttaaaatctaaacaaamagcttgtttgtggttcgtcctgaaatcctccctgctcacaaaacagccagctacttggttttctaaaagacgtaattttgcaggcagacttcgtagagcc

SEQ ID NO: 57512 - DNA, 201 bp, Homo sapiens
acgggatttcaacatgttggccaagctcgtctcaaacctgcctcagcctcccaaagtgctgggattacagatgtgagccactgcacccagcctgtagtttsttatttaatgtctgtccccccttctcttgacagtggtgtttttgccttcacactactgtatccctggtccataccgtaaatgttctgtaaatgtttgtaa

SEQ ID NO: 57513 - DNA, 201 bp, Homo sapiens
gatctctgtagcaggcacatgcaacgtccagtgcttccctgctggtaatgtggcggttttattatgcatgccatacccatgctctctatttcctcgatagrccttatagaaatcaccatgcttccttttagaagaaaatgatggtatcacatggagaacgagctgaggagcttgacaatcttggcaaggcttatcaaaaga

SEQ ID NO: 57514 - DNA, 201 bp, Homo sapiens
tgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctatt

SEQ ID NO: 57515 - DNA, 201 bp, Homo sapiens
agccactgcacccagcctgtagtttcttatttaatgtctgtccccccttctcttgacagtggtgtttttgccttcacactactgtatccctggtccatacmgtaaatgttctgtaaatgtttgtaaatgaatacatgaaagatgaccaggtgctgaatcagtgagagtccttaatgtacttcttatcatttatccctctga

SEQ ID NO: 57516 - DNA, 201 bp, Homo sapiens
gaagcacacacagctgttatcttccagaaacactgcttacagaggtaattgctcacagattttagggtttacagcaggtatcacaggatttcaaatttaaraggggggtgggggcctgtgttcaaagtcttaagaatatccaagggatgtatgatgtatgcataattacctgaaattgaaactactgtagtttaaacactt

SEQ ID NO: 57517 - DNA, 201 bp, Homo sapiens
ggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagaca

SEQ ID NO: 57518 - DNA, 201 bp, Homo sapiens
aacatgatcccacttaatcctccacttcacaattctgaaaagtcaacaaatttggcccatggtagagaggaggaaaccaagacttgaaacattaaataacrtgtccaaagtctcccatttcagagacaggggcatttggctccaggtttttctgactctagacagtagtttgtttttagcacatcaaatgtctgagacttg

SEQ ID NO: 57519 - DNA, 201 bp, Homo sapiens
ttactgtaaggtatctaagacttctgggtgtgggttttaaatatattttggatgagctttgttcatgtttacacatggccaccaggtcggccacaaagctrtggctctggtcagtctgactctctttagcaggaatcacgtgacaatctgtgtctgtgattagctccgtggatattactaggtagatttctcacttgtcct

SEQ ID NO: 57520 - DNA, 201 bp, Homo sapiens
tactctcctgatagccactaaagggggaattggatattgtctatcaattggttggtctctgaactaaggctgtatctaattacaaggcattgtatcggttstgatttattaaccatttacttggctttggagaaggcagcatttttagtagtactgttgagcctgcatgtagcttttccaggagggcagggtgcctggata

SEQ ID NO: 57521 - DNA, 201 bp, Homo sapiens
gagcctcacactccctggacaaagacatgaaaaactctggatgatttggaagggagatctagaaatggtgaaaggactggcaagtgcctctgtgctgataytgtacctgggctcagtggtctggctaaaggagaggtgctggggccaggtgacaggcgagtctctatacggcaggcccaaaaaatggaggtgcaggcttca

SEQ ID NO: 57522 - DNA, 201 bp, Homo sapiens
cggttgtgatttattaaccatttacttggctttggagaaggcagcatttttagtagtactgttgagcctgcatgtagcttttccaggagggcagggtgccyggatatctgatcttacagttattactttgtgtcatatataattttgttttctccctgcaacaaataaatctttgggactccggaagaaaaaaaaatggga

SEQ ID NO: 57523 - DNA, 201 bp, Homo sapiens
ttctcaattgcaaaagtgaggctggtcatggggcttggaaccacgccacggacgcatgaagcctccccgtttacatgccaaatccagagcttaggcatccrtgctcagggctctctgtggtaggcaacagctggattatttactttctagaatatctcgagttcttaatctgagcagtttcgaaaccaagcccacattaat

SEQ ID NO: 57524 - DNA, 201 bp, Homo sapiens
gagaaggacccggttggctctgcaaaccgcatttccttggctgaacgccagaggagagaaatgatccggcaagaagacacaccattccccgtcagcccctwcccgacccttgcacccctggatcttctgctgagtatcggattggtctgcgtccaagagctcctcgcttggccagcaggggctgcctggagaaggggagga

SEQ ID NO: 57525 - DNA, 201 bp, Homo sapiens
ttctgctgagtatcggattggtctgcgtccaagagctcctcgcttggccagcaggggctgcctggagaaggggaggacaggcttcgagttttttgggtagkgacttctgtggacgtgaaaagactgcaccagaaatcggaggcagccctccaaacataacttggcctcttcgttctccctgtggacacacaggctgtgttc

SEQ ID NO: 57526 - DNA, 201 bp, Homo sapiens
aaaaataatgataaagattgtgtgatcaagtatagcagccctgtggtgtttcctcagaatggtgtattacagaaaaggaaaaagccatatacatggagaaraaactcccgatatttaatattatcaattgctggttcctgtaaatttgcatttatggatcacattataaaagcaattactcttatggattgttcatgcaga

SEQ ID NO: 57527 - DNA, 201 bp, Homo sapiens
tgaagatgctgaggttgagggaagaaataaatgttaatgcaaagtgcccagtttagtgcctgccaagagtaactggtgggtctgtgtcaccttctgacatkatcagtgtgattgtctccaacgcatccatggaagtgaaaccgttggaggaagctaatgccgtgagccagctgttggttatgtttttgttttgtttttctt

SEQ ID NO: 57528 - DNA, 201 bp, Homo sapiens
cccccttcacatacttatactgtgggctgcatcgcttaccaatatttcatctgtttcacttagctgctgttacttactcaataatgtgtggccaatctcamaagatactaattctttttttcaaatgcagcatcgcttgaagctgtgataaaatatcacacctttggaaatcaaggctcttcttgtttatttatttaactc

SEQ ID NO: 57529 - DNA, 201 bp, Homo sapiens
gtaagaggtttgagggaaaaataatactgagttttgagtgtttctgattttaaaaatgtgttcagtagaattaaacgtgttcaccaaaacccattttatcmctttaaattattgggcaattaattgtatttacttagcattgaatgcatgattagaaatggaatttttaaaaaagcaatactcaagtggagtgagttcatt

SEQ ID NO: 57530 - DNA, 201 bp, Homo sapiens
taaatgttaatgcaaagtgcccagtttagtgcctgccaagagtaactggtgggtctgtgtcaccttctgacatgatcagtgtgattgtctccaacgcatcyatggaagtgaaaccgttggaggaagctaatgccgtgagccagctgttggttatgtttttgttttgtttttcttttttacttgctggatagtgggttctgt

SEQ ID NO: 57531 - DNA, 201 bp, Homo sapiens
agtggtggcctacttacagtgcatcgcccactctgatttagatgagcaagagctgctgagttgtagatttctagtttctaaacaacaataagtcttgcccscagatagcctcttagcagagccaaaagccagcagagagaagactcagcatttgctttggagtaagtttgtgtgtgtatgtttatctcccttttactcatg

SEQ ID NO: 57532 - DNA, 201 bp, Homo sapiens
tatccactgccctggtgggggaatcagtgaggctaggaatcactggaaaatgacattccttgagactccttcaatgggtagagtttgctttagcttttcawgtatcttactgtatgatggttgcttttgggttgaattccaccttgggttcaattcaacatgaaagttaaccttttggtgaaggaatgatccacgggaaat

SEQ ID NO: 57533 - DNA, 201 bp, Homo sapiens
atgccgtgagccagctgttggttatgtttttgttttgtttttcttttttacttgctggatagtgggttctgtttattgagaaatatttacatccgtctaawtcaggtgcttgctagggttcttggcacacagagcatcccaccaataaactgtggttcccaacaaggcttgcaactgaatctgggcaacaatgaacatgac

SEQ ID NO: 57534 - DNA, 201 bp, Homo sapiens
ggagtggtggcctacttacagtgcatcgcccactctgatttagatgagcaagagctgctgagttgtagatttctagtttctaaacaacaataagtcttgcycccagatagcctcttagcagagccaaaagccagcagagagaagactcagcatttgctttggagtaagtttgtgtgtgtatgtttatctcccttttactca

SEQ ID NO: 57535 - DNA, 201 bp, Homo sapiens
ttgtcagttcaggagggtagaggataggggggaaaaggtgctactggcatctagtgggcaaaggccagggatagtgctaaggatcctgcagtgcaaaggascatgcccaccacaaaatatcagcagtgccgaggttgggaagctctgtgccattgtgcaaagattcaaggtggctatgtcacaggactggtacatgtcctt

SEQ ID NO: 57536 - DNA, 201 bp, Homo sapiens
ccttgtatctactgctgtcgtttagattaggaacagattgccagatgtggaagaaatagcctcattagtaacttttctgtaagcaatctccttatttcttkttttttgttcttttgttttttgtgtgtgcttctgcgtgcacctcctctatggctccccccaccaaatttctgtgtcttcatttgcaactctcttttctcc

SEQ ID NO: 57537 - DNA, 201 bp, Homo sapiens
tagtttagaatgaaattttaaatacactagtatatgtaattaaaattgtatatacgttttagtcaaccatcagctgacttattcatgttctgtggactctrtggtgggtggggtccaagcctccctgaagcagatctctatcctgtcaccctgctggaaatgaaacacttaggggttagaaggggatcaaggaaagtccga

SEQ ID NO: 57538 - DNA, 201 bp, Homo sapiens
tggatttggcagctggttttgtctggatttgaaagggaggtaatcaggggtgtgctgggagggccagaacgatccacccacgtgttggtgccacccggcartggaaaagcctctggcctcggccttctccggaaggttgtccgcggtgccagtgagagctgcttttcaccttacagcagccccggcctatctctcaggagg

SEQ ID NO: 57539 - DNA, 201 bp, Homo sapiens
tcattatatgcctccaaagactttgtgtttcctgtgtttgacatcgagatagaatttttcataaccctttactagtaataaatttgattgttaagggaccrggttaatcttatttctaataccagcatctgattttaaaaccctgatttaggagcattttctttctgctaccttcctaaaacgcatgggtggaaatgtata

SEQ ID NO: 57540 - DNA, 201 bp, Homo sapiens
gatatccagtatattccatgaaacaaatatcatgaatttattccatgaaacaaatatcgtgaatatattccatgaaacaaaatactgtgaaatcataccastgatttttgaagaaacctaatgaaaacagcatgctcctatatcttttttctgggtgatctttagatatctcgtcttccaaacttttgtgtagcattgtct

SEQ ID NO: 57541 - DNA, 201 bp, Homo sapiens
aagcagaatggaagggaaggatggaaggaagagagggagagacggagggagatggaggatgacagggagatggagggaggcaaaaagaaaaagggagaagkaaagagaggaaagaggggaagggaggaaggaaagaagagagagaaggaggaagagagggaaggaggcacagaggtagagaggcagggagataatggagat

SEQ ID NO: 57542 - DNA, 201 bp, Homo sapiens
aaggggtccctagacatgaagggcctcttcaacctaccttttgttggcttcaaggttatgccatattttgcaaagtcaagttggagatggctctcgatatkcatgagtgtgttagactgcttttcttctattttttaaaaatgcacccaaatgtaaaagacacttttacctttttgatttgatgttgaaggtcatttgaaa

SEQ ID NO: 57543 - DNA, 201 bp, Homo sapiens
cgatgtgttgttttctttgttcttttttttgagacagggttttgctgtcacccaggctggagtgcagtggcagagtctctgtgcactgcagcctccgcctyccaggttcaagtgatcctcctacctcagcctcctgagtagctgggactacagttgtgcgctaccacacctggctaccgtgtcttgttttcaatgcagtat

SEQ ID NO: 57544 - DNA, 201 bp, Homo sapiens
gacaggcgtgagctgccttgcctagccaaataactccattatttaagaaaaattaaccagtatttattgaatacttactgggccctgtgctaagtgctttscatgtgatttctaatttcctgaccattctatgaagtggctactataattatcctgatttcccaggcagagaaactgaggcttagagagttgaagtaatca

SEQ ID NO: 57545 - DNA, 201 bp, Homo sapiens
aaagtcatatcttacatggttggcagcaggcaaagagtgagcttgtgcagggaaactcccccttataaaaccatccgatctcgtgagacttgttcactatsacgagtaaagcacaggaaagacttgccctcatgattcagttacgttccaccggggccctcccacaacacatgggaattgtgggagcgacagttcaagatg

SEQ ID NO: 57546 - DNA, 201 bp, Homo sapiens
ttttttttattattttttgagacagagtcttgctcttttggccaggctagagtgcagtggcgcgatcttggctcactgcaacctctgtcgattctccttcmtcggcctccgtagtagtcaggactacaggcatgcaccaccatagctggctaatttttgtatttttagttagacaccaggtttcaccatgttagccatgct

SEQ ID NO: 57547 - DNA, 201 bp, Homo sapiens
cctcttcattgtccccttcatacaaatagatagcttttagtgagcagctactctgcctggcactgttctaaacacatgacaccaatagctcactcagattsccgcctctcaacagggaaactgaagcacaggaagtttcagtgatgcacttaggcaaccagtaagtggcagggtcggcattgaggtcaagactggttggac

SEQ ID NO: 57548 - DNA, 201 bp, Homo sapiens
aaacccctaaattgtggtgcctcagtgatcttctataacataagttgatagtcaataattgcttaatgggaatcataaatatgagtttatttatatgtgtrtatatatatatatataaaatatatttccatgaatatactgaatgctaagccctccccactttttttttcttttttaaattcagaaatttctagttgtgtt

SEQ ID NO: 57549 - DNA, 201 bp, Homo sapiens
attctacggtggctctttacccattgccatcattttgtaggcagtgagtgcccgcatcagtgggcgttttatgttgcaccattttctgagcaatgtctttsgtccaccattaagcatttgtggccgcccaccccacaatatgctttgctttctgctttcagaaacaatactggtgacctgttttaagaaaagctgaaaagc

SEQ ID NO: 57550 - DNA, 201 bp, Homo sapiens
ccaaagcctgtgtttttcttgctcacatgtgagtcttctccttgcttcaaccctccccgctgacagccacaagactctgcctccctgcagcctgtggaacrtaatattcgttgggatcatacattgaccaaagatccgccatgtctttgcaactaacatactcactcatgacttcacgtggctatgtacaagaccacatct

SEQ ID NO: 57551 - DNA, 201 bp, Homo sapiens
agatttggagtcagatgtcatattcctgccagcaggtttagcagtcgtgggactagggaagtggcaatggcaggagcaactggaaatgtcttttttttttyctcctttttcctgaatatggaaccaaagcctgtgtttttcttgctcacatgtgagtcttctccttgcttcaaccctccccgctgacagccacaagactct

SEQ ID NO: 57552 - DNA, 201 bp, Homo sapiens
atctctcttagattcttatataaattttattgacctaatgttctgtacagtagtccttatttacagttttggtttccaaggtttcagttatacattgtcamctgtggtacaaatatattacttacaatacgatattttgagagagagagaccacatttatgtaacttttattacaatttattgttataattgttctattat

SEQ ID NO: 57553 - DNA, 201 bp, Homo sapiens
tcctttcacaataaccctatccttactgttgaagacttgtggaaaagggacatggcccagggaaccagagtggtttgggaaagcactttgtcaagaggctkggggaccccagggtggaagctgccatgcgcatgaggctgtgttagcagaggcagtggcagaagaagacattgcaaacctgcaaaagcaacctctgaggat

SEQ ID NO: 57554 - DNA, 201 bp, Homo sapiens
ttgacctaatgttctgtacagtagtccttatttacagttttggtttccaaggtttcagttatacattgtcaactgtggtacaaatatattacttacaataygatattttgagagagagagaccacatttatgtaacttttattacaatttattgttataattgttctattattgttgctcatctcttactgtgcctaattt

SEQ ID NO: 57555 - DNA, 201 bp, Homo sapiens
gcacccagcctgtagtttcttatttaatgtctgtccccccttctcttgacagtggtgtttttgccttcacactactgtatccctggtccataccgtaaatkttctgtaaatgtttgtaaatgaatacatgaaagatgaccaggtgctgaatcagtgagagtccttaatgtacttcttatcatttatccctctgaggtaggc

SEQ ID NO: 57556 - DNA, 201 bp, Homo sapiens
taatttataagtatactttattgtaggtatgtatgtataggaagaaatgaaatatatgtagggtttggaaccatctgaggctttaggcatctactgggggwcttggagtatatcccctgtgcagaagcggaggctactgtacatacatttgcctgtaagtgagcgcgttcttggattttgttgaatggtgccactgattat

SEQ ID NO: 57557 - DNA, 201 bp, Homo sapiens
tccctctgaggtaggcaagggattatagtttagaatgtgtaaatacgtaaaagataaggcaaggagacctgctgagagtcacacagcaagcccccaaggtyccccaggctcatggtcaaatgacatgtaagggacgtatccagcggtgtgggtatgtttggagggaatgaatgtaaggagagagaggtgaggcacaggaga

SEQ ID NO: 57558 - DNA, 201 bp, Homo sapiens
aagaaatgaaatatatgtagggtttggaaccatctgaggctttaggcatctactgggggtcttggagtatatcccctgtgcagaagcggaggctactgtayatacatttgcctgtaagtgagcgcgttcttggattttgttgaatggtgccactgattatgggtcagagcttgttgaaagggtattaatccattatttact

SEQ ID NO: 57559 - DNA, 201 bp, Homo sapiens
tacgtaaaagataaggcaaggagacctgctgagagtcacacagcaagcccccaaggtcccccaggctcatggtcaaatgacatgtaagggacgtatccagyggtgtgggtatgtttggagggaatgaatgtaaggagagagaggtgaggcacaggagagacaggatgagctttagaggtagacagctctcgggtccagccc

SEQ ID NO: 57560 - DNA, 201 bp, Homo sapiens
gtccctttttcttggaatgtcagcctgaccctgaaggtattctcctaccagcagagccttctttgatgccccgtcttcaacctgccatgttttcccatctstgaggcttctattttagagacttttcctccagaactggcttatatcatcctgtgttgctgcatccgatcacaggtctgtggctgacctgggcagcgtagt

SEQ ID NO: 57561 - DNA, 201 bp, Homo sapiens
aaccctccctaagcagctattgagcctcacactccctggacaaagacatgaaaaactctggatgatttggaagggagatctagaaatggtgaaaggactgscaagtgcctctgtgctgatattgtacctgggctcagtggtctggctaaaggagaggtgctggggccaggtgacaggcgagtctctatacggcaggcccaa

SEQ ID NO: 57562 - DNA, 201 bp, Homo sapiens
ctagatgcttaagaaatgttaactactattgttattggcttgcagtagaaattaaagattatgaatgttcagcattcagaatatactagatactcaataascattattgctgtcattattaacattattttccccagctttactgaggtatgagtgacaaaaatttcatatatgcgcatgagtgtgtgtgtgtgtgtgtgt

SEQ ID NO: 57563 - DNA, 201 bp, Homo sapiens
cctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactggcaagtgcctctgtgctgatat

SEQ ID NO: 57564 - DNA, 201 bp, Homo sapiens
cgaatcacgaggtcaggagattgagaccatcctagctaacatggtgaaaccctgtctctaccaaaaatacaaaaaaattagccaggcgtggtggtggggcscggtcgtgggtgcctgtagtcccagctactcaggaggctaaggcaggagaatggcgtgaacccgggaggtggaggttgcagtgagccaagatcgcaccac

SEQ ID NO: 57565 - DNA, 201 bp, Homo sapiens
cattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagaga

SEQ ID NO: 57566 - DNA, 201 bp, Homo sapiens
gcaccactgcactccagcctgcgtgacagagcgagactccatctcaaaaaaaaaaaaaaaaaaaaaaggctgtgtgtggtgactcgtgtctattgtcccasctacttgggaggctgagacatgaaaatcacatgaacctgggaggtggaggttgcagtgagctgacatcgcatcactgcactccagcctgggtgacagagt

SEQ ID NO: 57567 - DNA, 201 bp, Homo sapiens
ccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctat

SEQ ID NO: 57568 - DNA, 201 bp, Homo sapiens
cgagactccatctcaaaaaaaaaaaaaaaaaaaaaaggctgtgtgtggtgactcgtgtctattgtcccagctacttgggaggctgagacatgaaaatcacwtgaacctgggaggtggaggttgcagtgagctgacatcgcatcactgcactccagcctgggtgacagagtgagactgaaaaacaaaaaaacaaaaaaaaac

SEQ ID NO: 57569 - DNA, 201 bp, Homo sapiens
aagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagac

SEQ ID NO: 57570 - DNA, 201 bp, Homo sapiens
gcacctcatcaatgtattttttctgccttgctttatagtgttttaaatccgcctcggcctttgttcctgaatgagcacccgagaaggggagaaagtgactmtctggccttagtatgtgtaacaaattatttaatgaacatttaaccaagatttgcaattcccctagttttatcttcccggtttccttttcttctgtgtgcc

SEQ ID NO: 57571 - DNA, 201 bp, Homo sapiens
gcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtga

SEQ ID NO: 57572 - DNA, 201 bp, Homo sapiens
agaacagtttaacttgaaaggaaataaaaaaaggagactaacatgggcccacagacattgtatttcataaattttggatgaaaactgaacctaccatcatktattaagagaatggatattttcatgtcagaaattataggaaggatacagttatgggatgaggagcaattcttttttttttttttttgaggtggagtctca

SEQ ID NO: 57573 - DNA, 201 bp, Homo sapiens
ttcttatttggagatgctgttcctctcaagtgggaaaaatttggttatctcaggtggtaaagatgcctttgtttaaaatattcttctgttagtggggacawtaatactactaatttctagtactgacgcttctcatgcaatttaatcagtaggaacctgtttgcatgttcatttgaggaagtaccaaagccaaaagtagct

SEQ ID NO: 57574 - DNA, 201 bp, Homo sapiens
ccctggacctcgctctgctccgtagcgtgcagcattttgctgaagcattcaaggccaagaatgtgtgagtgttccagtggagggttatagatcataatttyttgctattgtaatatctttatcagatgaacacaattgggagaatgcaaggctgttgtgttgtcttggcgtccaaacaggaggctcatttatattggccct

SEQ ID NO: 57575 - DNA, 201 bp, Homo sapiens
attgtgagccacacatgcaagggatctaggctgcatgctccttacgaaaatctaatgcctgatgatctgtcactgcctcccatcaccttcaagatgggatygtctagttctaggaaaacaagctcagggctcccaccgattgtacattatggtgagttggataactatttcattatatattacaacgtaataataatagaa

SEQ ID NO: 57576 - DNA, 201 bp, Homo sapiens
ccataacacatttactgtaacttgataccatgaactacacttgctgttatttatcatttctttttattttctctcattgcagcataaagccaaggtagaarcaatgaccctggacctcgctctgctccgtagcgtgcagcattttgctgaagcattcaaggccaagaatgtgtgagtgttccagtggagggttatagatca

SEQ ID NO: 57577 - DNA, 201 bp, Homo sapiens
tgcaaatgtgtgaggaattatagttgaaaggggaaagaacatttcagtttttcatttcctgcgtcactgtttttcttatttggagatgctgttcctctcamgtgggaaaaatttggttatctcaggtggtaaagatgcctttgtttaaaatattcttctgttagtggggacaataatactactaatttctagtactgacgc

SEQ ID NO: 57578 - DNA, 201 bp, Homo sapiens
cacacatgcaagggatctaggctgcatgctccttacgaaaatctaatgcctgatgatctgtcactgcctcccatcaccttcaagatgggattgtctagttstaggaaaacaagctcagggctcccaccgattgtacattatggtgagttggataactatttcattatatattacaacgtaataataatagaaataaagtgc

SEQ ID NO: 57579 - DNA, 201 bp, Homo sapiens
aaattagttatctctgccctttgggaggctgaggcaggtggatcacttgaggtcaggagtttgaacctagcctgggcaacatggtgaaaccccgtctgtascaaacatacaaaaattagctgggtgtggtggcgtgcctgtaatcccagctattggggaggctgaggcaggagaatcactcgaacccgggaggtggaggtt

SEQ ID NO: 57580 - DNA, 201 bp, Homo sapiens
caagaagtgtgttttggggaaacactccaggtagtggtacatagaatcctagcacaagatcagtgactgggtgagtttgacattgtagatgcaaatgtgtsaggaattatagttgaaaggggaaagaacatttcagtttttcatttcctgcgtcactgtttttcttatttggagatgctgttcctctcaagtgggaaaaat

SEQ ID NO: 57581 - DNA, 201 bp, Homo sapiens
cctgtaggtttagcagaatcccagcctcacatcctccccgaacttggcagtaaaagccctgttcttccattcattccgatgatttatattctctctgggcrtcttatattaaacaggggaattccgacatgttccataacacatttactgtaacttgataccatgaactacacttgctgttatttatcatttctttttatt

SEQ ID NO: 57582 - DNA, 201 bp, Homo sapiens
caaaaattagctgggtgtggtggcgtgcctgtaatcccagctattggggaggctgaggcaggagaatcactcgaacccgggaggtggaggttgcagtgagycgagatcacaccactgcactccagcttgggaaacagagtaagactccatctcaaaaaaaaaaaaaaaaaaaagttattgattaaaatttaaatataaatt

SEQ ID NO: 57583 - DNA, 201 bp, Homo sapiens
aggagggactcataggacagcctagcatctgaggaaatgagtgcctcctggcccagaatgggggatctcagcagcacactacaatatccactacagtttcytgggcttgctctgaagccatgcctctctaacttcagggtatattcatgtaagtgaggtgcagggatgggggaaagggagaaggtaaagctacaaaggtaa

SEQ ID NO: 57584 - DNA, 201 bp, Homo sapiens
aatggtgaataccctcggcgggaggcaggcacctgatgccactgcccccgccccacctgcccccgccccgtttctcagatcacacaggcaggctgaggagygcttaacaccccagcctcccatgaagcatcctgaaaaagcagactttgtcttcctccatcagctttgtttgtcctctgccgagactccagggacatgatt

SEQ ID NO: 57585 - DNA, 201 bp, Homo sapiens
tgggagatgagttaagaggttttattcttatacatgcggaagaattatgccttcttgagccatgctcaggagatgtcagccttttccattgtctccccgcycccaccgccagccctgcttaaattatcccctctttttaaacagaatatcctaatcttgcaagtggcatatcatgttccttcttttttaagagagaaggag

SEQ ID NO: 57586 - DNA, 201 bp, Homo sapiens
aaacagaaaccactttcagctttcccgttccagggttaagtgcccaagcaggtgttgtttctgttatgtggtttgcagtgagcaaaaccaccccctcttamctgtggcagcaaaggcagggagactttgagacctggggagggctctctgctgtgttaacagaactggctcttggttggggggtggggggcacccattctt

SEQ ID NO: 57587 - DNA, 201 bp, Homo sapiens
attatgccttcttgagccatgctcaggagatgtcagccttttccattgtctccccgcccccaccgccagccctgcttaaattatcccctctttttaaacaraatatcctaatcttgcaagtggcatatcatgttccttcttttttaagagagaaggagaaattcctgcagatcatcagggactgaggctaactgaaacttt

SEQ ID NO: 57588 - DNA, 201 bp, Homo sapiens
gttgtcacattcttctgcctagagtatgccttttccttcaccaaaccaagtggctctttcggaagacttgcctgaatcctagaccccttctctctacaacmttcagtctgagttgggtaccttgcatcctcctttgttcccatactaacccctacaaccatggtcattttgtggttatctgtttaattctctgctggctat

SEQ ID NO: 57589 - DNA, 201 bp, Homo sapiens
gatcttaccctgacagtcacagaaagcactgggagcgtttatgaatgttgtggtatctcacataataaggggaccatgcatgtattttagaaagagccctytggcttcagggaagaacgatggatttgtgagggtcaggactggtagcaggtgggctcctagaatagtcccggcaagagatcatggaggccagagccaggg

SEQ ID NO: 57590 - DNA, 201 bp, Homo sapiens
ccgggaggattttcttttctttttctttttaatcctcctcctcaagggaaacattcttctcacaatagcttcctggtagaaagttctaactaatgactttratcgtgtgaatgtattgcagaaatggacaggacaattctcagcccattcatcttacagacctcaagtgaacaggcacaaaacaacaggctccaccctcct

SEQ ID NO: 57591 - DNA, 201 bp, Homo sapiens
ttttcttttctttttctttttaatcctcctcctcaagggaaacattcttctcacaatagcttcctggtagaaagttctaactaatgactttaatcgtgtgmatgtattgcagaaatggacaggacaattctcagcccattcatcttacagacctcaagtgaacaggcacaaaacaacaggctccaccctccttcccccctc

SEQ ID NO: 57592 - DNA, 201 bp, Homo sapiens
tcctcctcctcaagggaaacattcttctcacaatagcttcctggtagaaagttctaactaatgactttaatcgtgtgaatgtattgcagaaatggacaggrcaattctcagcccattcatcttacagacctcaagtgaacaggcacaaaacaacaggctccaccctccttcccccctctatctcatactttacctcaattt

SEQ ID NO: 57593 - DNA, 201 bp, Homo sapiens
tgtgaaaactgtgaagacataacacatatctatgaaccttttctattaatcttcttggggctggagctttaaaataaaataaataacttttctgcagagasagaacctttccttacccaaagatttcgtaactttctcacatccttggttaaggctgagctgcctagctgtctgcatttctgataggttttgctttcatac

SEQ ID NO: 57594 - DNA, 201 bp, Homo sapiens
gaaggatatcctttcaatagaggtgaaaatcctgaaataaaaggtttcataaatggggaaaaaagtcattgattgaaagagtcatggcatagatgctgaasttttgatgggaactttgcaggatgttcgtttgtttatcattagccctgggagagtcatccctcgcctcccaccaccccttaatttaaagggatttaaaat

SEQ ID NO: 57595 - DNA, 201 bp, Homo sapiens
gcaagtaaagaattataattaagagaaccagaagggcctgtctctcaggaaagcagtgatttcctttcacaataaccctatccttactgttgaagacttgyggaaaagggacatggcccagggaaccagagtggtttgggaaagcactttgtcaagaggcttggggaccccagggtggaagctgccatgcgcatgaggctg

SEQ ID NO: 57596 - DNA, 201 bp, Homo sapiens
cacatttcaaatcttcagtagccagatgtggttattggctaccatattgggtagcaccgatatagaacatttctaccatagtagaatgctcttttggatasatctgctttaaagcattagtccccaaagtgtgaaggatgaaccacttgggttccgagaggaaacattataacttctgtttatccattaaactctttcatt

SEQ ID NO: 57597 - DNA, 201 bp, Homo sapiens
ccaaagtgctgggattataggcttgaaccaccatccctggccttgatactgatattttattgtcctaactgacagttttgtctgcccagcattttcccccrtcacccttgtactatcccattttcctttgccatgcacctgtcttcctcttcaggattgatcacaaaatcaaaaccattcctaccagccagaggtgggcac

SEQ ID NO: 57598 - DNA, 201 bp, Homo sapiens
caaaccaggtgtcattgccctccccaccctaccttgctcccctggagtgtatcctgattcttttgaggatcacttgatcctgattttttttttatgtgtawagatgggatttcattatattgcccagactggtcttaaactcctggcctcaagcaatccagccacctcggcctcccaaagtgctgggattataggcttgaa

SEQ ID NO: 57599 - DNA, 201 bp, Homo sapiens
cgaatatttgggacccactgggagtttgtgccaaaccaggtgtcattgccctccccaccctaccttgctcccctggagtgtatcctgattcttttgaggawcacttgatcctgattttttttttatgtgtatagatgggatttcattatattgcccagactggtcttaaactcctggcctcaagcaatccagccacctcgg

SEQ ID NO: 57600 - DNA, 201 bp, Homo sapiens
ctttagccaaggaagaaatgacaacgaatatttgggacccactgggagtttgtgccaaaccaggtgtcattgccctccccaccctaccttgctcccctggrgtgtatcctgattcttttgaggatcacttgatcctgattttttttttatgtgtatagatgggatttcattatattgcccagactggtcttaaactcctgg

SEQ ID NO: 57601 - DNA, 201 bp, Homo sapiens
cagttgtaacagtggtatgtgtatatctcaacatatctaaacatagaaatagtacagtaaaaatatgatattataatctttgggaccgccatcatatatgyagtctgtcattgactgaaagttgtcatgtagcccatgactgtcgtctcttttaggggaaaaaacaaaagcagaaagcaagcaagctggtatcctgcgtat

SEQ ID NO: 57602 - DNA, 201 bp, Homo sapiens
tgagtctcagctgaccaagctctaaaatgagcataaccatatcagtttgtgtttcctgttacagggagaaaagactgagataactaaagtacctgattgastaactgctctctgaaggtggaggctggactgcttcactggacagggtggcctggggttattctagtgcagtggtagctggtgacaaaactcaaagaagat

SEQ ID NO: 57603 - DNA, 201 bp, Homo sapiens
caagggaacctttccccaaagcccctcaacacacttaggctgacatctccttgaccagaactgtatcaaatttacatagcctcaaatgaagcatctgggamcaccaggattgggtgtttaggccatggaagagtaacagcccagtacacaactgtctccagtggccagcacgtagaccttccctcacactttccactctct

SEQ ID NO: 57604 - DNA, 201 bp, Homo sapiens
taaggcagatggaaatgtcttgtaactcagtaaaacagtttagaaatttaaagcctttggagagagtaagtattgagaaggcacatctctacgttgttgaygtgaaggagttgcaaggtcgggtagatgggatcagtgccaggtctaatgggcttcatttgcaagacctaatttctagcagatcatggtgtaagcctcaaa

SEQ ID NO: 57605 - DNA, 201 bp, Homo sapiens
gtctcccatttcagagacaggggcatttggctccaggtttttctgactctagacagtagtttgtttttagcacatcaaatgtctgagacttgtgatgtgtyagaaagcacaaaggactttgatcacaagatcaagccccagagggccatgactgcataaaccacaacaactgcgtggctgcctgtcacgtcttcatctgca

SEQ ID NO: 57606 - DNA, 201 bp, Homo sapiens
tgcttcttacgtgtcacgcactgtgataagtcctaggattatagaagtcaataagctatgatgcctatccttaaggagagaaacacatataggataggaamatagcttgccatgtctgatagatattaggcattcagtctctctctctctctctctctctctgtttattatagatagaaataaaaaaattataaatagaaa

SEQ ID NO: 57607 - DNA, 201 bp, Homo sapiens
ccatcatttattaagagaatggatattttcatgtcagaaattataggaaggatacagttatgggatgaggagcaattcttttttttttttttttgaggtgsagtctcactctgtcaccaggctagagtgcagtggggcgatctcggctcactgcaaacctctgcctcccgggttcaagcaattctcctgcctcagactccc

SEQ ID NO: 57608 - DNA, 201 bp, Homo sapiens
tattaagagaatggatattttcatgtcagaaattataggaaggatacagttatgggatgaggagcaattcttttttttttttttttgaggtggagtctcaytctgtcaccaggctagagtgcagtggggcgatctcggctcactgcaaacctctgcctcccgggttcaagcaattctcctgcctcagactcccgagtagct

SEQ ID NO: 57609 - DNA, 201 bp, Homo sapiens
cgatctcggctcactgcaaacctctgcctcccgggttcaagcaattctcctgcctcagactcccgagtagctaggactacaggcgcgtgccaccacacccrgctaattttttgtattcttagtagagacgaggtttcacggtgttagccaggatggtctcgatctcctgacctcatgatccacccgcctcggcctcccaaa

SEQ ID NO: 57610 - DNA, 201 bp, Homo sapiens
aggaggtcaggaagtcattgatgtgggctccctcctggagtgcgtgttgctttggtagggagctcgctttggctgtgggcagttcctgaggagggactcayaggacagcctagcatctgaggaaatgagtgcctcctggcccagaatgggggatctcagcagcacactacaatatccactacagtttcttgggcttgctct

SEQ ID NO: 57611 - DNA, 201 bp, Homo sapiens
ccaccagccttggcctcccaaagtgctgggattacaggcattagccaccacacccggcccaaattttcttataaagtcaaatgggagatacttgtttgcargaaatagttcttttggttcttacttttccataaggattgagtctcaaaatgtctggtagcatccactgcattttgtaggggacaataacaaagaagatgc

SEQ ID NO: 57612 - DNA, 201 bp, Homo sapiens
ctgcgtactgtaggcagttgtaacagtggtatgtgtatatctcaacatatctaaacatagaaatagtacagtaaaaatatgatattataatctttgggacmgccatcatatatgtagtctgtcattgactgaaagttgtcatgtagcccatgactgtcgtctcttttaggggaaaaaacaaaagcagaaagcaagcaagct

SEQ ID NO: 57613 - DNA, 201 bp, Homo sapiens
ctgtgctgtgggagatgcgaatgctccagtcaatcccaaggaaactctgaagctggattattcttcagagatgcaaggaggtcaggaagtcattgatgtgsgctccctcctggagtgcgtgttgctttggtagggagctcgctttggctgtgggcagttcctgaggagggactcataggacagcctagcatctgaggaaat

SEQ ID NO: 57614 - DNA, 201 bp, Homo sapiens
tgcagtttgctgatccctgttttattaattagttaatattattgattgagatagggtctcactgtgtcacccaggctggagtgcagtggtgcggtcacagstcactacagcttcaacctcctgggatcaagcagtcttcttgccttagccacccgagtagctggatgacaggtgagcaccaccatgcctggctaattttct

SEQ ID NO: 57615 - DNA, 201 bp, Homo sapiens
atgctaaccaggatggtctcgatctcctgacctcgtgatccaccagccttggcctcccaaagtgctgggattacaggcattagccaccacacccggcccarattttcttataaagtcaaatgggagatacttgtttgcaagaaatagttcttttggttcttacttttccataaggattgagtctcaaaatgtctggtagca

SEQ ID NO: 57616 - DNA, 201 bp, Homo sapiens
ttggagccaaagccaaatagtgctctgtaaacattatgatttgtcagtaatcaatgtgatttgtataatttgtgagcaatcagatactttatccaaaagcrgattattgacctctgtgcccatcttgggagaaattgccacttggtctgtgtctacacagacccaagaggagaagggatttgacaatggtctgattaattg

SEQ ID NO: 57617 - DNA, 201 bp, Homo sapiens
gtgcggtcacagctcactacagcttcaacctcctgggatcaagcagtcttcttgccttagccacccgagtagctggatgacaggtgagcaccaccatgccyggctaattttctaaattttttgtagagacaaggtctcactgtgttgtccaggctggtctcaaactcctgagctcaagtgatcctcccgcctcgacctctc

SEQ ID NO: 57618 - DNA, 201 bp, Homo sapiens
gggctggatttgtcctgtggactgtagtttgctgacatccaggctagatccttaatatacaatgaagtagtaaaacacatgtaaaagtaaaaagcaggcgwaatagaataaaatacacatttgcacaccacagtatccaaaaaggttatgtactggggctaaagatttggcttggagtttcctggtagtcaaggcaaaaaa

SEQ ID NO: 57619 - DNA, 201 bp, Homo sapiens
actttttatttcctttgtggagtccagcccctttgcttattctcagcacaaaagaggcagtagagtgagaagaacgtgaacttcagagcccacgcatcccktttcacatttgaatcgcaactctgtcattcaccagctgtgcatccttgggaaagtcacttagcctctctgagctctaatttcctcacagggccgcaggac

SEQ ID NO: 57620 - DNA, 201 bp, Homo sapiens
tgcggtcacagctcactacagcttcaacctcctgggatcaagcagtcttcttgccttagccacccgagtagctggatgacaggtgagcaccaccatgcctrgctaattttctaaattttttgtagagacaaggtctcactgtgttgtccaggctggtctcaaactcctgagctcaagtgatcctcccgcctcgacctctca

SEQ ID NO: 57621 - DNA, 201 bp, Homo sapiens
gcctctcactttttatttcctttgtggagtccagcccctttgcttattctcagcacaaaagaggcagtagagtgagaagaacgtgaacttcagagcccacscatcccttttcacatttgaatcgcaactctgtcattcaccagctgtgcatccttgggaaagtcacttagcctctctgagctctaatttcctcacagggcc

SEQ ID NO: 57622 - DNA, 201 bp, Homo sapiens
gattcctgttttacatattaaaaatttcatctctccaatcttcgaagaatccgtagtccatttttaagtagctcttgtcttccaaaggtatgggatgtgcmtacctaatgctcttcctggatgggagaatattaccaaaaacgtttggtcgactaattttatgacagtttccaactacaatttttttcctctttgctttct

SEQ ID NO: 57623 - DNA, 201 bp, Homo sapiens
atggccgctggaaaagaagccaactcccagggggcacgaggggctaagctgtctcctgggaagtttgagggaggccaagtgttttccagttcatttccaaygcgtatttcttcagggccaagggcccagctgtgcctcattaggggtgagagtttggctgtgacacgacttaatagaaaaaaaaaaaaaaaaaggagaagt

SEQ ID NO: 57624 - DNA, 201 bp, Homo sapiens
tgcttctagctggtcgaaggtcctgtgggagctcacgtttttctcaatcactgatgaccatttgagacataatttggagaaggtttctatcaaatcctagytggactgcagtgaaatgttttcaaactagagaagcaccaaataggccatgataaagaataaataccacctaccccaacctggcaaatgtgtgctcaccca

SEQ ID NO: 57625 - DNA, 201 bp, Homo sapiens
tcttctccctctccgttaaaatgcaacttaattggtaaagtttagttgactagagatttcatttatttatttatttatttatttatttatttatttgtttrtttgtttgtttgagatgagtcttgctcttttgcccaagctggagtgcagtggcatgatctcggctcactgcagcctctgcctcccgtgtccaagtgattc

SEQ ID NO: 57626 - DNA, 201 bp, Homo sapiens
ggctggagtacagtggcacgatctcagctcactacatctctgcctcccgggttcacgccattctcctgcctcagcctcctgagtaggtgggactacaggcmcccgccaccatgcccggctaatttttttatttttagtagaaacggggtttcaccatgttagccaggatggtctcgatctcctgacctcatgatctgtcag

SEQ ID NO: 57627 - DNA, 201 bp, Homo sapiens
tctcccgtctctgcagttcaggagattatattagaaaatattctatacaaaaaatatgcatagtagggcttttctccagctagtagctcagaataagtcaktactactgaaacaggtaccttttgtggaattgattctgaaatctgtttggatctgaaatctttctttcttgcctttgagtaagatacggcagagaaaaac

SEQ ID NO: 57628 - DNA, 201 bp, Homo sapiens
tggactattttgccaaatgcatttttattggtagaacgtaagcaaatttaaaaaagcaacaaaagcagtttttatgaatacctagcgtactttttttttttaatgaaccatgagctgtttttgcattcaaattctcgtaggcattatattgcatctacacataaggacacagtgtttacagaccccaaagcttgctgtccc

SEQ ID NO: 57629 - DNA, 201 bp, Homo sapiens
cccgtctctgcagttcaggagattatattagaaaatattctatacaaaaaatatgcatagtagggcttttctccagctagtagctcagaataagtcagtaytactgaaacaggtaccttttgtggaattgattctgaaatctgtttggatctgaaatctttctttcttgcctttgagtaagatacggcagagaaaaacaat

SEQ ID NO: 57630 - DNA, 201 bp, Homo sapiens
ttttgttcctgcattgccctccattcagatcttgtcacttaggccttggtagcatgagctattaacagccctccatatttactatttttttttttttttttaactctgggagttcctgttgcagaaattggatcacttacctaaaaagctccccacccccacctttggtgactggtgggtttcatcaccaggaaagcacat

SEQ ID NO: 57631 - DNA, 201 bp, Homo sapiens
gactgcaactgaaaagaggagtaatggaaggacatgtactcttcccatatatttttaaacaattactgtatctgatttttcatttttcattttttttttttctggaagaaagagcagatctggataaagtcagtatacaatgtggtctttggtgacagacccaagttcaagaccaaggtgtatgcatgggtttgttcaagt

SEQ ID NO: 57632 - DNA, 201 bp, Homo sapiens
gctcagaataagtcagtactactgaaacaggtaccttttgtggaattgattctgaaatctgtttggatctgaaatctttctttcttgcctttgagtaagayacggcagagaaaaacaattacactagctgctggtctgtatttactggttagaatagaatattattaccatcaagaataacattagtggccaggtgcggtg

SEQ ID NO: 57633 - DNA, 201 bp, Homo sapiens
acttagcagttcacattcacatcttgtttattaactacaattctctagatcagaagcctagacacaatgtgactggcttctctgctcagggtctcttgggkacaaaataaaggtgtccgctggaggaacatcctttcctgcatgctctgtggaagaatccactgccaagctcattcaggatgctggcaggattcagatcct

SEQ ID NO: 57634 - DNA, 201 bp, Homo sapiens
tggcaacctttggtgtttggggcatgttgtcacctcattgccatctctgcctctgtcttctcaccaccatcttccttgtccatgtctctctatgtcttcartgttcttcttataaggacaccagtccttggatttagagtccaccctaattcactgtaatcacatcttacctaagtccatctgcaaagaccctatttccaa

SEQ ID NO: 57635 - DNA, 201 bp, Homo sapiens
cacttgtgacagagggaggaacatagggtgcataagagagatgtggggaagcactccccatccaactcgttccaaccagttcatcttttttttttttttttcttttttcgagaaagagttttgctcttttccccaggctggagtgcagtggtgcgatcttggctcactgcaacctctcccttccaagttcaagcaattgtc

SEQ ID NO: 57636 - DNA, 201 bp, Homo sapiens
actgccaagctcattcaggatgctggcaggattcagatccttgaagttgtaagactagggcccctgtttcctactgacttctgctggtggctgccctcagytcccagaggcaacccacattccttgacttttggccccctgcatctcaaagccagcaacagaaactctcttgtgcatggagtcccctcctgctttgaatct

SEQ ID NO: 57637 - DNA, 201 bp, Homo sapiens
cactagggggatggtgattagaaagcacctcatgatcccgtctacttcctgcagagaacagactagccccctatgcagcacacacctttgtgaggtccctyctccaacacagggattacaattcaacctgagacgtgggtggggacacagagccaaaccacactggaaggtaaaaaagttggcaaccagaggcttagagga

SEQ ID NO: 57638 - DNA, 201 bp, Homo sapiens
cttcaagtcagttacttaatggaataatacatgtttcctgcttccattgtcttcctggacctgacactcactctttaaccataagcagaagacacatacamaaatgtcctatgttaagaatctttatttaagacaggtggctagcattatttgggtccagaagcttccctggaaagaaaggattcactgcaagatcgacag

SEQ ID NO: 57639 - DNA, 201 bp, Homo sapiens
aaaatggaaaactccaggggaagagggtctttacttagggagttggcatttgttggaatttcccaagaacatttcatgattagtgacaggttatcttctastttacctgaaggctatggtcactcaacaaattttgtgttgcttcttacgtgtcacgcactgtgataagtcctaggattatagaagtcaataagctatgat

SEQ ID NO: 57640 - DNA, 201 bp, Homo sapiens
aaataaagacttgtgaaggtaaaactgtagcttacagtgtgcgactgtttaccttcttttggtttcttctcatttaataggttggtcatctctctgctggstttttcccccttttttctcccttctgtagaataacatgtggaccattaactatgatgctacttcttagctgcaaggggggaaaaatggaaaactccaggg

SEQ ID NO: 57641 - DNA, 201 bp, Homo sapiens
agaggaggaggaggaacttctcaggaagaagtggcagttccctcctttgtttcttatctctactgtttagcagccactctccaaagcctcttgctgggaaygtggccatcatagaagtaaatgagacatctctttcatctgcaccaacctccttattaagaccttatcagttacctgtagattctcccactgttgtacttg

SEQ ID NO: 57642 - DNA, 201 bp, Homo sapiens
gaaacaattcagcaactctcttacagatttttatcatcatcccattcataattgattccaaacgtgcatgaatctttcaagataagtgtcttattgattaycctgaaaacaagcgatcacttggtgtcctgagattcgctcactgccctcccctgattaccgtaaacagagatgttgatgagaagaaatgtcactttcttt

SEQ ID NO: 57643 - DNA, 201 bp, Homo sapiens
ccttttttagagataaagcctcaccctgttgcccaggctggagtgcagtggcgtgatcacagcccactgtagccttgacctcccaggctcaacctatcctyttacctcagcctcttgagtggctggaaccacaagcagatgccaccatgcctggctaactttttttttttttttttttttttgtagaaacagagtctctct

SEQ ID NO: 57644 - DNA, 201 bp, Homo sapiens
tatagcatctgaatttgaaaacctctactaattcatgaggcaatctatttgataatggcatgatttagttagtgttccttttttagagataaagcctcacyctgttgcccaggctggagtgcagtggcgtgatcacagcccactgtagccttgacctcccaggctcaacctatcctcttacctcagcctcttgagtggctg

SEQ ID NO: 57645 - DNA, 201 bp, Homo sapiens
aaccttacctactcaagtgtaagatgagatgccactgtggtatcttcaaaggaatttagaatcatgtcttaatggctccattaagaagaattctttttctsttttctctgaaaagcatcccaggtcataaaatgtaatgtgggattgtaggttttgtgggaagatgcacttggcagcaattccttgagaggaggccttgaa

SEQ ID NO: 57646 - DNA, 201 bp, Homo sapiens
tcaaatgcgcgtttaatcttcttaagctcaacttcatgcaagagacctaggaattcacagagtgaagatgatttctccattcccttctccgagcagagctsttgaagaagatgggagttaggagaagtgaatcttttgttttcgaagcctttgtccttgtgagtctcttaattggggtgtcttgtaatgcaaagtctttaa

SEQ ID NO: 57647 - DNA, 201 bp, Homo sapiens
ataagtctaatttagtagccagctaaaggatatctgtgaacccttcgcaaagagtaatctattgaaaaggaacaacaaaaaagtatatctgtgaacttatkaaatgactttaatcatatgaaaatcagccatcagccttattagagtggttgattttttttttaatctaagagctttcttggttattttctgttcttaatc

SEQ ID NO: 57648 - DNA, 201 bp, Homo sapiens
tgcttacttgacttggaccagggtggtgaatgaacataaaaaccgattacaacatttttccatttttatgtttcctctgaaaccagccatgagaggtactsttagcaaatcacgccttattcctaggcagacttcttgggtacactttccaccctccccagcagtaatgcctgaccaactaatggaatcctaactaatgca

SEQ ID NO: 57649 - DNA, 201 bp, Homo sapiens
gaacaaattgccaaatgcaaggcctgagcaaaagacacagaaaggatttctttatcgtaagcacacttctctacattacctttataatccaacaactctgstattagtaaattatagaaacaacttttgtaacactatcttgtttgcagagtatatgaaaaatttgaagttaaaattcagctccacgaatactgcagtggt

SEQ ID NO: 57650 - DNA, 201 bp, Homo sapiens
tactgttagcaaatcacgccttattcctaggcagacttcttgggtacactttccaccctccccagcagtaatgcctgaccaactaatggaatcctaactawtgcagtatgtgacgcctggcagctccagtccgaaccaagggaaaacctgcaaacatgcaatccttcatgcttttgtttttgtttttccttcagcctagct

SEQ ID NO: 57651 - DNA, 201 bp, Homo sapiens
ctattgtgcacttttgcccagttcaacaagaaagaatctttgctatgttagaagagactctggggaatccagagtcttggtcacgggtacatcaaaacgaygctggtgcctaacttctagttccagacaaagaaggagagagagagagatcagtaatttataggctgacattttccttgggtccttataatacttgtttat

SEQ ID NO: 57652 - DNA, 201 bp, Homo sapiens
tagaagagactctggggaatccagagtcttggtcacgggtacatcaaaacgacgctggtgcctaacttctagttccagacaaagaaggagagagagagagrtcagtaatttataggctgacattttccttgggtccttataatacttgtttattacagataatttgcttaagtgtgcacaaggtggaaggtcacgcaagga

SEQ ID NO: 57653 - DNA, 201 bp, Homo sapiens
atttccacccccattatttgcataacaaattacagattatccagaacaggtgggctgtacataaacaggctggtgggctggatttgtcctgtggactgtastttgctgacatccaggctagatccttaatatacaatgaagtagtaaaacacatgtaaaagtaaaaagcaggcgaaatagaataaaatacacatttgcaca

SEQ ID NO: 57654 - DNA, 201 bp, Homo sapiens
ctcttccccacttgcccacgagcagcaactcctgtttcttgtttttttccttttctttttcttttcttttgagacagagtctcgctccgtcgcctgggctrgagtgcagtggtgcaatctcagctcactgcaacctctgcctcctgggttcaagcgattctcatgcctcagactcctgagtagctggtattataggcgcac

SEQ ID NO: 57655 - DNA, 201 bp, Homo sapiens
atccagtgttataggagacaaaccatagcaagcaatggcctctcacccttcccttcacaccctccactctgtccacttgtttgttccttcaataaatactratggagaatgggctctatgccagtgtttctctggatgttggctgcagggatgaacaaaggcaacttctaggagaaatttctgtttttgatgctctcgtgg

SEQ ID NO: 57656 - DNA, 201 bp, Homo sapiens
ttttgctctcctccttttgtcagttggcatgcgatatgcttctcaggcagtaatttagagactgtcaattcctgagagccgctggggaactgagcaatcgyctgcatttcgtcgctttagcccgagctgggtctttgagctggcagagaccaagatctttttctgggaagggatggtcctatttaaggaaggccctggatt

SEQ ID NO: 57657 - DNA, 201 bp, Homo sapiens
gtatggggtggggaaggggggggggataaagatattaatttggaagcatttgattgctccattattttatcatcttcccatggaaatgttttcataacgcsttgttttttaattattattattattttttgagacagagtctcactgagtcgcccagggcggcggtgtgatctcggctcactgcaacctcagtctcccagg

SEQ ID NO: 57658 - DNA, 201 bp, Homo sapiens
ttacagcaaatttgtagttatggtggagcaaagggcagttttcactcctcttccctaaaactgtagtttaactaaaaagtggccactgtctcctggtagcrgttggtaagccatccagtctctgcaggcatctacgctccaggtctccagtctgaggagtctggctcctggggcaggtgcctctgggggtctctgccaggc

SEQ ID NO: 57659 - DNA, 201 bp, Homo sapiens
gagctgagtgattttagtaggtagtttaactccttaaaaacttccagtggtttcatattctacctagttttaggtgacagctggtatggggtggggaaggrgggggggataaagatattaatttggaagcatttgattgctccattattttatcatcttcccatggaaatgttttcataacgccttgttttttaattatta

SEQ ID NO: 57660 - DNA, 201 bp, Homo sapiens
tcccgctttgtgctggagcaagttttggctgagtttctgtcacttgcaaccaaatcagtcctatccagtatacctagtgactctctggtctccaaaggctrtgcctgctgggtactgagtgtctccccgaccgaccccatgatggctacagtgcacatcccttccagccaactctattgtgcacacatattcgtagggtga

SEQ ID NO: 57661 - DNA, 201 bp, Homo sapiens
ggagctgagtgattttagtaggtagtttaactccttaaaaacttccagtggtttcatattctacctagttttaggtgacagctggtatggggtggggaagsggggggggataaagatattaatttggaagcatttgattgctccattattttatcatcttcccatggaaatgttttcataacgccttgttttttaattatt

SEQ ID NO: 57662 - DNA, 201 bp, Homo sapiens
tttgacaatagatgttagctaggagagataagaaatggagcaagggaggggtttcatcccgccgtgttcatttgcttggctgtcctgaaattgcgaatacrcagttgttacctgctcccggtgggaggggggggatatttatttggcatcttgcaattgataggagctgagtgattttagtaggtagtttaactccttaaa

SEQ ID NO: 57663 - DNA, 201 bp, Homo sapiens
tggaagagttgacagagatttgcaggtgaaaaagaaaagaaaaaaaatacagatacgtgtatatatagagaaagacaaaaacttgtctgctagaaacctasggagagagatggtattgcccctgggacattggactttctgtttccagcatggtctgtcgtcttccataatggcatttaattttggaaaaattgcctgagc

SEQ ID NO: 57664 - DNA, 201 bp, Homo sapiens
cagtcacagaaatgaggtagctgtagccaaggatgatggcatagcacattcgtttcttaggcgtgccacgtactaggtggcttcagtcagcagaactgtaytttcccacagttttggaggctcaaatttgcaagtcgaggtttcggcaaggccatcctctctctgaaaactctatgggggcgtcctctttgcctcttcccg

SEQ ID NO: 57665 - DNA, 201 bp, Homo sapiens
ttttggattctgtgtggaagagttgacagagatttgcaggtgaaaaagaaaagaaaaaaaatacagatacgtgtatatatagagaaagacaaaaacttgtstgctagaaacctagggagagagatggtattgcccctgggacattggactttctgtttccagcatggtctgtcgtcttccataatggcatttaattttgga

SEQ ID NO: 57666 - DNA, 201 bp, Homo sapiens
aggctaggtagagcatattgctccctggcagcaaacatgtacagcatgtttctgtcctgaatactgtaggcaattttaatacaatgctaagtatttgcatwtacaaacatagaaaaggtacagttaaaatatggtattacaatcttctgggatcaccattgcatatgtggttcattgttgatcaaaatgtcattatgcagt

SEQ ID NO: 57667 - DNA, 201 bp, Homo sapiens
atgggagttaggagaagtgaatcttttgttttcgaagcctttgtccttgtgagtctcttaattggggtgtcttgtaatgcaaagtctttaaagatgtgtgytcctgaaactcaggaggctgctctatcccatggttcaaccaaagaaccagggccaaagcagtgctgaaggaacaactgattctcttggccctccttagag

SEQ ID NO: 57668 - DNA, 201 bp, Homo sapiens
ccttgctgaaatggttggtgctaagatgagcacttggcttaggccagaccagtccctagcctgtggagaaggggcaatctcttatctgaaggcctaggagstgcagggatgtttatatgggctgctagcgcttagtttcctgccacagggagacagtaagaaaggtgacgtcaatctgagatgagagagagagcaaaacag

SEQ ID NO: 57669 - DNA, 201 bp, Homo sapiens
cacctttcctttgggagcaatttttgggttgcttttgtttttatttgttgttttcattcctggtagtaatagtaacagtagaaaatggcagcgttatagcyataaacaaagtgctctgtggtttctctctcaccatcccctaaaccctacaaggctaggggaaaatggtaatactcatgaacaactccacttcataaatga

SEQ ID NO: 57670 - DNA, 201 bp, Homo sapiens
agtggccctaggatggctcctcagatagctgctggcagaaacctgcactcagtacatctatacatggtgtaatgattgactcaagataattagcatagccrtcatctcaaacctttattatttgtgatgagaagattcaaaacccgctttttgaactgttctgaaatatgcaataccttgttgttaactgtattcaccttt

SEQ ID NO: 57671 - DNA, 201 bp, Homo sapiens
aaaatgaggaagaagcgaacgtgagaacccctggtaaacccatcagatcttgtgacacttattcactatcacgaggatagcgcaggaaagaccggcccacrtgattgagttacctcgccctgggtccctcccacaacatgtgggaattctgggagatataattcaagttgagatttgggtggagacacacccaaagcatat

SEQ ID NO: 57672 - DNA, 201 bp, Homo sapiens
acacaggctgctgtggcaacccacagcaggaatagccagtcctgccccagcagggcgtatcaggggtgctaaggtgacttccaagattgaggttggcgagwtcgtgacaggtgtgcaagatggggtgttccaagactggggacaggacaggtgtgcaaggaccagccagctgaggtagaggaaacctagacctatggaaca

SEQ ID NO: 57673 - DNA, 201 bp, Homo sapiens
ggacaattcattggcttatcgtatagtcacaaacttgtgcagacatcaccactatctaatttcagaacatttttatcacccctaaaagaaaccctgtacccttcagccagcattccctattttatacccccgatctcttgacaactactcattgactttgtttctatgactttacctatttcgggtaattgatataaatgg

SEQ ID NO: 57674 - DNA, 201 bp, Homo sapiens
tagccccctgtacagcacacaactcggggaattttaggtctggtgatttactgctgttggagcctggccttcttcctgggagaaggctggaaaaacttcawgtcagttacttaatggaataatacatgtttcctgcttccattgtcttcctggacctgacactcactctttaaccataagcagaagacacatacaaaaatg

SEQ ID NO: 57675 - DNA, 201 bp, Homo sapiens
cagagaacagactagccccctgtacagcacacaactcggggaattttaggtctggtgatttactgctgttggagcctggccttcttcctgggagaaggctsgaaaaacttcaagtcagttacttaatggaataatacatgtttcctgcttccattgtcttcctggacctgacactcactctttaaccataagcagaagaca

SEQ ID NO: 57676 - DNA, 201 bp, Homo sapiens
accatcccggtaaagtgacgttttgatgaaaacagcatggatcttcctgcagagaacagactagccccctgtacagcacacaactcggggaattttaggtytggtgatttactgctgttggagcctggccttcttcctgggagaaggctggaaaaacttcaagtcagttacttaatggaataatacatgtttcctgcttcc

SEQ ID NO: 57677 - DNA, 201 bp, Homo sapiens
ttgtgagaaatgaggagataatatctttaaatctcctacggtgatacctggaacatgatggtgcttgggaaatgtctcttcttctgaaatgaggctgcctsgaagactcactggaacccaagcaaagtgtctctgcatttcactccgagccatcgacttctgttctgaatgttaaaatgcaggtggctgtgagggagtctt

SEQ ID NO: 57678 - DNA, 201 bp, Homo sapiens
gaaggatcatgggaggggaggagcgtgagttcctcttaagtgaatataaaccagggggtaggaaacaacatgagatgaggctggcgagagagaaggatgcyaggtgaggtgctgtggtgcgccagagactgcggaagtggctttctaattaagaaacagaagccaggaaactcctgtacttcaaggttttggagtgggaaa

SEQ ID NO: 57679 - DNA, 201 bp, Homo sapiens
gtagctttgttgattgttgatattacttatgaactttcttgcttttcagaaaccaccaccacaaaagaggcagtaacattagtattacattatacatcttmggcatttttttcctttgcccttttcgtaggtttttgtttgtttgttttttcttgtcagccacttcatcatgtttggtctctcgtctttggctgtgttttt

SEQ ID NO: 57680 - DNA, 201 bp, Homo sapiens
aattatatattatacacacaaacatacacacacgcacacaccaaatttaaaaagacagatacataggcagttgttatgcagtgtttgaaataaatttattkccagctatgggtcatttggaaaaagatcaatatgatgcatcaacataacaagtaaatggaaatgaatacaaccgcatggttttctgaaagcacggtttcc

SEQ ID NO: 57681 - DNA, 201 bp, Homo sapiens
ggtgagaaggagctggcagtgtgaatagccaggggaaaagtgttttgggtagaaggaacagaaagtgaaacggtgccctggcaaggcaaagattattcatkgctgaagagactatgttgcccagatgacttgttcatgtaatctgtgatttttaaatttagaattgaggtttgaagggaagtattgctcctttctttatct

SEQ ID NO: 57682 - DNA, 201 bp, Homo sapiens
gaaggcgggcggggcaagctttggaaagcacgggcaggtaaggacagggtttcaaaggtgagaaggagctggcagtgtgaatagccaggggaaaagtgttktgggtagaaggaacagaaagtgaaacggtgccctggcaaggcaaagattattcattgctgaagagactatgttgcccagatgacttgttcatgtaatctg

SEQ ID NO: 57683 - DNA, 201 bp, Homo sapiens
actgattaatcacagttatagagtagacataacatttttattaaactctcagtgagcaggaaaattagcacttcctgcaataacgatactaatttcattastgaacgttttcatttataaagtgcttcttccttatcttgaaccttttatcctcttcttattgaccaaagagagggcatatctttgggagctgctaataaa

SEQ ID NO: 57684 - DNA, 201 bp, Homo sapiens
gttggagaaaagggggaaaaagttaaatgttaatgattcttttcgtaactgcaattttatcggctcctttttgtacatatatgattatgaagcaatttgtrtgaaatttacaccttttcaaattttgaaaattgccttgttgaaaaagaatcgctgtacttctcaatactacactgattaatcacagttatagagtagaca

SEQ ID NO: 57685 - DNA, 201 bp, Homo sapiens
agttggagaaaagggggaaaaagttaaatgttaatgattcttttcgtaactgcaattttatcggctcctttttgtacatatatgattatgaagcaatttgygtgaaatttacaccttttcaaattttgaaaattgccttgttgaaaaagaatcgctgtacttctcaatactacactgattaatcacagttatagagtagac

SEQ ID NO: 57686 - DNA, 201 bp, Homo sapiens
atgtgtctgaccccaggagaactgccccgatccctatcttgtctctgctcagttctggtaactcttttatcttccctggagttatttttttcccttctttstttctctttttctgtgtgctcttctaagagtaaaacgcatgtccccccatgaagtcactcaaagctcaggcgtgtgcaacagggacagcaaaagcacaca

SEQ ID NO: 57687 - DNA, 201 bp, Homo sapiens
gattacagacaagagccactgcgcagacggacatatgaatttttaatttgatatcattgtgatcaatttgaagatccacatatggctgagggctactctawtgagtggtgcagctccaaggcagagagatggctgtgattaaccaatgaatgagggaacaaatatccaggcagaatgaatagtctatggaaagggctggaa

SEQ ID NO: 57688 - DNA, 201 bp, Homo sapiens
gcggcgtgatctctgctgactgcattctccatttcccaggttcaagcgattctcctgcctcagcctcccaagtagctgggactacaggcccctccacaccscacaccgccaccacgcccagctgatttttagtggagacagggtttcaccatgttggccaggctggtcttgaactcctgacctcaagtgatcggcctgcct

SEQ ID NO: 57689 - DNA, 201 bp, Homo sapiens
cagcggcgtgatctctgctgactgcattctccatttcccaggttcaagcgattctcctgcctcagcctcccaagtagctgggactacaggcccctccacascgcacaccgccaccacgcccagctgatttttagtggagacagggtttcaccatgttggccaggctggtcttgaactcctgacctcaagtgatcggcctgc

SEQ ID NO: 57690 - DNA, 201 bp, Homo sapiens
ttttaaggcagcaggactaagaaggtaaagacatgtactaggcgggtcagcatagtggtggccctcgtctgacacacatatttcaggaggggtcacccctsccgtcttccatgttggggtgctcttctctggcaacccactatgggtactccactgctggccttcatgcaggtggaaccacaccgggaagacccaagccga

SEQ ID NO: 57691 - DNA, 201 bp, Homo sapiens
ggcacagaacgagcactgtgtgtgtgttacagaaatatatgtgggtgggtgtgtttctgttttccgtaattccagctaggcaaagacatatttaacaaaarccttctgggctgatgagcatcctcagaaagtaggctgagggagctcttttaaggcagcaggactaagaaggtaaagacatgtactaggcgggtcagcata

SEQ ID NO: 57692 - DNA, 201 bp, Homo sapiens
agcatctggggctgtacacgtctttgtactgcacactgtagggtatccaggattcctggccctgccccatgatataccagcgccatgttgtcatcaaaacraccggaaatgccttttgtgtctccctacttccctttttaacatgtcagcccttggtctcgatattcacatctatatttttccttatcccgttaatatatg

SEQ ID NO: 57693 - DNA, 201 bp, Homo sapiens
tcatgccctgtgtcacctgactcaggcaccattagcatctggggctgtacacgtctttgtactgcacactgtagggtatccaggattcctggccctgcccsatgatataccagcgccatgttgtcatcaaaacgaccggaaatgccttttgtgtctccctacttccctttttaacatgtcagcccttggtctcgatattca

SEQ ID NO: 57694 - DNA, 201 bp, Homo sapiens
ttaacactatgcagaacgatttcctcgtattgttgaaaactcttggtaggggttttttttttaattggctggaagcacttcatcatatagttgtaccaaartttgcttaacatcccccttattactcagcctttgggtggtatccagttctttgctttgataaataatgctgagatgaacatctttctgcatggctctttt

SEQ ID NO: 57695 - DNA, 201 bp, Homo sapiens
atgctctacctcttccctttgctaagtggcaattttggaccttctgtgaccgtgcaaacatgcagattatacatgcactataggagtggaatgtatgtgayttaatagcgtaatattttgtccattattttaaaacttgctttatttggtcaagacatacggaacacgtatagatcaaacaaaaatttttaaaaatgcttg

SEQ ID NO: 57696 - DNA, 201 bp, Homo sapiens
tccccaggctaagcacagtcacagaaatgaggtagctgtagccaaggatgatggcatagcacattcgtttcttaggcgtgccacgtactaggtggcttcastcagcagaactgtattttcccacagttttggaggctcaaatttgcaagtcgaggtttcggcaaggccatcctctctctgaaaactctatgggggcgtcct

SEQ ID NO: 57697 - DNA, 201 bp, Homo sapiens
aattcttaaagttctggagcctgggaagtccaagagcaaagcaacggcagattcagcttctgttgagggctcgttccctggctcatagatgatgacttctygctgtgtcaacttagtgggaggggataaagcagctctctggggcttcttttagaaaggcacaaatccactcttgtgatctaatcacctttcaaaggccct

SEQ ID NO: 57698 - DNA, 201 bp, Homo sapiens
aacagcacacgtcaaggaagcagttttggtctctcagattatatgaagctctccaatatgttctttcagaacagccagtgcctagaatactgcctgactcstagtagcactccttatgtgttgaatgagtaaatgaagagtccctggaatttcttcttcataacattgaacacaactgcagtttgaaaacataatttctgt

SEQ ID NO: 57699 - DNA, 201 bp, Homo sapiens
aatggcatctatgatcttagatttagtaaaacgcagtatcttcttccccagctgaaatagcgaaagggtctcttcaggctcctgggataaaaaccaggatscttcatgtgtctgagcaggcttcccaccatttgactgctgctcctttgtccagacacatttaacaccatctccctgcaccccttcactgggctccgaagc

SEQ ID NO: 57700 - DNA, 201 bp, Homo sapiens
cagaaatgtaattcttaaagttctggagcctgggaagtccaagagcaaagcaacggcagattcagcttctgttgagggctcgttccctggctcatagatgrtgacttcttgctgtgtcaacttagtgggaggggataaagcagctctctggggcttcttttagaaaggcacaaatccactcttgtgatctaatcacctttc

SEQ ID NO: 57701 - DNA, 201 bp, Homo sapiens
ccctggaagatggatcttgccttgtggatgtttttctaccgtgacagaagatagaaaggatgaaatagaaagagtgtgagtgaattctgcacccacccccrccccccagcttccccacctgtaaaatgatttgctcaaagtttgcaaagaatggaggcatattcaaagtgctcagcactgggccggacccatgggtatgaa
